United States Patent 7,868,149 (PLANT GENOME SEQUENCE AND USES THEREOF) - sequence listing, part 115

SEQ ID NO: 63123 - DNA, 13194 bp, Oryza sativa
ggtgactccactccagagcgctgcttgatccatcttctgctttcattgttactatttctttgcttccaaaccacatatgcattcagggtgactgaccgaatccaatgccattgatttcttttgtcctctgtccaccaatcttcgaaattttgtctggctagcagggaaagcgagcaggcaggttcagtggtcagtgcagagagagcaaccctgcagctattgattcagtgcagagagaacccagcaccagttcgcgaaaaaaagaacccagcaccaaagctgcaatgattcagcagctgcagctgttgattcaatgcagagagaatccatcaccacatctgatcgcagaagatgcagatgcggttctgcagacgatcagccgccagcaaaacaaacgccagcgaaggaccagccacatcaagttcaacgatctccaaattgacatgcaacacaacaaaagctgattagaccatgggagaggtgcaaactggtgtgcaacaacaaaaccttattcgaccattgaacaggtgctcgtgtgcggagcgtgcgctgaattctcctgaagtgaaggctaccagcgccgtattggcacatcagggatatcaacttctacaacaaaaactgctcattagttcccagatgcaggggtattccaaaatggcctcttaatttgatccatcttatgtccagtggtgcctcagctaccattctttgggaatggatcttgttaggcaccaaaaactccaatggggaggcaccactttttgtaagcaaaatgttaatatattgtccaactagtaataactataatgataaccccatgataccatgctatggacaacttcatttcaaaaggtaagagtatggaataaagctgagtggtgagttaagtatatggactgaatgggacagctattagtggccccttttcttttttattttaattttcttttttgtccttttggcacaacaatggaacatcctgggtaccttttagtaatttcccagaaggttagctgagcacttgtgcgtggatgcagcgtatggccccaaaagtgagttgagccccttcttctacataaggaaagaactaactgaaatttggggctgtactcttctaaatttcagttagcgctcttcgtttaatttttgggagacgaaatttgtactctatctggaactagcgcatctgcactctctttcctgtgatcctatctaatctctattcatattgatctaacatttttttgaacaaacatgtgattgctttgctcataaaagacatcaagaagagcaagatcaagaagaggagctagctaggtagtctgatcattgggtagaaagatttgtgaaacaaattaaggacccaggtacgtgatccaattatttcccttctttactccagcttggtatgtttggagtatcagatatactacaattgtcagcagaaactgttattttccaattgtagacaaagtctgcatgttgcaatttcttgtgttcttggtcgattttatactgtactagtaagcttagaacaaaatttcaaactgtgcttgctgtcttacatgtttctttcactacgactagtcgaacttccagagaaattatgtgcctatttgagatatagttgtatgaaatacaattatacatttagatgtccaggcagactgcatgttgtagccttttgtgttgctcttcagttttgtactagacaagtaatgttagaacaagatttcaaaattgtgtgttttgtcttgcatgttgctttaaccaaaactagtcgaatttcctgagaaatcatgtgccttcaaccactagatacagtagacccggcataatttgctagactttaaaagcaaattgttttttgaatggtagatagataggtgttaggtttgccttcaaccactagatacagtaaatctagcttttccatgatgcatctctggaactcttaacagtttagcacttatgatcatgcagcagtgctcaatctggctatggacaaggtcgtcggaatattgaggggagtagctggtgttgctgctgacgccaatgcattccgtgaattcttccactgggtcacaccacacgtcttagctgccgtacgttctcaacagcagcagcagctgctgcaactggattcaggagggccagtatcagcatcaactggaaacaacagaacagctccactgcatcagattcaggatgatcttcagaaactcgagcacaacctttgggtgatccaaacaactattacatccacgatgcatgatctcatcgaccgccttgagtggcatagccacagggaaacagaagccaggcaccttcgccagatcaaggatgcagtgtacgatgccgaggacctccttgatgagtacaattactatgctcttaaggtgaaagtggaggcgagcaagaacttggggcaagatcactcacatggacccgttttagagttcttggacagtgtcaacttcaatggcaacttcagcaaagtgatggaaatccaagacagactgaagcatgttttcgaccaatccatgggtttaggcttgcacaaaacacccaagaagtttgatcgattagtcaggccagagacatgccgtgtccttgatgagtcacagatatttggtcgtgagcaagaactgaaggagttgatgcaaatgctaggagtagatggacacaagagaggcaggcctgcagcacacactaacactactgaagcaagaaggatggagttgcctgtgttgccaatagttggcatgggaggtgtcggcaagacaactatggcccaacaaatctgtgaggatccagaggtgcgcaaacattttcatcaccgcataatctggatatgtgtctcagatgaatttgaggtaaacaggttaacaaaagatgctctgaagtctcttggagtcaagtcagaagataccgatacaagggataatcttatggttaatttacgtgatagtgtcaagtcaaagaagtttttgctcgtccttgatgacatgtgggatgatgtcttaaaggatgagaaaggatggagaacatttcatagaactttaagcaatggtcttgatggcagtatgattttggtcaccactagatcttccaaggttgctaacttagtcagcgacggtaatcactatgagctgaaaggattgcaagatggggttttctggaatttcttcaaactatgtgcatttggatctgtccagagttggagcaacaggccagagttgcagcgcattcgtccagaattggagcgcattggtagagctatacttcccaagttgaagggttcacctttggctgccaaaactcttggacgattgttgaaatgcaaccgaagcatagagcactgggaagacatattgaaaagagctgtggcgattagaacaagaggagactgacattttgccggcccttcgactaagctatgcgtacctgccgcagtacatgaaagaatgcttctcaatctgtgctatatatccaaaggatcacatatttcaaaaggaatttttagcagacatttgggtagcacaagggtatgtggagcctcaagatgcatcctcttgctttgatgaccttgtaaaccgatccttctttcagcaagcagcccaccaatatgataatcagtatgtaattcatgatttgctacatgatacagcacaactagtctctaaggatgagcgcttcatcatacaacatgtaagtgacctagctaaaatccctccaaaggtacgtcatctatcaatattcactaatggaaatatcagatgttcagatttactgtatatttgcgcacaaaataaaaaattgcgttccctagtatgcaatgattcttacataaattgggaaccttttgctcccatgattgacggttggttcaatgaacttttgaatatccgtgtattgagttttgatctttcgactgtcagaaagctacctgagagcataggcaactcaatacatttgcgctaccttggtttattaggaaattctacttttgagacccttccttcatctgttagctgcctgtatcatgtccagactataaatgccaagggttgtgttttcaaaagatatcctcaaggttttagtgatcttatttccttaaagaaaattgaatcaaagggcttcatatataataaggataaagataagcaatgcctaaggtggcccataatgcgaacacctgacaggggcgaagccagaacaaggctgagccccccctatgctccaaacctggctctgccactgacacctgaagaacagttacagatgacagaggagcagattgaattgttacctcattggaaccttcagcatttgacaatagagtattacctgggtcaatcttgccccagttggctccggccagactgcctgaaaatgctgacttcacttaaactttcttattgcaagaacattcagagcatatcattctttgacccactctttcctgattcggaagattcaaagaacatttgtcaccttgaggtgttggatatccaacattgtcctaacatcaattggcaaggtttggtggctttaccttcttctcttagaaagattatccttggaaactttggccattcgacggatcactttgtgagttgcttttgtggcctcgctctcctgaaatgtctgcaaatacagtgtgaattcttaatgtctattcccctgcaagtttgtaaaaataatcttcaagccttggaggatttgcatatttatcagtgtagctccctcacatccatctatgtctcagaggcaagcagcaggcaccctgttggagtattttcatccctttcaagtgtcaccatttctctttgcaatgcactgttgagtcttgatgagttcctgatgcctgcttatatgcccgtcgtgaagaccattcttgtggaaagttgtcgacaattagcattactgccgattgatgagcttcatcgcttttcttgcttggaggtgctacgtattgaatcatgtcccaatttgaatacacggaggataatgacattaccatcctctcttcggaagctcagtttactcggttgtccaagcatagagttcatcgacaacagccatctggcgagttctgtgacactcaagggactcaacctgaaacttgttagctgtccagacctcatctctattgttggtgctatatctatctctgaaatacagtcgggttatatacatgattgccccaagctgatggagatgacacagcctttcacaagaggtcgctactggtacgtgctaaggaatcacacttgatagctcttttttttttctgttaaaactggttatcttcatctatcatagagtaatctcattaactttttgataattttttttgtatgaaatatttttaagctcacagcaaattgtcatgctagaagtgctctgcttccatatcataaattgtgttgtacttatttataacatctagagttctagactcgaccaaatctcataattggtattacagttagtcgtattttcatcaactgtggcaaacagaccggtttccgctggctgtcaagtccacaataagccgatactagctttttggagacttcacttttacaatactatgtcgtagaatactaatttgtttagatttagttatgctctaggaaaagaaagctgaaatgaagtacgagttgtactatttatattcattggatttgatagttcattgttgttaatggtttcagatgatttcaagataatgtcgagtgttcaagatgatttcagatgcaaacagcacagaacatgccagcataagttatgttggggatcagggagaatcatctcggcaaactctacatcattcacttatatcataatgtttgaagtttagtaataaactttgttattatatataggagagagccaaaagaaagtgcagactaatcagaccatgggtattggctaggagatgagaatctcaagagctgaatttgtgggtgtacaattgtgtattttactggatgataccccatgcattggtgtggagatttacgtgaaagactattatatatagagggacaaactttataaaaatataacggtatcatgatgaataactttgaatcactctattaaattttgtaggatgcagttttatttcagcccacggtggcttttgttgtgtgttggtcttagtagaattgtatcagggaactatagcctacgtacataaccgaagtatcttaaaactgctgagatgaaatctgtatgcaatggctcatgtattcttgataatgatatggcgtgctttatctaaaggctcctttatagtgttaattgcagttagtggatcagacaattatataggaagaaaggattacggtgttagaaaaaagaactctttatctctgttactgagcaattgatgtggagcacttagaagttggcagtgtagattttgatgtattgcctgtcagagctcgtcagtatgcaaatattagattgaactgaaatttgccaaaagggtttatattaagctgtaaggtgagagacatcagtaaagatggccatcattcatgggctgtggatgataacgaggagcatctggctccttttctgccgatgcgtttgctctacttgttgtcagtgctctattgtcttgaaatggcgtccgttgaaacactaccacatgacaacatcatttagaaatagagtaaatttcaaaataactcaggttgtaaggcatatgcatatgtaaagagacaattgcttatgggactagagagagtacatgacaacaataagcaaaacatacaccctccgttctaacatttatctagattcatctgcataagttattttttattagacgaagggagtgcatgacaacaacatttactcatttagaggttgtgtggccgaaagatttatctatttgtcactataagaaacggtcattctccaaatgctactattaaaattatcattacatttttttacactggagtgaggagaatgttttttttttttgctactttcgcatatatgggtgtgccaacgggggaataagtacactttgactccctcaaatatacaatcaatttaatttctatccctcaatcacaatagcaaatatcttaaacccttacggccttaactattaaaactggtgcaaaataactttctcggtggttataaagttggttttcattggcatgactcgttgatctagtccaatcgctgagtcggcatgtatggacccacatgtcatcatctctctccttcccttcttcctcctccccctctctctcccttctctccatgttcccatccctactccaacagcggcactgccgtgctgtggtgtcaacgacgaggccaccccgtcatcggtttcactttccctggtgccgctgcgcaaggtcgccctagtgaccggcatcacaaggtaggacgggagctacctaatggagcttctgttccggaagggctacgaggtgcgcgcgacggctctaccacatctaacatgacccacacacacaatcatcgatgccacgctagtagatgcacctccactacgccgacatctctaactcctcgtcgctccgttgcgtgcttgatcacatcctcctcgacgaggtctacaacctcaccgcgcagtgccatgtcgcgttgtccttcgaggtgcccgactacaccgccgacgtcacagccacgagcgcgctctgcctcctcgaggccgtccacctcgcccacaagcccattcgctactaccaggcggtcccctccgagatgttcggctccacgccaccactacaaagtgagtcctcccccttccacccatggtcccctacaccgtcgccaattcgccgccctctagtacgccatcaactaccacgaggcttacagcatgtttgcctggcagcagcgtactcttcaaccatgagtcctcacgccatggcgagaacttcagactaacattaccggcgccgtcggccgcatcaaggttggactcaccaaggtcttcctcagcaatctctctgtcaccagggacttgggcttcttcggggactaagtcaaagcaatgtggcatatgttgtagcaggaccagcacagcgactacgtcgtagccaccaaggagtcccacaccgtcaaggaattcctcttggccatcttccccagtagcagctccgtcaggtggctcctgtcatgcctcgtgatgctggtcaccaaggcgaccttccacgatggcaccagggaatgcagcatcaatggctggggtggcctcattgttgtcagcaccaccgttgtccactgttagagtggggtggggacagggagatataagggagagaggggagtagaaagaatggaaaaagagagaaaggatgacatgtgggcccacacatgctgacaacgaatggattaggtcaacaagccacatcaacataaacctcactcaaaaccaccgaggaagtcatttgcaccggttttaatggtcgagggtttaagatatctggtattgcgattgagggataggaattatagaatccagatcctctgacgtagcgcttggacaccgcatcgaacgaaagcgcggagtgtggcagccaaactggctcgcgctcggcccaaatcagcaaaatagcaaaatcggcatcggtcattcgctcccaattcctcaaggccgtcagccggtgaccgctcctcgtcgtctcctccggcccaagcgctggtggagcggatcctgcaggaagcacctcccctcgttgtcagccacctccccgtcaatcgcctcctcgcgcctcttgagagccctgcttcatccgggggatctgcctcgtctgggtctacctcgacgacgatggcttccacggcggagcacttcaccaccacccacatcagagcagtgagaccagtgacaggggtcgcgctgccacgataccacatccgttgctgccatgaccgcagcactgccgccacaacgatgaccaccatcaccacgggcttttggaggaaggcaacagttgcttgagaagcctagttgcgattgtaaattgatgtgaatgcggcaattggatgtcttctttactgattccagactgattaatttgtccaattgagaatgttctattatgcaatttgagatcagtacatacaaacttggcatatatgcatagagacttgcatactacttgcttttgcttgcaaaatggcaaaagatagctgtttgtactccacccgcacctgagccagactggacgggacaacgagcgaccgccggccgatggccacgaggaattaggagagatccaagattttgctggcaaattaaggaaacgagctctttcttctaacggaccgtgctatttcgctgatttgggccgagcacaagccagttttgctggctcactccgtgcgttcgtccaatgcggaatggacgacgtagacgtccatctgacgtcacgagtgatctggatccaaattatactggatgtatatttgagggactcaaaatggacttattctgccaacatgtactgtcaacacaaaaggtccattttgcctcttgtaggtagggatgaaaacggtacggaaacggacggaaaccatctttatcgttttcgttttcatatttttttcggaatcgaaaagcccggatacgaaaatggaatcgaatattatcgaaaccgaaaacggagcgaaaacgaagtggcacaaatacggtaacgaaaatttatcggaatacagaaacccctcaaactgataaatccaattctcaagtctcaacggtcaacaattcatcgtaaaacacaatcatataaatccaattgttaagtctaaacaatatatcacaaaacacaatctatgaaataaattatctatgtttaagagagtaatgttgttgataaatcccaacgcagaaaaaaaatattcttatgtaacttcatatttacataacaaatatttttttaaaaaaaataaaagccaaacaccatcgtattcagtacttaaaaaaagaattcaaagtatttcagtcacaaaatttccggaaattccgagaaaatttctagaaagtttctaactgattccggaaactacccttatcattttcgattccgtttccgagaaaatatttccgaatttgttctatttccgaaaaattccgaccgataaattccattttcgaaaataggtccaaaatacggaaagtttccgtaccgttttcgccactactcgtggcatgttagagaacaagctccatctccacttttcccctctagtactgatgttgttgctgacctgatggctattttttttcttctattttatctctcccatgggagcggcggagcttctcgatccgacggcgacagtcatggggagcagcaggcttcacggccatggctacctcggttggggtggctggctggctccctgcctcgatccctggccgccgggcactgctcctcctcctcggctccccaccacgaacaggactgaggtgtggttgctagctaatgctgcttgaactactttggttttttgtttttgttgtcccccttgttccaaccgaagaaatttgcgttttattggtgttcggttgctccagtgtacaaatccaaccaaatatcattctttgcctctctcgatttgtttccaggcacactggagatggactacgaacatcagactgtatagatgacgtgagagagtcaataatctagacagactgagtattcaaattcgtagtactagaatatatcatatctcttttaaatcctttatatggtcatgttattttctccaataagagttatatgaagattaagatttttgtggcacgtatttcaaactgttaaacggtgcgtaaaaactttctatatgaaaattactctaaaatatgatattaatctatttttcaaatttttagtaattaaaactcaatcaattgtacgctaataccacgttgttttgcgtaaaaaacttaactttcataggaaaaagacaccatctatatatggaacagagggagtatcacattccgtattaaattttttttttatgcgatggagggagttactgattaaccatgtgtcgcattctgccactgacgttagtgatgtgtcggcggcggcgcagtcaccgcgctcatgaactcctcgtcggcgaccagcctcgcgagcgcctccggtgccaggcaaatctccaccgccatgccgccgccgccgcctcgcctctcgtacaccgtaatcttcccgtccatcttattcccggcgccgctccggacgcccaccggcctcccccacccgaagtcgttgccgaacacgtcgaaccgcggcgagcccgagatcaccaccacgccggcgttctgcaggctcgccaccgtcacgaacctcggcgtctccggccacgccggcagcgtgcgcctcacgctcgcctcgtcgcccgcggacgccacggcgcggttcagcagccacgccgcccagccgagccctctctcgaggagctcgccggcggtggccctcgcgacggcgcccaccaccgtgttgcccatgtattcttgtggcacctccttgacccgcgctcgcagtcccacggagaggccgtgcctcgtctccagctccggcgcgaggcggcgggctcggcacacggctcgccagatgtgcgcgaccaccgactggagcgacgatatggcggcgccgccgccgccgccggccatctcggcgttcgccttctccttcagcgtcctcacgctctccgccgagaaatggaggaagcactcctccaccggcgtgtacgcaggccgccggaccatgtcctccagcttggcgaagggtagagggatcggcgccgggatgccgtccacgaaccatctgtcgaacactggcggcggcgtggagagctcgaggtcggcgttatcagcgccgctgcggcggcggttgatctccgaccaggtgcggaacaggtgccagaaggtgaacccgtcggcgacgccgtggttgagcgacatggcgatgaacatgccgtcggcgagctcggtggcctgcgcggccaggacagggcggcggggctccacggcggcgtccgtgccaagcatgccgttgagcgggaagaaggaccacaccacccttgggacgaagagcgagtcggcgatgtcggccacggtgacgccgggcgccacggcgtggacgaactccgccccctcgccattgcagcggagcgagagggagatggtcggacgagcaccaccaggcgacggcggcgtctcggcgacggcgaggcggccggccagcgggtagaagcgggccagcgcgcgggcgaacgacgagacaaggtgttcgacgacgtgctcacctccgccgggaggcttgggcaggacgacgcccttctggacgtagtcgccggtgatcatccggagatccaacggcgtgaggtggtgcaccgtctcgtgctccggcagctcgccggcgtgctccgccgccggccggaccatgcgccgcgacacgatgtggacgccgccttccattctcgactagctctcgagctcagtcgactaatggtgcgtacgtgttcgatgaacaagatcgagttttaggcattgaatatttatatttttttttataaagcatatggcatatcactccgcgaatatacagctttaaatttagctttaacaaacataaccatgtatacggatacttagttagagttttgttacagctggtagaaatccaatttaattatacgtatctgtgaactgatatatctcatattttttataatatattttttatatctagataaaatgcaagaaaacgagaggatgcttgatggggaaaaatccatatacgatgtacagctgtatacgatttgtgtggtttttgaaaaacaaacgagtacattcatgaatgaatgaattgataaagggcatccgaggaagcttacctgactttacacaagaagatccacaaaagagctaactgataaaaataagagaacagtgatgggtctaaatagtagtggtgtcaaaattcctgtatcaaaaacacacgcaattacaaatttaccattggtttgaattccacgttattgcaagactgctattaaaaaattacaaaaataccatagaattatcattcgagtagcattcttacataattgaaaaaaatcacactggtggagaaaccatctttcgtcggtcggccgatt

SEQ ID NO: 63124 - DNA, 1953 bp, Oryza sativa
gtgatcttaagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcagttttttttactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaacttgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctactgttcgtaaccatcaacgattggcctgcacttagcaacctatccggacagtccaacaaggggtacaaggcttgca

SEQ ID NO: 63125 - DNA, 1311 bp, Oryza sativa
gctgctcgacagcatcttgatgtggtaggcccgcggcggcctttccccttctcccctctagcgctggcgcgacgtccctctccgccacagctcagggagacggccgacgagctcggcggtgcggagaggaggagaacgacgagttcgccagctagggtttgagcaggggcgtcgacgagactctctctggcacggcggcagctgtctccggcgacgatcgccgccgcctcacacagggtgtggggtgtgggcatcgcacagagccacgaagcgcgaagccacgacccccacagtgcaccgcgccgttctccccacgccgcgcagcaacttttctgacgaagaacgcacgcccagttttggctacacgaacctcgttaggtcacgctctaatcccagctggtagagaatctcctacgtggcgtgggttggccaaatgccacgtgtgtgcactgtgaatgccctaacgaagatagtaagtgtcgacgggtgatacccgtagaccggatatagagggtattggggtacgttggtacaaggatctacgtagtacgacatcaagcaaacaaaagacaagaattatactggttcaggccccttgataggtaatagccctaatccagttgatgtgggattatatggtagaaaacacaggttataaagagaataagggaacttgtcggatccggcgagattgtagtcgagttgattcaactagctctcgatgacttggctcctcgtaagctccggcttcgtaggctgtggaggttatgttggctctgagattcgatgtctaaaccccccggggggggcccttttatatcgcagatgaggaggtctcctcatagaactcggaggtatcagaccttatacgatatgccaacgacccagttctgcccgagtaggattcttcccatctatagattccgtgaaaggtttccttagaatatacaggaaatatccgcctgtgcgtgggtatgccatatcgatatgtaacgtatatcgaagggcaaatggtatgcctaacccgtaaccctgacagtagcccccgacttctgcttaaattgaactcgtgcaaccatttgcgacttcgggtgtcgagactgttgtcattcccggtgcgagaaccgcggagatagaccgtagtcgagcacgccatttgaagcccaacggtcacaagcgaattttaaactgaagtccaaaaaaccggcgcgcgtaacgggaccagaaatttccggcgggcatctctctctgttccctggaatttgcaccgtcggtagtgcgcctatttaaaggaattttgggagtccatct

SEQ ID NO: 63126 - DNA, 1494 bp, Oryza sativa
atttgcggtgatgaatcgggagtcggcttggggataagacgacgtccgtggtggtcagagatcatgcaggatactaaggctagagttgatgcacgtggttgatggagattccatatggcatacgatggagttattgtgtgcgtatgggatgcggagtcgaatttggaaggagtccaaatttggtacgattggttatctaaagtttctatcttgtactagagggtttcctaaggtgtttaggactcctagtatgagtttggttcatggctttaggctgcctacctcgggtataaatagagggggagcgtgaggcttcccggtatcgcttttgagagcaattgagttgagttttgagttagggtttcgagtttagtcgaaatttttgtaaggagtgctgttggtgcactttgtaaacacagagagaagtaataaagtcgtcatccactttaagagttctttgatttgtgtttcaccgggtttcggcggtttaactggcgactaaccggcggttagaccggcggcatcgcggcggtccgaccggcgggagcgaggcgctcagaccggcggcggcaacagcaagcggcagatgatctcggtggtcagaccgaagatctaatctcggttagaccgacggcaaccaggcggtcagaccggcagggcaatttcggtcagaccgcaatccgtcgaattcgagggtaacttttatttccgctaaaagttttcggtttttgggtataccaaccattcacccccctggttggattagtttttgtgatttgatcctacaagacttactcacctcggtagctcgtggtggaatgaagacgggtgtcgatggagcttggttggtggaagacacaccagagcatgtaagaggagataccgtccttgttgaaatagcatttccaaaacggtactttgttgattgttgtcgtccctgcaattcttattctgccaaacatgcaagtagaaacaatcttcatattctttatagttaacaatatcttgaatctcacggttcaaccctccatagaaacttacaatactagcctcttcatcctctattacatcacaatgcaaacaacattttttaactcctgataatattcttttatagatttatccccctagtctaagcatgcaatttctttaaaagatcacgtctaaaagaaggagcacaaatctagtgcacaagttgtctttaacacttctcatgttgtaggtgctagtccatctgtacttatttgagtccatcatactgttgcaaaattattaaattcactagtagcttgcttaaccctatgctcaccaggaataaatgtgcactaaattttttatctacagttatttcccaatcaaaataagcttcagcatcataggcacaatgaaaagagggaatcgtaaccttaaatttagcatatggatcattacgcacattatgaaaattacctccaatacctcaacgattgaagttaagccagttgctatcaatct

SEQ ID NO: 63127 - DNA, 6171 bp, Oryza sativa
cctttggatacagcgcacagattgagaggcatcttttcatgtgccgtggcaggtaaacataactcagccgaagggctggcagaatgtcagtctcctcttgttccaatttccacaattcacttctcaatatgtcctcccagtgctcaatgcttaggttgcttttcaacaagcgtccaagagttttggcagccaaaggtgaacccttcaacttgggaagtatagctttacctatgcgctccaactctggacgaatgtgctccagctctgggctattgctagaactattggatctgaatgcgcatagtttgaagaaatcccagaaaacatcattttgcagtccgttgagctcatagggatcactgttgctgactaggttagctactttggaagatctagtggtgaccaaaatcatacttccctgaagaccattgcttaaagttctatgaaatattctccatcctctctcatcttttaagacatcatcccacatgtcatcaaggacgagtaaaaacttctttgcgttgacactatcacgtaaattaaccataagagtatcccttgtatcagaatgttgtgactttacaccaagagacttcagaacatcttttgttaacctgtttacctcgaattcatccgacacacatatccagattatgcagtcaaagtgtttccgcaccactccatcctcacagatttgttgtgccatggttgtcttcccgacgccccccatgccaactattggcagcacaggcaactctgtcctccttgcttcagctatagtgctgcatgccacaggcctgcttctcttgcgtccacatactcctagcttttgcttcaactccttcagttctttttcacgaccaaatatcttatctggcttgtcgaggacacgacatgtctctggtctgactaatcgatcaaacttctttggtgttttgtgaaagcctaaacccttggattggtcaaaaacctgcttaagtctattttggatttccatcactttactgaagttgacactgtccaagaactccaaaaaggtttcatgcgagtgatcttgccccaagttcttgcttgcgtccaccttcaccttgagagcatagtaattgtactcatcaaggaggtcctcggcatcatacactacatacttgatctggcgaagatgccaggcttctgtatccttgtggctatgccatttaagacgatcgattaggtcatacattgtggatgtagttgattggatcagccataggtcgttctcgagtttctgaagatcggcctcaatctggtgcagtgaagctattctgttgtctctagctgatgctgatcctacccctcgtggatccacttgcagcagatgctgctgctgctgagaacgtacggcatcccagacacgtggtgcggcccagttgaagaactcgcggaacgcattggcatcggcagcaagaccagctgctcccttcaatattccaacgatgtcgtccatagccaggttgagcactgtgcatgattataaacgcaaacaaattaagccaaaccgttaatatcacggcaaatgggatcttttacaaatatataagacacatgattgatcaggaaattctatctcaaataggcacatgattgcccagataattcaactagtctattatgtgctaaaagtctttcacttaaattggtgagtccaatattataaaccgttagattagattaatctgaaaacaaaccatacactacatgaacagtcccacctatcctcctcccctataggtgtacatacatatgtattgtaaccacgcacatctaggagtggatgtcgagctggctcggctcggctcgttatcctaacgagctagaatgctggctcagctcggctcgcttctcagctcgagctagctcgtttagctcgcgagccaatacatcgaacagatgcaaatacatattatacaaccaaaatgtccacgaaggcaattgtatctccatatcaaaccaagaaatcacatgctagctcaagtgttcaacaaatgaatcagtattcatggtagctctacctttaacaataatcttgttttctggtggcgatatacgagatcgagcacaagtgctcaacctcctggatccattgccccatgcctgcaacctcctcctgcccgaccattacaccacttgaccaagacaagaacgggagagccgtgcaggtggtcgaggcgctcgaggggtcggcggagctgccgccgatggagggagcgtgatgcaaggacgtgaggcgcagcaacaaggcggggccgtgtgtggcagaaggaaggtcgatctggattgggaattcgggatgaggggaaagaggaagatgaaaagctacactgatcaaataggttctggtctttcctttttgactgttttctttggacctaccgtgggatggattatttttctacatatgggccttggcctactaacttctctgcctatgcttctagctcgtttaagctcgtgagcagcttttatgtgtaacgagctaaaacagctgctcggcttgttgaaaaacataacaagccgagttggctatgaaccgagcgagctaactagccacgagcttttcgtccaaccctacgcacatctttttttatagtttccgtgaaatacaaatgcgtacatatgttttattttttgttagctactttgtaaagaggaaaaatgttaatgcaaaatataagtacattgtgaccatgtgatgagtaattatgtatacattgatgagatggactaggtaccacagagatttctaaaagtctgaccatttcttggacaactatctactaagctcataactcaatatcgcacctgcattaaatccaagattagtctttacaaacatgctcattatataggcaaaatttgctacaaggcattcacaaaacatgtaattagctggtggacaccgcaagaacgcaaatttgctgttgggcatcacaaaaaactgataattagctaatggacactcgtgagcttattttactatttttggaggaattggagagagaaacactcattaaagacaaatttacccctggtcaaacttgttctgtgggacctacatataagacttgtcttcttccctagatcttcctcgggttcgacgaggctagtagtgggacgatagcgaccgacagtaggcggcggcggcggagtcgagggacctgggcggcatcaaggtcgtcatgcgacgccctcgcgtctagctcctctgacccagctgagttcaagggagcccagcaatgatccggagcggcgacatagacctgatgcgtggtacgcggatccgctccgcaatgatggctccagcctcgcctagctagccggggcggtagtcgtcatcatcgttatcgctgttaggtttgagattcaggggcggggacaaggttagcggttggatctggccgttgtggtagagttcgccgaactcgaactccgtagttgctgtcgatgttgtcgtccatggcgttgacaaatggggtggagcagctgctgtcgatgcgtcgttctggtgccggaaagggtggccgggatgggcatgcggctgggggaaggatgacgcggatgcagcccagggagcaggtgaggctccgcggcctccgcttcctcgacaagacgtccgacgggaaggaggggtggaagtttgtcaagcgctgcttggacgagatggccgccaccccaaggagagcttcggcaagtgcattggtgagtccgcagtccgtgcttccttgctctgcgtagctaccagaacgacggtgtgatccagaaaccgtaaattcaattcccaaaaagcgattagctgttgctaacaagaacagcaaaaatatcttgggtaaatagggatgagtacttgagagaatattgtgttggagctatgcaggggtagaattgtaatctcacatcagtttctctctcgaattcttctcgaaataataaaataaggccgcaagtgtccatcagctaattacaagtttttcgtgatgttcgacaacaaattcatgttcctgcggtgtccaccagctaattacacgttttttggatgcctatagctaattttgcccattatatatgtacaaacataatccgggagtagattatgtcatcatatatattaccctttggaaacatatggaactaaattaattagctttgcaatatttaaaaataaagtttacaccattatatatttaccattgaattttgaattaataatgtaagataagtttcattttatccggtgaaactattatttcacaccattatattatctacctattaaattaaaaaaaaataatatctatattaaataatttacacttaaacaagtagagccatcttttaaactatttttttataaaaataaatttgaccatcggtttacatttaaattgatgaatacatcgtttgtatagacgatcaaatctatcttttgttaaaaaaaaaacaaagcctatgaagacctctctctgcccctctacaaaatgcacacatatgtctttgccgcctcacatacgacgaagtgtcgtatctgaggcatctatggtgatttgctaaagtgatcatgttgtagctttgccaaagtgaaggcgtatgagatcatcaatggttaacaattggttttgttaataacgtgaaaataagttgaaggtgtggtgcatagagaagaatcaagcagcgtgtgttgtgtttttgcaacatacggctctgtgtaagctgaaacaaagaggtgattacctgattataatgtactgtggtaagtctactgaatgttcatgagggcgaaaaaaatcatgttatgaatgggagtataactttaaacaatatcaatagacatcttactagtacgaggatgctacaagggagtctgattatggagttttattgcacacttcccaacttggtagaaattaattcattggacatacttttggaatacttttctacagaacttttcaacttggtagaaattaattcattcatttatactctcaaatagctataaaaaaaataagatagtacatatatttttttatacgagtcatggtgatcaatgcgtagtcaaagtcatgagataaatctccaagagctactctaattgggtaaaagaacaattgataatactctctccatccacaaaagttacaccaatttcacatttgagtttttccaaataagttattactatttgtagtctttatgcattgaagacttaaatgaagagataaattaaatgttttattagaacccaaggagtcatctaaatattcattggttgcatgcttgtattcactccttgattttgtaatatccaaggtgacttaatttctccttggtcttggtgtcaaaagtaatatgtttaacttttgtagatggagggagtacgtgtcagcatcgattgccattagacatctaatgactttctaccaacataattaatttctctctataaaataaaaattaccctctaacaataacacacacacacacacgcacatatatataacaaacacaattaaggttttaattacatgtgttaataaataacatgctttgagaaaaatattttgagccctgtatccatacacgagggaggagtaacgtggtgttgcctctgtatgtaaactaaataagtagataaagttagagtaaatatggtctatatgaccatcacaagaaataagtgagtcgggatgccattgtgcaaatagtgacaaatagttttcgagctatgtaaaagtgatggcacgatgtatcattttgtgcaaagatttctttctcttattatgagtagtgacaaagactgtgtacatccgattggatgtagaggctgggttcatcctattttctaaaaaaatgagtagtgacaaagacaccactaagaagtaaaatatgtgcttatttgaaatgaagaaaaaaacaattaggtgaccaatctttttaagtagtcatggtatttttttactttcattaattaatcctggtagtttaaattatattgaacttatagatagattataatttacatcacaaaactatattcttgatagagtgaagtgtacgggcggtccttaaacttgtacggacatatcatataggtccctaaactttcaaaatgcattttttccccgaacttatcatgtg

SEQ ID NO: 63128 - DNA, 5124 bp, Oryza sativa
  unsure (1)..(5124): unsure at all n locations
aaacatcaatttccacttatatatggtgaccaattgttttctactagcaatatttatgtatgtacatacatattgtttttaaatactttgatgatcatagttatatttcattaaacttcctgtatacgcttctaatccaccacgtggcaccctataaacacttatgattcatcacgtggagttctaaaaaaacagagaaattcaaccgtcgattttcattgagattaataaaccattattctccctctttccatgcctctgtgcggcgttctcactctgtaccaaacctaccattcctccgttcctttcttttttttcttatttgataattaaacttataattttctttatgggcctaaaaaattttatagatagacatcgaccgactagatctagcaagctcttactctatactctctttatagtacgttaaacatcataaaaatatttctaaataaccacatgacacactaaaattagagaaaataaaaaaataaaacattcgaccatcaatttcttcttaaaactatcacatgatataaaaaaaagtttgagatttatccacgtcatcatgagtaaaacttttatttccagtatacctctacaaatgcttgtaggccatcttatagcgatggacataataaactactatgattgttttaatgcctaattcttttaaaaaaagaagataaaattgtataggtattgcaggcttcgcattgaagattatgcacaaacacaccgtgtaaaccaactaacacacacacttttgaagaccgtgtatatatatattgggagcaagaaaaaaaaacataattctaagacagttatactcttaagaccgcaatgtagcattgaagcttttacacataaaactattttagtggagcacttaacccgtaagatagtattgaatcaatatactcccttcgttatagaaaaacatagctcattttacatcataatgatatttttattctttcaaaatttttatatttatcttcatacaagtcatattaaacacaccaagagacagataattataattcaattcagtaaattctatcctttaaagtaacttccatgggtttctctacaacctgcatgtataagcctctaaggtggcaatataaaataagtagcctttcttataataatattattaaaagttattttttcctaatatattattattttacgattcatgttggctaggtcttttccttaaaaagaagcgctatataatatatgtatatttgatcaattaaaaagagggcgtagcaggatggtaaaaaaattaaatttacaagcaataaaagtttctcgagtcttcttaaggaaaaaaaacttaacaatgaacattcaattaaaaatgaaaaataccctattttactttcaacttactttgttagaagtattttcgaaataaaataatatggatgcccgttagaagtattttcgaaataaaataatatggatgcccgcgcggatgcgcgggctaccttcttagttatatgctaattgtctttcacttaaattggcgggtccaatattataaaccattagattcgattaatctgaaaacaaaccatacactacatgaacggtaccacctatcctccttccccgtaggaaatagaatccaacttttaatctacccttaatttagttgtcacccccatcatgagttcgttagaagattcaatcacaggaactttgagtcccttgctcttagcgattntcacttgtaaccatattgcaaggtatatgtgcagatggtatgcatgataattagctaggagtagtttattactttgttgatacaaaaacaattcaaaacagttatcaaattagtctatattttattcaaaattcgatgaatggtttttttatatatattaagaaaaacataacccatgaatcattttaaaatgacattgttcaatctttagtttgcccttaacgtatatataggagataatttctgagcaaactataatcttacatttcaacgatccatatgcccgcgcatgcatgcaggccgccttcctagttctggttaaagcaacatctaaaacaacaagcaccatttttttttcgaacattacttgtctagtacataatcggagaacaacacaaaaggctgcaacatgcagtctgcccgtacaactaaaagtataattgtattaaatacaactctatctcaaataggcatataatttctcaggaagttcgactagttgtggtgaaagcaacatgtaaaacaacagcacagtttgaaattttgttctaagcttacttgtacagtataaagtcgaccaagaacacaaaagattgcagcatacaattgggaaataaggggggataattggatcacacacctgggtccttgatttgtttctcaaatctttctacccaatgatcaaactaacctagctagctcctcttcttgatctttctcttcttaacatctgttacgagcaaagcgatcacctgtttgttcacaaaaattgtttgatcaacatgaatagagattataaaagaaagaagagcacagatgcgctagttccagatatatagaatgttaggaaagttaatctctcggctaaggaaatcgggagaaaatcacgcgttatcgttttccacccgttaaccagcgtgattagctaaatcaaatcacgattaaatttccttaattgcacgcgcaataatcggtagcgcttccaacgtttccttttggagcagcccccgattccctcagcgcaaaataaaaggggaggccggcccgtgagaaagatgacgatctcactcacggttccaatctccccgacatcccaaaaccctaatttcccgattctcagttgcactggaagggattcgtagtgctattcccggacagtgtaggtggcgaccggaaggccgctgccactccgcaggtgatcgccggtgacctcttcgggatcaagccggtgtactcactgctacgaccacttctacaccgacaattcgcgaggtggttcgaggttctacatcctctacatccaccccgaaccaagcaagaacaattgcaatggcttcaaacaacggtcagttatcctaaattccgcattagggtgatcatgttaggcttagcacttatgtcttagtagattcgcaaagtctacatagagtaccaattttgtctcccgaattcaaacaaaaagaactaacagaaattgggaagagtacagcccccaattttagttacttcttttccgaggtagaatgaaggactaaactcgcttttgcggctatacgctgcttccacgcacaagcgctcagctaactttctgagaaattacttatatatatagaggaactgatgttcgttcagaacacggtaggaaattaaaagaggccgctgttttgccaatatataggacaaaggcctggtttagttcttaactttttttttttcaaacttctaattttttcatcacataaaaactttcctacacacataaacttccaacttttccgtcgcatcgctccaatttcaatcaagcttttaattttagtgtgaactaaacacacccaaagaaaagatgccagtaggaattgttcatttcaatccatatgtttaactcaccagtcagcttcgttgcaaagtcagaactttttaatgtaagagcgtcacgaactgagagggaacgattggactaatatatattcattgcttaacggtaatagacataatcccatgcgcagatcaaaaacagcgcattgacatcttaatatattggatgaacagatttggcctctcagcccgatgccttcttttgagtagttcgctctcgagctgaaatatggacttctaaaacttagccttttacatcttggcttttgacactacaaggaaagacaaatagatctaatattatgaatgatagcagtatcattgtgtcaacaacacccatgggtggacctcatccagatgctgttacgggaaggagaaaagttatccatgtcctgagtatgtaaaaccagcaagcttgatgaccatagtaatcaacggaggtacagcaaaaaaaaaaaaaaagaaagataagataatatgccacttggagttgtccatttcaatccatatattcaactcaccagtcagcttcaatgccgagtcaaaccttttcaatgtaagaattccatgacccaaatgtggtatgtgttcttggtttaagaaattcgtgtgctgaattcttagctttggatgttgcccttgacaaaccacggcaagactaggttctgtcacattgagcttgtctcggatcacagtagaattgtgttatcccgatttggttctgtcacattcaaaaaataaaagatagttcagtctattgaatgcaccatggagttgatagtgaactgtactagattaggagttttatatgagttcgtttcgttgataatgaggatttttattactgattcttccctttttgaataaatacaaatcaacctagcatctttctgtacatgtgtttaactttgtgacagaaaaatattctccctcgtgaatcattcaaagttactgcgtgtaacaatttctactgctctgaaattagagcaatactggcaaatttatctagcaatatctgaaacaatttctagcaatttttaacaaatttatctattattctagttaggaaaaaatatgaattaccccccgaattatcgcggtcggccgaatttcccctctgaaccagaaaaccagacatgactcaccctaaactttcaacaccggacgaattacccccctcgacccaatccatagcggttttatcctatgtggcgtacgcgtggcaacccagtcggcattttcttttttaaaagatgttggggcccatctgtcatatactccccctctctcactctctccctctccctctttcggcgagcacggcaggcggcggctgcagcctgcggcgtgggatgcggaggtggcgtgggacactaaggcggcggtggtggcagcatgggatgtggaggcggcgccggcggcctgggatgggaggcggcagcagcgcgggacaccgaagccgctgcggccgcagcatgggatgctgtggcagatgccaaccatatccc

SEQ ID NO: 63129 - DNA, 6994 bp, Oryza sativa
ggcccggcgagtttcgaagcggcggctcgagtaggcgctggccgctcgatgtagccgcctctcgacgcaggatcccgacgccgccgggaggggaccgggttgtcccgcgtcccgccctgccgccacctccgcgtgccgcaccgccgtcgcctccgcgtcccgcgcaccggtggtcgaagcctaccgcggtggcctccgctctcctctcctcgctcctcctcgccgccattaccgtgcccaccacaacaaccaccctccagtcctcactgcctcgctcgctggtgtcctcctcctcctcgctgccaccgcggccaccacagacgccgcctccccacccaagagccgctcgtccactacaccgccgcatcccacgccgccgccgccgcctcccatcccacgctgcagccgccgccactgcctccgcatcccacgccgcagccgccgcctgccgtgcttgccgagtgagggagagagagagagagtgagagaggggaaggagagagagggagtatatgacaggtgggccccaccatcttttaaaaaataaaatgctgactgggttgccacgcgtatgccacgtaggataaaaaatctttggattgggtcgaggggggtaatttttgtctggtattgaatgttcagggtgagtcatgtccggttttcgggttcgggggaggggggggattcggaaaatatattgtgattgtgaaaaacatattattttgtaattgtttggtttgcattaacaaatattgtcatagcgttagcacgggcaaattactagtatttctagctatcattcataatattagatctgttttgtctttccttgtagtgtcaaaagccaagatgtaaaaggctaattagtagtattatgttttattcatggattcatctaagtttagaagtccatgttgcaagtcgacaatgaactgttcaaaagtagggttgtagtgttaaaaggagggttgatgaccaaagtaatcaatagaggtgtagcaaaaaaaaaaagagaaagataagataatatgccacttggagttgtccatttcaatccatatattcaactcaccagtcagcttcaatgccgagtcaaacctttccaatataagagtgtcatgacccgagagggaaatacccgacaatccttgatgatgaagaattatggtgttgaagttcctccacatgctccacttgaacgcttagcacttgcagcacaagtatggtcttgtagtttgcggtatcgatgactcctaaaatctccccatcatcaatttccatctcaggaacattggtttcacatagaaggttagcagcaagagaatattcttgctcaacatcactagaacttgcatatccaccatcatccgtagcgatgtatgcatgctgacttgtacaatccttcatgacatgtcacatacccttgcattggtgtcgtatgatccgattgtttgccccgtagaagctactgacgaggtacttttcgtgggtacctacactttagtagacttgtaaaatcaaagatgtttttgattattattctgtgatgaacaattgggcattggatattattggttttattatttggaatttattcacgaagtggttttggagatgattggatttcataggtgaatatacaggtagtgctggatttgggtccggtcagaccgggcacgggttgccggtcggaccggcgtgtattgcgcggtcagaccggcgcagcccactgtctgaccggccgacgctgtgtcggtttcagtttcgggttgtttatttggatatccatgattatttcataattatgacttctagatggatactatacgtatgtaatactattgtttgctgctaatgagtcaagttggagatagcttggtctcggaatatggtttctttgtttgttccatgtgtaggtgattcgatgtctctggagagtatttgcggtgatggaccgggagtcggcttggggataagacgacgtccgtggtggtcagagatcatgcaggatactaaggctagagttgatgtacgtggttgatggagattccatatggcatacgatggagttattgtgtgcgtatgggatgcggagtcgaatttggaagcagtccaaatttggtacgattggttatctaaagtttctttcttgtactagagggtttcctaaggtgtttaggactcctagtatgagtttggttcgtggctttaggctgcctaccttgggtataaatagagggggagcgtgaggcttcccgatatcgtttttgagagcaattgagttgagttttgagttagggtttcgagtttagtcgaaatttttgtaaggagtgctgttggtgcactttgtaaatacaaagagaagtaataaagtcgtcatccactttaagagttcttcgatttgtgcttcaccgggtttcggcggtttaactggcaactaaccggcggttagaccggtggcatcgtggcggtccgaccggcgggagcaaggcgctcaaaccggcggcggcaacagcaagcggcagatgatctcggtggtcagaccgaagatctaatctcggtcagaccgacggcaaccaggcggtcagaccggcagggcaatttcggtcagaccgcaatccgtcgaattcgagggtaacttttatttccgctaaaagtttttggtttttgggtataccaaccattcacccccctctggttggcttagttcttgtcattcgatcctacaagtggtatcagagtcttgttttcttctttggatttttatcgatctagagtttttgccatggctactcccgctcgtttttcaactaagcctcatgttttcgatggaacggatttttctcattggtgtagtaggatgcaatcttacattatggctgaagattatgatatttggagaaaagtttcccatgcttatgtgattcctgaagctattaatactgctgctgaaaaaactgcttttgaacaaaattgcaaagctcgcaacattcttttgagtggtatttctcgttctgattatgatcgtgttgcgcatcttcaaactgctcatgagatttgggttgctttaagtaattttcatcaaggaacaaataacattaaagagcttcgtcgagatcttttcaaaaaggagtacattaaatttgagatgaaacctggagaagctttggatgactatctctctaggtttaataaaattttgagtgatcttaaatatgttgattcttcttatgatactaattatcctcaatctgagatctctcgccactttttgaatggtcttgacatgtctatttgggagatgaaagttatatctatttaggagtctgttaatatgtctactttgactttggattcactttacaccaaattgaaaacacatgagatgaatgttctttctcgaaaagctgattctaagtctagtgctttggtttcttctacttcttcttcggttgttgatgcttcttcatctatgccttcttttcttgccacttttaatgccctatccgatgatcaactcgaacaaatcgaggaggaggatttggctttggttgctaaccgtattgctcgagctgtgaataatgccaggaacaggaaaagaggtggtccaaataggagctttgaatgtggttctattgatcatcttcgttcgcattgtcctaagcttgggagaggcaaaagagaagacaaagatggtgagaagacgaacaacaacatgcccaacaacaacaggtcgaagggctcatctcaagggaggaagatggagaatcttagaaaggcttttcaataagtttgcgccgctttcgagccactaagtgatgtagatggtgaaagtggagatgatgataaagggaagaacatctccgatgtttgcttcatggcgcgtggtgaatctgacatagagtatgaagataatgagttaagtgcgtttgaggaagctattaatattttgagtgaaaaaaaagaagtgtgagaagatgtgtagaaaacatgaatttatcattgaatctcttaaatctgaagttgctagattaaaatctcttattcctaatgatgatgattgctcaaattgtgaggttttaatgaatgagatttcaaaaattagagatattaatgctgcacatgatttgaaaaatagatcttcttttgcttgtagtttggccttgcatacacgcactttggatgagttgtttttaactaaaaagttgttgcaaaaaaaatatcaaattgcttttcatgctagtttgatgtttaacatgatttctgctaaaaagttaaaacaaccttatggtgttttggattgctcaacatgtgatttgaataagatgaaactaaaagatgctttaggtcgtgttaagtacatggaagatgttgtgaaaaacaatgaagtgctttcttgccccaaatgtcgtaaaagcaaaggtgtcatggtagattgtgaaaattgtgctaatttggaaaaagaggtttcttatttgaaaaattcttttcaaagattttctgatggtaaaaagaacctcaacatgattttggatcaatctaaggttagcacacataaccgtggtttaggttttgacccttatgctcataattctagacatcctcctattgtgttagctgttggtgctagaagtggtgagattttgattaaacatgatactaataaaactgtgtttaaatctgctggtatcatgtctaccatgaatgcatcttcttcaaaatccaatgttgagcatgcagaacctcctgtttctgcttgtgttgctaaatcttcttgtcctaacaatgtgtctaaacaacgtgaaaaatatacttgttctttttgtggaaaagatggacatattgttgatttttgtttcagattagctcataaacagaaaaaggagagagagattgcttttgcaaaatcaaagtggcaaaaatctggttttccctcgaggaaaccggtcaaaccacagtgggtcccgcggtcagaccggctacagatcctcggtcagaccgaacatcggtcagaccggcggtacagtggcggtcacaccggcccctggtcagaccggctactataccttggtcagaccgacctcggaggaatttttctgaaaattctaaaattgattttgcacgtggatatatgcctattggatcttttggtcgtgtgtctcagtactggattcctaagtttttattattatctaaccctagtactgaggcttcgacttctgcttgtgtgtaggctttggtggcaaggaaggagaacgtatggatcgtggattccggttgttcgcggcacatgaccggtgataaaaattggttctcttccctcaaaaaggcatctaagactgaatctattatctttggtgatgcttctacaagtaccgttgtcgctacaggtttggtaaagataaatgaaaattttgaattgaagaatgtagctttggttgaggatttaaagtacaatttgctttcggttttacaaattgttgatgaagagtttgaagttcactttaagaaaactggaagtaaagtttttgattctcgtggtgattctgtgctgaatatttctcgttatggaagagtgtttaaagctgattttgaaaatcctgtttcacctgtgataacatgtttggttgctaagtttgataaagatgtgatgttttggcatcgtagacttggacatgttggttttgatcatctcactaggttaagtggtttggatcttgttcgtggtttgcctaaacttaagaaagatcttgaattggtttgtacaccgtgtcgtcatgctaaggtagttctacttcacatgctcctattgtttctgtgatgacggatgcactgggacagctattacacatggacactgttggtccagctagagtgcaccgttggaggaaagtggtatgtgttggttattgctgacgatttttctagatattcttgggttttctttatggcaactaaggatgaagcttttcaacactttcgtggtttgttttttcgattaaatcttgaattttctggttctttgaaaagaattcgaggtgataatggtggagattttaaaaatgcttcttttgaacaattttgcaatgaaagaggtcttgaacatgaattttcttctcctcgtgttcctcaacaaaacggtgttgttgaaaggaaaattcgtgttttggttgagatggctagaacgatgttggatgaatacaaaactctataaaattttgggctaaggctattaacactgcttgttatatttcgaatcgagttttcttgcgatctaaacttggaaaaacttcttatgaacttcgatttggtcatcaacccaaagtttcacatttgcgtgtttttggttgcaaatgctttgtcttgaaatctagaaatttggacaagtttgaggcacgctctaccgatggattgtttcttggttaccccgcacatactcgtggctatcgtgtacttattttagggactaacaaaattgttgagacttgcgaagtttcttttgatgaggctagtccaggtacaagacccgaaattacaggtacactgtcacaggttcagggggaggatggtcgtatttttcaagatgagagcgactacgacgacgacgacgaggtcggctcggccggtcagactgggcgccaggccggtcagaccgccggcacacctccggttagaccggcgcaggacgtacggtcaaaccggccaggatcgtcgggttcgggtactgttgatgctgatcgagatggtcctccagagattactacttcgaccagtactgatacagaacgtgactcaacttcagaagtcactgctcctttgcacattcaacgacgacatccgccggaacaaatcattggtaatataggtgagcggactacaaggtctaaggtaacggctcatgatgtttgtgcaaattctgcatttgttgcttcttttgaacccaaagatgtttcacatgcattaactgatgaatcgtggattaacgccatgcatg

SEQ ID NO: 63130 - DNA, 3040 bp, Oryza sativa
ttgttcaactcacgcttggttgtagattttgctgagactatgcgcagggaatttgagatgagcatgatgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctacagctgtgttggatcctgatgaagatggtgaaactgttgatcaaaaggaatatagaagtagattggatctttgttatatctaactgcttctaggccagacatacaatttgctgtgtgtttgtgtgcacgcttccaagcttctcctcgtgcttcatatcgtcaagcagtcaagcgaataatgaggtacttgaatcatacacttgagtttggaatttggtattctacttcatcttctatatgcttaagtagatattccgatgctgattttggtggttgtagaattgataggaaaagtactagtggaacatgtcattttcttggtacatcattaattgcatggtcttcaaggaaacaatctagtgttgctcaatcaactactgaatctgaatatgttgctgctgctagttcttgttcacagattttttggcttttatctactttgaaagattatggtcttacttttgaaaaagtacctctcttttgtgataatacagtgctattaatattgctaagaatcatgttcaacactcacgcacaaagcacattgatattcgctttcactttctgcgggatcatgttgagaagggagatgttgaattgcagtttttggacacaaagttgcaaattgctgatatttttactaagcctttggattctaatcactttgcttttcttcgtggtgaattgggcataattcatccttttggcatggtttgagggggagtttgtacctcatggttttatcaagcaataatatgataatgagaaaaatttataaacgagagctttgtttatgcatatggtattttcttgtgcatgctagcaatactttgaaggtttatttgtctctagcatagcttgtatgtattctagtcttttcatgagatttagattttgcttttcagggagatgatgcatgacacttaaattctatacttgaattaagaaaatatgcaatgttaatgctagcatatggtttgatttataaatgctctatatatatgctttattgccttgttattcctcaaatagttttaattgcttattgtgaaaaagaaaataaaaaatataaaaaaatgaataccgaatccttggaaacagtcttgacgacaaggacgtattcgatgtgagcaaaataatgggtgccgaatccctggaaacagtcttgacgacagggacgtacccggaataaaaaagagaaaaatatgagcaaaaaggctcaagaaaagaaaaagttaaaaattctctttgttgttttgtgctaaaggcttatttgagaaagagtgataattgcaataggtatatgtgtttagtgtttattcttcaacctatgtgcttgttaagatgttgcattataaatcgtatgaaatcatgaattatgattgttaattcaagcttaactgtaaaatctttggttcatggttatactttaattcatgtttgttatgttatagatgggttcattttctttttattgcaacacatgacgtaatatgctatatgtatgctaagctcttgaatattaatgaacataattcctatacttgatgaaatcattgtcaaaagggggagaagtaatgtgaaaatttttggagaagcaagattaatttttgagagttgttgagaagagcaaagagcatgttttttgttcaattgggaatttctttcttttaaaaagggggagaagttttcttttggatttttgagcacgatgtgtacatttgtacgaagtgtgctttttaccacttttgttttttttttccaaacaccaaaacatttttatgaatttgccaatgtgttcatcaagggggagattgtaaaatcaaaggtgtttttgattattattctgtgatgaacaattgggcattggagattattggttttgttatttggaatttattcacgaagtggttttggagatgattggatttcacaggtgaatatacaggtactgctggatttgggtccggtcagaccgggcacgggttgccggtcggaccggcgtgtattgcgcggtctgaccggccgacgctgtgtcggtttcggtttcgagttgtttatttggatatccgtgattatttcatgattatgacttctagatggatactatacgtatgtaatactattgtttgctgctaatgagtcaagttggagatagattggtctcggaatatggtttctttgtttgttccatgtgtaggtgattcgatgtctctggagagtatttgcggtgatggaccgggagtcggcttggggataagacgacgtccgtggtggtcagagatcatgcgggatactaaggctagagttgatgtacgtggttgatggagattccatatggcatacgatggagttattgtgtgcgtatgggatgcggagtcgaatttggaagcagtccaaatttggtacgattggttatctaaagtttctttcttgtactagagggtttcctaaggtgtttaggactcctagtatgagtttggttcgtggctttaggctgcctaccttgggtataaatagagggggagcgtgaggcttcccgatatcgtttttgagagcaattgagttgagttttgagttagggtttcgagtttagtcgaaatttttgtaaggagtgctgttggtgcactttgtaaatacaaagagaagtaataaagtcgtcatccactttaagagttcttcgatttgtgcttcaccgggtttcggcggtttaactggcaactaaccggcggttagaccggtggcatcgtggcggtccgaccggcgggagcaaggcgctcaaaccggcggcggcaacagcaagcggcagatgatctcggtggtcagacc

SEQ ID NO: 63131 - DNA, 16245 bp, Oryza sativa
atatacccacagggctacgttaattacctgactggatatcgggggtaactcatagtaacaaaatatgtaaagataaggactcgggtatcatgttaacttgtatatcaagaaagtatctcgtagtcttagtcagttacaattgtaaaatatttatagaacttagaccataagggataaggtcttttatcttgtaatcccgactccttcgcctatataaggaagggtcgggggccccctaagggcagaatcacatccaagatcgttagatcaataccacaatcggcggaattacttctcatcgagaaggcctaaacctgtattacttctcatcgagaaggcctaaacctgtataaatcctttgtctcataacccattcactttcatagcttcttcgccacccccttttgtaatgccgaaatctagtttcgatagttggcgcgccaggtaggggttgcgtcaagtttttcgccgactagtgcgatgggatctacatctacatcaagcattgacgatttcgtcttccctctcgggcagacattccgcttcggtagcctcgacttcatcactaatagcttcggcaagatctctcttctcaactcggattcgaaccagtcgggaggagatggcatctcggccccgttcggtctcctgaactcggctgagatctactccaagaacctatccctcgagttggtttcaaaccactcgagagactccgcagaagattcctccatggcatccagcaactataagaaatatgaccttctgtgacgaattcctcgtgatatcggagctatttatcattagcacattccattttatgatgattagtatgagatggggtggcttagtgacgaaaaaaatgtattcgtctttaataccaactagaaatcgtcacaaagtatttcaatgggatatcgtgatgaatattaatgtaataaggggcacaaagcaaacatcatagatttatataatgcatttctagaaaaatatattaaatgttaaagcaattccccactccaccgccgacctctgggaggcgaagtacgaggtgctcgtcgcatcgtcccgcaccacgggcgggaagccgctcacctgcatcccacaggcggcggctgacttgtgacgcttacggcagtgagctgtagcctcccgtggcttggcatccagcggttagagtgggggctgacagaccactatggtggcgagatctagctgctacgatcccctgtgaggcgaatgagctgcggccttcacaagtgacctcggctgctgtcccagccaggcctgacgatggtgagtttatttcctgtagcgaagctcttttccaacaaggccagggagtgaatgataatagtgatgcctaacttcaatgctattagtttactcaaatgtctaacgcattgtaacactgaaatgcatataagtttctggatgtaagttactgaaacaaaattgtcttacaaaaaacggccgatctcattgttggtttgcatgtactttttcattcaaaagctattgcctgattgcctaattctcccatgagttgttcatgagacattgcatatgctacatgatttattcagtagctaaagacagtttatttccttctcaattcagtaagtaaacacagggctaagttacactcagtttgtatttaatggtttagggtgatcatgccaaataatttgttaaattaattctaatagaatcttctgtcggaaagacatgcaaacctacttaaaagataaagtggagtatttatgattgtgatgaagtgatgcatattttattatgctaatttaattttccctgtgtgatttgtcgaattactagcatggcaaataaaagattaggttcattccatcctaacaaccatcacagtgttttttttttaatattctgtacatgtgtgtgcttctaaccgtggatatatataaccattgtaccatgtttactgcacaggttattactaaactatgcagctgcgatctttaattgtcaagatgtttatgcaaactaactagattcgtataattagattaacgatgtttggaaaagtttctggatttgcatagtcagattaacatctagcggaccccattgatattgggtggtgactggtgacgaggtgcagccttattaacagatgacctccgctaagcctaatggtaagttctacttcctgtatcctccattcctttgaaaacaggccatgagggagtgatatcattgaggcatagttctactgctgtcagtttactctaatatatttagcattttttcggatgaatttactctaatattcattctaaccccaaagtatagataatttttttgatgtagtaataacagtatagacatgagtcttatgtgtgtgtcaactaataaactactctctttgtttcccccttgcatgctctaatattagcgcttttaatatttcctgttctatactttgcttcccaacaatgtaaaacacttctttttgtataaaatgtcagtcatcgcttcattgaatattttgtttttgtccaactaatgcaatatgtttccaatcttaactggcctgtttttcctagctaccagaaacaaagaaaattcgtgttattaacacttgagttcactgcagtacttggtttgtttcctaccagaaactgagaaaatatacccattttaattgagttcatgcagccaacagtatactactactccctccgtcccaaaaaaggcaaaccctgggtttgcgtgtccaactttgactgtccgtcttatatgaaatttttttataatttgtatttttattattgttagatgataaaacatgattaatactttatgcgtgacttgtctttttaatttttttcataatttttacaaataagacgaacggttaaatattgggcatggaaattagggtttgtcttttttttgggacagagggagtaagtcttagcatgcgcacggaaaacgaaagtgagtttgcgcacggaaaacgaaagtgagttttcctctccttgtgctgctgctgaccgcaacatatgcttcgtcgcagataaaagatgtttgttaacttggatagaactaacaaaaaataaaatcatattggtattactgtcctttggtcctttacaagagtgaacgaatcttgatcctttagtcctttacaagagtgttttatcattctttctagctcctgcatcagaaacttctaagtttgttcatgggatattgtaatgatatggttatcctcatggaactaattaaaattagattactatgtgtgcatgtatattgccaggtcaacatgaaagtatgcttttcatgattggttgcgtacataagttaattaatgttgttcctttttacttgcagcaaaaaaaggtgctccatgtaagggactttgggggtactctcatggcatttggtttagagatttgaaaggatttgtgcttgcctaggtgtgagcaattggttggatttggctgttaactgggttataaattttgtgttgtattggatgtttgtcgggttgtgttggatgctaattgggctgtaacctttgtgctatatgggttgttattgtgtttgattgttgggcctatatgggcttagcccacttgttatttgatactaatgtaaatgaatataataagattggctgaaaatggtgtggtataatgtttgggcctatatgggcttttgcaatggacttggtacatttattatttgatattaaagcaaatgaatataatagaattaggctgaaaatatgccacatcatagatgggctaggctaaaatctagtcgggcttgccattgggctaagcccataaacagggtgttcaatacatggattttaatgggccatcagatattttatgacgttttttatgttagatatgagcgtcacaaagttatgatgacataaggattgccactagattaatgatgaaaaaaataagatttcgtcatagaacgccattagatatgcatgataggtgacgaatgaattttcgtcacacgagcgtcgcatattacaaaacatgacggaattttatgtttttgtgacgtaaatgaagcgtcatctatgataagatttcttgtagtgagctttgcttaaatgccacgatatccgcctatcactatgcgcctccctgacgatctcgcggccattttcggctcaaggaaatcgtccccctaggtctcgatctaatctgactttgagctagatcagatctagctccagggaggtcggagtcatcctccaaccactcagctcttgctcgacggacgaaattgccagctatcttagctcccctaacatcggatctcaagcgaaaccagaaatcgtcaactacaacaatgacttcgacttcgataacttcgcttgctacaatgactactacgacgactactacggtgacctcaacgatgactacacttcgctgtacttcggcgtctttatgaccaacaatgagacagacgagcagagggcagcacgactggcagacgaagaacggacaaggttagaacaagaacgctaggagcaggagtggcagatattggaacgtgagcgtctggatcaggagcgccgtacaagagaggaagaagaacaaagacggagagaagaaaagggaaggcggagagatttggctcaatgtggacgtcgcactcgacaactcattggtcagactgttgtagatgacaccaacgtgtttctcacacctcagcagaatgcagtcggggcaatcaccctcatcgacaccatcctgcctgaggccccagactacgtgacgccaactctcaacaggatgaaggccatgatcgcggcaacacttccggacgattatagtggcagtcggtaacccaccacctcggcgcatcatcagttaggaagccgagctagttggtctaattctcgcgcttcgcactcaagttgggggcttcgagagcagttggttcactctccagctgttggcaatagagggccccgagtagatcacgagcagcagaagtcttctcatggcctggttgatctcagagaagccttgaatgcaagacggagagcgagacacggacgagggcaccaccactccacggagtgcattgatggcaatgatgaaggagtcactgcattcacacgtgacctgcgtcgagtgaattggccggccagcttcaaaccgactggcatcgagaagtacgatggcaagaccaaccctgagtcctggcttatcgtgtacactctcgcaattcgcgtagcaggaggagacaacaaggcatggcgaactacctgcccgtcgcattggctaactaggccagaaactggctcgctgggttactgcgaggcacaatcggttcccggggcgagcttcgcgaccacttcatcgccaactttgaagggaccttcgaacggccaagcactcacttcgagctctacaatgtgatacagaagcctaatgagcccataagggattacatccggcgcttttcagagaagcgcaacaaaatctctaacatgaccgacggcaatatcatcaccgccttcaccaagggagttcgcaacgagctactcattggcaaattcggacgcaaaccacccaggacggtcaaggaaatgtttgagaaggctaacgagtacgccaaggcggacgacgcagtcttagcttcgaagcagtccggcagtggctggaagcccaagaaggacagtggcaacaacggtgcaagtagcagcaacactcaccacaaggatcgcaagtgtaagcccgaggatctggttgccgccacgtccacttttcagcatcaacgaattcgtgtcaacacctaagacaagatcatgaatgcgccatgttcacttcacccgaactccaagcacgctgccaaagattgtttcgtctacaagcagtttgccaagcagtacgtcgctcaattcaagaagccgacttaaggggaaactgacacgtcaacatagaagaaggacgacaccgagccagctcaaggcactttgcaggattcaaggaaggagctcaaccacatcttcggagggccacttgcctacgagtccaagaggaagcagaagctgaccgaccgggagatcaacgcagtccagccagaagtaccacaattcctacaatggtctgaggttgcaatcgattcgatcgctcggatcatcccaaccgagtggtccacccggggcggtacccccagtactagacccagtagttcgcaacgtgaagctcaagagaacccttattgatggcggaagagcgctcaatatcctcttcgccaagactctcgacgaaatgcagatctcgaggatcgagttacggctgaggaatgcaccctttcacggagtcttccttgtgttttcatctacaccactcggccaaatcactatgccggttacctttggcactggggaaaactttcatacagataatgtctgctttgaagtcgccgactttgagacagcttatcatgcaatgcttggacgaccggcgttagccaagttcatggccatcccacattacacctacatgatgatgaagatgccaagaccacgaggagtcatatccctgcgcagcgatgtcaagcaggctatcacctgcgacaaggaaagctgcgagatggcccaatcttgcgagcaagcactcggccgagaagaagtctgtctagctacatctacttcaccagagggagacgtgcccgctaaaaatttgtccaagtcaagagaaaacgacgccaagaccaagaagattccactcgatcctttagatccttccaaaactactgtgataggcgttgagttagattgtaaataggaaagcacactcatcacctttcttcaagctaataaagatatatttgcgtgaaaaccatctgatatgcctggtattcctagaaagaagacgcgaaacctattaggcaacgactccgctgatttgcgcaagacagaagagatgtgatcaagaaagagttagccaagctgtttgtcgacagtcattagcgatcagtttcgcccgtcaatattacctaaatagaggagaacaagttatgcttgcaatgcatttttgtgttaaaataatatatattccactagcactaggattactaatctcttacacagaataagcataagatggaggagaatcgacaacaaaatggacgattaatcaaccggacgctgtcgataatcagacttaaaggaagatagaccaagaactcagaattgacacgatcgaattgggccaaaattcacaagtctgaagatagaagaggtcaaggaggccaccagtcgaattgtgggctggatgggcctgcccatggttcggcagaacccgtcgtgcagccgctggatccagggttggcgatggacgatgtggatggcttccctatggcggttggagggtattaccgacctttccaatcaccataaccgtcattaccagcttatttaaggccatcactctctccatttcaagacacacctcaagcaaaaagcttcatacatctctcaagtttagtatatagtctctagagtatagtggaatagaaatagaatagaatctttagttctccgagtcttcagaagaattcgggtatggctctagtagcttttccttcttttgtaagacttgcacttaatttaaaatactcttctttatactactttggtattgtattactttccgagtatatgatcgaaatgatcaaataccaactttattatatatccaagttatatttattatgatgctagcttatcagggagatgcaatggtgtgggtataatgatcgtatttacgatgactctatgtcatgacgatgatattagactagtattttgtaacttaagcgtggtgtttagattactggatatcattatttggggttatattctacggaagcgaggtgggccgctgatggtgacagctcagtacgggtattcctccgcgcgtgtacatagtcctccgcgtgtgtatatagtcctaagttaatttcctggggagggtactcctccgtatttagccccggttgggtagtcatgacagattgtcgtaaggaactcggcaatcaggggtggcttcttgaagcaccaggagggcattggaaagagggtattagctaagtaatcatataactaggatgtatgtgtaatatgtttgtatactagaagtataggaatatgatctttcgattttctttccacttagcttagataattatgaatgagagtattaatgcttctgcttagtgtcactatactctttgaattatattagcccctgcttagactttgattattgcaagtaatatataaattattagtatggttctctctattataatcttcccacgggattaaacaattacgatacccttggaatactctcgggtgaaatactacaatggtatatccgtgcgcttgcggataaattctgtaaccgtaatataccagaagtatttctgcgccattgctggcaattatgtttctagtaatgcgccatttcatcaaggaggtctttcatcccgactggttggctaacccagtcctggttcggaagaaaactaggcaatggcgcatgtgtgttgactacaccgacctcaacaagtcttgtccaaaggaccccttcggcttgcctcgcattgaccaagttgttgattcgacagccggctgcgagttgctaaactttttgaattgttactcggttaccatcatatcagcccgaagaagtccgactgcttgaagacttcattcatcacgccattcgggtcttattgctactttatcatgccttttgggttggagaatgcatgagctacatatctacgcatgatgcagaggcgtttcacaacccaagtcggctgcaatgtagaagcatatgtcgacgatgtcgtcatcaagaccaagcacaaggataatctcatcgctgatttggaggaaatgtttgccaacatccgagccttcaggatgaagctaaatcccgagaagtgcaccttcgaagtaccgttagggaagttgattggctttatggtgtctcacagaggcatccaagccaacccggagaagatcaatgccatcctcaacatgaaaccgccgagctcccagaaagacgttcaaaagctggctggatgcatggcagcgctcagctgattcgttccaagactaggcgagcagtggatgccttttttgaagctgctcaagaagacagaaaactttcagtggacccctgaagcctagaaagcttttgaagacttcaagaatttcctcacaactccacccgtattggcttcaccacacccacaggaaccgttgttgttatatgtctcagtgacatcccgggtggtgagtatggtgttagtcgtcgagcatgaagaggagggctacgtccaaaaagtataggggccgatttacttcattagcgaggtgatggccgacaccaaaacacgctatccacaggtacatatgttattatatggtgtcttaattactgtcaggaagttggcccattactttcagagtcactcggttacggtggtcacaaccgcggagctactgggcgtatcactaagtgggcattagagttgatggcattagacctaactttcaaagcccacacctcgatcaagtctcgagccttggtggattttgtggccgagtcccagacagatgtacctgcggagaagctggagtactgcactatgcatttcgatgggtctaagagaatttcaggcacaggggaggagttgtgctgatctcctataaattatgattattttcgaggatttaagccgcatatgctttgtaattgattcagtcattttggtgactataattttttttaaaccattcggttgtttattttttccttgactatatgtttaatttgttcaactaatcatatagtcgggggctacatctaattaggtttatctagtcgatgcacctagatttttcttttttagcccttcacagcatgagatgattgaggtactcaggatttatggtgaggatgattcaagtacttggattcttcatgaaatcactcgggagaatatcattaccactcaggagaaggttgtctcatcatctgtgaaggtcttaggggttactgtggagattatgggtaccatataccctagggctacgttacctgactggatatcgggggtaattcatagtaacagaatatgcaaagataaggactcgggtattgtattaacttgtatataaaggaagtatcccgtagtcttagtcggttacaattgtaaattatttatagaacttagaccgtaagggataaggtcttttatcttgttttcctgactccttcgcctatataaggaggggtcggggccccttgagggcagaatcacatccaagatcgtcagatcaataccacaatcggcggaatatatccccggacaggagtatggtattacttctcatcgagaaggcctaaacctgtaaaaatcctatgtctcataacccatccattttcatagcttgttcgccaccccttttagtattgccgaaatctagtttcgacgcatttgcaaatgaggtacactattatggtttcctttcagccgtgttccaaagtgaatgcctattgatatagttttggagctaaatgcaagtatgttcttaaacaggaaacaccagagatgttaaatcatctgaaatgcaagaagtggtacattgcagcatgcaagaactgctaccaagtactactatacaagaagaggtttctctttgcaaggaatactcattatctgtttacagttctgtattaaatacgtagtgcccctgttactttgttcaggactatggcctggtttagttccccaattttttttcctgactggccgataggaattcatgtattgacatgggatcactgttatagcatcactcttattatttgttgccaagttcattacgtgaatgcaaagtatgatcacattattacctgactggcattcccagataaccttgttgagaagactcctgccagcagtaccctatcctccccaaagttgagtgaccgactgagagagatttcaaactcattgaagcttcttagcactcggccagtgagcgtgagggcagaaaagtggaacatagaatgtgtccggagaatcaacacgattgcaccagagccaaaaactcctgaagtgcatttgtaatttgagcaagcggaagatcccaaggataaacttatggcccacagcactgggattaaggttaacctgtttttttttaattcactgactcattttattcgcttaatgtgtttaattgtaccttcttataatcatcttgcctgatgaattctctcttgttttttatgtcccacagaaatctctagctcaagagtgcttgacttttctcaacagtgctaataagtgagtttggcattatctttacaaccgacttcacaccacttctgcatttctaatgcatgtttgtttgtgtgtccattgcagggagcaattaaaaagcttaaaggtttgctctgaatcatatcgtggcagcccagattgcttctttcttaccattaacccactgatacatgtgtagggaatcggagaaaaaagggcaaactacatacttgagcttcgtgaggagtcaccagagcggcagagctatttaaagaggtgagcactctagatcaacaagggagtagccgttagacccaagcaactagaagttattatatgacaatgcaactcagagctgattcttttgctttcgcagataagtgatctgagagacatcatcggaatgaattcaaaagaggtactggagaatctgattgcaatgtgtacatttatctatgttctttgatcactggaagatggttttagttttcacaaacatttcactggattacactgtcactagagatattcctgaatagtattagactccagctgcttcattttgcaaactccatgggttttgggtgtactaaaattgccactgctttgttatcttcaccagatcaaaaagatgatgtccgggattatcgactcctaggaaagtaagcagcgcgagtgcgatggttctcctgtggagtgtgcatatgcttctttggtcaaaggtgtcatgtgtttgttttgtaatttttttatccagttgcttctctcaagagcgaatgctttggccaggagttggcgttctgtgagagaatcagtgctttgcagtggtttgctgctattatgtgtttcgtgtaatcatcatacagtgtggtaccaatattgataatggtgtggcgttgatgtgatttcctctcttttgatgtttgttgctataaatgccgatttattattttagaaaaaataatgagccgataaatattcctctctgttgatctgagaagctcagttctagttgttttttattccgacaaatatttgttctgatccgtatttgtttcgttttcgtattcgataatatttaactctgtttttgtatttggcgttgactattttgattttgatttaaaaaaaagtgaaaacggaaacggtagaaccggtttttgtcaagaaaacaataaaataaagttaatatgggtgttgggtttggtacggaaatgacatggacaagattagatgtaatataaaacttgctcttaagatactatgtggtgggagaaagtcctattaagcaaggcagatatatgttggatatgtagaacatgaattaatgggagggagaaacatagatgttaagtttaatgtgcttttattcaaaaatatagcaacctatactagaatatcacctattagtatgaatctgatggataggtctatattcacaatatgaaacatctacgttgaaacattttgcctcaaaaaatgaggttttacattccgccttccctaaaacctgagttttttttatttttaaaatactctatttctaaatgttgttatcatgtggttttacattatgcattccctaaaacctgagtttttttttaaaagatactctatttctaaatgttattatcatgtggtagtgtttcaacaggacttcatttaagacaataaagccctctagtctagtcctctctatactagaactctagaagtttacagtgcgtctcgcaccaacaccgaacctgggaagccacattggatgaaactcctacaaagccacccatcccacaatgcaaataactaccttctctcttatagtgggtcccaccatcagatgcttttcatcttccttctatctactctttacttttccccactcatcccctcccaaacgatcccctctctactcaactccggtgaccccgccggtgccacctctcccatcctcaccccaccggcggtgccacctcacctctccctcctcctaccggcggctccctccaccggagacgggcttggcgctccacggcggcagaggacacgacagcgacgagtctgggcgcggcgccacggtggcaagtcggggcgcagcgcagcggcggcgagtcgcgacgacggcgtggccgagctgcccagatccggtggcatcggctcgtcggggtgcggcggcggcggcgctgtggccttccaccgcggcggggcggagaggacgacttggagcggcacctcccccttcctcctccagcctccgtgccgtggcccgagcagctacggcgtcgttcggcggcaggcggctgcgcagcggtggcgacgacggtgtggggcggctgtgcttgtgcttctgtgtgtgcttttcccaatgcgctctctctcctcttcccagctgcgcttgcgcttttcacatgcttttcagcccaaaaacgggtgaccaagtttggctactcggtcttcacttggctacacatgtgaaggacgtggcaccgaatatgccattcctttctctcaggctgagcgtcacgtaggtgcattgtaaatgccctaatgtggccgcctgcatgccaccttttatcacgagagcttttagggatcgaagctttatatatgtccgatatagaactattctagggtcatgaggatatatggtccaaatagctgaaaaggagaaatctccacatcaacgcatggggtatcatccagtaaaatacacatttcccacgaggtaacacccacaaattcagttctcaagaatctcatctcctagccaatacccatggtctgattaggctgcactttcttttgactctctccaatatataataatacagtatattatcagatatatattctgaactgcaaacattatcttataagtgcatgatgcagagattgccgagatgattctccctgatccccaacataacttatgttggcatgtgctatgctgtttgcatctgaaatcatcttgaacgctcaacattataagaacatcctgcacatcgatggcaattaactatcaaatccaatgaatataaacagtacaattcgtacttcgtttcagctttcttttcctacagcataactaaatctaaacaactaagtattctatagcatagtattgtaaaagtaaagtcttgaaaaagctagtatcggcttattgtggacttgacagccagcggaaactggtccgtttgccacagttgatgaaaatacgaccaaccaactgtaataccaattatgagatttgctcgagtctcgatattataaataagtacaacacaatttatgatatggaagcagagcacttctagcatgacaatttgctctgagcttaataataagtcgtacaaaaaaatatcaaaaagttaatgttactctatgatagatggagataaccagttttaacggaaaaaaaagctatcaagtgtggttacgtagcacgtaccagtcgtggcctcttgtaattgaaaggctgttttatctccatcagcttggggcaaccatctatataacccgactctatttcagagacagatatagcaccaagaatagagatgaggtctggacacctaataagtatcaggttgagtcccttcagtgtcatagaactccccagatggctgttgtcgatatactttatgcttggacaacgggctaaactgagcatctgaagagaggatggtaatgtcattctcctctgcatattcaacttgggacagtatgcaatacatagatcctccaagtgagaaaaacggtggagctcatcaactggcactaatgccaattgttcacaacgtttcacatgaatggtcttcacgacaggcatataagcaggcataagaaactcatcaagactcaacagtgcatcgcaattcataatgatgacatttgaaagggatgaaaatactccaacagtgtgcctgctgcttgcctcagacacgcctatggatgtgagggagctacactcacgaaaatgcaaatcctccaaggatctaaggttacttatcaagacttgcaggggaatcgatgttaacagctcgcaccgtatttccagatatgtcaggagcgtgagtccacgaaaacaactcacaaagtgatctgtggaatggccaaatttatcaagggtaacccttctaagagaagagggtaaagccaccaaaccttgccaattgatgttagaacagttttggattttcagcacctcaaggtgataaatgttctttgactcttctgaatcacgagacgggggggggggggggggtcaaagaatgataggctctgaatgttatggcaagaaaaaacaacattttcaggcagtctggccggagccagctggggcaagattgacctaggtaagacactatttccaaatgctcaagattccaatgaggtaacaattcaatctgctcctttgtcatctgtaactgttcatcagttattccctttgtggaccattctagcaattgcttatctttatccttgttatataggaagccctttgattcaattttctttaaggaaatcagatcactgaaacctttaggatatcttttgaaaacacaacccttggcatttatagtctggacatgatataggcaactaacagatgaaggaagggtctcgaaagtagaacttcccaataaaccaaggtaacgcaaatgttttgaattgcctatgctcttaggtaactttctcactgttgaaattttaaaaatcaatacatggatactcgggagttccttgaaccaacagtcaatcacgggagcaaattgtttaatacttttgtaagattcattgcatactagggaccgcagttttttattttgtgtgcaaatagtcactaattctgtacagctgata

SEQ ID NO: 63132 - DNA, 2590 bp, Oryza sativa
aagctgagattttttaccgtccatcatagtttttggtacctcccgatactataatcggagccatccatccagtgagatcaaacggttgacaatcactggtactgcgaggtacgggagtcccgtgtgggatacctcccacttcattcgcatgcgtggaactagaggtggccaaacgggcggcccggcccggcacggcacgggcacgggtccggcacggcccgtttcggcacggcccgttaggcacggctcatgaaacgggccgtgccgtcccgacccacgtgccgagccgccggcccaagcacggcccgtggatggccgggccgtgcccgtgccggcacggcatgcgtgtggcccgccgtgtcagtacgggcccgtgaatgaaaaatgggccgtggacggggcacggttggcccaggaaccgaaatggcgcggagggatgcgatgcggacttgcggaggtggctggcgggctgggccatcagctaggaggggtgctcaacggacttgcggaggcggctagcgggctgggccgtcagttgggagggatgagatacggacttgcggaaggatgagatgcggacttactacagtagccgtgccgtgccgtgccggcccgcgggctcggccggcggcccaagcacggcacggctactcgtgccgtgccggcacggcccgttactgtagtaggccgtgccgggccgtgccggctacaggttccgccgtgcctcgggccgcccgttttggcccggcccgtttggccacctctacgtggaacaagttgaagggcagaattggactttcgcataatagacagttttcgcagagacggtttgaatccccgacaccggcaatctcactcctcccgatccccttccttcctcgacggcggcggcgcagccaagctcgctggcctccgcctccctcgctacaaccagcaatcaccaccctgcccaatcccaacttgcccctcctgctcccggtccaaatccggccgcgccgactgcagggagccgatatagctcagggcgtcgacgacctcaatgcaccaacgaagagatgtccacagcgacgagctcagtgcccgcctgaacacaagcaaagacgagctcggtaccaatctgaagcaacatgaatcgtggactggaggacgaacaggatgctgctgtccatggcatgaccagtacatcatatcgatccttcactagtaggcaagcatcttcatctttccttcaccatcatctctcgcgtcagcctcgcagcttatgcttctccccgctggcgtcgtttgacctcctggccgctcaatccacggagcggtggaacatggaggtgtcaccacgccgatgcaccacgtcgcgaggcaggcgccgaggcgtcgggagcccagacccagctggccctggttgattgccacccgtccccttcgccctgttcgtgtcggtggccagcctatgcgcgtcgctgagtttctcttcgttcactacccatcgtacccctctagagatcaacggttggattgtaatcggtacctcacgttacatgtacctcgaggtacagaacgctggaccggagaagcctctaagaagttttagggttggacacggttattaaaaaagtaggtagaagtaactggtggaggattgtgattggatgagtagtggagataggcggaaaacatgaatggtggaaagttataattggttgggaagagaatgttggtggagaagttgctatattttagcaaatcctgatggctaaaagttgttatattttaggatggagggagtaccaattatgagatttggtcgagtctacaagtactccctccgtttcaaaatgtttgacactgttgactttttaagtacgtgtttgaccattcgtcttattcaaaaaatttaagtaattatttattcttttcatatcatttgattcattgttaaatatactttcatgtacacatatagttttacatattttataaatttttttaataagacaaacagtcaaatatgtgctaaaaagtcaacggcgtcaaatattttgaaacggagggagtacaacacaatttatgataaggaaggagagcacttctagcacggcaatttgctgtgagcttaataataagtcgtacaaaaaaatatcaaaaagttaatgagattactctatgatagatggagataaccagttttaacagaaaaaaaagagctatcaagtgtggttccgtagcacgtaccagtcgtgatatcttttgaaaggctgtattatctccatcagcttggggcaatcatttatataacctgactttatttcagagacagatatagcaccaacaatagagatgaggtctggacagctattaagtcgaaggatgagtcccttgagtgtcatagaactccccagatggctgttgtctatgcactctatgcttggacagtcgactaagcagagcttccgaagagaggatggtaatgtcattctcctctgcatattcaacttgggacagccctcaatacatagctcctccaagtgggaaaagctatggaggtcatcaaccggcagtaatgccatttttttgcaatattttacctaaa

SEQ ID NO: 63133 - DNA, 15276 bp, Oryza sativa
agtcttcataacttgttcctggtagggtccatctcaggcattgtttatcacagttctccttattatacatgaagccttatgattcaattttctttaaggaaatcagatcactgaaaccttgaggatatcttttgaaaacacagcccttggcatttattgtctggaaatgatagaggcagctaacagatgaaggaagggtctcaaaagtagaacttccgaataagccaaggtaacgcaaatgttttgagttgcttatgctctcaggtaactttctcactgttccccgcaaaaaaaaactttctcactgttgaaagattaaaaatcaatacacggatattcaggagttccttgaacaaacagtcaatcacaggagcaaaatgtttaccacttcggtaagattcattgcatactagggaccgcagttttttattgtgtgtgcaaatattcactaattctgcacagctgatattttcagtagtgaatattgacagatggcgaacctttgaagggattttagctaggtcacttacatgttgtatgatgaagcactcatctttagagactagctgtgcagtatcatgcatcaagtcatgaattacatacgtaccatgctcaccagctgctttctgaaagaatgaccgatttaaaaggtcatcaaagcaagagggtgcattttcaagctccacataaccttgtgctaccgaaatatctgctagaaaatccttttcaaatttgtgatcctttggatacatggcacagattgagaagcatctttttatgtcctgtggcaggtaaacgtaacttagtcgaagggctggcaaaatgtcagtctcctcttgttctaatcgccatagctcacttttcaatatgtcctcccagtgctctatgcttaggttgcttttcaataagtgtccaagagttttggcggccaaaggtgaacccttcaacttgggaagtatagcttcaccaatgcgctccagctctggcctgttgcgacaactgttgctccaactctggacggatccgaatgcacatagtttgaagaaattccagaaaacaccatgttgcaatcccttcagttcatagtgattactgttgctgactaggttagcaaccttggaagatctagtggtgaccaaaatcatactgccctcaagaccattgcttaaagttctatgaaatgttctccatcctttctcatcttttaagacatcatcccacatgtcatcaaggacgagtaaaaacttctttgacttgacactatcacgtaaattaaccataagagtatcccttgtatcagaatcttgtaactttactccaagagacttcagaacatctcttgttaacctgtttacctcgaattcatccgagacacatatccaaattatgcagttgttgaagtgattccgcaccactccatccacacagatttgttgggccatggttgtcttcccgacacctcccatgccaactattggcaacacaagcaactctgtcctccttgcttcagctgtagtgttgcatgccacaggcctgcctctcttgtgtccacgtactcttagcttttgtttcaagtcctccagttctttttcacgaccaaaaatctcatctggctcgtcgaggacatgacatgtctctggtctgacaattttgtcaaacttcttgggtgttttgtgcaagcctaaactgttagattggtcaaaaacatgcttcagtctttcttggatttccatcactttcctgaatttgccactgaagttaacattgcccaagaactccaaaaagggttcatgcaagtgatcttgccctaaattcttgctcgccttcaccttcaccttgagagcataataattgtactcatcaaggaggtcctcggcatcgtacactacatcctttatctggcgaaggtgcccagcttctgtttctttgtggctatgccactcaaggcggtcgatgaggtcatgcattgtgggtgcaattaatggttgtttggatcacccaaaggttgtgctcaagcttctgaagatcatcctgaatctgatgcagtgtagctgttcttctttctccagctgatgctgatgctgatcctgtccctgctgaacccacttgctgttgctgctgctgttgagaacatacggcagctaagacgtgtggtgtgacccagttgaagaattcccggaacgcattggcgtcagcagcaagaccagctgctcccctcaatattccaacgaccttgtccatagccaattgagcactgctgtatgatcataaacgcaaacaaaatcaaactaaacgctaagattttggagcaggtggtcagggaatgttttaccagggacatgggtggcggtctagcctgaagattggtgctccctgatttttactgctttccttctcttgttacaaactcttttgtgggtttgtatgttttggctgtgtgcatcctagttatgcagaggccgggaattttcttagtatggttctatcaacttgatgtaatcgtctgagattaataaaagcttcctttataaaataaaaaagagttccatgtcgggagagatgcaccatgccaaagctacatttactgtatctagtggttcaaggcaaatctatcacctatgtatctactattttttttaaataaagtctagaaattagggcgggtctatattatagatccataactaaaaatggacaggaactttgttttgtgagagtatagcctataggaactaaagatatggttttattaaatacaattctatctcaaataggcatatgatttagaaggaaatttgactagttttggttaaagctacatgtaagacaacaagcacaattttgaaattttgttcaaacattacttgtctagtataaagttgaacaacacaaaaggctgcaacatgcagtctgcctgtacaactaaaagtataattgtattaaatacaattctatctcaaataggcacataatttctcaggaagttctattagttgtggtgaaagcaacatgtaagacaacaggcacagtttgaaatttttctaagcttactactacattataaaattgacgaagaacacagaagactgaaatatgcagactttgggtacaattggaaaaacagtttctgttgataattgtagtactattatctgatactcaaaaaatatcaagctggcataaatggggaaaataattggatcacacacctgggtccttaatttgttcacaattctttctacccaatgatcagaccacctagctagctcctcttcttgatcttgctcttcttaatgtctgctacaagcaaagcgaccacctgcttattcaaatgttagaacaatatgactagagattagataggaaaaaagagtacagatacactagtttcagatagagtaccaatttcatctcccaaattcaaacgaagagaactagatgaaatttggaagagtacaacctccaatttcagttagttcttttcataggtagaacaagggactgaactcatttttgggggcataggttgcttccacgtacaattgctcggataaccctctgggaaattattaagaggaccccaggatgttttcagaacatggcagaaaaaaagagcctgccgctgccggcggtggcctccacgactcgaccgcgcacggttgcttggaatggaccctacattttaacaaaaaaattgagagcagaatttaaaatagattgtgttcaatttttatacatttttatctaaaagtattttagggctaggtaaataagattgtgaaatactcattaccacccttaacgtgccaatttgatattttgccatcctccaaacggggtttcgtttttgctgtctaaaagcatctccaatagcctctttaaattggactctccaaacacctgtatagctaactatctatctgatttggctaatcaaactagatggtcactccaacagactctctattaatcctctctaaaataacaacggacccacatgtcagcctctactcctcttcttcctctctttctcccccttcttccttctctttctttcttttcccttttctttccttcccgtcgtcaaccaggcggcgcatgcagcgcggggaggtggcaggtggcggcgcggcgcggggaggcggaaggcggcgcaccgcgggtaggcggcgcggggaggcggcaggtggcggcacggcacggggaggcggcaggcggcgcaccgcgggtaggcggcgcggggaggcggaaggcggcggcgtggcgtggcgcggcgcggcggcgtccttgctccctctccccacaggatctagaggccgccgctggccttgccaacctcggcccgctctgctcgatgaagcgacggcggcggacagcttcggggggcagcggcagagcttcgggcagggatggcgacggcgagcgcagaggctagcgacggtggcggcggctcgcgacgatgacctcgatgacgacccgacgacaacgactgcgcagaggaatagcatgtggggcccaccatttggcgaggagttttggctggccaaatctaaccagctagctagcgagtttggccatctgttggagctcttttttttttgtcttgaatagctaaaatttggcttggagagactaatagagaggctattggagatgctctgaagagccggcctggctcaacacgacattgacccacaaatggtgcagaccattaaagcatcaccggtacgactcatggaacaatccatgctatgctaaggtcgagttgtatgggcccaaatatgacacgtgggtcgacgaatgtgtattaatatgtttggcatatcaaaattaaaatataagggaaaaaaaggaaaaagaaaaagaaataaatgtgaaaaagatgataaaaaacaggtccccgacccagccttctcagtaaagcagcaacaacatcagtacgatacgagaggggaaaacatgagagagcttgttctctaacatgtgtgatctacaaggggcaaaatggacctattgggttggttgtccacgatggcggaataagtccactttgacttcctcaaatataagtccaatctaattcgtatccctcaatcgtaataccagatatcttaaaccctcgactattaaaaccaggttgacatttcgcggcggcaccgatggcagggcggcctcgctgttgtcgccgaagccaatggcgctgcttagggagtgggatggggacggggagagagaaggtgaggaagaagaagggaacaagaaagagaggatgacatgtaggcccacatatgctgacttagtggttggactaggtcagcgagccacgttagcgaaaatcaacctcaaagccaccgagaaagttgttttgcaccagttttagtagttgagggtttaagatatctactgcgattaaggaatacgaattaaattgtacgtatatttaaggaagtcaaagtgaacttactcccatgttggcacactcatctgtcataccacatagaccaaagtagcaacaaaaacgtaatggcaattaatagtagcatatggagaatggttgtttcttatagtggcaaatagttaaaatttttcggaatcacaaattctcatcttgatgcctcatgctcgcatgccacacagcatctaaatgttcttgtcatgtagtccatctattccataaaaaataacttctggagatgaatctggataagtgattgtcagattcatcccattcttcttataacggagggtgtatgtatcgctcgttgttatcatacactccatccgtcccataaaaattgagatgaatctagatatgtttgttagattcatcccattcttttttaacagagggtgtatgtatctgcgagacactatttcaaggatttcatccccaagaacagcagatgacgatcctattgatcgatgtaattgaagatagggtcgaagtgctcgcaccacaaagtttttcacagtatggaggcacacacgtgtacagtgtggcggagggcggaaaaaaatttaggtgtggccaataaactaccacacgcaagagctagcacagaacaagaattaagaaaaaaattcaatacacaatattgtacaacgcaacattatctcaaataagtcatagtaatgagcactaatcacaagttcacaattcattatccatttgcaaacaaatgtaaatataaaagtaggtataaaaaaatacctcaattcctcaagattcactgatacgctttgaaattgcaatgttctgaaattgtaaaaaaaaagtatatttgataaattttggtaaatttgcaaaaaagtactacggccgtgtttagttgttttggtaaatttttttttatgtacatggatatatatttgaactattaaacatagactaataacaaaacaaattaagattctgtctgtaaactacgagacgaatctattaagcctaattaattcgtcattagcaaatgtttactgtagcaccacattgttaaatcatagtgtaattaagcttaaatgattcgtctcgcaatttacatacaaactgtaccattattaatacttcatgcatgtgtctaaacatttgatgtgacagaaaagttaaaagtttgaaggaaactaaacacagcgtacctctctgtgatgccagtgccttcccttttctctttctgtccattttctgatgatgggagattgggagtgatgcctgatggctgctcctgcttatgcttgccttgcttggtgcttggtgctgcggcgccagccgccctgcttggcgcctgcgcggctgcgcccctggccggctggccactaactcgccgcctgccacgccgcgccgccgtccggcgtggatgccgcagctctgtggctgcgcccaggagcccggcagacggcgggacatttaactttatgtcacttttaagatgttgcaattaattatttgtcactcgttgtctatgacatatgggactatgtgtcaagtagcaaataatttaacaccccttataagagtggcaaatagttaattattccgcaaatggcagccatgcctctcctcgccttcgcctgcccttccacgcgcggcgtgtcgcttcaagactctagcagaaagtaccgcagtagctgctgtcggccgaaggggattgaggattggggagggggattgctggattgggtgttgggggaatcgatggaggtggatgagatggggaaattttggtctagggttacacaaaacaagcccaatggcccgcgggcactggagttcgccaacttcgcgaagccaatgggaggcaccgccatcaacacggggagctcgccacggttcgacgtgttcggcaaagacttcgggtgggggaggccggcgaccgtgcggagcggcggcacggacaagttcgacggtaaggtgacggtgtacgaggggccgaccggcgccgggagcatgtcgctggaggtttgcctgactccggtggcgctagcgaagctcgtcgctgatgaggagttcatggacgcggtgaccgcgccgtgaactgcaggggtgtttagattcaggagtgtaaagttttggcgtgtcacatcggatattatataggatgtcgcatggggtgttcggacactaataaaaaactaattatataatctatcagtaaaccgcgagacgaatttattaagcctaattaatccatcattagtaaatatttactgtagtaccacattgtcaaatcatggagcaattaggcttaaaagattcgtctcgtaaattagttgcaatttgtgcaattagttattttttaagtctatatttaatactttatgtaggtgttcaaatgttcgatgtaacatggtgtaaagttttaggatgagatctacttactacccattgatgtcagtatcatgcacttcctatccgtttgtttcaatttgtgagcagaaaaattgagaaatttcatcatcatgggtggcagagaaaatggtataacctaccatgtgaggtggtaggtggccagactctgacaatggaggatcagatcaggagatcatgggaaatgatttcttttaaactattgttgcttaaactatcacaaatttcatcaccatgcttcgctattgtttgtttgcacagtcgaaccaattagtatcgctgcttgcgtgtcttttaaatagttatgaacatatttaaaaaaattaacagatatgatactcgctatgttctataatattagaatttagtactggatgagacatattctagtaccacgaatttggataatggacttgtccagattcgtagtactagggtatttctcattattactaggtccttatattttacgatggcgtgagtatatcacttcataaatatacgacttggaatttaaattctataagatgcaacaaaattcaagtgtgaatatatatagcactgcacaatgccacggataagctacatcgcacatattctactagtctagcactgtacggtctcgcgcactcaccgcgtgaccctaagtagtctcgcatcctcatcacgcaaagtcgtacggtaacacgtgattttgcactttcattctacgacaacaacatagttttacaaatccctttttaaatgtgtatatttatgtaaaaccaagaaaaaaaaaagagaaggtttgcagccggtctccaccaattttttttgagagaatctattctgtgtaccactgagttcgttcgagttctcaatgatttgccatcaacattgcctctttgtttaatatactggcgactttataaattgttctacaatataccattaggttgagtcatcttttcaaaaatatccttatgaacatataaggttaataattgatttatctcattaggagtgtaaaaaaacttttatggggcctccttatgcacacaacatggaaatttaaatttgtataggagtttcaactttttgacaattctattttttctaaaaaagatactttataacttatctgttatacagtatataaaaatactttattattattatttttaatataaatcatctttcatacactacagaagatatttttatgctatcatctcatgtataagcaaattctctctcatataccacataataatatttgtttagaaaaaactaaatataccagaaaaaaatttaaaacctatgtacaaacttccatgttgtgtaaggaggccacataaaaattttcatattttttgaaacttataacgagataaatcaattgtttatcttgtatatctctaagggtattttgagtatttttaaaaggaggtccagtctaatgacatatcgtagaacaattgctaaagtcgccagtacatcatagaaagagacaatatcgatggcaaatagttgaactcgaacaaactcggtggtatataatagattctctcaattttttttcccacgcgagggcattcccgttagttattaagcaaatattaaaggtctatcacatctctcatccgcaaattctaaaaacatctttagaatgcatgattcaacactggaacataatcgaaatgtaccaataaaatgttatgcgtgttgaattacggagtgttacagaaaccaaaccatagaaaagtttccaaactaatgtttgaatgatacattagaaaaaacaggcaggaactaaggcataacctcattctttttaataaaactttttatggattggcttattataaactaccagtaacatgccatgtacggattagacaaatataaatatagatacctttttataataagtgtaatagggacaaaacattggatctgatgcatatgcatacttacgcttgtgagcgtgttgcacgcggtgggaggaagagaaacggaagatttccatccaaattaattaatccctatagtggaaatggaaggatttaatttatccctatacaggaggggacacggaaggcagtagagaaattgcgaaataatatatagggatcaatcctttatgccaaaggatttcataggattttttttcttactttacaaatcccaccagatattcttcccttttttctttgtttcaaaggagacctgggattataaatttaatttgttgttttgcacgatgtatgttttacaagcaaaaaggtagatttaatattcaacttttagttttggggcatctacaaatttgctactgacactggtggagaaaccctttgtagtcccggttcgtaacccccctttagtcccggtttccaaaccgggagtaccaatccggcactaaagatcgctatctttagtcccgggtgaaataaccgggagtaaagatcgatctttagtcccggttggtgttaccaaccgggactaaagatatagctgacctttttttttttgcatgcccctgttgctgcatggtttatatatatatatatatatatatatatatatatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtgcacatgcatatagaaacatatgtagtcatatattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaaaaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagtaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggtgtcaactttcgccttctttgttgcccttatgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagtttttcaaaggaatatgcagctcacatggtgtccgctgagtgatgtcatcaatgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgtgttcatcaaccttccttgccacctcctcttgcatgttgagttcgtagctcgatacccggaactctaggtctgcaatcttcgcctcgttatctctcttgctcctcatccgactcctgtacgtgtggatgtcctccttgaaaccaatcttccaaggaatcacccctttccctcgagttcgtcctggatgctctggagtctgtagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttatttctttccatcatcgccttcccttgttcacctgtcttatatgcaacgaactcgtcccagtgatcccttagctttgggaatgtgtcgaagttcagtgtctgcccctttagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccatgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacatgtcttttctgcaagataaaaaaaatgtattaggataaatgcgaagtaacatatatatatatatatatatatatatatatatatatatatatatatatatatacatgtatatatatatatatatacatgtatatatatatatatatacatgtatatatatatatatatacatg

SEQ ID NO: 63134 - DNA, 2298 bp, Oryza sativa
gcggcgtggcgacggcggcggcggcgtggcgttgtggggccgtggcggcggcggcgtggcgtggcggcggtggcgtggcgtggcgtggcggcggcggcgtggcgtggcggcggcggcattgcgcgcgcggcggcgaaggcggcggcggcgtggcgacggcggcggcggcgtggcgttggcatgcggcggcggcgttgcgcggtgtcgaaggcggcggcgtcgaaggcgacggagagagatcgagatcggagagatcgagatgcatgaagggagatgcggcggctctcaccctagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttctcaacaaccgggagtaaatatcttttcccgctatttcgaaattctttttaaacccggttagggttaagaaccgggactaaagattcccgctattaattataagtcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctagtaatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtcgcttcatttgataggaggatgctagggtcaatcgtcaccgtaaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacataaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacgg

SEQ ID NO: 63135 - DNA, 778 bp, Oryza sativa
aacatcgctatgtctagattcattaacatctatatgaatgtggacaatactagaatgacttacattgtgaaacggaggaagtaatatctactccctccatttaaggttataagatgttttaactttgatcaaagtcaaactatttcaagtttgactaagtttatagacaaatatagtaatatttataatactaaattagtttcatcaaatcaataattgaatatattttcataataaatttgttttgggttgaaaatgttactacttttttctataaacttagtcaaacttaaagcagtttgactttgaccaaagtcaaaacgtcttataacctgaaacggaggacgtagcaaacaacttagcttatctcttaacagcactgcagcggcaaaacaactttcaaaattttcagcaattcagaacagaacctaaaccagcaaataaccagaccaatcatcagtgcagtacttcatgcccacgttaaatctcctgcgcacgtaaaacggagcggtttattagcacgttattaattaagtattaactaattgtttttaaaaattggattaatatgattttttaaagcaactttcgtatagaatatttttttcaaagaacgcactgtttaaccgtctgaaaaaggagagaggtgaattgggaaagttagggaaagaactcagccttaatagcagcatctcacatgaaggaaatattacgcaccaaagtacattgactcacaaacacaccgcacacgcctgcaatccgtaacactagtcttcca

SEQ ID NO: 63136 - DNA, 16746 bp, Oryza sativa
  unsure (1)..(16746): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcccatgtaggccacgaaaaccacagagcatagcataagatttgtaaattataatatacctctgaaaaagatagccctgcatttctatctgtgtaccaatagaacattccttcttgaatgtccacgctcaaagcaagagacatgtacatgtaaacacatggtcgccatacttcaggacattttaaggttgccatcattgttctacttgcttctacaaacttcatatgggcctaattttttaacagtagacaggaaaatgtcaatccaggaaaacaaaatagtacttatatctgacatgaaaaagcaaaattgtttaccagctcatatggaaagttgggcatatggacgtcctttatcatcattccagctaggattaccagggcagaaggtattgccaacatgccaagggcacccttgagaaacacaagattaatctatgatgagacaccgtcacaagaaaaactgaaaaagcagcagtggataaaagagagaagcaccaccaccaccacttcacttatatttatgcagaaacaggatctttcagtggagaataatttaaatttaaattgattgccaggactatagtaaagtggtataaccattgtgattctcatttagaagtacaaagtactaacaaacaagtaaaaccaacgatactcacttgagagcctattgcatggacaaggaaaccacttattgagaatccaataagccctcccacagatgcacagaatccgtttaagcttatcatgtcagcagcaagatgagggtgcactatactgttttcagcaacacaggcatctatagttacatcggctattgccacactagcacttccggccatcaatgccaacaacgcgaacaatacatgaagcttgctgtggagagataatacaagcatcgcgactactcccatgaagcctgcaattcctcagcaaacagggaggcataatcaataaaaataattccataacctgtaactgaataacagtcgcacttaatcaaaggaacattatgttgaggaaataacagtagaaaaaaacatatcatcagacttgtcagtactaaataagtcaccgggaacatgaaactatgccacgttcctcgtcccgggaacgccgttcccgttctgggaacacgggaataacctcgtttccccccatgttaaaacataaaaaatgtagcgtcccatgttccttgacccatcgatccgggaacttttatgacataggtactaatgctaccgtgctacggcaacagctgatatatttgagttagacagcaaggctgtttatagtaatgcacctacataactgcattgatccatccaaattaggtaatggacaaaatttgctccttcaacccttttatgtagttcaatgatccaaaatattaataactcaatggaaaactgttctatgaacttcggcctaaataattaacactcctcagctaaagcctagtaatgaaaagagatagtgtcccaaggagcatatcgaaactcgatacgcttccttgctacaatttcagcatctaatcatcagacatcactactctcaggtcctaaaatttcagtttgcgattcatgattaaccagtaactcgtttttttttaacaaaagatgattaaccagaagttttccattgcaatcatcatcagcagcagcaaaatgggaagcgtgaagtactgttaccacctgcgatgacgaagtaagggcggcggcggtagccggcgatggggaggacgtcggtgaggaggccccagagcggcttgaccatccacgggatggaggtcaccccctggtacacctgcgccgccgacggctgcacccgctgcacgtccttccagtagtagtccgacgccacccgcatgacgccgccgccgagcccctggctggcgccgtacgtcgccaccacgcccgccacgaagctccagtgcagctccctccccagcatcctgaaccaccccaccggcgaccacgcgccgccgccctccgccgcatcgacggcgaggaggacattggcctcctcttgcctgctgctgctcctcccccccttcccctcctcctcggcgcggaggtcgtcggcggcggcggtggccggcgacatcttcttgcgcaaagatctctcgcctggttttacccgaattgctccggcttgaatctggagctcggattccagcaccagatttgggtttcttgaatccaaagctcggagctgcgaggtaggtgcatcagtaatcgaatcgatccccaaaaagtcttaaagaatcaagagaaaatgtcggggtcttggcaagaacatcaaatccaactgctgcttcaacctctcagctcctttcacatgcttactactccacacagatagaaaacaatcgccaaaaacagaacagaaaaaaaaaactatatgctaaatttgccgcagaatgctgcctaattgcatccaaaaacaccactcgagtatataaacagcagagatttggtgcctgaaaacaagaaagaaaacgggggaaagaagtggagccgaggagttattaaatttgcacgctagaagtgaggaagtccaaagaaattgagagatcccttctggttggtgtgcaggtgtagtagaggtatagatggccatatggcccgaggcccacggcccggcacaaagcccgcaattttggcccggcccaagcacggcccggcccgattagggtcgtgcccgtgccggcctggcccgacagccgggccgtgcctgggctgcaccctcggcacggtgggccggcccggcacggcccgatcaaataaaaaaaatatagggacaaaaaatagacttatataatcgtataaggcatggcccaagaaaataggtatacaaaatagacttattttccagccatttaaacacaacccacagagttgagggaccaaaaatagacttatttccagccatttaaacacagcccacagagttgagggatcaaaaatagacttatttccagccatttaaacacagccacagagttgagggaccaaatataaactctttctgtgaggcagcacaatagcccatcgtgccttcgggccggcccggcacggcccgactagtattgggccgtgcctgggccgtgtatgccgcccgtgggctggcacggcacggcccggtgcatcggtcgggccgtgccggcccgacaagcctcggcccaggcacggccgggcttgggccgtgccgtgccgggcggcccagatggccatctataagtagaggagaggatagccgtttgtcttattaaaattttaaaattttaagagaaaattcgatctttagtataggaaataaagcggtaccaacaaataacacaaaaaaaaagtttccactttcgatccatagcataggccaccgattttttttcgtcctgtagcacttccgtcgcattttgaagtaatagcgttagatcgggagtagagaaaatttttgtcggactcatttgcccttccttccccacattccccaccaggtctcctcttccgctccctcctggatggcggcgcggcaaccatcggcgtgctgggagaacgcctcgtctccccgccaccgccgagcgagctgcggcgctcgtccggcgcatttcttccccgccggcgactacttctcctcctccaccggcggtggcggctgaacagatgatgatgatggcgccggcggagtccgtggcgcacttcgactctgcgctcagctcgctcgtgtcgtctccgcagggcggcggtgatgagatggcggccatcggcgacctgatcggccggctcgggagcatctgcaaccacggcagcgccagcgccaacaactcgtgctacagcacgccgcgaacgcgagcccgaagctgtccaaggtcgccggagccggagacgacagcgactcggcggcggcggcggaggataagctggagccagccacaaagactacatccatgtgaggatgaggaggggacaagccgccgatagccatagcctcgccgagagggtaattaattaattacctaattaatcaactaattaattagatcctaattagctttttgctggtgcactaatccgcgcggctcagcttcgccaagtaggagcagcatctccgtgaagccgtcgccatcgtcgtcgaagatggccatgctctcgctgtagcagcagcgagcacgctgctcgacagcccgaaccccgtccacgaagtcggagagcgggacggtgggtgctcgctggaggaaacggcggaggaagcgccacttgtgctgctccatggcgtggagctcgtcccggccgcggtggtagggcccaatggacaccagccggggctcgtacagctgctgctgttgtcacgacgggagccggcgggaacacggaatggtgtgcggctggtgacggagacggcggcgacgcgactggggacggggatcgtcgccgcgtcgctgtttggcgacggcgccatcgtcgtgggcaccgaccggagagaacgagatgacacaggaagacgaagggcaaatgggtccaaaattttttttctatacttcaatgtaacgctgttagctccaaacctgatggaagtgctatggagcgaagaaaaaccggtggcctgtgtttctaatcgaaagcgaaaaatttttatgctattttttggtaccgctttttttcctatgctgttgatcgaattttctcaaattttaactgtaattctgcgcgctcgctaactgaaacctacccctatgcaatctcacagcttctgacaggtgggacatgctggttgggaccacagagcagtgagggtaatgcgtgcctgtacgacgagtgactagcttaaaaaaattatacgagttgcttcgaaaaatcatattaatcatttttcagaaaaaaaaaatattagctaatacttaattaatcacatgataataagccacctcattttacgtgataatacgtgttttacgacctctaacataccgaacacagcattagacgggtacagttaccgaaaattggcccttttacaaaatttactgtaagagtgaaccatgtcgaaaactaattgtaaaagtgagtctgacctcagcgcatgtagatgtaacatcttaacactagggttggcactgtgctactccctccgtcctaggaaacccaacctagtatgtaataggtgagttttttttttttttgacagatgaagtattctccaacgtgactcgaattttccaaattagcatagttcagcaccatgagagctccggatcgaatgaacctgttcatggtactaccatgtatggtgaagtggctctagcctagtggtagagcacctttcactctcatgtcttggtggctgtggttgtggttgtgggttttttctttaaaatatcacatgttttgttccaattttattttataaatatcacaataaaaaatgagaacttaaattataatattaatattaatacaatatttagctcaataactataaatttgtattttttgtacatcttaataaataaaagttacatctttctgtttaaatttaaaaataaacttaagaacccatttgaatcgcaggattgaaaaaggtgatgaatagaaaaaatacaggattctaatagaaatgtaagtgtataataaaagattgcaaaacacggaaaaaatacatgaatgatcgtttaattgtaccacaggaaaaacgtatgaatcggatgagatagattcaaaggaaatttttcaagaggttgggctcttgctaaatttcctccaaaatctacacacaacgagtcatttcataggattttaataggatttagaaagtttcaattctttaaatcaaagggccaaatagaaaaattttctataggatttaagtcctacgagattcctatataaattctttgattcgaagggactctaaaacatagtatgaactatcagtagaaactagttttcacttttcagaacttgatggtaagcctcccgtgaaaagaaatggaaaagatgaagtgcatgggggttcaaatctatgatgcaaggataggagccacagacccgaactaaatttgaaaatatattgtctatttattttttctcagaaatattcgggattcaattttttttgcacaaatataccgtcggtatcgctcaacggatatgcgaaaatgacgtgggcgtgacaacgctgacaatgtcgcacgacgacggcgcaaaaccactcgttctcgcgcagcgctggcgtgagaccgagcggtctcgcacaacaaaacagattatcatttcaaaatggcttaattagtgattaattagcctgattagcgaattaataaattattaatcaatcactatctattattaattaatcaataatcatgacaattaatcactaatcaatcaattctcaaaacggtttcgctgtttggccgtgcgagacctctagcattgtcacgtccacgtcattctcgcgcagtggttaagtgatatcgatagtatatttgtgctaaataatttgaatcccgaatatttctgagaaaaaacaaatgaacaatatatttcaaatttaattcccactaaccctacaactgagctaagaacgttcaaacaaatatggcttccagcatatttggaggcagcagaggtcggcgccaagccgccaactgtgttggcactgagatctcatgacgtaccgaaagttgccacctcggacacaatctcagcgtcaagaaagcttaagtgattcagacacgatgccactacatctaattcgtttcccgaaagttgccaccttggacaatacaccaatagattgaactaggagtgtttttcccttaccccaaaattcttcttctcaatgtatgtcaccgcgaactaaaagcgcacaacgcgaactcaactggagcttccgacggcagtagaatccagcaccagccagagctcaccccccacgcaagcggcacaattaggaatatctgattgaaaataagaatcaatttgcacaattaggaatatctgattgaaaataagaatccatttgccacaatggcagtgtttggtttggttcataaataattctttggtgtttggttcataaataattctttcgattttacatgcgtactggtctcctcctggagcagagtgtagacgcggctcaacacctgttgtgctcgtgacttcgtaacaaacgtagcctaaactgcagtttgttcagctcaatcacaacattttagtgcttacctttttaacggaccacacaatctcatcagtaacgaaagatattagcaaaaacacatagcagccaccaacaacacatactcaacacatagggcatactcctgtgttcttggtggctgctatgtgttcttagcactacgaaagatattagcaaaaaacacatacgaaagactgctccaaaccgggatgaagacaagatacattcaattcttaaatctagctacagcactaacacaatttactgcacccacagagcaatgtttgtcagggtaagtcatcttacgcttacccctattcatctagaagaccaatgggtatccataatgaaccgtaaaaccaacccaaccgtaaagtctgtaaccaatatcccactaagactgcatggcatcatctcctgcttcacccggcacttcattgaacatgtactggctctgatactccatcaagtactgcgtcgatctcttgacgtccaggaacagctggtagaccctgcttatatcctccatctccacaaccttacccttgcgtttctggcaagctaatgcagccgaagtgatcaggtggatagcatacctaagggacgtctccactcctatctttgtgagcaaaaccttagcatctgcagacatttccacatcttttttattggcccttgatgtctaggatcttcgggatatcatcctcggtgtaaggctgtgtcgtgatgattaacagacgatcaaggaaatcaggtggtatcccatgtggtgatcggtagtttgtcccacgtatggatgtgatccctcggttagttgcaatgactagaattggagccatgtcattttccaatgcacggtttaggaaggagaagcattcgatatctagcatgtggacttcatcaataaacagaacaccagggacaatctcagccttcccttcctccctccactcagcaacttttgtatcaatctgctctcgaacctctgcacgaatttcaccagtgtcaccagtgaaaagtgcaagaaaaccttgtgtctggacagcaataacaaaaaacaaaaatgagtttgtgcaagatagtctcacttaatttttatggtaggtagaaaaccacatctgaaagccaataatcttggtctaacgacccaaaaactaccaagccagttataagttagatttttggtgattaaaaaatggaatgttcaaaaagattcaccaaagaatactatttagaacacatcagatagttgtttggctgataacatacttagagagagagagagagaggagagggagacagaacacatcacaatcacgatcagttcatgatttcaaactagttgaagcatattcatgtaccttgtcttggaacatgttcatttatgtgcacatgatactccctctgggctgataatacttgtcgttttagacaagggtgatgtcaaactttagaatctttgattatgaatcatttttaaaatatttttctttcaaatatggtgaccaccacatggatagattagtcttaaaaagcactttaataaaatcatatatttgttaacacttttatacatattataatgaaaaataatggtcaaagttgttttttgtacactgtgcccttgccaaaatgacaagtattatcaacccggagggagtaattgctaagctatccaaagtaccattaggcttgactaattttcatcacattatgtcctctagcaacatcgtgcaggtcctttctttcacaagagttacaacaggaggctgctctctattgttatttctctacgggccaaaagaaaaattagatctgatttgggcagctgaattgtatttcagctccaagcccaacaagatcatatatgccatccagtagtcagtagaccatattttcttagtattggctaactgtgtggatgcggcacttagtagggagaaactgatccaactagggctgtccaaatccagtttaaccgagttctgtcaacccgcattttacatgtctgcaggtgaatgaatgagatgactaggtgcgacgtagtcactggaacactatggttagctatggtttggccaattttgctaatgcaggaatgctcaaccctttgatctagttccagcgtcattcaataggatttgggtggtgctgagaatgggacaggggttgtacagtataatgcagggacttccgtgcaaagagcatggtcacagtgtaaggcagctaagcaagattaaccgatttcaaatttattatgtgattctgatcactgcagatacacgacacagaaattattttccattcaggctcagaagcaaaatacaagattgtaaggcagtccttaatttggaatttggagcgacaagctgacaagtgatcctttgtgtgcaaacgctggaacagatttttcaagactgaaaaagaaactttggtggctaagctatcacctggataattaacatacaagcaagcacacagcacatatgtccagggtaactgaaagtcaatgtgaaataccagagctgatagaatttgaaatacttcagttggttatttcacttgtatctatttttcagttgagtgataccaaagctgacagagacttcacttttgtccgcttactcgttgcagtaagatgtgataacaaacgccctttaatatgtagttctctactatgccaaaatgattaaatacttcaatgtagatttcttgtcaggtagtatgaaatatctactccagtaatggacgaatttttgggaagggaatgtgaaattaccggctattgatgacatcaatttcatgtaaggtgacacaatgcacgacctccttgcgcttctggagctcgccctcggggcacttgacgaacttggtgtgaggaccaacagcatcgtaatcccgcgacctcccgattgagcggccaagcttggtcaccttcccggaggccttgtcgagcgcaaccacatccccgctctgcaccttctccttccccagggcctcaatcatcttgccgccgagctcgtacacggtctccatgtccgtggtcttgagcgtgaggcgcccggtcttgccagccgcggcgacaccggaaggcgcggagctgccggcggcggctgcggcggagacggggcggtcgatcgagatctcaacgacctcgccctcgatgatctccgcctcctccttgatgcggacgccgatggagcggcggaaggcctgggtgagcgcctcggtcttggagaggtcgagggagaagagctcggacgcggcgacggaggcgaagggcgtctcggcgccgagggacttggcgatgcccatggcgagggcggtcttcccggtcccgggctggccggcgaggagcacggcgcggccggcgatcttcccctggcggatgagctgcaggatgagccccgcggcgcgccgcgcggggagctgcccgaccatcccctccgacgagccgcgggcctccagcgaggagtccagccccagcccccggatgtgggagtgcgccccgatgcgctcgatccgcgtcaggtcgcggctctccgacagccgcttcagctccgccatggccaccacccgccgccgccgccgacgaggtgcttttggcttcccgagggtactaaaagagaagaaggtttaaggcgaaagggggggaacgagttctagggttttgccagccagcttgggttgggttgagtggatggatatatgaagacgaagacgaaaggggggagcacggagaggtgttgcacacctgcacttgtgacataatgggccgttactagttgggccagatgtctttttcggcctgtttggaaccaaagtttttcctattggattaagtccacatgacgttcctagtctattaatcgagtttaaatcgcatccccgaaccgcaatatctttgacctcccaacttgcaaaaccgggttgaattaggtcctccagtagcatataaggccggtttcgctgacgtggcatggtcaacctacctgagttagcatgggccccacatgtaagtcgcaaaaaaaatcccttctctccctggccgagagtagtcgccataatagtcgggtgtggcggcagcgaagctatgtgtccttggctgcttgcaggtccaccagccttgcgtcccgggtcatcgcgtctccgtcatccctgagtgggaacgatgatggatctaattttatgcaaattcaaatggcatgactacgtatatacgatttgtaatgccatttatctgaattgacatatctgcaatagcgtggatccaattaacccttacataaattccgaattcatgtgtttcccctgtaccctaccccatcattgaactctccctttaataacgggggaatttaactatttgcaactattaggtttgtcaattatctaaatgcccctcttagaattgcatttatttttttgccattgaagagagagaacttcttaattctttgccacttttgcatatatagcacgccaacaaggttgtcccgtcatcttattccttctccacctcctctctatcttctctcccccttctctctcacctccggcatcttgttggacaaacggcgagctcctactcgtcgagcactgagcctcgctgagccctctgaaggaggagctcgctgaccggatggtgcccaagtatggccgtgtcacgtgaggttgggggttgcggcagacattgtcgactgcagaagtgtcctaaggaggatgacgaggagagtccatggaccgaggcacaacgatgaagcggggatgcggcggtgtggaggagggaagggtggacttgaggaaaagaggcttgctactggcaatggcgctcattcgcggctccgcgacccgtttcacttgacctcactgttgacaatggcgctcctccttatcaacatccaccgcgagcacaaaaccctcatcttgtgcgccttgtcctcctttggtgacagcaagctcctgggtccctgccgcgccacatctccacctaaccagccaagacaagggagctcgctggctacccaagaagatagccgaaggtgaggaaggagagagaagatagagaggagggggagaaggaagaagatgacggggcggctttgttggcgtgccacgtatgtaaaagtggcaaaaaaaattaagaagttgtttctctctaagggcataaaattaagtgcaatttttagaggggcatttggataattgacaaacctaatagtggcaaatagttaaattccccttaataaccctctagggccagattctcaaattctcatcactcgaggggttaaaatgtaaaagagcgaaaaactcccgcgcgccaaatcgtgatggaaccctaaactccaccgctcccatctcgtctcgatcccctccatttcaaatccacactccgcctcccctctccggccgccgccggcgagatggatctctccgccaccccgtccagatccaaatccggcctcagatcctccccgaggaagcccgtcgccgcccccgccgtggcccagatggacctctccaccccgtccaagccgacccccaggcggaagcccaaggcgccgccggtggcggctccgatgtcccccgtgaccccgtcctccgtccgccgctcctcccgcctcctcgagacgccgaccaaggtaacttccgagacccccgtgaagcccaccccaaccccgaagcggaagcgcgccgcgccgtcgccgtcgccgaagacgccgacccagtccgagcccaagcggcagcggcagaggcagaggcagaggcagcagccgaagaagccgaagaagagggcgtactaccggaaggtggtgtacgacggcggggagttcgccgccggggacgacgtgtacgtgaagcggcgggatggcgcggagtccgacgcggaggacccggaggcggaggagtgccgcgtgtgcttccgcgccggcgccgcggtgatggtggagtgcgacgtgtgcctcggcgggttccacctgcggtgcgtgcgcccgccgctgcggcgcgtgccggagggggactgggcgtgcccctactgcgaggccgagcgcgcggggaaggccatcgagaggcccaagccgccggaggggaagcgcatcgtgaggaccgccaaagagaagcttctctccagtgatttgtgggctgcacgaatcgagaggtcagtgaaaattgtgctctgtggttattttgtagtcagtatggtaggcagaagttgattccgttcaattattgtttcgattcatttcaacttgcttgaactagccacattacgacgaattctagtgaatcttatagtcagaatgaggtagcattgagcagtaatgacgaactggtggtgtgattgtgtgaataggatgtgtaacggcgcatccttgtcatgatttagttgttccagtaatgaattctgcatagacaatcgtttgttctggccttgaattaggtctgataccccatgtccccagcaaaagaaggttgcatcagtaattggggttggtgcaagatgcacctggataatttctggatgtttatcgttgcaattaaacctctagttctctactgtaacaatttcactcgactgcttgtaaagtttgagacatacaatttcttaccaataccgttggttgcaacagtttatggagggagccagatggaatattctgggcaaaggtaagatggtatattatccctgaagagactgcagcaggaaggcagccacataatttgcgtagggagctgtaccgcaccaatgatcttgcagacattgaggtgataagttattttcgagtgataaattggttcctttggatggtatttttgttcattattcattctgttccttgcttttatggcttttgcagatggaaacaattcttagacattgttatgtcatgagccccaaagaatttaaggatgctagtgatcaaggagatgacgtattctactgtgaatatgaatatgacatacactggcataattttaagcgtctggcagacatcgatgatgaacctgaggtacatgtactgaaacttggttatagactgttcatagtaggagtgtaggactcaggggcaccattctggtagtcaagaagtgaacctcatcctactctgttattgtagacaaaggaagatcctggcgacgagccatacaatgctggtaatgattatgtcagtgactcggatgaagattctgaatatgatgaggaggaagaacctactaaatgtagttctgctagaacacatcaatcacatgcgttggctgcggtaccaaccattcctcgtcctccccccctcttgcctgtctcctctctgctagtgttgcacttcatgctttactgaaatgacatgcccatttgcagaatctgcggaaagggaggacatatggcctacaaaaaattgggatccgtaaaattcctgaacatgtccggtgtcatcaaaagaccaatctggagaaggcaaaagcaaccctgttattggcaactcttcctaagtcgttaccttgtagggataagtatgttagtacatttttgcagcttgtttcaaccactttcttttgcaaactgcttttgagttgaagtctcatgtcagagaaatggaggagatatctgcatttgtgaaggatgcaatttgcaatgatcaatgtctaggacgctgcctttatattcatggtgtaccaggcactggcaaggtaactaaccatcctttactgtcccctatgatggtttgatgtccttttctgtggctgaaggctaagcaatattttctgtgcctactttttcaacctgtagactatgagtgtacttgcagttatgaggaggctaagatccgagcttgattctgggaatctgaggccttattctttcatagagattaatggtcttaaattagcttctccagagaatatctacaaggtatgtgaacttctatcttggttgaatactatgattgtcctagtaaaccatatcagccatgttaaaaggattataatgcatataattttaatatatgcaggttatatatgaacagttgagtgggcatagggtagggtggaaaaaagcccttcattatttaaccgagcacttttcaggtggcactaaaattggcaacaagcaaaccagccaattattttgctcatcgatgagcttgatcttcttttgacgagaaatcagtcggtaataatttgtagctgaacctgttgagtagttcagcaattttgtattctattgtttggaaaatgataattgtttgatatttcgttttgtttgtcactttgttttaccatgtagattcatgttcattgacatttgagctaatgttttgtcaggtgctgtataacattcttgactggcccaccaggccaaattcaaacctagttgtcataggtacctatacttttgtttgttttacgtgtgattttagatggccttttaattactctttggctgttactgaacgcaggtatagcgaacacaatggatcttcctgaaaagttattgcctcgtatttcaagtcggatgggtatccaacgactgtgttttggcccatataattatcggcaactgcaggagatcattacaagccgtctaaagggcattgatgcctttgaagaccaagctattgaatttgcttctagaaaggtttggaatgcagtgtcatgtgtaatcttttctattattcacccatgtcttttctgtgactgttgctttgtccatcctatttgcaattttttttcctgaagggtgaatttatgcaacatgtcttttgttttaaggttatttcattattttgttctctgcatatgaattttccatgccattaaacacctttttgctaccgcttgtccgataacaaaaactttggatgttctgagttcctagtcaaactaataaatgagtggcaggtgctgtaatcactctacacttttcccttttccaacaaatactgtacagaacacattgtctgtttagtcaatgattgcatgccatacgtgtagcagtcttacttttgggggattgaacttacaactaaggaaacaccttcatgatctaggagatcaattatttgtgtcatctgtagttagttacttaagacacttagcaatttcttttcattgtagttcctttttgtatgttcctgcaagttcagttgacagttgacaccaacggaagccagtggactaactgcattcacagcactgtggtttggttgcacactgactgttaagtg

SEQ ID NO: 63137 - DNA, 6286 bp, Oryza sativa
acgatgacgaacagaccggagaaattttccaaagtgagaggcgtggaatggctgccatgatcatctgtcaactgtgaatcagtcttgttggtaattcttgtcatgtccaagatggctactgaaagattatggaccaatggagaacctatagggaatccctgaagagaaaaacacggtgttagtaaccaacttttgaccccagaatgtatcatagtatagctctttgaaggatgaggtgtaaatgtacgaactcattaaagtgatagtcttacaaaagcaaatccaaggatattgtatgtctgaggaaacacccagaactcgttagaattattctggtcagacataaaagatcttatataggggatttcatcaacaatagcagatactttcccccttctcaaagcttctgcatattcttttccatttgcataaggctttaacctgtcttctttgaacgtttgatttaacaaggagtacacaaatgatttattttgatacccgaacatagtcattattgtgacggagctggtcgagatcaaccactgaggggcggagcctcgatgtggttagcatggatgacaaactagccgtgtaactctgcatagtatcaccactgcaaagcaccatattaccacaacaatttttgacatagggcttctaataatttgacctgtgcataatgtaaccaagaaagtaggttatttcagaagtaatattatagaataataaataaatctgcatgtttgagatgtgagttataaccatgagaaaatgtcattgtggagaaagcaaagtagagagaagtgctgatctgcctcgagcttgatccttggtactcctggtttctgggtcgttcaatcatccacacgacaaatgcaatgtataagaaactactcacagcagccaaccacagctgccatgtcagcggctttataaatatccattgaattctcggtttggagtatttctcagcgagcacaagaatagacaaaccagattgtgtgtatggcattgtgaaatctacatgtctttctcgttcggcagttatgctgacatcacccactgtagcattaaacttctgacaatcagaagaacgattcagtgagagaatgacaggaaattaaaaggttataattcaagccttgcaaaatgccaagaaagcaggtaggagtaaggctcaccccagaagagacgctgcctactagatcatcatatgaaccctcaaagagacagaacatatagcatggaggatgatctaacttcttcatagcgttctcaaatacttcgatgctaaaaccagtggcatttatcttgccattaggaagatcagtaatgttcagaaaattttgaaaaccatattttcgtgtcacagcaatcctgagtgtctcgttagatttctcactcccactttcacaactactttttgagcatttgtcctttgattcaatagcatttcttctctgagtttttggattaaggggtgttttagtgccatgtgttactgctaatccaaccctattgtggcctacagaagctgattgagaatcctctgttacagctccattgccattgctgctaatgtcaaagctatagttgctggtgcttcgattttgggggagcccagaatatgatgtcctagaacatactcccctcgcaccttcaccagtgatggttacaatctcgtacgatgatagcttgagcttctcagcaagctgataaaatgatatggtgtccgctgagtcggcatgtgttcttctggctacaagcacaccaccctgacccaattctctctctattgtctggaccactgagctgaagagcctgcatatctcagttgatgtggcagtggctggtattacattgtatgaccagagcagaatactttggttgtgcacatcatcgatgttcggattatccaggaaagcagcaaaattgacttctttatttaacctctgaggttccctgctaatgacgaatgccatatcattcttcgtcaggtatttagctgcacagcccataggatctgtccatcacaatttatgtaaagcttcatcaataggtatatctgtagcagaaaacattgaaattttcctactttcgacaaagagcgcatgtagaaattagtttttttttcttttcagatcctccagaaatacctgtaagacattaggtatataactcactatagagatgtttgtcttataattaacactactatgatataacactaccacttaatactaagtagtagtagtaaaagatcttgaaggaaataccgctgacttgattaatgcggaattgacaaactgatttggtccagttggaacaggatcgagttgtgattttggcaggaactgaagtgacaaaaccatcgtgtttggaatgctcataggaatggaaacaaactccaggccggaattgagggccatccagagaatgcgagaaagccctcagcgagctgggcagagccgatttgtatagcgcatcaacaaaaaaattaatcattcacgaaagaagaaaagggtgatccaggcaggggctaagccaggatttagagatagggggtgctggcacaagccttaagaactcaccggcgcctcggtaggcaatggtgtgaatcttggtggctcaaatcctgcagagtggcagattggcctcacctagtcgccttttgttcgctctaaaatacatagtcgcccctcgtataattatattttgaattttgtggctatttgtcatttgcactaatatatacataaaatgattgttgatatgatttggatttatttcaacacattcttctagattcatatataaaagtgaacttattttagaatggtgggtgtatgtctgagtccgaatgtaccttaatatagaataaaaagaaccatttttaaactaggtcactaaatagcaccaactttactcaatacttagaatgacacaacatcatttatattcatgctttttagttttggagacttgcaaccacatcgcgttatgttaattaactcaagtaattacttaaagataaaacctattagacacctagatataggctcaacttgcaactgattaatgaactaattgtatgattagatggctaatcacgcggggtttgcatgcaacgcatagggatgaggggtgccaggcccaccccggcacccccggtggcttcaccactggatccaggaagcaccaagggtgtggtggtggagtcgtgggtgcatgacttgcatgactccacccaccagggttcaaattctggtgcccataaatattagacacatgtaggtaaacattcaacaggatttcagtgatattatgaatgtgccgttggttttcgtctcttagcccatattttagcggacgtattcgcggggtgctgtgtaatcttatgaaaaaaaaaagcagaagaaaaaggtggcccatgacggcactcaccgttggcggtgagagcgatttgggggcggcggaggacgatgccgaccagtgcagcaccggggcccgggggaggaggacggggagggagggcgtacgtgacccatgagtagaggaggcgggctgctgccccaagggcggcggcgagccgcgcgacggcgcgaggggcctgcggcttgggtcgcgaaggggagaggggggattttggcggcggctacacctggtgcgatgagcgacgagatcgacatgttactctacctccgccctaaaaatatgggctgccttgtctttctcctaaaatttccggcctttttggataagctagatccttccttattcagattttaagagtctagtactccctaaaaaaaaataatctagatgggatttgatacttcctagataaacttatatccaaggctgaacttcagtccttttccatcacatcaatctgtcatacactcacaacttttcagtcacatcatctccaatttcaaccaaaatccaaacttcgcgttgaactaaacatagcccaaatatgtcgtatgtcgtagatgataccaaatcaattgtcttttttaagaccaggggtatactttaatggctccaaaaattcatggattttgaaacgataccaatgcatgtgaattacaaggaggaaaagtgattatatttcacgtttgaacacgttgcgtgttacaacgagaggatgaaaggaggacgagtccgaatttaagaagagagtagagatatacaactgtactttgtatatggcattgctatcaatacttagttataatttcgtcttaccatgatttgacgacttacattttattgtaattttctcaattaatatgagaatttctaactttcgggcaaatcttggtaggtgaagtcaagaacgaacgattccaccgccatatttgtggtgtttcgccgtgttaaaactaattcataactcatctttttttattatataatttgcacatacatttgtttgaagtattaaggacaaaaccattttattttattaataatttcaagaatcaaaattactccctctttcatattagtcgttttgatttttttttcaactttttaaagttagtttgatcgtgttataaaaaaaagggaaaattggttctatagcatcgaaagattgcgattttggttttatagcattgaaagtcacaagttcactttgggagcactaaaagtttgctccgttagtgtatatagcatttccatcgggctccgttactgcacagggatgcctgtctgcttccgtcaatcttccactcgaccgccggcggccccgccgtcgctgccatgccctcgtgctggagcagccaacgccgccgtcgactccttgagctattccacacggtcccgcccctaacagccaccaatcacattatcacaccttaaatttcccgtgtagctgcctggaatatcgccgtccccttaaatctgtcatcgagcaatccgccggcggcagtggtatagaacagacacgctcgaatgatgtgtatgtggtctggtcatctgggccaacgacaacaacaagaagacctctggctagattgactccgatcacaacccaattgaatcaattttttttatgtgcatgtgtagatcgtaagagtaactagtactagtatttctctagtcctgaactcctgatatgctccctgctcagcaagcagcagtcgagggggcctgaagctgcgcatcttgttgccgcttgggatagaaatttagaatgagaggcatcatggcttgtgatttctgtggagaagatgaagggggcatgaactgatttgtctcagcctgaccgagacacccgagacgaaggggcaccgtcgtcgtcagtttaacagaagttagcctcaagtatgacagaaatgctatatgcactaatggagcgaactttcggtgctaataaagtgaatcggtgatttctgatgctataaaaccaaaatcgcaatctttcaatgctatagaaccaattttgccaaaaaaaatatagcaatatttttaacataaaataaacatgttattgaaatatgttaaatattagttttaatgaaactaatttaatgttgtatagatattgttaattttttttctataaatatagtgaaacttaagaagtttgaatagggaaaaaaatcaaaacgacttataatgtgaaacaaaacaaaagaagtactaatatagttggataaatggatatacgactataaatataatagaagaaaggtagatatatactagcacactagctagacatatgttttttagatagtgagatcagataggtagagaaagttgaagaacacaggctctttcttagtgacactttattaggtttaactaaatttataaaaaaaatacaacaatattttaaaaaaatatcaaaatatgtttagtgttaaatataatgaaactaatttagtgctataagtgttgctattatttttttataaagttgattaaactagcttttaaaaattttgacttaaaagagtttcattatattaaaaaacgacttatattaatatgaaatggagggaatagcaaacttgttatgggatatcaggcatataggtgcgtacctactatattaacgttagcatgatacataaggtatatatcatataacttatgatagagagaatcccttatatgtcactgaaattggtttgatcctttatatgtcactgaaaattggctatttccctatatggcattggtccaaatttgtgcaccctcccatgtcactcccgtctgttgaccgttaactctcagtaaaaaagatgtatttgcccttctgagttgtcct

SEQ ID NO: 63138 - DNA, 1580 bp, Oryza sativa
cttgtggtacaactcctccaacgccatctcgatgcaggtgcggctcttcctccccgcttcggtccgcaggtgtaccaccacgcccaccatcaccggcgccgcgttcccacacgacgacgacgacgcgagcagcaaaacgagcagtaaacaacaatgagcaagagcagtaaaccggctgatgatatgtgtaagaaccatcatcatatactagtaataattaattaagcttcctctaaacgtatagtactaatttctctcaataggtttaaggagttaaagacagcatacgtatatatatagtataggcatgtgtacacgttcgtcgatcgatcgatcgatcgatctccctgcagacgagaggttgacgctttccatgcattcacccggtctgtgaatacgtgtgcgtcgtcgagcgatttgtttccgtctaagtaatagcctgtagtacgatatgtgtgtgtatactaattaagcgcgtcttcatccaagtggttatagcagaataataagcaaattaatgaaccaaaaacagtgacctggtttatattcaagatcgatcgatcgtcgttgacgacaggctagcctgcaagtagctaagctaattacaatacctttgtgcatgcattcgtaatttcgcggggaaatttcttttatataaatgcatcaaaacatatcatgggcaccatatatcaaaaatatataccttgtgaggtgattagtactaccggttgctaaatccgtgggttacaccggttattagttactgttgacagtattgccgggccggccaagaaaggccaaccaaatttacttaagaactgttgacagtacaaacatcaaaattttaataacatgttaaatacattggtttctagcaaaatatatgctggttattttcaaagtatataggtttggattaaaaaaaagagtctagcagttataactgctaaccaagttaatttcaaaattcattagtaacttttatgaacgagatagtacatcctaactgctgagaaatttctctcttgctacctactccgatgcgtctagataattacgcatgaaggttgattttgggtttgaaaactccttccctcgaagaattcagggttctgcacatttcgctatttagagctgtcaatgttcaggtctacaatcagtatatcttccaagcgaattaatctgacttcttgcaagcagaaaagagtggatacacgtactgatcccctgattcaaatgatcaacaagaaaagttagcattgcttcaacttatcacagcctgtatctgcattggggaatctcatctgacaagttacaaagttcatcatcggttcatgtttttatctcactaactggtaatttacacaatattttacatatttacatcgacgcaataaaaccgtcaaaacagaacaactttagatgatgaataaacccactaaaatatctactcctacataactatatccaaccaaattaaggccctaatttggattgcaaaaacattcagatagatacaactattcaggccatgccaaatcaagaaaaaattccggcgtccaaaccaaagcccaaatgcc

SEQ ID NO: 63139 - DNA, 2323 bp, Oryza sativa
cccccaaattatcacaaaactacatatttaactcagtgtatcacaaaactacacatttaacatcaaatttatcataaaactacacatttaagatgaagtgtcacaaaacacatgtttagtaactaaattatcataaaactacgggtttagaaccaatttaatcacaaagtaataatgtttatagctccaccataacaatggtgctagggatttaaactccaaaagttgtagttttgtgataagttcaatattaaatatgcatttttgtgatacttaacctaaaatctgcagttttgtgataaatttggtactaaatgtgtagttttatgatataactccttaaatctgtagttttgtgataatttggtcaaaatacctgtagttttgtgaaatttactctacatcttctgataaaaaaaacacatgttaaaacatggcctgccctgctatcattttttttcttctgttactagttcctgccaagatttcattcaagtgacagtatatctgctggaacttgacctctctcattttcaccctctctgctagttgtatgggggcattaaaacattcacagtggtgctgttttatcttcattctcgaatgtgactaatttcgtttatacttatgtgtatgaaataacttggtgtgtgttcctattgcagttgcaagcttggtgaaggtaagataattctctgcgaggaaggcactaagcacaagttgcagaagcttcagcttaactatccaaggttagcttgcaagattgtgtttgccattgaaattggcattacaaggcacctttatgccgactctttacttactgccttttaaagactatcagagtcatcttttgggggaaaattcaatttgaatcatttacatgtttaaattatacatcgtgtgtattgttccctcgtcaacttaactttttgtttgaacgaattaaagcctagaggttctagttttaagacttggcacttagctaccccattattagtgatccacttcggccattggtggagccttgacgtgagcggagaacctttgggtaatctaactggatgaaaacttaatatgcccctcttttatcatgtaaaactgtactgagaatattttttcttgtctggcagtgacgatgtaacttttgccctgaaggaatccccagatattccatggttgtccaagtacctgtgaagtttacacttgcagcggttgtactttcccagcatttcattcatctactcctggagttggagagcaacgatcgcaactacttgcccttgatcagcagtaagtttgaacatgttcccttgttcattttttcgtacctttgcagaagtttgaaggccatctagtattttcttgtcatgaaccatactccacactggagcatgcaacactaacaagcctagcgcatcttctgcagaatctcggaatttatgtgggtccaattgttcatcttccaaaagatatcgactcgaaggatgccgctgcaacaaaatgtaaatgcagtgtcgcaccaggactgtaacatatgtatgattcgaaggagattgtaggtcgccattttattttcgccaatctgttgttacccaagaaactttgctctggcagtgttgttttctcttgcatccctctgttacgtactcccttcgttccaaaaaaagacaaaccctggtttccgtgtccaacgtttgaccgtccgtcttatttgaaaaaattatgaaaaaaattaaaaagacaagtcacgcataaaatattaatcatgttttaccatctaacaacaatgaaaatacgaattataaaaattttcatataagacggacagtcaaagttggacacgaaaactcagggtaaaactcagggtttgtctttttttttttacggagggagtacgtgcgagctgattgtactactgcacatttgtaactggttacctacaaatcatcatcaaattatctgttgtgaaacattgacaaatgtatgatggattgatgatatctgttaaaacattgacaaattatctctttttcgcttgtgaattcccgtgggatattaatctctcgtttggaattcacgcgggctctctcttcttcgttttatagcttggacccatcgccttcctctcgccgccggcgagcccattaccaatggcgaacgcgagtgcaacgcccaagacccctcgccgccgccgccgcgtcacgttcctggctaggacttgccaccgcctcctccgcttgctcgccactcaccgcctccgccgcggtggccatggccttaactccatcagcgccggtgacgactcccctccctccggtcagcc

SEQ ID NO: 63140 - DNA, 3384 bp, Oryza sativa
tatgctcatccctttactcaatgatactgaaaaagaaacaaaaaaaaatgaagcgtcaatgcttcgcatttaggttcaactcctaaatttagtttcaggagttaagtttgaaatggagttctgaagcggcctaaacccagctctatctccttagtttaatttgtgagaaagcttcacccggcttggctcctattttaggtgaagctgaaactgttcgactgagagctatgccaaacatgccataaatgacgaaacttgagcagagctccagttcgtttattttctcctctaatttatttactctagttgtaaacttgcaataacgttcggatgtgcgtttctgaatttcaagctggatcaaagttttttttaaaaaaaatggattctgattgttcttgttgcattgatcaggcagatttggtgttcctttcaccgccatggggagggccatcctacagccaagctcaagtttactcccttgatatgctgaagccaagagatgggtatgttgttttttttttttgccgatttcctgtcatatccacaatatgaaaaataatgtgtttaatcatgcagatttacaattttccaagctgctcaggaaatatctccaaatatcatcatgttcctgccacggaatgtggacttaagccaagtagagcaactttcttggttgtcttctccccccttggattttgtggtacgatctgtttcataacctttttcttttttttcatcgagcatttaaaactttcaatatgtgaaaaaattgacatggtattcctgttgttttatagagcgaagagaattacatagaacatagattcaaagggataaccgcctactttggaggtttggcacaagaagttctgaagcaaggataaatttctttctaaggtttcaatgtctagcttcccctgaaattctggtctaatatcttgcaaatgccccttagttggtgtctcaacgcaagagaagctaaggcttgatggtagcccaacgtttttatttgattcagtatatggaaggtatatcccatatttttggttcactacaaggtctcaactgtgtcggtggcgtggtgggagatttggtattgtgctgctccacaaatttggcttcgattatttggcattctggccttttagcaaattgctaccatcattgtcaagattgcccctaactccacatgcagcgaagcagtcctatctcgtcaatgctaaatttagaaaatctataagcaaccccaatttactggagaaaaatacatagagggaaaaccaccatcactgcttccattcccttcagcaacaaagaaatagttcttttgggagatggatttttgtccctagagagaatgtccaatgtcgtctaaaaagtcattaaaagagctttaaaaaaatttggtaagatagaacttttaaatttgacttgtacaattagaattttacaaaaacaataaaattaccgtgaattacgtgttctatttgaagtcaaatttattatttttgtttctgaattgaccatgagtttattattatacagagtcaaatctattgtttttgttttcagagtcaaattgaccgtgaattatgtgttctatttgaaacctgtatgtttatggtgtggtaccatttttattattttttgtgcgacctaaaaaaaccccaagggaatggcccctcgagggataaataaactttcccattcttttgtcaatgtaaactttagaaaacctataaacaacctaatttacatgacaaaaatacaacaagggaaaaaaaattaacaaaagaatcaattcctccttccatccccacaaaccccccaacaacaaaaaaaacaaaaatgttcaacacatatttatatattcactaatgctaactatactaacaatttatataatcgtcatcacaagcggctcctgaatgcgtgagttcctctgttgtagccgtagtaggagaggtaccaccggacgaacttcttgagccccatctcgaggctggtcgtcggcttgtacccgagctgctccctcgccaggctgatgttggcgtgggtgaagggcacgtcgccattgccgggcatctcgacgacgtgcctcctcgccttcaccatcaggcacctctccagcatcgccaccagcgccggcaccgtcaccggcgacgtgttcccgaggttgaagatcctgtacggcgccgccccgcgcttcctcccgcccccgcccgtgctccgcccagccgtgtccagcgccgccaggcacccccgcacgatgtcgtcgatgtaggtgaagtccctggtgttggaatataaagtgaattgtccatcttttctcaccagctcaagcttttgagttgaactagtcggtgcatgcaactcaatatggtatcagggttggaaatttcggaacgaaattttcgaaatttgatcatttcagacccctccgatacgatattatttcagctgaaatttttaaatttctacgtgaaattttggtaatatttgctcaaattcaactaaattttgttcaaaatttcggaccgaaattgaccgaaaatttcagcatttcggtgaggcccgatcaaatcggcctaaccgataggatcaaccctgactggctgactcaatatggtatcaaaagttagaggtcttgagttcgaattctggctgaattgcagcccacttctattccatgcaacttaatacctggcgatgtcgacgtgatcacggccccggtagacggtgaccggcttcccctgcaggatgttgcgggtgaagaagaagtaggccatgtcggggcggccccagggaccgtacaccgtgaagaagcggaggccggtgatggagaggccgtagatgtggttgtaggtgtgggtgatggcctcgccggctttcttggtggcggcgtagaggacgccggcttgtcggtgcggtgcgcctcggagaaggggacggcgtcgttgagaccgtagacggaggaggaggaggcccagacgacggccggctgcgggtcggcgtccttgcaggactcgaggagggagacgaggccggcgacgttggagcggacgtacgacgaggggttctccatggcgtagcggacgccggcctgcgcggcgaggtggaggacgtgggtgaaggggacgacgtcgaacagcttggcgaggaggcggccgtcgttgatgtcgccgtcgacgacgaacacgccgtgcgagcccaggagggcgcgccgcgccttcttcagcgacgggtcgtagtaggagttgtagttgtcgatgccgacgacgccgtcgccgcgcttgcggagggcgagggagcagtgcgcgccgacgaacccggcggcgccggtgaccagcacggacagcccggcgccctccgccgacccgggcg

SEQ ID NO: 63141 - DNA, 4796 bp, Oryza sativa
cgtcgccgtcatctccaccaggaacagcgcccacaggaacatggtccccgtcgacgcgagcaccggtgaacctgccggctcatcgccgccgacgaccgctgctccaccttcaccttccccggcgtcgacgggtacatcacctcggcctcctcctcctccaccaccacccgcatcctcctcctcctcctcctcctcctctcctcacgcaaccaaacaacacaccatcgattcagctcgaacgagatcaaatatttttgagttccgttgctcgaaaaagaattagaattttgagttcttgctgaattttggtggttttgttgttctgagaaatgatttttttttgttttctttaatttttttggccgtgggaaatgggcgggagggattagtggagcgtgcgaaggatgttgcataaatagcggtggttttgtgttcggaggctcggcgatgatggtgggggtccctgtaatttagcactgtttatttttaggccatatggtataacatttgaggatgttttgaaaatggcaggaccatcatccattgaatgcattagggcatctacaaaggtagagtcagatatgagctctacgttatctggagactagcatcctacaacagttagagacaatatggtctcaactttttcttacttttattttctttctttcaccaccatgcaacaaaatttgctctaataaatgctaagagtcgactctgagctgttgtcatgcataacaaccatactcctttctctttcttccatgtcatcaaacttacttgcatggcaatagagagagaccactaataaacaccgttgtacatgcccttatgcatgagatttgcgaagaaataggaacatatgtatcgaggtttgtctagcattttaatcctttccttatgccattaggccaataccatatgccattagttggtttcagttttgtagtataacctaaacaaaacccactatatttagacttggtgccaatgcaatgatgtactccatccgtcccaaaaaaaggcaaactctgggtttccgtgtccaactttgactatccgtcttatatgaaatttttttataattcgtattttcattgttgttagatgataaaacatgattaatattttatgcgtgacttgtctttttaatttttttcataattttttcaaataagacggacggtcaaacgttggacacggaaaccagggtttgtctttttttgggacggaggtagtacctattatcatgtcatgcgctgaaaagtgtagtctgccgtttccgagcatccgagtgcctctcttttagcacatcaaaatgtgatggaggctagaacaaatttataaaaccgttgaacttagtttttttacttgatatatgtgttaagaaacttagagcttgaccaatgaagacatgaaccaaatatatttattgggtccatcaccaaacttttcatatatggatttgcactactgtccaaagaggagaggaattactcatttgtatacttgatgaaaggattggaataagagaaaataatctcacctctaaattttgtatctccactttgctcttaaattatacaaccgtgttgtactactctctatattatcaagcacgaagctataagggagaccaaggtagaagaaggaagagaaatctcttatacgatttgcactttaagaattggactaagggtgtgtttagttcacgcaaaaattgaaaatttggttgaaattggaatgatgtgatggaaaagttggaagtttgtgtgtgtaggaaagttttgatgtgataaaaaagttgaaagtttgaagaaaaagtttggaactaaactcggcctaaaaaatgaatttcttgtatcctccttgtttcgttttggtgccttctgacgactagccgattcgattcaccggcgactagccgattggggttttgggtgtgctccatggtaaacaagaagtcgatgttgcatgtatggagcagagacgacgtcggaccgtgccatcgaacgatcaggccatacatgacggtggaaatccaacccaacccaaatgcaacggtagaaaaactgtactgtacacctctccgtgctcagcagcatcgaggagtggacaagatgagcccgggcgtcctcctcatcatcgccatcctggacgtcgttttttttttaaatgagggtaaaagctttgcctcgtatattaatagagatggagaaaaaacaaaacaaaattagaaagggaaatatttacagggcaagccaaaagagctaaacccgcaagaattggccaagagactaagtgatatctccaaaaattccaaactcttgaagctttgaggctccagccttgacccaggctcgagcctcctccttgatcttggcgatgatggaagccggcgttaaggtggtgtttcggaagattattgcgtttcgttcgcaccaaacttcccatgaaaccaagatcaccagtgctcacaaaggaaagcggggggtgttaggagtgtctaccactacgttccaccattgctccaccgagtcgcagtccaccgagtcgtcttcttcctcttcggcattctcaacctgctggtgcagaatctcctcagacagacttcagagttcaaaccaaattggccctaaattttcggcatatcgagtggtgtgctctgacgctcagactccgcttgttttacacacaggggttcagactttcagttgcccctctgcagcaacagccaacaagcccacccttgcagaagctttgtcgctaggaatctagtttctgaacttttggaaattcggaatgtcgtcgagatgaacaacacatctgcaatctcacctccctcttgcagagttttagtgttctccattttttatttttgcccttgtctagatccacatgtaccaaatctagaacatgaacttcaatctgagtatccagtaaaacctatgacatggaccctagccaaattattcatgcttttaccaaatttcgagtagacttcaaaccgaaccacactaaattttgagaaaattgcatatctatcattgcataagttaggattcgctcaactactatcacttaaatgggcttagctagaataccataattaaccaatgtgtatttgctaaaatactatcccggacagaaataccctggatcttcttcttcatccctccctccaatgactgaataggtcgccagtggccaccgccggctccactgccgcgccatcgctcacgtcgtctgggctgggcaccgttgcgcatcgccgccccaccctgactcgccggctgacgacaacctcgccccgacaccttgctgccaccggcaattagggcgttgccctccctaccatcggtccatcctggtatgtgtcggcgaggcagcacctgtgaagccggcggtggccgccagcaacctcttcaagcatgggagggaagaagatgagctaggggcatttcatttctagatagtattttagtaatgatcgattgtggatggtattctagcgaagtccattttgaataattgtatttttatccagtagatatgcaattttctcctaaacttttggcctatctggacgtgtcaggggatggggtgacacattgatgaatggtgtgttctgactctgcttgttttacgcaggattcagattttcgttgctcccatgcaacaacaagcccacccttgcagaggtttgtcgctagggaatctgcaaaatttgtttctgaacttttggaaatccggaatgtcgtcgagatgaacaatacacctgcaatctgcagtatcagtatgctccctcttgcagagttctccaatttttttttactgacatcgtagtttgatactctgtgcaaccataagtttacgtgaccaactttaattgtacgtattatttaattttttttataattagtatttttgttgttatgagataataaaacatgaataatactttatgtgtgacttatgttttaaagttttttcaaaaaaaaaattaaataagaaggacgattaaaattgagcacggaaaaatatggctgcaattaatatatagccgcaatcagtagtttcattgcattgcgtacatcagcatgacgtcatcacctaccatctcttcttctctacgacgtcgcctcgtataacaacaagctcttcttcttctcgtgttaccatttgtgacaacaatggacacgtcggcgtccacctcgccgccgccgccgcgctctgtgctcagcaccatcgaggacaagatgagcccgggcgtcctcctcatcatcgccatcctcgccgtcgtcttcttcctcttcggcttgctcaacctgctgatccagaacctgctccggatgcgccgggcgcggcggcggcggcggcgcgtgggcgacggcggcggcggcgtcggcatgggcagcccgacggcgttccagggccagctccagcagctgttccacctccacgacgccggcgtcgaccagaccttcatcgacgcgctccccgtcttcgtctaccgcgccgtcgtcggcgccgggctccgcaaggacgacccgttcgactgcgccgtgtgcctgtgcgagttcgccggcgacgacaagctccgcctcctcccgacgtgcggccacgcgttccacgtgccctgcatcgacgcctggctgctgtcgcactccacgtgccccatctgccgcggcagcgtcctcgccgccgccgccgccgccgacgacgacgacgactcgtcggcgtccaccccggtagcgcggcgcgtgctcgactcggagagcctcggcgagacgttc

SEQ ID NO: 63142 - DNA, 2748 bp, Oryza sativa
ttggagattttaagtttgaaatgctatccaataacaagtgtggtcactcctgcgcatcgttttttttttaatatagtttgatattaaagtactgaaacatagttttagttttttttttgttagacaagttgcaagtgatgaacgtgagttttctggttttcttccacaattcctgcaattaaattgattcatgtataaatccagcaaagttaatgcataatatctactccacgaagaccctaaaaatttctaccattctgacagactcgacagaggttctctattgaggtaatattgcaaataaatgcttgcataaagaacagaactgatgcaaataaaaaggttctgcatattatctttttctatcgaaaaatgtgctccattgtcttgcccttcactggatttctgtacaacaattttaaattttcttttgaaaaagaattcatggattgaagtgtgggctactagatttaccagtggttaatcactgacaatgtttttctgccttgccatggcaagattgaaagaacaaaatttataactaagttattttcggtttgttaccctttacttacaaaatcaaataggctattcagataagcatatctggtgtgcttgtaaactcctgcatcctccgaaatcaaaataaaccaaaagaatccctgatcaaagtgatcatcaactcaatgtgccatagcccataactactacttcctccgtttcaggttataagatgttttgactttgatcaaagtcaaacccgcttcaagtttgacaagtttttagaaaaaatagtaatatttttgacctaaaataaatttattaaaaatatacttaattatcaatttaataaaactaatttagtaatataaatatcactatatttctctataaacttaaaacagtttaactctgaccaaagccaaaatatcttataaacggagagagagtactggtactgttcatcatcagttgagccgtgcaagctgcaacaacccccttgtcccgggctgccgtccccaatctgaacctcatattctcatcccatctgtgcgatcgatcgatgcacgcgctacatcactatcatccttcgaccaaatccccaaagcgtcactaatcctttttttttttgtcggcgtggatggagtcactcgcttactcacccctgcactttgacaactgacaacatcaccaggaaagagaagattatggccccatttgatttgtacgaaaaatattgaaaaattagatgattttaattctataagaaaaatagtacctattaaggtctttgaaacaaatgattgaattatttcctttcaaatccctatggaatagataatactatgaagagattttaaagaaaagttagcaagagcttcaatatgttgagtctatttttctcatctgattcctaagtttttcttttagcttattcaaataaccatttatgtattttgcaatcgtttattttgcagttacattcatgtaaaaatattacgtttttcctgttcttcctatttctttttttcaatcttttgcttcaaatgagccataagggtcccgtttggacgataagattatagattattctaactttgtgataacaattgtttttccattacacgagagacgcacgtgcacacacaccactacataggtaacaccatactcatacacccacgaatgtgttatgcacatgtttaaaggaacagaaatcaacgtcacatacttggactctgtggccttcacttattgggaggcaattatatagtaataaaatattagtattccgcgggagaagagaaaggtccccattgtttggcttatttcctaataagccaaaacggcttattaggaaataaaaatgaaattgtgggtaaaacttttgtaaatgtgttttttttgacttaaaagccaatttgaaaaaaaaaactacgttgaaaatatgtcaaaatcaatcttaaaattaagcttgaaaatttaaaatttagctttttctttggtttattaggccatccgatgaggctgaaaaaataatccaagacggcttggcgatgaacagctgcaaccagtagcagcaggcaggatgttccttcgtacttccagtgtagaccagccttgttttatctgggcctcttcggcctgggataagcccaggttctgctcctgcaggcaggaaagccggatgttccatacttccattctcgaataattgacacggttaattatgatcatgtcattttaaccgcattcttttaaaataattatattaagtaatgaatagaagttatatttatgattatacaacgttcaataatataacatgtttaaagtatttattagaaatgaaaattagttaatgctaaaactaaattaatatcgatatcaattattgaagaacagggagaaatcatccagacaacactaatttacactacacaccacctttgggaagaaatcaggcaggaggaaggtgtgctttgctttgggatcctttggaacaacttacacttgacaccaccttcccttccctttgttttgaagcccttagagaaactgaggcaacggcgaaagatcttagggctcctttggaacaaagattcttagaggaattcaattctataaaaataccttcttatgtggtcctttgtatcaaaatccttgaaagttcctttggattaactaaagggttcatcttttttgcttacgtttattctttcaaccaaaatttaacttttcaagctt

SEQ ID NO: 63143 - DNA, 7482 bp, Oryza sativa
ttgacattccacctcataagtcattttgctgcaaatacacaccttctatttagtttattgtaaaaatcacccgaatgcacacgtgcgtaaccgaatcaattcgttatcgctgatgtacagttaccacaggctaagctagtcaaatcaatcgtgtccaagtgcttgcattagacttagggggtgtttagatccaggggtgtaaagttttggcgtgtcacatcgggtattatatagggtgtcgtatgaagtgttcgggcactaataaaaaacctcatccacgcatggcacgggtcgcgtactcgcgtggccctcctcgctgccgtccattagccgccggaccttgctggccacctccatgtaggggtggtaatgggcccaacattttggcgtagaaattatgagggttgggtaaaaaaaggtttggctgaaatttagtagttttttgtgctaaaaaaatttaagggttaagatggattgtgaaagaacccacgggtcttgacccattaccacccctacctccacgcgtccgacaacaacagcggcgttcggcccccggaggaggcggtccacgcgaacgccagcgcagaggatgtccgccacatgcttcgcgttcgccgcctgctccgccatcaccggccacgtcagcatcggacgaacggcggcgaggctctccagcacggagttccagccggcgtgggtgacgaacgcgcgctgtggcacccagccacggacgatcttcccgtcgccgccactggaccggccgatggcccagaggcaggcgtggccggagtccactaccccgtgccggccgtgcgcgagcgtgccgaacgacaattctgtacttttttttattgagtgatttctatagttttcttgttcttttcgaataatagtattttgacacgataattctgtactttttttttattgaggtcctgtttggttcccacgcaaaaacttttcaccctgtcatattgaatgtttggacacatgcatggagtattaaatatagaagaaaacaaattacatagattgcatgtaaattgcgagacgaatcttttaaacctaattacgccatgatttgacaatgtgttgctacaataaacatttactaataatagattaattagacttaataaattcgtctcgcagtttacaggcgaaatatataatttgttttattattagactatgtttaatacttcaaatatatgtacgtatatccgatgtaacgcaccaaaatttttttatcccagtacaactaagggctcgcgaaaagaaaatttttggcgtcacatcggacgtttgaccagatgtcggaacgggttttcggatacgaatgaaaaaactaatttcataacttgcttggaaactgcgagataatcttttgagcctaattaattcatcattagcacatgtgggttactgtagcacttatagctaatcatagactaattaggctcaaaagattcgtctcgcgattttccccctaactgtgcaattatttttttaatttatctatatttaatactccatgcatatatcaaaaattcgatgtgatgtttttagaaactaaatggagcctaataaacagtgcctggcgtgcagcgatccggtgcaggcgtgcagcagcagcactgccagtgccagatgctgagatgggggaagtataaagtacaatctccccattcagcccaatcatgcaatcttcatcttccatcgttggattgagaaatagacgtctaaaattcgtccacgtcaccatgagttaaaaattaactcgcagattcaccgtgagttaaaatttaatgagagttaatttttattcaaacttaaaatgacatgacgtcgatcactcacagttaccactgtgtcgacgtgttctacagttcgctcaacacttgccactgccgccattcgccgagctcgccgccgccgtgccgtcgccggcgacgacgtagcttgaccgcagctcgtcgaccagccgccgcagcgcctcccgcgacgcgccgccttctcccaccgccgcgcgcgccgcctcccggacctcctcggccctggcgcggatcgcgcggccctcctcgccgccgtccatcagccgcccgaccttgccggccacctccgcgcgcccgacgacgacgccgccaccgcggaccgcgcggacgccggccccgatgatgtccgccacgagcttcgcgttcgccgcctgctccgccatcaccggccacgccagcatcggcaggccggcggcgaggctctccagcacggagttccagccggcgtgggtgacgaacgcgcccaccgccgggtgggacagcacgcggcgctgtggcacccagccgcggacgatcttcccgtcgccgccggcgtccaccggcggcgaccactcgccgccggaccggccgatggcccagaggaaggcgtggccggagtccactagcccgtgcgcgagctcgtcgagctgcgcgtcggggaggtgcgcctgcgtgccgaacgacacgtacaccaccgaccctggcctcgccgcccgctcgtcgagccaagcgacgcagccttccgggtcgtcgtcgtcgtcgtcgtcttcctcctgcttcgtctccggcgactcgccagcggcgaggaacagtgggccgacgagccacgcgcgggatccggggtggtagaacgactcgaggatggccgcgtagtcgccgtcgagcgcggcgaagctattgacgaggacgccccagctccggtggtcccagtcgcggacctcgtcgtggaggaactgcgtcaccgggtcgtcggggttgcccccctggatcacggcgtccgggacctcgtcggcggtgatcctcacgtcgtccgggaagccgggcacgtggaactccgcgccgccctcgacgccgacgtgtggtcgcctcgaggcgagggtgaagcagagcgccagggagaagggcgacatgccgttgaacgtgaggcggcggacgccggcgtcgtccgcgactcgctgcgtgaacccgaggaagaagtcagagacgagcacgagcggcggcggcgacgggagggacgcgaggaactcggcgaagggctcccggagcagcgccgtggcgcggaggaacgccgggaagagggactgcgacgggagcgcgtcggtggactcgacgccgggcgggatctgcgggtgcgccgggaacgggatggcgacgacgcgcaccgacggcgacggcggcaggcggcggcgcgcgaaggcgaggttggccggggtggtgacgagcgtgacgcggaggtggtcgccgtggtgcaccgcgagcgccgcgcgaagtggaggagcgggatcatgtggcctttggacatgagcgggaagacgacgacgtggtcgcggccggccagggtggcgccgtcgttgccgccgacgccctctgcggcagggcgtgtggcggcggcggcggaggcgggcatggtgttcgacgaagcgttggacaatgggtagtttggtgagctacaataattggcaacaaagtgactcacgaaggctttatattgtgtaacttgtgtttgcatgcttatggttctatacttctctataattttatatattatgcggtgtttgaaaaggagggattaaactcacaaaaattttagtctctatgggaggggcaaaagctgtctagtctctacttttcaaacaccatcttagatgatgccctatatggcaatatttcatatgaattttgttaatattatactataaacgatggatagaaatattttgaaataatgtgaaaatgacatggtagatgaggatttgatatgcttgcatattagtaagctttaaaatatacccactttatcccattgcataataatttctagagtttagattttggttgttctaatggtagatacgcacaaatgaatatgcatagtgatagtgttgacaaactttaagttgctcaactgtaatgaatatctccgtcaagtaaactgtgacaacacctaataagtcaatttagtatattaaaaagacaatattgatgaggtcactgaaatcgtgagagcataactctatctctcgatttctcgattaaattaatcgtgatatctataaatattaattaaatatgtgaatacgctttaaatagtatcttaaaaaaatccaaggatttattgctggtccaagcatgcattaattaagaaaggtacactcatatgcctgcgatgccgacttattggctataaagttttttttcagccttctcttaacccacacatataatagttagctatttataattaatacatgacccacttgtctttctcacaattttttggttattgtgtccaagtcggctgtaagtttacagcccgcttctactctctctcttctcttctctcctccacctcagcatttagccgacttacagcctcttattatacttgctcttagtcgttattactacctctgtccccaaatattataattctagattatttagcatatactcacttcatccacaaaagttgcacatattatttttgtcacaaaaaccaagaaaaaattaaatcatcttcgatgttacaaaatcaaggagtgaatgcaagcatgcaaccagtgagtatttagatgactccttaagttttaatcaaacatttaatttatctcatcatttaagtcttgaatgtataaagactacaaataagaacaacttatttgaaaaaaaacttaaatatgaaatatgtcaaacttttgtggatggagggagtattaaggtttcaaaagaaaaactatggtgcccttcgtcaaatggtgcataggtaaaagttggggagtggttgagggtagaatatagagaaatttggatgagaaatcattgatgagaccattagtactttactatgacaactgttttggggcaaatttgaatactaaaaatacaattattatgagatggacgtagtactctatataagtacaactacaaacgaacatgaaggttgaactccgagttccaaattaacttgatactaccttctacaccctttgttccatagaaaataaatcatagctataaatctggatatgtgtgtcaggttcatagctatagttgaactttttctcagagggagggagtatgctgagtacaactataaatcttcaactcatttgatgtgttgtagtagataatctgcagtggacaacatactactcactatatctcaaaacataagaaactagtactggatgtgaaatttcatagtattaagattcgaagtactacaatgtacaatgtgtcacatttattactagattcttataatttgggatggagatagtacctccgtcattttgggacgaatggagtagttattaagatcggaccgaatcagtggtccaatcggaaaaaagacaaaaccaaagcctcagccgattcggtctagctaaaagatcggccatgcaatcagatcggagaaaaaccggttgaacccacgttgacgatttagttagagacacgtacatatttgagccgtgttgaatcggtggtcgaactggttggagtaccatactcattgtaaaccgagggctcaccggttcgacttctggtccagtgctaataactatgatagagagaattgcttaaggcagctagttgtattactaaaatgtcccatttttaggatcattcttaattattaacttctcagcgagtaggttattagcttgtattttaagagcacgtttttcatggtacgtacttccaatataatttttctttaaaaattaaataaattcaattttaaatttataataaataatatttaattaattactcgttaatgatcacctcgttttatgtgtaccagctgattagctcagccttgctttgtggccaactcgaacggggcttaatcgtcatagttgaccactaatttcaaatacgaaacgaggaaatccaacaaatgtgagatttactcctgtccggcagcatgtaccggccagtagtaccgggagatacaagatcaaatctgactgtccatcttgaagggatacgattggaaatagaaagagcaagaggagcggaacgattccggagtcgcgccgccgctttcctccttgcgctctttcttttttccctccctgaatcgcttctttctcatctgttcctccctccgagcacagaaacggagcagttgccccgccggccgatttgatccccatccatctgccgtcggcggccacggtactggagaaaacctcacggcgcgctcgcccgcatgcagtgtcaggagcacaagcagatggtggttctttgccttcatgcatgcttaagctctagcaaaccagatgatgacattgtatcaattgattcaggcaggaaagaaggcgctccactcgctggtaccgtgacttcctcaaggatatatggatgctcctcggcaatgggtttggggcagagctcgggaattcggtcactggggagttcgttgttgctgagtggatgtggagccacagtcgcgacgggaacgggatgaaggtgctccgtagcagtgacgggaagaggagacgccgctgcgatgggccgccgcgacgacgggaagcggaaccaccgccgctgcgatgggcaggggagccgccgctgtgatgggccgccaccgcgacgggaagcggagcagccgccgctgcaatgggcaggggagacgccgccacgacgagagccggagcagcagccgccgctacgacgggcaggggagatgccgctgcaatgagccgccgccgggacgggaagcggagctgccgccgccgccgccgcccactggatacggatcccgccgccgccgcccaccggatgcagaccccaccgctaccactgaccggaatcggatgcatccctacacgaaaagacaaaattacccatccacccctctatctattccggtaccacctcattggcaaatttgtacctgaggtaccggataatttccaccgtccgatcgagctgaataaatggctgagatttggtacctggctagtaccgtggtacctgctggataggagcaatgctcaacaaatgtaccttgttcaacgtagctaaacctggccaaatgggccgtgccaagccgggccggcccgagcacggtagtactgtagccggcccaggcccggcccggcacgccagcctgtgggccatgccggcacggcccgttatcccgtgccgtgtttaggccgatgcctcagcccgtgggctggcacggcacggcacgtttactgtagcgtaccggcacggcacggcccaggcatggcacggcccaccggcccatttatttttcctacgattttctaatttttcccatatatttctcatattttttatttttttccacattttatcctatttgtaccatatattttatgatatatttcctaaattttcctcacatttatcctatatttatcatttttttcctttatattatgttttttctgccttttttctttttttt

SEQ ID NO: 63144 - DNA, 9087 bp, Oryza sativa
attatcaaccttcgagacttctctcccaccagtacactaactaaaagttatgtaatgttcccaaccttttgaaatgaataaaggtttaggctggcaaaagccagccgtagttcccttccgaagggtataagcatcgagatttctgacatggctctgtttggatttaagagatattttttagccctctcttaaatagcccaaatagctcaaaaagattcaaaagggtgagctatttgagagctatttggaaatagcccacccaaaaaaactatcccacccaagagggaagaaaatttggtaagacttaagtcctacgcttatccgaaagactctgcttcccgcacgacacctgtccgcacaaatcttaagagtagcgaatatctcttttgtaccctttcttcttcctccggccagggacttggcgacaaatccaactcgctcttaggaccgagggtccagcatcttcagacgtagcaaggtccgggggcaaggtctggagcagagtttccggttgccaccgcacccgtcatgcttcttccatggaaaatattcacctgacattgttgttggtcaaaggtaatggatgaacttgcaatgcactagaacttgggaaaacatcaaattgatagatgtcgccatgtcgatgtgtgtgtgaagcctctgtatacgttgcatcctagtaaatgattaggcctggttgtcaaaagagaaaaatgattaggcctgaccttaaaacctattgacggcggttgggttgagcacgaggtcgatgccgctgcgcctccttggcgccccctttcttcaacacatcgtccagtgctgctagctgtgacctcgccgtggccagagatgccagtcaaactgtgggcttgatgccttgccggcggccggccgggtagtacgaagatgggagattggagaagagagagaggaaagagaactgttgggagaagagacttgctgctctaagattcgtttggacaggtgtcgtgtgaggaagcaaagtctttcggatgagcgtaggacggaagtcttaccaaattttcttcccccaatagatgctaattggggctattttaggtggggccactgaaaaaatgtcttttctctttatctctctccatgagaagttacgttaaaagccaaatagctctcaaaatagctattggatccaaacaactcagagttattttattggaggactatttacttgtgctaaaaaatagctctcaaaataactcttggctagttctctaaacagggctattaattgatggagtcatacacccacgactttattcatgaggccaccatctaccacacaaaaactgtttcgtactattccaccgtaccgaaattgttccgctatagtattaaggctgtgtttagttcagcgcaaagtttggattttggttgagattggatatgatgtgactgaaaggttgtgtgtatgacaagttgatgtgatggaaaaggactgaagtttgaatccaaattttggatctaaacacagcctaatttttggtaggtgttgctggacaactaaaaaagtcacataaatcattgttgccacttgccatgctactattgcttgtgcaataacatttgctgtgcttatcacatagggatgaaatgtgaacaagttattagaagttttttttatgaaaaattaaataaaaatgaactaaaaaaacaaaaatcaaaatgtatagtatcatattggctataatgtatattttcgcttcaaattaataataactagtccaacctattatggcagtggtagtcaaatcaatcttctcacaagtcttaaaaataaataatggagtgtttagatctagcggccaaaagttttggcgtgtcacattgaatatatggacacatatttgaagtattaaacgtagactaataacaaaacaaattacagattccgcatgtacactgcgagacgaatttattaagcctaattaatccgtcattagcaaatgtttactttagcaccacattatcagatcatggagcaattaggcttaaaagatccgtcttgcaatttacatgcaatctgtgtaattagtttatttttcttatatttaatactccacacatgtgtccaaacattcgatgtgacagtgtaaaaaattttgccaggggatctaaacaggccctaagtttgttactatactctataaaccttgtggtcacaaattttaagtttccatgcacattggaaattctcatctcccaaccacggatgcaggtcgtttgcagtactgcacatacagtactgcaggggatctcaattgctgcccaatcacacaactactagtagcaactagcataactgcaagatagatgttcagatggcccaaccgaacaagccaactatctctcactctttctcaaaaaaaaaaaaaaagagaataagttcaccgatcgtcactcaactttatgttgagtttgtttcacatcccttatctccaataccagaaatcttcacccctaaataatacaaaaccatgcaattagagttccacaacagtatgtatctccggtttcgctaacgtggtatcctagtcagcgataaaaaggcccacatgtaagttataagagaaaatgtgtggtcttcatatcttctctattctattttcttttctttcttctcctttctttggtgagcccgggaggtcgccgctggcagaggggggggagaggtggccggcgagcccggccgagctccgccgctatcgacgccgcctcgagcgcccaacaaagccatagctaacctcgcctgcgtcttctcggcggaggcgaacgcccctgtggcgggcgtcgcaccgcaccactctagactacctcgccagcgagggagtcggaggcgagctccttgcggatgccgatctcgctattgcagaggagctcatcaagccgatccgctgatgtagccgctggcagccctggccagcccggccgagctccgccgtcaccacctcaagcacccactgaagccgcaggtgacctcacccacatcttcttggtggaggtagcggtgaacacccctgcggcggtcgtcgcaccgcaccacatcggactacctcggcggtggggtgagttggaggtgagctccttgtggatgccgacctcgccattgtagagtccccgcccgttgacgaggtcgacgacgtgaaaggatacgagggagggggcaggcagacgcgagggaggagctcgtcaagccgaaatgctgtcgctggtggtcccaacgtctacccctccggcaccggcaaccatgatgagatcccactctagctcgtggaacacgagtgggaggctacagagggcgaggcgacatgaggtgtcggtagcacggcaaggtttggttaggatgtgcagagctggtggtggtggagggcaatgagttcacgagcggtcgagggtgccggagctgctgctgtcggtggtgccatcctcctcaccggctgctcttcctcaccgtctgttgctgggcgctgcccgatgatatgagcacagaggagagattgagagagagaggggggagggaggggggggtgaaagggaaatggtcattgacaagtgtgcgtcgacatatgctacgtcaacaaaaaccgaggataatatggtccatattgctaagggacttatttaacatggtttcgaatacttgaggggtcaacatttctaacattgaggattagggggacgtcatgtagactcgatctgaagttgaggtactgagagtgaacttattccaaaaaaactgaaaacaataagcccactatgagtccacgggcccaaagacccaggcccaaaccgcgtgccgtttccctgcacaagcccaaccccacacatatcatctcatcccatctctcccccgtcttctcgaactctccatctcgggatctcgcccacccaccactccaccccctctcctctccgtgcgccgccgcagaattcctcgccgccgccgccgccgccgccgccgtgaggtccatcgagatcgcgaccggagcaggtgggtgatccgctcccgcctctcgcctcccccctcttacctcccctccttcgtgatttccccggtcccaaaccctagatccgccgcacggccccttgcgggattagatctatcggtctcggggggcaggtctctacgtcgtttttgtgattcgttgtttaatccgattgtatttttgttttcttttggcgatttgataggtgcaggttgcgatggcccgcgtgtacgtcggaaacctggatccccgcgtgacggcgcgggagctcgaggacgagttccgcgtctttggagttcttcggaggttagtgactcgccccacctgtggtatgtattgtgtgcgattgtttcggttttctgctagagctgcgtgcgcatgtggaatcatatgggggaacatagctttagcccaccatcggaacagcaaaactcgttctagggccagggcctgagtgacctatgcagccacatttatgtaacttttggggaagacgattggccataccagcagtgcacggtgaaattttaaatgttgtaggcttttctgaaatcctgttccgaccctagtagattttactgtaatagaagaggtagagagggaatttgatggattcattttactcaagattatcttattacaagtcgttatttatttatttattttgagatgtattgatctttctagagcacaattacttcccagctatggcatccaggctttagattgcagtgtacccatctacctgacatcaatggcctccaaccaaacactagacttcaagcaccttggattagattttatcaggatacaaattcaactcattcagatatctacaacacttatttggctaatttactgtatgctggagatgcttttacggtttttctgttgcctaactttttcttattttcttgatgtgctgccaataagtttcttacctgaggccatgtatttgtattttgcacccacaattcaaattatgtttgatgctgattgtcctgatgcagtttgcttatttttgttttgtgcaagcagtgtatgggtcgcaagaaagccaccaggttttgcattcattgattttgatgacaggagggatgctcaggatgcaattcgtgatatagatggtatgtgaatgcttttatgagaacatagcctctgtcagttggatctatcacctctgagaatctttctgctctgattttcttttggtgagttacagggtggtctttgcttgcaaaaatatcttgtgaaagttaaacttctttcaaaggccatgatatatgcctattagtgacaacatgtgttaccattatatctatactttgttttagtaccagaattatgtgaatgtgatgtggcctgctgtttagattatgcttttcctcccagtccctctctctcatccaccaaaacacctccttgcactgttatgttagagcaatttcatgtttgtgcattaatcacttggacgtataagctgtttggacattgtcaagagggtcaagatcctacatttatgggggaagtggggtgaggcgataaggcgtaaaacaaacagtagtgacaactctgaatttctaatttttaaatggcttcttttataggcaagaatggatggagagttgagctgtctcgtaatgcaagcagtggtcgtggtggccgtgatcgatatggtagctctgagagcaagtgttatgaatgtggtgagactgggcactttgctcgtgaatgccgtttgaggattggttccgggggtctaggcagtggaaggcgtcgtagcaggagccgcagccgcagccgaagtcccaggtaccgcaggagtccaagctatggcagaaggtaatcaaaatgtcaaataactgttacactgttgcaatagttaaaagctttttgttactataagttaatggtcacaataccattgttgggactgttggttctgctatggatgtgaagtgttagtggtttgcaaccctactcactctttgatacaactaagttatctttctgtattcattgtaaaacattatatgacatgcacacaatttgttaatttagggttgcctatggtccaaatttacaaacactaagataaagcttgcaattttttctattcagtatttatccacctgttgccatttcccaacatctaggatagtaagtgctagcaaagaatagtgtagcatttatgccctgttttgtgtatgtaactagtatatttacacgaagaagaataacatatctgataatgttataaatgatttgctatgtgagcagaagttacagccctgcagggcgctctccaaggcgtcgtagtgtgtcaccggctcgtgcacgcagctatagcaggtcaccacaatacaaccgtggccgtgatgaatctcctgcctatgataacgggtaatgcagatttcagtaagcagttgtcattttactgtttctaactgagttaaccattttcatcgttcgctcttcgacaatctctaatatgttccatttatggtgtcagatatcgccgcagcagaagttagagctgaacctgatgtctaaagactgctgttacaaatgttactttgtgggttgtcagctatgaacaatgccctactccaaatatcatcatcaactctggactttgattaaggttctcataacttatctaccttattatgctttgtgtttgaagttatattactcgagaaacttatgattggatgtgtattcaactaagttcaactgtctttctgtgtgtcaataaggcatcggcctgcactgcttaaacgactcggccgactacggctaccagttatatcttcgtggttgtgttcttcgctcttcattctacgcgcgccctcgcctgcttcatgcaaacgtcatacagccccattagttgctgcctacaacacctcttcgtgatccatatacttcgttgaagatgctgctcatcagaaaacagtaatcgccttcttttatcgtaataaaaatttggtcatatggtcttcggaacaacagtaagtgcagcatctggaagtattggtgaaacaaagttcttcgtaggcatagactccagaaaatgaatctgcaatccgaggagctgcagtattcagttggatgatttacacccctgcccagtccgtcacgccttgtggcaggtaaatgaggtcaccagaggagtgctttttgacaaggccgatttcagctcagcaagcactgtatctgtgcaagcctgcttaagattttgttggatgcagccagaggttttgctctccatgatcttccttctgcactcgctcagcctgcctcagcctaccctgcgtgctgccgtctagccaagagccttcgccaccactgcttccccgacgtcgccttcgtttccattgcttccccgacgtttgatttcatttgcttagcatttgttcgtcaaattaatgtggtgaatggttatttcttagggatctacgggtgaaaaatgccagatgttattctatttcgtcgtcgaaatgtgatcattattcatatcatcgcatgccctttgcactgcattgccgtttcattatcccgactcggttggttgtgtggccaagatgcctaaccgaccatcaacgtcaagatgctcactgtagtgtaagacacgagcacatccaaaaggctggtggtgacatgaagaaagctgacgtttcttgccgatcaactgttggttgccgttcgcctaccggttcatgttgcgcgaattgtcccaagatcgtgacgctgttctccgttgcgccgttcgggttaacctttggcacacgatacgtagcgttcctgaaaaaaaatcgatacaatctcgcacgaaaacggggcaaattcctccgcgttcaaatccaaacagctctctcttgagtcgcgactcgcgacggcgggacatgagccgacgaccgggtggtttggttggtgccgcgcacgcagatgatgcaggtgggcgtggatggatgatgtatggggagaagaaagtagagtatggaaaggaggatgggttggtgatgcgaggcgccgccgcatcgcaccaggacattatcccgatcgaaacgggctcaataaacaaacggctcgaggaaggaggattaggtagatgatgatcgatggacgatccctttgctttttttttgtcgaccttagctggggctctgccgccgatatattgtattaaaaaaagttccatccgatgttaaatttttatattttgggaagtactactccgtcttaaaaaaaagacaaaccctaacttcgaacctggagtgttagacacgcatatgtccagattcatattgtcgaaacatgaattcggcaataataaaaggaggtagcgcacgagacctaaaagtggatggatgcagagacaaaggatttagacaggttcaggccctctcgatgagaggtaataccctactcctgtttggggatttgaatccgccgggtgtagtatagatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggccgttccgtaacatacaaggaaacgtaatacccaagtcatgatctgttacatattccatagatataagttatcccctatagccagtcggataactatgccatgtgggtatggggtacccataatctccacagtagcccctgagaccttcacagtcgaaaagataatcttctctcgaactagattactccaaagctgagtgcttcaatcatcttcgccatggtctccgaagtacttttaccaaatatgaagactgtggagggctgaaaaataaagtcagatgcatcaactagatgcacctaataggtgtagccctcgactatgcggttaagtgaacaaaccaagcatatagtcaaggaataaataatccaaccaaccgagtggcttcgataattgtagtcaaccaagcgacttaatattaatatgtagcatatgcggtgtgaatcc

SEQ ID NO: 63145 - DNA, 6522 bp, Oryza sativa
taatattggtcaataaaaatgcacacttacgtggcgaaaagcaacgatattgtatccaatcaattgcttaaaaacccaaacagcaccatgactatattaaaaagtcagcggggcagctatataaagctttactgtttgacaccttttaagatgcactgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgcttccgagtaataaatcttccgggtaatatagaccaagtgtagctcatatgaatagcttctgatctgaatgattatcccttatgggatactccaaaataggtgtaacaattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcgtagtcacaatcgtccattgatggtagctgacgcagttggcatatagacaagacgaccaatatagagataatattgcccaccagaggtggcaacaatactggtggtagtgaagatagtgataccaatctaaagtaatgaagtcgcatagtcatggaggcgaagaaaccagtcggcggcagacagatcaactaacaatgaagatgaaggaacccagcgacaaaattgtgtagccatggcagcaaaataatcagtcggtgacagacgaggtagatcaaaggtgatgacaaaatccaccaatcatgaagatgaagaaaatagttgacgacgacaaacgcaaccgacatgatgaagaagacgatgtcggtgatcagccaatagcagtgtaccaaccaatgataatgacaaagacactcatcagcatttgcatagtaggtcaaccgtgaaggtgaaataataagtcggcgaaaacataatcatccattagcaacagcggagatgtcagggtcgatgaagcagaggtgctggtgatgatgtcagtgacaataatccatcaaattaatgttatagctgttgtagatgcttcacttggaggagagttgatgttgttgtccaactcgttcaaaccgaaatatttgaagttgttgaagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaacacatatctagaaatggattttttttttttagaaagatggagtatgtagtaacttgggggtcatattattttctttttcagatacttcaccagattattacaatggagtgctccacgtctttaaaataccttttcagaatgaactcttttctacttcctccatttcatattataagccgttttgatcgttttaaaatcaaacttttggaaagtttgattaagtttatagaaaaatatagcaacatttatagcactaaattagttttattgaatctaacattgaatacatttgaagtttatttgttttatgttaaaagtattgctatattttttataagctttatcaaagctaaagaagtttgacttagaaaaatatcaaaacgacttatagcatgaaacgaatgtagtacaatgttgtttgagcatatcacttgtttaaattatttatataatttacttatcaaaatatgtaatctattgttataataaaattaataatctgattcagatatggcctacgagcgtatattttagttataataaaatattgaaacaatagattaaataatttacttatcaaaatatttaatctattgttataatagagaatattatctccaatgcagatgcttactcccttcgtcccataaatttcagttttagtattgaagataatatttttaatacaataaatctatacatccaatattagattggatggagggtatatgttggagcctggagaagaaaatgaacttcacatgcgtatgcacaggcagacaggctcatatgaccacacggatccatcacagcctaaaaatgcattcttttaacaaaagagtagttgaccaggtctccgtgtcaatcaatactactactagtactagtagtctagtactggagtagtaccaaaagcagcagaccaaaagaaagaatctctctactcgactaaaaatcacaccttcacccttcatgtcagcacactaaccgcgatatttaccccaaatcccaccgatttaacagcggttagtagtaataataaagtaaggtttggatgcatggacttaactttaatctctatatttagacactaatttaaattattaaatatatactacttacaaaaccaattacataaataaaagtaaattcgcgagataatttttttaaacctaattaatccataattaaagaatatttactatagcatcacatagactaattatggattaattaggctcaatagattcgtcttgcgaattagtccaacattataaatatattttattaataatatatatttaatatttataattagtatctgcacatacgatatacgatatcatagggtcttcagcgaaaaggcccccatcgtcttccccctttccacggtagttttcgttttccgctcgccttcctcctccctctcccttcccctcctcgaactccgcgcggcggccgcggcctccctccctcccgctcgatcccgacagccgccgcagctccccgattcagcgcggtctctgctctcctgctcctctggtggctcacgcggggaaggatccggcgctggatggatgagaggaggatgaggtagtttgtttggtggtttggttgtggcggaggtaagcccatgtttgggtcgaggagggtgaaggacgagatggagctcaggaagcagaggaccgtgaggtgagagcggctactacttgctttgctttggggaatcggggtctttgagttttgagtttgtttttagcttggggggaagttggggggcgcggaggtgaaggcatgacaagggcagtctttctcccacttattagtggggaattcaagaagaattccatttcttgcgaggagaagatgaattcttgagtggatttggttgctggtggtggtcagttggtcactgctgtatttttggactagtgtttagctcatcagttatagttatgttcgatttaaatggttaggtttaatttcttgtgttggattatggataatcttgtagtgaatcccacaagttgtttgctaacttcaggcttaactttgatgagcacaattagagatatatttataaatgagaatgagatgggaaaggtagtctgataagcctaagaagatcatgtcatgctgattgctgatcatttcttgcttttagaatcactctaacaatttctctctctactcctgtataaaagaatctagcaaattaataatagtcttactttttgagtgaattctaatgctgtcttcgtccccagattccacgaggagagagcaaaaccaactatacccactcaccagaagcaggctgggctagctactagtaagcttggcctggggatttcggagaagaacaagatttttctagcagggaatgagctttggtacaagaaaattattgacccatcaagtgatttcatcttgacatggaactatgtcctccgtattgcatgcttcgtggctctatttatggatccactgtacttctatgtacctaaaatctattatggcactccgaattcatgtatcgggagagatacacgcctagccatcatcgttactgtcttccgatcaattaccgaccttttttatgttcttcaaattataataaagttcaggactgcatatattaatccaagctccacgttaggggttttcagtcgaggagaccttgtcacagatcctggtaatatcgcaaagcattatttgagatctagctttgtggttgatctagtggcttccttgcctctaccgcaggtaacttggtttcttccccctgtttttctgtcaagacataacttgagcctttatccatctaattcattgcataattgaaagcttgggctagcaagaacgctcttaccaaacatggaagtattggatctcaaatttcatatactaagatatttcctgctttagttgcgaggttataaatctttgtgtcttttaggtgaaacaatccacataggctgctcaagtccttttagtgttgtattattacttctttaatgcaactgattacattctcttgcattagttaaaaagggcatctgcacttttgtacctgaagttcgaggtatagaagttatctgacatatttctccctttcttgcagatcatcatctggtctgtgataccatccgtcaaatattctttgtcagaacatgacgatgatatactgcttctgattgctctttttcagtatgttctaagattatacctcgtattttcattgaactctaaaattgttgaagttaccggagcattttcaaagacggcttggcaaggagctgcttacaatcttctattatacatgattgctagtcatgtacggtactcatgcgagttctctacaattttactcctttcgccatttaatactagctggcatggttacttcgaatttgtgctaccgttttcttctgttttgctatttggatagtcaagatgcacttatccttttcaggttttaggagcattatggtacttgctatctgttgatcgccagaccgcgtgttgggaaaaatactgtagcaaaagcgggctgccaaaacagatacctggcctgtgatatacagtctgattcaaattggaaaatcagcaccgctatcttcaataaatgtgatgccactaacaaaacaattgattttgactttggtatgttcacaccattattatcaaatcaagctcccgatcagggcttcctgaagaagttcttctattgcctttggtggggtttgcagaatctaaggtttgactctaaacacatcttctctgagacttgtaattaaggagaagaaatttgaatataagacacatcgtgctcactgttaaagcaaaagaatatacaattataagtcccatcattattacaatttttatctgattatttgaactattatgatctgattcaataatagctaatatgaagattctaatatattctaacatgcactgtgattcttttttgttaaacagttgctatgggcagactctgactgtgagtacttatattggtgagacgctgtatgctatattcttggcagttcttggtctcgtcttgtttgcgcatttgattggaaatgtgcaggtactttcatggtgtaaactccatttacaaattgttaaaatgctttagttatgaagtaactttgttgttcatttttgatatcccattcctttgttgtctgatatataaatattttttctgaacaaatttctgtattgtaattttacttgcttttgtcaaactattttctagtgcctgcctagatttggtggtgataccatcattttccctctgaactattaatttctgattattattattttttgcattgctacaaactcctttttttgtttgcctaaaaaaagggcaagcactagaaaatgtatgtttgcaagatgaaacgtaactccttatttcttcgtcactagggctagagggggctattttatgatgttttatatacatgcaaatttaaagtattgtttttaaaaagaacagaatatatatttattgaggctttgggtgagcatatcgccaatactaagtttgttcattgcaaattgtgattcgttttcttgcttctataacatttgactatggctttaggaatggtgaaacaaatttttcctggtgtccaataatggtgaacatgcataaagttttttttcccctgtaacaatcttatatttttgcactcacgcagcacattcctggtacattgtattatattgtattcgaactgatgtgtgatagtaccatagtggatttaaatagcagatgtttgggtttttgtcttgaaggaagctgatataaacaaggcttccaataatatcatgcaatgcattaattagaattgtttttacgagataacatcaacagctgtttatttgggtatttctatgacctgttctgttctagtaactgatttatgattatactagtaaataccattacaacctcttagcttcaaaggcgtacataattttctttaagaaatattgagctcatcacattatattgtttgctagacctacct

SEQ ID NO: 63146 - DNA, 1679 bp, Oryza sativa
tgcaagtgacaccaattatgtagattaggaaattggatccaggaaagcactgcaaaacagattgctatctttgatgtcctacttaaatttgataagcctgtattggtactactaaccttttcagagagtactgaaagagaataggggaattctcctgttgctataatgatgaaaaacagaaagggtagtgataatacgctgttataaaacatcaactcaacggaggaaagaccatcctctgctcctgatttctccacaagaatcaaatacattgtctgcatacacactcaattgtcagttacagttagaaatccaaacaattatctgagagcaacaatagtgaacatattacaacctggaagaagactgatgttagagccatggagtatccatacaagtcaaaggaaaaatctccaagagctgcaataaggactccagcggccgtgcagatgactgaaagggacacctaaataaatttgtagtagtgaggaagagcaaaatatttttgaaggaaagagccaaatatggtggtaaagatatattccttcccaaggggatactaatatactatagttgagtccattgaaaatcttcaaaggattgcatggtaaatcttgcaattcagtggcaacattaagttgacctattcaatgttgtttagtgctctcgtgattttataagcagcatatggatccctcaagtagctgactggcaaaaaaactaggggagtatgatttatttatttttttttgcggggaaggggagtatgaattgatgatgacgccatcttagaaggccaaaatcttgaattgggacttctatcgaaatatcctacctaactttattaggacaattcaccttgtaatgccactaaattgactttcacaatccaaaagtaacatcttgggtaggcattggcatgtgtaaagtaaaaccataactctgtaaaacctagtggagaaaagaaataaaatgactaaaaaaaatgcactcacctgtgttggtggtttcccctttccccgtaaacacccagccaccagtacagcaaggggagtgagccttttaattgcaatatacataggaatgttaaccccttttaggcttgccagcgcaaatgcaacatttgcattgtagaagatcgacagcggaagaagcttccttcctgttgccatactgaaatcttttcttttagacactcctagaatttgaccaaaatgtatgataagtgctgtagctatttgctgcagaaatagtgatattgaacaaaataatcaggctcagacaaacataggaaaaaataactttttttttgttgtcactgatgaatgatggctgatgtttgttcataattatacctgtaaggtgagaagagtcattgagtgagcatactgcataagaattgctttgttcacgaataccattgccatagatgcaattccataggagaaggcagcagataagctgcagagaagataaagagggaaatggtcagaacttccaatacatttcctacttcaattaggtctgaaccaacagatccataaatgtatagaaaactgcatatttgtggctggcctctcatcttctgcttgttgtcttgttagccacaacaaaaaatgaattttaaaacttaattttagagttgattttgaggtttttttcattgtagtttattttct

SEQ ID NO: 63147 - DNA, 2817 bp, Oryza sativa
ggtcagtagaccaaacaatcagagcttaaatctcaggaattgatgacatgataacaaatgcagtaatgatgttctctagtttccaataattaaatgaatcaagaagattccccccacggcatctttggcaatatcattatatcaatagctcgggatgatgaaatctagcgcgttttatttaatcatcatgcacaggcatccgtgcagcttaactaaaaaaatactagtagaattgcaccacactgcgaggctagatagttgactacctattccttttaagtaatgaagcaacctgctttctcaagtgaaaataagtacttgtaaactctaaagcctaatgcaggatgttcttaaggggaaaaaaaaaccattctgccacctccattagcctgcagaatgctcattgcctcattgcaatgccagatgggagatggccttgggccttggcaggtcttgatcgatgtatgcataatgcacgtgtttgcgtcttgaagaaggggactgacatctcaagcaaccatcactcactggaatacactttttgtcccctctttcttggattcgtaattcacagtaaatcaagaaacaatcaattcaatcaccgaatgctacagcccgcgagccgacgcagcgatttcccctcattttcttggattcagacttcagaatgaatcaagaaacatcctccgccgaatgctacagcggtaagtccaacacagcggctgtcgaaatcaccgcaaagaaaaggaaaaaaaaaacagaaatcttgacgagcctcatccgccgcctacgaagttcttttcccaatcaacaagaacatggccaagaagaagaggtgggggaaaggggagagctgaaacaagaagaggaaggagaagaagaagaagctgacctgaggaaggagctgggctcgccggtctccgcccccatctctctctcctcgagctcgcggttccgacaaggcggggtgctctacatggaccggagcaagacaggtgctggggaatgtgggtggggggagatctggagacggagggggagcatcggaattggcgggggctggggttatatcaacaaaatgcgcccaagtgtccttctcaaattaatccgttaattaattgactaaccttttctctcttttttttttccaaaaaaagaagagtattgcattctacaaagtacaaacattctctttttttaacttctaaacgatgtattgcatgtagaaccttttcttatatagaagttatttctaaaaaaaagttaatttaaatctgttttttaagtttatataaatcaattgagtagattttcagtaaaccgttcaacctatataacaggtattatgactggtgttatataaaactcatttattatggttttataaaaccccgctcctatatatatatgtgtgtgtgtgtttagcacacatttacttaagtttttaaaatataatctatatggaatttttaattgttgattttaactacgatttaactcttcactactttcaatatttttcacatatgataaaattaattacagtttgaataaatgtgagatttaatggaatacttagaccatgaaacatgtggttatatgtcacaagttataacaatatggctttctaccattttttaccatgaaagtaatgatttctaaaatttattactttaattaatactcagttaattatgtattaatgaattttcttgtttcgcgtgccgcttaaaatcccaaccaaaccttacgaacgaacgcagccttaattaactaattgaaggatcaatctaacatatgatttgatcatgattttgttaatcggtattatgatcatctggttacatctagatataaactttagcatttaaatcaactaagacatgtacattctaaatattgaagagtgttccaaagcgtctaaatcgaacatgtatataatattaaaatccagccacacaaatacacagataccgtgccagtggttatatttaaaaggagagaataattgttctgaacctgaactatatattctaatctggaaatgagacagtggcttacaagctattttagagaacatattctctaaatctttgtaaattcaactaaaagatggaaagtatccatacctgttaacatgaaaaaatcatgtcaatattttcacaaactgaattacatattttggcatcattttacggcgcattgtagtataaaagaattgcactgcccatggagtatcaagaagtcatttcaactctgccgtttcttctctaatctcgaaaccgcacatgacctctgaggctctgaagctcttctacgcaatcatcacattacatgctagtagatgtttatgcacgatctatttctaggatgctctcaaattcttgcataagattcagaagcagctactagcatttatctttgaaatggaggtaccaatcgtgctctttcaaaaaagatacttcctcagttcctcttgcttgattcatcgatcaccagccgtagcatctaattaatctagctttcttcagttgacttgcagtaccaatgccattcctcaaaggatcaacgtgtcgcctccatgaagaacacatctacctctgaacccaaggctggatgatgacgagtcgacgcagctgctcttgcctcgcagcctcgccggattgtgtgtcaccgaaccatttcctatctatccgtgccatctcctcctgcaccgagggcagcatgaaggcttgctatatatatgtcgtgcacaatcggcgatcctatcggaaatgcctgaagaaacacatcacaaaatgtgatcaaatcttgttc

SEQ ID NO: 63148 - DNA, 5204 bp, Oryza sativa
gcataaccgcacaaattctctccttccggaagcccatttcctcaagccagtgcaccacggtgtagcccttttgatacccgacgtttgctgtctcttaggagatcttggacgttggttgctgctggctggagctgtggaccgtcagcattgattgccaggtttgccgtgtagcttgaggtcagaataagcgcgacaaacacccatacgatgactcaaaatacaaaacctaactttcccatcgcgtcgcccacgcacaggcgactcaggggcgacaacgaaccctagcagccgccatctatagaaaaatctaattgttgtattctgatatttcctgatctattacattgaccctctcatgaggtatatataggagtacatataggatagagacttggagtacaatacaaataaaaatagatttatctctatgattctatctctagtactctatcttatctttaggatatatcttatctctataatttgtttttgactcttatctctaactaacatattatacttctaacaccacccacaccctctcctccacctcgctgctgctggagctcgccgccggaaatatagcggcgagcgaggacaacagtggtgggcttcgatgacctctcaattcaggcgcgaagaacgggtggcgcaaggcagcgacgaagatggtgcggcagtagcgacggcacgcgacgcggtggcttcccctcgaccttggcagcgccagatccaacgtctccttgccgtgacaacaaggttggcggttgcggcgacaagtcacaatgcacttcagcgagaaccattacggcaacaacccttgcagctgtggcggcggcccttgcagtggatgcacactgaatgcgcagagatgtagcctagagggggggggggggtgaataggctttcctgaaattttctcaacaatcgcagcggttaatttaacagggcccggaacctcctggtgaagaacaccggaacttcctggcagtgatgagcagcccggaacttccggagttcttgggccagggcccggaacctcctggtgaagaacaccggaacttcctggcagtgatgagcagcccggaacttccggagttcttgggccaggaacttccgggcaacagagaaaattgaaatcggggatgtaaaacaggtcctagctagagacaatcaggcacaaggtagcacaagatgtaaatcacaagataccagcagattcaaacacagatcatgcacaagagagacaaaggcgattttttcccgaagttcggatcacacggatcctactctccgttgaggtgttcaaagagccgggtctcgattaaccccttgcctcacttatgcaaagatcccagaagaagtccacagccttcaactcaacacttctaggtcattttctagaattgagtgaccaccaagatccaactcacaattccttctagaaaagaccacaagtgcaagttgctctacctaggacaacctctgaaaactcagcacaagaatctttactcacttacctcgtttccttgcggaggtgaggaaaaccttcacaaacttttccgggacatccacaagatctttggaagctcacaggcgacacctaaccgtctaggagaagatctccaagagtaataagcccaagtgacagcccacaaggtatccaaagtgctcaaacaaacctaatctttaagccatctccaaaacactcctacactctaatctaatctctcaatctcacaagataggctctagatttgagtggaggaagcaaaggaagcttgggagtggctagaaaaccctagaacatgaaagagctgaagtggaatggccaaagggtgacctggggacgaaatccatatatataacggctaggtgacgtcatctagccgttactcacaagtttgaactggaaacctgccaggaggttccgggcaaaagtgccaggaacttccgggcagcacttaggaaaaaatctagctaaacttcggtgcccggaagttccggccagaacctccgggtagccctctctgtcccggggagaaaataaactttggtgtccggaggttccggccagaacctccgggtaggcctctctgtcccggggaaaaacatttccaaaaaagattccaaaaacctttagactcatggatatgactcagagcactttgaataccctagaaccacacttgaaacccctctttatagtacggttttttctaaactcaatttcgaaagtgaaagacctagtctaatcaccttcggtgtttttcgcacttaggaacattcaaattggggggtctccttgcattcttagccatcacaacttgctttgggactaaactcctgtgaataaacttgataaacacgttagtcccctttaaccaccttgtcattaatcaccaaaacccactagggggtttaagtgcaccttcacacaccactctggcggcggcggcgcttgtggcggatgcagatgcggcaacaggggcagctccgacgaatgcgtagtgtggcgttgggaatggatctaatagggatgaacgatgacacaaccgctagccgctaaaaaaaactttggcaattgggaccacatgtcgtgtcgcgcacttgtcacgtcctatcgtatctatcaacaatcaacggacggattaagattggaccctcacgggacatgtatctcgagatacaaaacaagacaaccggatatatgtagcctttttaaattaggaacttagccctcaaacaacccagtctgaaaatcgctcctatgaagatttgaactcagtaccttagcatgtgtttggttgcaggggcgggacgggtcagaaggaatgcatgaagtgggttgaacccagatggaaatattcctctcagatccgagtttggctcatccgccaaaatctcccggaccaattgaacccacctgggtttctctcccatgttcttccccagggcggcaacgcgtggggcgaagcttgctgggcagcacacggcgcacgggacggagccatatttattaagaccggaccggatcgggaaaaactggaaccagagcccttaccggtctggtccaggtaaaagaccggcatgcaatcgacccagccatgaaccggtgagaccgcccggttttgaggtaaaaccgctattaaaccggaaataaaatcggcgctgaaccggtctcatactgctgtatgtgggatgggcacgcgtgcatgggtgatggtgggggaaaacggtctcgtggcgctgaaccggtctcatactgctgtatgtgggatgggcacgcgtgcatgggtgatggtgggggaaaaacggtctcgtggctgctgtatgtgggatgggcacgcgtgcatgggtgatgctgggggaaaagtgaggaaaaatatgggtaggtgggattcgaacccaggaccacataggagggagttaactcgccaaccatcaggttactatgcttcttgtgtttttgatagaatgagtaatgcatttaatagttattgaaccgggtcagaccagtggttcacctggttgaaccagtgaaccattgaaccaagagcctcaccggtttgattaccggcccggtctcaataactatggacggagctcgttactcgtggacgggcgcgcggcgcgaagctcgctgggaagcatggcggcgcaaggggaggagctcgctgctcgtcgacgctcgcagctcgcggacgggtggcggtgcacggggcggagctcactactcatcgacgctcgttgacactcgtggctcgcggacatggggcggcacatagggcgaagcttgcggctcgccgatggatgccgacgctcgtgactcacagacgtgtggcagcacgcgggccgaagctcgacaacacgtggacgggcgccgccgctcgttgctcgcggacgtgcggcgacgcgcgggccagagcttgatggcacgcggtggagctcctagcgcgcagacgggtggtgacgcgcgggatagagcttgacggcgcgagcccgctaaagtgcggtggagctcctggctcgtggacgtgcagctgcgcgacaaagcttgcgggagcacgacggagctcgcgacttgcggacgtgcagtggcacgcgacgaagcctgcaggagcatgactatgtacggcggcgcccgacgaagctcgacggaggtcgacagtgcgacgcttggcactcgcaatgtgctcaatcaaatgccttcgacttgatcccacctaatcctccaaccaaacaaaaactaggaccatcccatccctcttcaaccaaacaagcaacttggatggacctattccaaaaagagaaccgctagcgcacgggatcccttgagggattgagagtcatgggatagttaaatgaatctgcccacaccaagctttagtctcctagcacgctacctttttttttctttttgttaagacatcgcatgcggtctcctatcgtaaggccatggtgtcagggttatggatatcacatacccaatagtgatcaactaagctcggtagggcccaccacataccatgccttatacggaatcatacctcgtatatagaagaagttccggataaggaaggacaaatagagttctatatggaaacgacaaggactactcggattgtatccatattggtctcccaagttctacttggacaagggggcatctatgggtagaaatacaagccccccctaggaggaggggacagatcaacaagacacaacatatacgcaagccaacacacgctggcagatctcgacatcagagattagcctaaatataccccatccggtgcctacggaggccggcaagagggatctagcgccatctctgatcacgatgagttcatattcgaggaggagactaccccgtcgttaactacgagttggttatccatgccgccaagtcgacgacaactagataggttatcccaaatattgaacttgtgtgattcagatgaataaagagcaacaccggtttaggccaacaggatgtaggggtattacatgttaaataaggggctcgaacttgtataaaaatccttgtctccatctcttttacctcaatctcgcatataccctggtaccgacgatccccataccatctaaataccatagtcatggtaccacccgtcgacaccacgtgtagccaccactcactgaaaaataagctagtgttgtttctgatgtgaggtacaagg

SEQ ID NO: 63149 - DNA, 13385 bp, Oryza sativa
accgtccatccatccatccatccatccatccatcccaaaagagaagacacacaaagacaatatctaaatccggtagcatagagctaaaaggcatcgtcgctggcaaggaacctgccttgcttgtactccctatcacctacatagtattccatggcaagctctccccatcctccattgtcagcatcatcatctccatcctcttcctttctccaaagaagacagagggcacgccatcaaagtggaagaagcataggacaaggagaagggggatcgagcccagagcaacactagtgtgggggaggtcgacatacacggtggatttgcacgaaccttcaccgacatgatggagtagggggaaagacgagcatgaggggaacaaggagagagagagagagagaggggaggaagatgagcttcccggaggtccagaggataaggccccgtttagttccccataaaatttccccaaaaacatcacatcgaatctttggatacatgtatgaagcattaaatatggataaatgaaaaaactaattacacagttagggtggaaatagcgagacgaatcttttgagcctaattagtctatgattagccgtaagtgctacagtaaccccacatatgctaatgacagattaattagtctcaaaagatttgtctcacggtttccaggtgagttatgaaattatttttttcattcgtgtccgaaaagcctccgacattcggtcaaacatccgatgtgataccaaaaaattttcttttcgcgaactaaaccagccctaagtaatgtgtgtgtggtggcctgatactctgatttgttaaatgaattgcatcattaattaatttatcccgttgggacatgacactgttgtgtagattttctgttccaaaaaacagggtggcgccaacctatcctaaggagtctccaaaccaaacatgcttagggtgctactcagatcaatataaccactaggctatatgcactctcacggtttcttgtctttataggtaccagaaaacagaacttctttaatgtacgtgggcacgtggctacgtattattgcttcaagataatatatgatgaatctcgctcgcctagaacgtcattgcaaacattattacattgccgttcatcctaattagtatttgccgcttgaaataaaactacacgcgttgacgcaattaaaaagacattgacttgatcggtatacgcatcagagagcaagaatactacaggcgaactatctcgatccaatagagtaattcgctgctatatcgaattctatgcatacgttgttttccccaacgccatgattaataattttatcgtaaaacaaacactcaccttctctcaatataacagtgttttaatagctggttagctaagacatttaaagatcaacgttctcaaatactcctctccatctacttttgataatcatatttccagatctaaaaaaaaatttttgataggcatatttcaattcaacaacttatcattttaatgactttctcggatttaatgcatgactattcattcttccacacatgattggctacatgggtattgagaaatataaatattaatgaatcgcttgtttacgaggaatgactagtagcatgtttaaatggataaatagaattaattatccttagtctgtgtgccaaaatgaaatataactatcaaaagtagatggagagagtactaactaatacgactaaataaaattatagtaggagatttgcgttcggaaaccctgtgtttccaacacaagctgtgtgcacggaaaacgaaacggctcattagctcatgaagtatttgctcattttttttttccaaaagtggatcaatatgatttttttaagcaacttcgtatagaaacttaaaaaaaaaaggtcccgtttagcagtttaaaaaacgtgcgcacgaaaaatgagaagggaaagttgggaacacaatgttccaaacacagccttaatagttcagagtttttttttttgacagttaatagttcagagttgagatcgagcatgttgatattctacaaaattaacccaccggccagcggaagaatactccgcgaaatttcctgcgacttgcattgtacaagtcgcacaagaccaaccgcgtgtctccagttaaggtactcctacgtgtatatgtatgccattcataacacgatcatcgatcgagtaaactaacttaattacacccgatcatcgagcgaattgaaagacaagctagctagctaaacacgatcgagttatcggttatggagaggtggccgcttcccgttgctgcttcggcagctgcagtagctcgcctttctcttctggtcgtgctttgcggtgccatcagtagggcggcggcgggggccccggtgagggtcgaagttgtgctggacctggcgagcggcggcgagggaaggaggagcctcgcctgcatttcaatggcgttggacgactactacggcgccaacgattattctaccgccgcggccgcgcgcgcgagggtggagctgcgcgtcagggactcgcgcggggacgtccttgcggcagcgcacgccggtgagtgcagctactatacacatgaagctagctagctaagctagatgtaacgtatgcacatgctactggagaaatggtttgtagtcccggtttgtaacatcctatagtcctagatagcaaaccgagactaaagatccgggacggttcaaatacccgggactaaagatcgatctttagtgtcggttggtaaaaatttctatattctttcttccctacgaaaaatttctctctgatcaacttccatcaaaattacagaggcaataatgtatacaaaacatatttctaaatgtaatatgatacccaaaaaatatggaaggatgaagtactgaccctttaagaaccctccaattggtatatatccaccaaaataaatccttaaaaaattcggccacccctcccctcctccaaagaaaaattttgaggctgggtccgggtggaataaaaaatccctccccggtccattaaaataaggaatttgaggttttggttggaacggttaaccccttgtttatccaaatttttttgaaattattaattattttatttgtgacttactttattatctaccggtactttaagcacaacttttcgttttttatatttgcaaaaaaaattttgaataagacgagtggtcaaacgttgcaagtaaaaactgaaaatcccttatattgtgggacggagggagtacatatataaaggaagctaactagtcctggttggcgttaccaacccggtgtaaagatccccgggatctttagtcagttaggatctttagtcccggttggtgttacaaaccgagagtaaagatcccggggggcctgacatagcctaccaaccggaactgaagaacacatagtctcgttgcgcttaaaaagaatttttagttccggtttttattggaaccaggactattatgtaatttggtcgactgatcaaagatactttctccagtagtgacagtggtgctggcttacacggctggtcggctgcacatgcatctgctagctacctcagtataccggagaaaaccaacttctgatgataaatttgtacaagtgtttatctaaatttatttttaaaagttgctttttttttcttttacagagaaagtatgcaccaaaccgtttttcagttttacttaattttgtaaaaatattccatcatatttattattttgattacatgcatctgtttacaatgttattgctaactacgtatcctcgatctattcctccgtgtataagtaatatgtgtatttctcatatctcttagttaaatacatgttgaattttttttaatatttgttgagtacaaaaaacgttttttaattattacttggtataatatctccttaatctgtcgaagtctgtttgtagcttctaggagtttgtttgtaccgtctagaagaataattgttggaaacaagacgattcatttcgtcgtgtattattctccttagatcgacatccatgttacacgttattggggacgttgcaggagtgtccatgatggaccccaaatttaggggaaaagatgaaccggtgcgcatgcctgtgtatcgtaagtatcttcactcttttttgttctctggcattcatctagattggggagatctttttttgggaggggggaggggttggtatttggggtagtattgaacgaggaggaggccggatgcaaaatttctgcctacatggagtgccatgtcggtggtcatctccggtcaaatgaagtttgaacctgctatgattcattaaaccgagttgatggatttagatacgtattttacaagtttatagatctaagtgacacctccgaattttgataagtagtatctatattctttaatatttgacgttgattagtttaaaattaaaataaccaatgtaaaaaaaagcaaaggaaatatatttttgcttatcgaattgtcactcagcacgtacgtcaaaaccacttgggtttggaccaggaagaagaacggttttaagagttaagggtggttcaatatccgatattagagtttatagttgtttataaacaaacgctaattgaaggggataaaattaaattaatggactacttatcccttctcgttgtccttgcagttgaggagttgatgaacaagaacgcccaggtcgaagccatcatcgggcctcaaacctcagccgaagtcgagctcttcgctggcatcgcgatccgcaaccacatcccgatcctctccttctcccctactacctcaccggcgttgagctcaccgccgacacgcttcttcgtgcgcaccgctgccagcatcgcctcccaggccgcgcccatcgccgcaatcctcgatgtgttctcgtggcgcgcggccgtgctccttcacgaggactcgctctacggcatcggcatcctcccggcgctggttcacgcgttccaggtgcaagggcagctgctggcagggtcgtacggtgcgcgtggcgtggtggacagcgtgtccgtgccggccgacgcgacggatggccgcctcgacgcggcgctccgtgccgtcaagatcatgccgtggcgggtctacgtcgtgcacatgctccccgccctggtcgcgcgcctcttccgccgggccagcgtcgccggcatgatgtcggagggctacgcgtggatcgccaccgccggcgtcggcgccgcggcggacggccttagccctgacgacatcgagcacatgcagggtgtcgtcagcctacgcccgtacgtgcagccgacgggccaagtcaggagtttcacgaggcggctcaaggcaaggtttcgccgtgataacccgggcatcgacgacgaagacgacgacgacgacgtcgcgcacacgtcggcgtcgctgctctggctgtacgacacggcatgggcagccgccgccgcagccgatcgatgtctccaccagagcagcaacgcgagggaagaacacaacacgacgacgtttctcgatgctctgctcgcgaccacgtttcaaggcctggccggaaggttcaggctggtcgacggcgagcggcaggtgtcggcgtacgaggttgtcaacatcatcggcagcggcgcgaggacggtgggtttctggacgccggagcttggggtctcccaggacatggcgcggcgccgccccaagagtggcagcaatgaggagctgaagcaaatcctatggccgggcgagacggcggccgtcccgatcgggtggagcgagtcggcgaacgggcggccgctccgcgtcgccgtcccggtgaaggtcggattcaaccaattcgtggcgatccgaaggcaacaaaaccagacgagcgccggcggggcaatgatcacaggcttctgcatagacgtgttccaagcggtcatggcgaagctggcgtatccagtcgcatatcagtatgtgccagtcactgacaacatgttatcttatgacaaaatggtgaacctggtgcatgaaaaggttagtgtctacttaccacctccattaatttgcgtttacttggcagcattaacttttattgcttcaactttgatcacaaaatttatttttaacttaaatgggtagaataccattaatatattttagaacgaaggaggtacgaaacaatatgtgctacaagtataggccgataaagggaaactattctaatccctcgaggggatgttccctcgtttgctaaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagcgtactgtttatatctaaatttgtcttttttgtttctcgatgtgtagatcgaatttgaacatgaattttggtggactagtaggtatcattatactctacattgtcaattttttttagattttttcacaactatttgtatcgaatttggaagaaaaatgtatacgaggggatatcctttcgagggattagaatccactcccgccgataaacaatgacatgccactaaaataatttatcctgaccttgttgaggatagaattgtattaagatagaacatttaaatatactaaaatttaacaaatgcatccgtctcaaaatataccaatctaatactattgtattgtagaaagccgatgtggttgtggctgatatgacgatcacggcagaacggatgaaactggtttcattcacgatgccattcaccgactcaggagtgtcgatggttgtggcggaaaaggagaaggcaaacaacatgtggatcttcctaaggccactaactccgggcctttggatcactagcatggctttcttcttcttcaccggcttcgtcgtgtgggcaattgagcacaggatcaacccccgattccatggcacgccatgtaatcagttcggagttgtattctactttgcattctcgactctagtcttctcccatagtaaaccccgttcttgcccccccccctttttttaagtactccatcattctaaaatatagtaatttagtactccctccttcccatattgatcatcatataaatttatacaccaagatcaaagataatttaaatcacaacatcaagataccatgcacacgttctctcacaatgcatgcatcggttaaattataatgccaactacacaccttagcatacacacattctcccgtgctgcattaataattgtattctgatgaaatccgtgtccatgcggttatatgatgatcaatttgagaaattttaaatttcattgtatgatgatcaatttgggaaggagggagtattgaattagaaacaatctagtactacgatatctgtccaagttcatagtactatattatatcaaattcaatactcgattactatattttaagattggggagtatattattatatgattgcacaattttgttactattcccttttgatgacgacactaatcctgatttaattttcagaggagaagttggagagcaacctgtcgaagctcgtggtcatcgtatgggtgtttactgttcttatcatcacgacaagctacacggcaaacctaacatcgatgttgacagtgggacagctgcagccgacgataaacgaattaaagaagggcgactatgtgggttatcagcagggatcattcgtccaaaacatcctaaaagacatgggattcaatgaggacagactaagggcatatgccacaattgaccagtatgccgagccctaaacatggggtcagataacggcggtgtctcggcaattattgacgaagtgccctacttgaagctctttgtgtctcagtactgccaaggctacgccatagttggtccaacgtacaagagcggtggatttggattcgtctgtccttatcatccctttcaacacatttcacacaacataatttagatagaaaatggatttatggtacttgagaaattactgaaagttatcaaaattttaaactacaaaatatggtactccttaattcctcaagaatcgtagaattttaccaagaaattaacacatatagaaagtggcagttagctcatactttgttcttatacggtaattctttttttctaaatttaggggtggccacgagtggagcagcttgagcttaagtcccacacgtgccaaaaaaacacaaaggaatttgctgatctttagttaaaattgtttaagaagctcatactctagtgatttagccctatttatggttcctggcttcgccctttactaaccgatggggttttttttctttttttttcaggataaccgaggaatactgttgtgccttttttaacgtagctagctgggattttttttatatataaaaaaaggttaaaacctggactatgcatccctttggatgcacacatccgagctagctaggatgtatacagaccatggtctatgtttttttaactatctgaaacacatgcgagacacgagggcgcttaaatccatttttttaaaacgattcatagggcacttagtatttatgtatttttgttctttcactaagttgttaatggtgcagtaacaataaaactaacaagttatatactaccttcgtcctaaattataagaacttaaaattagattagatatttcttagcataatgtattggaataggaagtattagaaaatatcttatttatttatacgttcttatattttgagacgagagagtaaatgtttgtgcgtgtaatgtcatccaggttttcccggtggggtctccgctggtgccggacgtgtcgcgcgcgatcgtgcagctggccgaggaaaacaggctcgcgaggatcgagaacaagtggttcggcgagcccggctcctgcgcgagaaagagcaacagcaccggcgacgacaagctccggctgaagccgaggagcttcggcgggctgttcctcatcaacgccgccgtgtcctccgccgcgctcctggcccacctcgtcgccgtctcgtcgctgccgacggagctgcggcggcgcttcgccgtcgtcgtcgctttcggtgtatccggccggcgtggaggtggagcgccggtggcgatggctggtggcggcgcggaggagagaataagcgagccgcatcagttggttggggaaccaccgaaccagaaccactcagctgcagggaccagctcaacagtagtagtacagtagttgagtacacaatagtcaaatagtagtagtaatcggctgatgcaagatatcacctcggaggcatcatcctgtcccgttctgtagtagtatttttcttgttttatagatgagtattggtaattgttacacgatcctatcaatacttcaataggttgttgttttataaatactagcaataacagcgcgctacgctgcgcgtgtgtttaagatgatgaataaaaggtagttttcagctggtaatttgtaatcatacatgagataagatttatatgtaagctagcaatttgttgtgcacacataatttagcacaaaggcggaccaaattataggtataaattagctagtatggatgtatgattttctagctaaaacatcacctcattgttcctgagcccttgcatataatgattgcacatgtaatgaacaaacattcatctagtgaacatacacatctccagattcctatcaaacaaaataaaacatatctctagactccacatatatagcatgtgcattttttggaatcccatgtcatcagctccaattgttttggttatctagatacctacaaacaaaggacttccagaaaagataaaccattaataatattgattggcaccatctgagaacaaaaagagaccataaataagagtgatagtatcaagaacacagaataacccataaggtacatattgaacttgatgatttctcaagcagcactgctagtgataacaattgagaagagcatgcatctactacagacatcacacctcttgatctgtctctactctctagtgtacctactacacatatatagaattctaaaaaagtaaatactatctaaatgccaaaatgtagataaaaaagaaaacatggactattcatatcaacaattttagccatttacatctggtattgatactgccatttatattcagcgcatatctcgacatattgccatttagcttgttatacatagagcctgactgacctaacgaagacaatataaatatgtatatttgtgatctagtaaagttctagctaatatcaaaatcttcaaccgaagtatagatttttttttttgctaaatgtgcaacattccttgtaattgtcagtaagttccataacccttgattgacacagtagtattggttgttgtgtaagaaagatcatataaagatgtagccttttaccataaagaaatgatttgttggtaccgaatgcaacatcttaaaaatgtaatcaataagcctaggattgggagaatggactcagaataagcttgttgtctcataatggatatagagatgaaggaactaaggccccgtttcttttagcttaagattattataatctagattattgagtcagattactataagctagattgttataatatgtagtagaataagcggttagttgtttctttcctagattattagaacctagattattaggtttgcaagtctaaaaaaggagtggggtggcatggtgggtaatttttcacccaataatctgaaaaaagctcacctaaatgagcttatcagattataataagctaggctcgagattataataagctacttcaataagttgtctgtttctttcagcttactcctaataatctggattataataatctcaagctaaaagaaacagggcctaagctaataaaaatggagatacaaatgcacgaataacaatacctttgaatggacaaactgaaaggttcaatgcgatatataccaagattgccaagttcggagaatctttgatgacatatcaatcaatattcccaacataagattgtccaaaagtatatcatacatactctgtcattctgcatataaaaatagtgggcagcaaattaataaataaaatactatctgatgaaaagggaaggaagttgaggagactcaagagatgcagcatctgcccgtagcatactatcatggaaatgcggtgagtatttagaagaccaagattattacctcttagagaagacaacaaagaatttccatacggtccaaatagaagcacaacaattggcaagtggctgctgaaagaagatatttcatcaatatggaacttacaataagtagcaaaccaagaacagagaagagatatcatgggattcgtatatatcagctacatatacatataatatgtgaaacatcttatcggaacttagagggaggatcgatggtttaagtagtggtgcataactgcatatcatgctgtgttagctgactgattcgcagaaggggaaagatagtggatgcgtaggaaatggcaacaacaggccagattaattacaacctgcatgaaagaatgaacacaacaaagaattaggactgcacaagggggaagaaatggctgttgaaatgaactatctgagtttggaacacaggttgctgagaaaaaaaataatttcatatggtcaagtttgattcattctaccctggcacattatagttaaaatctggattatataggcacttaagcctcctttaatttgcattcagtgaaacattatcaatggatcgtagttcctacactaagaactacctcatcccatatcctattatccccaactggctgtcaataactgaaagcctacttggctgttgaaataaaatatctgagttttggaacacagtagctgctctaatggtatataggcttcaatttgaattgtcacattttagctatatgactatgtatgtagcatgttaagcatattctgctatcaataactatttcaattgtagaaaaacactataacataagtatatggttttttgaacgcctgaatttgcacacctcaggagagatatcctacttccccaaaatgcattagtgctctaaagagagaacctagctagtgcttctcagtatacctctagctaagaggacaaaccaaattaaggaacaaaaataacatgcaaaaacgttccatgccaccgcataggtcaatgatagctaaaatttcagttctaaataggttaggatgacttcatatgatgttttaagaaaagtaactaattcgtatggagggaaaacagaatttacatagatatgtaccactccatatgcactggaggaatacctgcatctagagaggaatacctgcatctagaaaagcttaataagcactgataaaaaatacagtagggcatttacattatgctctgaacgctttgagatggatctgcactgtattctttcttagtgtacatcttacgcagggaaaaaaaggagcacaaatatgaacctctaatcagtcaaagaaagatctttaccttggcaaccaactgcaagctagcagagaacagctgggacttgaataaatgcatgaaagtcccaactgcaagcagagaaccacatgggggcagcggcgttggtactgcaaaagaacagatgccaatcaggaggaagcctttggcagaagtgaggatgtaagagccagaggagagattggaggtaccagaggaagcgatgacgtgaacatggcctttgcagcgtcgagctggccatctggctgcgggagcacaggcaagggatgcggggaggtcgtccggccgtcggggtggacgcgagatcgacaggtgcacggaggagctgagggagcgcaggaatgagcgcgtgcaaggcggcgtgtccctggcaccggaggacggaccaagggcgactggatcaactggtggggcgtcctagaccatcgcttccggcggcccctgaaccagatcgagcacctcacctagcggagtggagagcgcaaaggagagggaagcggtggccgcatggggatgaatagggataagagggcggtggcggctcgcgttcctctcgtccacgcagcgacgatggctcgaagagcgcgggctgcgcggctgcgccggcagcggtggcggcggcgacgaacgcgaggggaggagaagggagaggctgcgaagcgggcaagagggctagggtttggtgtgggctagcgaaatctctgccgtccgttcgcgatccgacgatcccacgggtgtgaaagggccgccatggcgggacacgtgtatggccagatcgatcgcaacatgagatcggacggtggggagcggagacttgcgcgtaattaactggaaattc

SEQ ID NO: 63150 - DNA, 1437 bp, Oryza sativa
agttagattcaggaagttagcatgttttcatgcttggattacatagtctgttggagatgcattatatcctggcagagtgatgtgtcatgctgggatatttggcatggaagaatcaatgcatgtagtaactatatggcaaaacatcttcgatcacaacggttgcaactatatcaaataacacaaaggggcattttgtgccatttagtgaacctgatttcagaaatggcaagcaccattgattgaatatgcacaatccttgtagggataatttttagaagctcaatattacgaatcggcgatacaaattcatttaggtcggtgagttggcaatagctggaacatcagttggttgatcccaaggccaacacagaaaaacatatccttgttcttatcttcccaccacaaaacaaagaccgaccaaaccatgagcattgctagatttaagacagtatggtaggtgggataatattacatgggagccccaaatctaaagtgaatgggcagtcagttcttgtttaaacaaataaccacacaagtagaacataactgcttgaaataacttacattggagcgactctagtggcagtgtatctcagaatagctcgcacaatactgaagctctgggatgatcaccttcatcaggagatgagctacaaatgcatgtcatttggcacatctgaaaacacaattatattatatatcatgtgcggctaacgaaggttttgtatgttactgcatcctcagcactctgtagtatgtccaatttgcaaaacctaaaaatattctgaatcgcatctttgaggtaacataaaaataattatgtatagcttagcacttaaaaagggtataggtttgtcttgccatccaaagatatgactataatatctgaacatgaaatgtctactaattctccatgatacaaagagcaaaaataaatatcctctttttgcattgattcaattcaagaagcgtcaagattgacctgatagtcaatataacattaccaataccaccatgcaaaaatttaataagcacatctcagaaataaatcaaataagaaagttcataaggattacctcttgctcagaactcagagcagagatcaatgcagtatgaatgttccctattatcttatcttgtgtttgtttctcagtggaacaattgacagcttcatccattatgttttcctgagctgaggatagtggattggccctctagacaggaataggtattttgcaagaggaaatatgtcttcaaaactgacctacgatttttcacttgtctgaagatcaagaacaattgagaatgatcagatatcatcgctgtcctagatgaaagaacaatttagtaaagtccttttccaaatttaaaaccgaataatagctatttcagtaggatgtttcattggcataatattcaaatgggtgggctgcagga

SEQ ID NO: 63151 - DNA, 1074 bp, Oryza sativa
atttgtttaaaaaaactagctatttctagttccagaaatctttatatctaaatatgccaatgtatttgtagcaattgaatgagttattctgtttgtgttttataaaaaatatacaattcaattcattataatttaactttacaaactctagttttaaactgatttgttttacatttttatggtcttattttgaggctgcgatattatacgatacttcttacttagatttcccaaggaacatacggactttactaattattttatataaaattttcggtaaaattcctcaattccaaatgatatataacactgctaaatctgatatctcccatataaaagtgaaaaatataaagtgctcttttcgtggtaaattggtgaagcttatgcctttgatttgttttagttttcttatatttaatataatcagccttgttaggaaaaaacaaatgttttcgaaacataaaaagtattttttactactatctcaattttaaattaattattgttttagttttgtcttaagtccaaatatgtttatctttgaacatcaactaatttatggaaaatcgtaataatttaccacacatgttgacagagctcggggctcctcaccgggagaccgcgcaggcccccctttgccagttcggccgggggcttagggtgagatctcaagctctcgctgtgtgtggaaagatcgcgtgccaggaagaaacgcgagacacggacgatgtatacaggttcgggccgctgggaagcgtaataccctactcctgtgtttttggtggatctgtgtaagagcaagttacaaaaaatcaaccagccctctcctctctcgggaaaatccagccccctctctttgtgggcatggtcctccttttatatcttaaggggataccacatgtaccctttcctttccaaactggacttttcttctctttatggacggagattggtatggttgccgtccgaatgacatttcgatgggacaacccacacctaccttcactcccggcggagacaggcgcaacgtgggatcgtggctgtctgttgctgacgcgaccagtgtcagaccgg

SEQ ID NO: 63152 - DNA, 4217 bp, Oryza sativa
cgcaaaaaatgcggttaggtgagcctttccgtgttcacccaacttatgtacatagtgcaaaccccacagggggtcggggcacctcggccctcggggtcggggcaggagcaacccgaccccccctcggggaaatcaggaggaggacggacacctcaccctcgggcccgacgtccccgaaggtgccaggccacgtgggcgattccatctgcctcaagcctccgggcgcaatactcccggtcccatatcaccgacagtagcccccggcgttatgtcagggcaatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgtagattcgtttcgtctggagatatggtaacgtcgcttcggtcagcgagcgtaattaacgcacacacgatacgatctatctcgactgccacaaccgcatatctaccttatgcgccgtaagcgggcgaatggaatttagtggaagcgtgggcgcgagaaacgagggagcgagatagcgagtaacgagggagcgagatagtgggcacgagaaacgaggagccgggctcagcgatggcaagggtataaagctatcgaggaaaggacttgctcccttccttttcgccactattcccctttccttcgccgtttgcgcccctaactctctctttgctgcgcctcaccttcgccacacacactcgttctcaaccctctctttctccgacgacatggcacggggctccgctctgctcgacggtagcgtactaccgccttcccgcattgtgagcgagaggcaggctgggctgccgcgccgcttcatgccggaatccgccaccggccgtgagatagtaatgctgggtgagggacgcccggcgccagactacccggggcggtccgtcttctttctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggcggctgctatttcctgccgcgggggccggtgttgaaccgctacatcccctgcgtcctccgcaaaaagtgggatgactggaagagcgactggttctacacccccctcgccgacgaagcgcatctccgacttccgagccagcccccggtgcaggcctccagctggcgggcgccggtagatctgggggatggctatgacgccgtcctcgaccgcctcgcgggcctgcgatcccaggggctcaccggggccatggtgtacggcgactacctccgtcgtcggattgcgccgctccagcggcgcgctcgggccgcctgggagtacatcgggcccgaagactatatgcggacccaccagggggtcagatgggattgggcccccgaggacttcaagatactgatccaacgggtgctaaatctcaactccgtggaggcgtccctcatcccccacggtatcctccccctctgcagcgacccagatcgcgtctccatcttgaccattatgacggcggtcggggcctcagaggagcaggctcctaagggccatggcggcgcaggtgggagccgccggggggatcaatctacccccggagggggtcgtgcttctgggccccgcgtcgggggctcggggagcaaccgccctaccgacgcccgggggaagaggaaactgggaggaacacctcccccatctcctccccgagggggcggggcggcgcgtgccagcagcaggcgcccggagggggccgcgccaacatcgcagcccgagggggagcgcaagaagaaacggctgcgcaagatgggggagacagaaccatcccagggaaacctaatttcccctccaaggtggtcatttaaccgaccccctcgcaggttcgtcccgctctctttgcgaccgtcttttcttctatcccaaaagcaagttttaccttacccatcttgtttgccttctggttttttcttctgcttcagcgatgtcccgtcgcgtccctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagctgaagaagccgctcgggaggaggccgcccgggctcgtcaggctgaagaagccacccgggaggaaaccgcccgggctcgccaggcagaggcgatggcgtcttccgaggcggtttacgacaagaccgccggcgcgtcgctcgggcccactccctcgggtgacgctcaggcgacaacctccggggcggcttgcgacagggccgcgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccaccccgctgagtgccgagccccttctgcaagccttggccgccgcaaacaccgcggtgctagatggattcagcgcccaggtggaggccttgcgagcggaactagcggagctcgaggccgcatgggcgcgcgtcgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgccctcgtcgccaccaccgcgatgattgaggcgcaggactccctccgccttcaacacgggagctgggaggcggagctaaagaaaaagctcgacgccgcccagggggtcctcgacgccgccgctgcccgagagcagcgagcaacggaggctgaagcggcgtcccggcggcgcgaagaggcccttgaagcccgtgccatggcgctggaggatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccgcgacacaacggctggcggacagcctgtccctccgcgaggcagcgcaggaggagcaggcgcgccgcaatctggaatgcatccgcgccgagagagccgcgctggagcagcaggctgctaacctcgagacgcgagaaaaggagctggatgcgaggaagcgcagcggcggggcggctacgggcgaaagcgacttagtcgcccgcctcgcagctgccgaactcaacgtcgcggacatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaatttcgcgctccaccaatctggaaggcctcgccccgcaccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggatggcgctggaggagttccctcccgggaccgaggacgatgcgcgcgcgcgggtccgggatgccgccaaccacatcgtccaaagcttgaggggtcggcccctcggctcgcgttcgcccccagctccgacgaggagggcgacgccagcggcgaggacgacggtggcgacggggccagcgacccgggcgcattggaatgagcccccaggcccccgccaatctccaattttttctttttctttcttctttt

SEQ ID NO: 63153 - DNA, 14045 bp, Oryza sativa
tcaagttaagattctttagaaggaaaacggcacagacccaccctttaggaaattgaaactgcttttattgaaatgctgaaataagaaaagtaaggttgtgcatgtgtggtagcccccggctaaccctgcacacccgaggggggtgcgtggttagcccgagcccgaaacctgacacccgaccccccccctcaggggtagaagcgacgaaggtgttcgatgttccacgggttcggcagctcagtgccgtcgcccgtggccagccgtacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgcttggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatctttacaacgggataagcctcgggccacttagtgaacttgtcgatcgcaacaaacagatactcaaacccggccggggcccgtttggacggttccaggatatcaagcccccagacagcaaatggccatgacagtggtatgatctgcaaggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcgatcaatctaagagagcttggagcgctcccttcgggtcccgaggcctggactccgacgggcctcgggggtcggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctattccgtcaaaatggcgctccatacgccgcacttggcgtacataggcgtccatttgcgggtcggagcaccggtactccttacagacctggttaacgaccagctgggaatcgcctaacaccaggagacggcggatccccagtccggctgccaccctgagtccggcaaggagtccctcatactctgccatattattggtcgctcgaaagtcaaggcggaccagatatctaaggacgtctcctgtcggggaggtcaacgtgacccccgcaccggcaccctggagggacagagaaccatcgaactgcatcacccagtaggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaattcagaaagctcgattgcccattttaccacccgtcctgtaccctctcgattatgcaagatttgaccgagggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccactgcacctttcggtggggccgatcctctctgctaggggccgtatccccggggcgttcttcgttcaagtggcctttcggggtgcacttgtcttctgtgccgatgacctcggggtcggaggatgaaaggggcggccttccctcagtggcctcggggccgtcctgggggtcgggggctcctggcatcgtcggacaagcgggcaaagggccaactccggtcgtcaggggcctctggcctccgttcgactcgggggcctcttctccctgctctttctcgggtcgagtcagcacagggttagcctcggggtcagagggcgttaagtgcggccttcccgcagtggccttggggccctcctgagggtcgggggcacctagcaccgtctgacaagcgggcagagggccgactccggtcgtcaggggccgtaggccaccgtccgactcgggggcttctcctccccgctcgctcccgggccaagttagcacaggatgggggtgcacgaaatgaggattgttttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcctcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagttcgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacagcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaggcgagcgcgactttaaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgcgtcgcctcatgagtaggggccgcggcgagaagctctcgcctcatggccttgaaactccggcgagaaacgtgagcacacgctcccccgtcgacagtggcaatggtggccccaggttcttggaaacctaggtcatcatcaccgtcatcgatgtcaacggcgggggccttctgtctggcctcacttcgccgtttaccggagggaactgccgcggacttgccctcacggcgttcctgcctcatgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccagaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaaattcatggtaaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggccctcacgtccatgtcgaggtgacaccctggacgaagaggcaccctccgttgcgcggggagcacgccgatcactacatcggcgctcgatgtcgaggcgggcatccggctcttcatgctgatcctcccgagtcggaggcgccgacgagggagtggtagccgaatggcgtgcagcagccgccgctcgccgcgccctccgccttgatgacacagagccggtggtggcggcgccggaggtcctggtagtggcggaccgtccaccagcacccaggcgctgctgtgccgtcatgaccaagttggccacgtcgtccagccatcgctgggctggagactccgggtcagggacgacgggcgggtgacgtaggagcgcgccagcagcctgaagcactccctggggcgtgctgccgtcgccgtagacgaggaggcgacgctccccatctcgccgttctcctgcaccacccgcgactggcgatgctgcggatttttcgactctctcgagcgcctccccccgcttgggactttggcgcggaggaggtgggggagtacgagctcgatggcgcgggtttggctccccgtcgtcgccgctcacactcggagagaggtcatgcgcctttgcttgctcggccattaggctgaacaagggaaacttggcccacacggaagagtatgagagctcagaaaacacacgctgagccccctacctggcgcgccagatgacggagctcggggctcctcaccgggagaccgcgcaggcccccctttgccagttcggccgggggcttagggtgagatctcaagctctcgctgtgtgtggaaagatcgcgtgccaggaagaaacgcgagacacggacgatgtatacaggttcgggccgctgggaagcgtaataccctactcctgtgtttttggtggatctgtgtaagagcaagttacaaaaaatcaaccagccctctcctctctcgggaaaatccagccccctctctttgtgggcatggtcctccttttatatcttaaggggataccacatgtaccctttcctttccaaactggacttttcttctctttatggacggagattggtatggttgccgtccgaatgacatttcgatgggacaacccacacctacctccactcccggcggagacaggcgcaacgtgggatcgtggctgtctgttgctgacgcgaccagtgtcagaccggtcacagatcggtcattcttgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctaaaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgcttgaccagaccgcaataaatgcggttaggtgagccctaccgtgttcacccaacctatgtacatagtgcaaaccccacagggggtcggggcacctcggccctcggggtcggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacacatgtgaattatatattatgaaaatattattcaagttaaatctggaaacataaaccttattgtgttaactatattagtttttagatttttagaaatattgatagtcaaagaccaaagtttgacttaggactacaaaactagaatgaacaaataacttaaaatggagggagtatagataatataatttttaataaggtaccctggagagctatcatattttttacatgtagtaccaaaaaatttacagccccggcatatttataaacgaaaaataatttgtgaataaaacttttttatatgtgtttttaatgatctaaaaacaaaggctgaaaaataaacttcaatgaagaaacaccaaaatcagttctaaatttaatgttgaaatttcaaattttagctgataaatataagcacaagtgaaaagatgaggcccctcgtgtaaaatttaggtatctcgagttaatttcttaaggactaaaaaattcaactaaaaataaacaagtttgtgggagtaatcaaggcttacccctgaagatacattgcgtacaagatcatcatatcatacgatccgtcaaaggcgtggaacacatacttccggcgaggccgtactctggccatggcggcgttgaagacgtcgatgcagtatccggtgatgttctgtctcttggtgtccgggttattctcacgtcgacgaaagcctggaacccggtcttccgcggcacggcgatcctcagaacctcgcctgatgacgatgacgatgatgaccttctccccgccaatcgccggcggtcgagacgacgaccagtcggagcgccggcgttgtagcggcggccatggggcggcgagccgcctgcgcgccgtgctgatgagaatatggcggtgaggatgccggtgagcgccgccttggctgaagtgtgatcggcgccgaacggcggcgccgtcgccgttgcatggtggggtggatgatgtgacggcggaggagagccgccggagatggggaaggcgaggatggggacgcggtggcggcggcgaaggcgggcaaccacggccgtatgcgcttccgtggtgacgatgatggcctgcacctgtgcgttcttgataaggtcttcggctgcatacacaaattaacacaacccatgcacgtacctctagcataagttaatcacccacaaataagttaatcaaagtagagatcgagttagtagctagagaagaggtaacgggatgtaagaggtaattcttaagacggtattatatattttctagcgtaaaatttggtatatacattcagatactggtatcacgagatatcagtgtaaagttttggtatattttattgagttttgtgaaatttctctatatatatgataccttaatttacatgatcaaattaaattttgaattaactacatagtagcataatataacataacagtttggaatttaattaggtcccttaattagtactatctctgtcccagaatacttgtcgcttttagtttttgtttgtaactttttatctttcgtcttattcaaaaatttatagaattattatttattttgtttgtaatttaaagtactttaaagtatgacttctacatttttatatatgcactaatttttaaaataagacgagtggttaaacattacaagaaactactaatttggaacggaggtagtacatgatgagattcatttatgtgcatcctttatgggacggcagatccccatgcaatgcaacggcagattaattctcgcacacctttgagtgataaattagttggtgtgtgcgtgaaaatgcagtgattatatatatacacacacactgacattgagctatagctgttacagcagtggagaaatttcgtcgaaattttcggtttcgagctgaacacgatgacgggcttggttggtatagctccaactcctaaatttagctataggagttaggtctgaagtggagttgtaaagttacctaaacccagctctataactctagtttatttggtgagaaagctccactcagcttcacttccaattttgatggagctgaaactgtttgactgagttggagctgtaccaaacagacccaacgtttcaccggttcattttcttttacatggggaaagaatgtatgatggcgttttacaattgtttttttcgctggagacatatcactagattttattagttcttcgtatttcgatcaagtcagattgaatttatatatatatatacgtacgatcttatctgttactaaaatgatatgacaatgtttgcataacgtagcaactaggggacctgatattatatgcgtgttgcgttgcacgggtgacagctgggaactagaggaaattaaattaaggttcctagtcgaacaattttttttaaataacccattttcctatattgttggtatttaacggaaattaactcatataaaacaagacatacataaaaccacacaaaaccatcccacacaagttaagaatttagagtctagccaagtgtaatacacgtcctggtgctcaataaccacgagcacggctattcgaatagatttgttttactcacactgcattggatgtacactttacccgcactccgcgactgcccaacacatgagtctcgtcccaacacatgagacgcgtcacggcaaaacttttcgataacctcgcattggcagtacccgctccatgaacttacatcctcatgcactctaggcgtctatatttctagcagtgagaggagttctggcgctcccggggaagaagtctcacacacacgttaagttctctctcacactctcatggcagtcctaccaatggcgacaccgatgtagggcacacctcgcggcccacctcaacggctgccccaccgtagcgcatctgcctcacttaggggtgaaccatctatgcagggatactgcctccgctcggctatctaatccgctaggcctatacccattcaagaggtacggttatacgggggtcgtttcatgcttaacttcatggcttgatccttaattgacggggacggtagtagccttttccagataccacccaaatcctccgtccgcccagttgaaaacagttgtttagttttatttcatcttttacaaatcatgtcatcaatatcatggcaatgtggcgctcatgtctttatatgccgcatctcaattaccttcccaaaggtaattacctaagcatatagcatttgataaatataagtatgcatgattctagaatagcatttctaagcatttatcataattgactagggacttcatacgtaaacatggttacgaaggaataaggggtaaacaataatcaaggcatggcataatcacatgtaggatgttcatcattgcatgcaattttatttatagacaaaataatttcgcaattggatcaacatgttcaaggaatagtgatgacttgcttgctcaggatagtccttattcttgatataattcttgatcaaccttctcctcctagaagctgcatacgttgtctcacgattaaccgatatacaatttctataatatgcaagaaaaaccaatattcaaacaccaatcaattatgcacaacaaaatgtacttgttggggtcgaacctagggttgctcatactattcgtgcttgctaagggattccaatcgtgataaggactaaagtttcttaatctttatgttgtcatcgtggtctatttaggagtaaccaatagtgtataaatgagatatacctctggctaatatgtggtttagtctagctaatgactttggaaagattatggctacacatgcatctatctaaataaaatggtcatatactagaggttttgttgtcagatggatttaggatcaatcaaataagtacagtgaatcatttgtattattgttttattgatggaggctttactttaattgttaacatattttatttatcacaataaattataaaaggttaacaattatccatgctttgtatgttagagttgtttaggttaatcatattatggttacagattatcccatcacgtagatttacaatgaataatcctaatttacaattgaacttagattatattaggtcaagatctataattagtatttatccactataattagtatttatccactacaaatgtttgtcatagactccttggtttaatatatgcaaaaggtagattattgttcttatgtatgattttaaatggattgtacagtatatgtgatttaagtgggttgacaagtgattttcctgtttgagtaattattggatgctaaccaactcaaccttatttgggtggttctatcataacaactctgttcctattcctcataaacaaattaaagactcatctatgtgtattcatgtttgatttacctaattataaggctaactttatttaaataactgataattcatgggtttaattatatttggacatagattaataaatggcactattattttcctatacatccattaatttgaaacattgattataattatttatgtggttgctacagtgacaaaacatgttaaagaccaatattattacatctactctactttacaatatcaatcctatttactagcatatttttaagttgaccaataatctaatcttttgatattaattattttataattatatatatactttattaaatagtgaattatataccattggaaagcttatgattttagatgaatttaggttcaagtttcactataatctgagttaaaatgagtgagttatgctagttcaaagttcctaattcaactaattgcgaaatggcactgttcctaatagttttatttttattccaacctaattattaacttactacgactgacaggtgggccactctatcctctcttttctcttctctttttctacctctctgctccctctctctcactctcgcggctcggctggaaccggtgggcggcgcggcgcaacgacgagcggtgggggagggggagactcaccggaccggcggcgtggtcggcggcgacgcggcgtcggggtcgatggcgaggcgcgtcggctgcttccgaagaggcggcgacgctggggatggaaaagagaggggaaagggaggggaggtggtgagggtggtgtgggaagcaacgggcgccgcggggggggggggggggttatataggcggagggggcgggcagtgcttaatgacaacggcgacgcggcgcggcggcgtggggcgggactcgatgcagctcggcatggggctcggcgctgcagtggcagcggggcgcgaggcggtatggcagcggcgcggcagtggcgatggcgacggcgcgcggcgcacagcagagcgacggcgacggtgacacgacggcgtgtggcggaaagggacgctaggaggcgtggcagcggagcgcgcagggcgacagcgacagtaagcggcgcggcagggcgacgacgacgacgacaagacggcgcgaggcggcgcggggcgcgaggggcggccggaagaggcgcgcggcgacgatacgtcgacggcgatggatggcgatggcggcttggggctcaaggccagctagggcgtcgcagcagtggggaggaagagggctagggtggcaaggatccaaatcgaacacctaggggctaatgaacagtgctagccgactattttttttattttagagggtattttgccattaggaaaaatatactattgccaccatttttgtcacaatgtaaaatacaccatgtttaagttattaaaatttaatatagcacatatttttatttttattatatacttttctaatttctccattttccattcttttagggttttgcttaatttataatttgaggaaattttgccaattaaatgtgtatttaatcaaaagtatttgagtgacaatattaagtgttcaaatgtgaattttctccaaatttaatattgtccaatatttaatattatcctagatttttataatttcctatattttgggattttggtatttatctgttttcacacatattggtttatctttttagattggttttaccacaacatggatttctacaattcaatatttgtgattcaatacaaattatgtaatatcgaattgattattcccagtaaaactattttatagatagagctcgacttatttgaatggatatcatttcatgtgtatacagatatcatgacactcatcgcatggttcaagtatttaatatttaatccataaattaaattacttcttttgtctgactttgatttcttgtgcgtaaatatttatagggttcatgataaatatattattattataattattacttagttgtatagctttagtttaattttccattgtgacagtttatagtttggcaagcaatagtaaccataacaaccagcatgatgcaaaagttttaaaaagttcaaaattttagtgttttttattgtcgggaattttcaggatgttacactccgacaaggggagggcggcggcggcggcggcgaggcgagagcgcagggccggggggcgccaattttttttgttcat

SEQ ID NO: 63154 - DNA, 6395 bp, Oryza sativa
ataataaaaaaaacagtggccggtactagcgctggcatcactatctttaatcccggttgttatcaccaaccgggagtaaagatagatttttagtcccggttatttcacccgggactaaagatgagtatctttagtcccagattgctactcccggttgcaaaaccgggagtataggggggttaccaaccgggaggaaaaacactttctccactagtgtgctgccgaacgccgtatgcgagatcacgtcggcggtcagctcctggaacttctgcccgacctccacctgcacccgccgctcgccggcggcggcacgcgcctcccacgcccgaatcacctcccgcgcgcactccgccatcgtcttggccatcatcttgagcttgtccatggcgaacgccgggtgcacgacgcggcggtgccgcacccagtcgtcgccgttgacgaaggcgaggccgttgccgatcagcgccagaaagctcggcccgggctccggtttgccgtacagccccgtccggtcggacaggatctgcttcaccatggcttagtcgccgacgcagagcgcgggcgtggcgccgctccacgagacgaacaccttgccgtagcgccacatccacgcgcggtagtgcggcagcacgcgcgggacgatgtcgtggcagcgcaggtcgagcacgtcgccgcgcgcatcgcgttcgcctcggcgtcgctgccgacgaagagccggtacgccggcccgcggatcccctgccgggcgaacgccctcgccacggcgtacggcctccacaccagctgcaccagcgccgtccacagccacgtcaagaccaccagaagtccagaaccaccgcggcggcgacggcgacggccggccccgtcgatgactcaacgatcgccatgcttggagcgagctggcttgtgtggcgacgtggcgtgatgaccaaattatcggaagtttatacagggcctgttcactttgatgccatttccaaccttaccaaattttgataaaattgccaaaaaagtggctacatttagtttgctgccaaaatttgataactatataagaaatcttatcaaaattttggcataattgccaaaatttggcattaccaaaatttggtaaggttttttttgcaatggattctcatgtcctgaagtattactgtaaccttgttttgattcttgaacttgaccaagcaccagtcttcctctaaatcatttggctagtaaagtaatttgccttcttcacattcaatttacaaaaaagttaagggcctaaacagaaaatcacaaaggcacagagtgcagaacagatagaccgatctgaaataacatacaagtggaccaaaacaagaaatggcagcatgccacgcgccattcaacgcgccacccaaccggaaacaaccatcacagtgaccggcatccaaaccccaaatgcatgaactaattaccaatcaaccggcctaattaagcaggcaaccggcgcaccggcaacgcataaacatgcaagttaggccgaggagcagagaacagtaaacggagacgtgtaagacagtcagatagaaaaaaaaatcatgagaaaaatggtgagattaggggagttactgattgatgatatccatagtgtttttggtggtcatgtacaattttacttctgaattttattttgtggagcagtataaaattagcacaatagaatgaacaattatctgtattacattttttttaaaaaaaaatccatgctattaggcaattagagccgacgggaacccaaaattaaaccatgaaattggcttggagttgagccagaggatgagaggagtgctgctgctggactaaggtataagctttattcaagtttcaaagcacatgaattcatctctgtctcgggataggcgctacgactcgttcaagacgtggtccgggaagcttgagcggcaactcacccatctggctagcgccggggacggaggtccctgaggaggaggaggacggttgcgacggcgatgccatccgcagccaccacatcaagtccatgcctcaggttgatcgcttcttcgccgcactggagggccctaaactggacaaactccgggtaagtttcttgagctaattcttccggaactacacatcgatctatgtgctttgatttgctggaacactggagagagctcatggtgtgtgttgtgtcgcatcagtcatcggaggagctggtgcttctgtcggacaaaacgtggccattcctgctctgttcccggtgtcggcgttcggtatctgcctcggcatgagcagccaggagatcctgtggaagacagtggcgacgtcaacgccgatgagattccttcacatcactaccaaggtgaaccaggtgctctggtgcgctttctgtcgcgctcatgtgcgtcaccgcggccatctacgctagcaaggtggtcttcttcttcaaggccatccgccgatggcacggtcataccaatttcgaccgttaatattgtccatttaatgaagactagctatgcttgcaatgcataattttcaaataaaatatatacttccactatgtcctatgctactaacatatatgcaggagaagcacacataaatagaggagaattgatggaacataaatgaacaattaatcggaagccgtcgagaggtagacttatggatggttgggcctctaaacccagtaaaataatatcaattgggctcaaccattacaactactgggctgaggaatcaatgaggagtggaataagttcattcgaggtcccttaacttgtcaacgaatccgatatttgtccttcaaccagaaaaccagatacaacgcgtccctcaactgtcaaaaccaatgccgatgaggtccttcggaggttttgatggcagttttcgctgacgtggtgcctgggtggctattttgacttggtcttcacatgacgtggcgcttacgttgcaattcaaaataataaacttcatgggacacacatgtgacatcccggcccagagcttaataggattaatagaatactcatatcaacaagttgcaacttcttttccggaagccgatttccaaagaattccaggttaagcgtgcttggtctggaacaatttgggatgggtggcagaccgggaaattattcctgggtgcgcaagagtgacaaagtgtgcagaaaagacttgtgttggtctgtgagggcagtctatgacctgtgaaagctgccagatgtaagcgtgcccggcctgggagaggcgggacgttacaaagtggtatcagagccgactctcgcggtttcacaggcgcgtgtgtcgcagttgcgcaagcatggtgcacatgtctggtgtggacctggagtggtcacacagcatggcacatgcgctggcactggacacacggacgtgcgttcctggcctggggttgaccgacgtgcgcatggctggtgtggacccactcctgtcgcagttgcgcaggcatggtgcgcatggctggtgtggacccggagtggtcacaaagcatggcacatgcgctggcactggacacacggacgtggccaagaggggacgttcctggcctggggttgaccgacgtgcgcatggctggtgtggacccggagtggtcacacagcatggcacatgcactggcactgacacacggacgtggctaagaggggacgttcctggcctggggttgaccgacgaggacgtcggtgtcttaagggggtgagcattgtgacatcccggcccagggcttaataggattaatagaatactcatatcaacaagttgcaacttcttttccggaagccgatttctaaagaactccaggttaagcgtgcttggcctggagcaatttaggatgggtggccgaccgggaaattcttcctgggtgtgaaagctgccagatgtaagcgtgcccggcctgggagaagcgggacataaataaataaaaaatgatgggcccacatcttcctcctctctctcccaactcagtttcacataaataaataaaaaatgatgggcccacatgccagctcaataaaaaatgatgggcccacatgccagctcttcttcctcctctctccccaactctacaggtctatcgcagagaatacatcacgatccgcccttctcgccaccgcgagcttcttccgctgggggcactgcggcgcgaggagtcttgatacgggcacgaagtacggcatcaccgcaccgcgctcgccgtccccggccatagcacggatccgaaatttccgagaggaggaggcatggtgagtttgcaggcgacgcgtggtggccgggggcacgagctcccgttcatcgtcttcacgccgacggtcttgctcgccgagccccgacggcacctggagcaagccgctagccaacctccgccatcgtctcgtggttctgccgccggccatggcgccctcgactcctccgcaccctccaccggccgaccgtcgacctgcgctcgccgccgaccacctcctcgactccgccgcccgccacgacgcagccgaggggtaccgagctcgtctccacctccgctggcccggcgccctcaccgggatgcgagggacgagctccctacgccgcctctcgtcgtccgtcttgctgcgccggcgccgatgccctccatcggcatctcccgtcgacccgattccccaagtcccgctgttctctcattcactcctcattctgtgtctgctcacatgtggccggcgacctcctcctccggccacctcgccgcacgcggcctaccgccgccgctccactctgccccgcctcgcccggccgccgcgcgccgcctccctcctcgctcggtggagaggacagaggagaagggagaaaaatgaatacagggagttggggagagagaggaggaagaagaggaggatgagaatgacatgtggggtctacgtgggtcgtaccatctttatttttttagatgacatgtgggcccacgtgggccccaccatttttttattaatttatgtgtaaactaacatgtgggtcccatgaagtttattatttttctggatgaattgccacgtaagcgccacattaatggcacatgatgcgaagacgagtcaaaatagcgacatatgcgccacgtcagcgaaaaccgacgtcaaaactgccgagagacctcatctgcactggttttgacagttgaaggacccattgcatctagtttttcggttgaagggcgtagtccgacatcaagcaaacaaaagataaggattatactagttcaggccccttatcaggtaatagccctagtccaggttatatgggatttatgatgatgagaatagattacaaagagagtagtcgaatcagatgataccggtgagatcgtagtcgagggatttgacgagatctcccgacgagttggctccacgtactccggcttcgtaatatatggtgggtgtgttggcgattgaattggatgcctttcacccctccccaggggtcccttttataccgtggagggtgagcgagggcctaagcggcgatagaggatgtgcaggagatttcaagtagacgatacaacaggacctccgtccctcaccactggcaaccccactgacctccatccttcgctcgccaccgccgcaccgacactcccctccctccacgtctcctgcgggtccaactgcctctccctgccactttttcctcgccttcgtacttggctccggcctcaccgtttccttctctcttgtcctcaagctgtcgttgggtgactccgccaacagaggagacagctcggcgccgacgatgtcgaccccgtcgtggccattcgaaggtgacaatgaggagcgtcatcccggtgcggggtgacacgcgatggtaaggagagagaagggatgagaggaggaagatgaggacatgtatgacccacatgccaatgacccccacaatattttctgtgaatgacagatgggtcccacgtacttttttgccttttgttttattataatgccacaaaagcgccatgtcgatgtcacgtgggatagagaccaagtcaacaacgccacgtaggcgccacgtgagccaaaatcgcttcctaaaccacccagagacatagtttccatcggttttgatagttggaggggtcgatatacccggttttgtggttggaggacatgatattatactcaggcgatcgttgagggagtcaaaatgaactttttacgattgtttatacatatacagcccctttacagagacagcccaaatagcgggccattgggaccctttttgtcaagggttgtgaaaagcgggccattgatcctcagtaaacagagcccctttcgcgagagctcctctgaaatatcggctgtgttcggcacaggaattttccagcgcgctacagtggtttggcccgaggcacgctttttaaa

SEQ ID NO: 63155 - DNA, 4143 bp, Oryza sativa
  unsure (1)..(4143): unsure at all n locations
ttgatcttaaccctcttttcattgatcaaaagctaatttattatcctatttctcatcgcctttgtttgttattcttctcttgtttgtttggcttttgtgaagccatcccttccttccgtctttaaaggcatcgctgccgggcggctgttagctgaatcgatcgcaaggaaagacaaaggaggagagttcagtcgacttgggatcgagtagaatcgccggcttctgctgctattgcggtactcttccttccttgaatgtcgtttacttctccaggtgcatagcatagcttttttttttttttttggggggggacggagaccgacgagattaattgttgtttctgttttgaagctgaccattatatccaatcccaatccaatcgacgatgggcctctctcgtcggtttctgaacctgatcgtggacaaccgcatccctggagccaaatcgctgcgctgcatcgacctcaccctcgcgcgctacaagttgttcaacactacaacacctgctgcactgacactgaatgggaacggaaacggattgaagaaaaggatggagaagatttgtcttcccagcccaatcttcaacttgggagcaccaggcgaaccgatacacatgttccctgctttggagcgcagggctttctctttggaccagtcggggcgtggcctccttctggaggcagacacatcccgtctggggtgatgccaaatctccacaagcccaagttggaacccattgccctctacatccccggcgctgagatagatctggatgaccttgatggcggcggtggcggtactctttttatcatggatagaattgcgaaaccacaggaggctgactatttgttcgaggctttggtgtaccgcatgttctgttccagctacttatcaaagtcctgggactgcaactcctcccaccaccgccgccatacgtcgtcaaatgtggcgttgactttctaaagatcatctcatatggtttggttaaaggtggctctgagatctgcatatccatcgacggggttggtacttattgctttgacactgtgaaacacacttggattgaagtgggcaagtggatgctacccttccaaggcaagtttgagtatgtccacgagctcaagctctggtttggcttcactcccaacgatggccactttgctgttgctgacctctctgccatggacgagtacctgcaaccacagatacgccactgctggaacgaacttgatgagtcactcatccaaggatggaagcagatacgggaccctcagcttgtcaacctggggtctgccaagttctgcattgcaaggttctttcacactggtgactttggcgatggattgagtggccagaatgtttctgtcctgactggtgtagagtttacccatgccaatgttgaccatgagaatattggattgatcaagcacaaatcgagatgtcacaagtctagctgcggtgaggagaccatcacggcagttttctgattaatttaagggctgactccccatcctttgaataattttctgtctctctctttaagagaacttgtgtctcgtcctaattttactttagcataataaaaatgatacttcctccgtttcataatgtaagactttctagcattgtccacatttatatatatgctaatgaatctaagcacacatatatgtttagatttattgacatctatatgaatacaggtaatgctagaaagtcttacattatgaaacagaggttatgaaacagaggtagtaccttcgttgtccgcatgttgtaattgtctcctgcacttaagtaactgtaccatttactactactagtaactactataaacttactcttaatttatgtgttgtctactgcaatggtaaaattcgtttcaaatgctttcttggttttggttggagcggaaaccaagaaggaatggtaatcttgtgtgcttcctctgtcccaaaataagttaaccgtgcgggacttttccagaggaagagaggatgatacgtgatgcggtgtatattccttttctgaaaaaagtctaagttatactacggttaatttcaactttttcatattctatcttgatcttaaaaaatatatttggaaattatcgtgacctcagttttcatcttctttcatagactttgattttctaaagaaaattggtttcttaattctaaagatgccagtacgtcactgttcattttgtagttaactctggtacatgtttatgtgaaattttgattattcagcagttgaaaggaatggaggattgctttgtgatttataatcacctgtgctgctacttgtgctgcagtcaatagtctgatgggaaaaatggaattgaaccactgcaagtgcaagatatactgaaatcaaatcagtgggtaaagtctgacaagttatctgctgcactgaaatctcctcatgcgtttgtgagcaaggtatccagtagcattattatctctgtatattttcagagtatatattagttgcaacagatagtcgtcacatatataatctatagatggccataaggctcgcccggcacggcccggcctaggatcgggctaggcacggcccaccagcgatcgggctggaacggctcagtcggcacttcgtgttgggccgtgctggcccatgggctgcacctccggcctaggcatggcctactagcaatcgggccatgcagtgctagcctgaaggcacgggtggtccatcgtgccttctttgaaataagtctatttctcctctctcctctttgggctgtgacatatatgtagctaaaataagtctattttatgtccctattctttgggccttgttatataatacgtctatttttgctccctcgtgccctacatatggttgaaattaagtctgttatgcatccccacactctcgtacagggcctagtcgtgctgggccggcccagtgtgtcggtggggaagcccaggcacggctcggcggtaaggccgtgccgtgcttgggctaggccaaaatgccgtgccttgggccgggccatcgagcctcgggtctatggctatctataataggaaaaagtacaccgaaggtccctcaacttgtcatcgacttacaaaatcgtcctccaattgcaaaaccagatatatgacatccctcaacttacaaaactgttcactttaggtccttccgtggttttaaccccggttttgtccgatgggacagctgagtcagcgtgggacctatgtgggctccacatgtcagggtgtccaactcagcaccttctctctttcccctcttctctacctttctccttcactttcctttcctctctcgtgtctccgacgagcaatccggcgaggtgtgccatgaactcggtgttggtaacgcacgcagcgaggtgcggcggtgtccgccgggagaatgccgggattgtgccgacaagggtcgggttcaggcagacgcatcgcggcggctgcaacggcggcggcaggagggacgacttgagcgcagctggagtcgctggataggttcaattgggcggggtatagagccgtcgtcgacatggcccgcgacgaggggctcagcctccgcgtcacgctccactctggcgaccccgacatcctcttcaccgactgctccagcggccgtgactgccacttcttcgccgtcgacgagctccccgttatccacggcaaggcgccgctcgactgctacgacgccttcttcctgttaacgatgaaatttggtaagtccaaagtcatcatcagctgaaagtcactatcggcttccgagttctagaagcagccgatgggagttgtcaagtcgccatgctatcatgttcttagtggagtcgaatcaattgaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63156 - DNA, 13295 bp, Oryza sativa
actcacgcaacatgcatggtactgttcttgggtgtggttgagcaaattaagtatagaccagtgagaatctgggcgttgctgcgaaaacttctttttggtaaaatagaaaatattagttcaaaatatatttatatattacgtgtgggatcgatatttgcgatgatttaagtacatcttggaactctttctaaaaactttaaaaatttaataattaatggagagatggagtggcatatttttaggtgcttgctccagttgagttaggttgttagaaaggaaagacatttaccattcatcattcccatgctaataaatttggatctattgtgaaaaatatataaactaaattatagttagcgcacttagtactctgagaattaacccaaaaaaaatcatagccgtatgaagaaagattacgatggaaaaggtagtgctatttatgcattaatatgcttatatgcactatgttgctagaagcgcgggggataaaaggatgactaattaatgattgaattaaatagataataagtaattagagtggcaaacaaaaaaatattatacatatgatagtatatatataatattctaattttaagctaataatgtgcttaatataggttaaaacaacaaaagattaaaaatttttgggtctcagtgacctcatcagtcctcaggtagcacaacataggaacaccgaacacggacacccctaattaagtaacttctagatccaatggctgttattttttactaacatgatcttaaggtcaaaagttgttgatcatgtggttttgtgtatgtcatgttttataggagttaatgttccattaaacaccaagaaatggattatttaaaaaaatgttcgactaggaaccttaatttaatttcctctagttcccagctgtcacacatgcaacgcaacacgtatataatatcaggtcccctagttgctacgttatatgcaaacattatcatatctttttttctaacagatcgataagatcgtacgtatataaattcaatttgacttgatcaaaatacgaactactaacaaaatctagtgatatgtctccagcgtaaaaaacaattgtaaaacgccatcacacattctttccccatgtaaaagaaaatgaactggtgaaacgtcatcctattcagctcgaaaccgaaaatttcgacgaaatttctccactgctgtaacagctatatatagctatgtgtatatataatcactgcattttcacgtacacacagcaactaatttatcactcgatcaaaggtgtgcgagaattaatctgccgtcgcattgcatggggatcaggcagcgtcgccgtctgctcgctgttgctgctgctttcctctcgctgctcgctctccggaatgcggcggcggcggcgtcgccggcgccggtgagggtgggcgtcgtggtggacatgacgagcggcgaggggaggaggagcctcgccggcatttccatggcggtggaggacttccaccggcggcgacatcgtccgggctccgccgcggtggtggagctgcgggtgagggactcgcgtggagacgatggtgctgcagctgcacgcgccggtaaaatagttgcatctttttttcgtttttgatttcgtagttcaaatttcagacatagcatgcattaagctaacttaaataaacagtatattagagtgagaaaaacggacaatagagtcactaccagactcaagagctagcctataggccaaaataccgtcacaaaaatacggtccgcctgcgaagatagttttcgcaggcggcatcttatatggttcacctgcaaaaaacaatcttcgcagatggacggctagcatggccccgattgctaatatcgtaggcggccgttttgtctctgagggcgatgcccgcctgggaaaaaaacacatatcgccatgtcggaaaatcgattttttagtagtgtgtataaatagactgtggaaccgaccagaagtatcatgacccacaggctttgtctctaaaaccagtaatgagtttggagaaaatttcaaattaaataagtaataaaatgtcgcaatcacgatgtttttcacttgtgtgtaagattgtaagttgaagataacatgcacaccaatgaaaattcaaaattgcgaccttgtagaaaaacccaaatatgttaattagttgtaccaggtctcttaagttcttttttgtcattgaagagttatagcgatagaatagtatattataagtataagggaccatatattatggtatatataatcccatcttaggaatacatctcttggacatcaattcagcaaaaccattgaaacttctttgcaaaccagtgtttctaaaaaactatatatagctggagtagtatatttctcttcaaaatataaaactaaaggtgattagaatcagtacaaatttacagatacggcctagccaaaaatacaatatgccctgcagaacccaacaagtcccctcacacttgttaattaattagtagtaatttagtactagtatatcagtacaccatagaaaattaaactgcatatatacaaccgcgttggcagatggtgacagccaaactggaataaatcgcgtgtgtaaccaccgtaaagtcaaagaaaatttgcaacgtgagcgaggtagtagcaagcgcatcgttgcaggcgtcgaaacaaaacttcatttataaaaaaagttcatgttgacagtacatacatgtctcccataaaggatgcacataaatgaatatcatcatgtactaattaaggaacctaactaaattctaaactgttatgttagggcattcccaacccaataactaggatgatgtccatagcattaaataagttgtcacataggataaaaaatgatgtggcaagtgaataaatgaggaaagagaaggaaaccatgtcttgtatgagacatggtttctacccaacatccaagatatcatgtgagataagtagcattaaattgaagtatggaatagtggtgtttgcattggaagagtagtgtctagtactagtttcttgatgatgtggtgtttatggaaactatatctagtgttatgggttgggactgcccttatactccctccgtcccattctaagtgcagccatgattttcatgctcaactttgatcgtttgttttaattgaaaaatttttgaaaaaatttaaaaacataagtcacgagtaaagtattaatctctccgtaaggagttttagggttggacacggttattaagaaaataggtaaaagtaagtggtggatggttgtgattggataattagtggaactagttggaaaaagtgaatgttaagggttgtgattgattggaagataatgttggtggagaaattattatattttaggacaaatcctaaggctaaaagttgttatattttaggacggaggaagtattcatgttttatcatctcataacaacaaacatactaattataaaaaaaatttaaattagacggacgatcaaagttgagcgcggaaactcatggttgcacttaaaatgaaacggagagagtattatgctactatgtagttaattcagaatttattttggtttggtaaattaagggatcatatatagagagaaacttcacagtactcaagaaaatatgcaaaaaccttagtatctcgatgtacaatatgttaaagtatcaaattttacactaaagaacatgatactccctctgtctcagaatataagaagttttagtgttggacacggttcttaagaaagtaggtagaagtgagtggtagaggtttgtgattgaatgagtagtggaggtagatgagaaaagtgacggtggagggttatgattggttgggaagaaaatgttagtgaaaaaattgttatattttggcacaaattctgaagactaaaaattgttatatcttgggacggagagagtaccatcttaaaaattacctcttacatcccgttacatcttttctagctactaactcgatcgacatatattttgattaataacttatttgtgggtgtaacttatgcgaaaggtatgtgcatgggctgtgttaatttgtgtatgcagccgaagaccttatcaagaacgcacaggtgcaggccatcatcgtcaccacggaggcggatacgcccgtggttgcccgccttcgccgccaccaccgcgtccccatcctcaccttccccatctccggcggtgctcctccgccgtcatcacatcatccaccccaccatgcaacggcgacggcgccgccgttcggcgccgatcacacttcagccagggcggcgctcaccggcatcctcaccgccatattctcatcagcacggcgcgccgccggctcgcgccccatggccgccgctacaacgccggcgctccgactggtcgtcgtctcgaccgccggcgattggcggggagaaggtcatcatcaggcgaggtgctgcggatcgccgtgccgcggaagaccgggttccaggctttcgtcgacgtgagaatcgacccggacaccaagaggcagaacatcaccggatactgcatcgacgtcttcaacgccgccatggctagagtgcggcctcgccggaagtacgagttccacgtctttgacggatcgtatgatgatcttgtacgcaatgtatcttcaggggtaagccttaattactcccacgaacttgtttatttttagttgaattttttagtccttaagaaattaacttgagatacctaaattttacacgaggggcctcatcttttcacttatgcttatgtttatcagctaaaatttgaaatctcaaccttaaatttgcaactgattttagggttttttcattgaagtttatttttcagcctttgtttttatattgttaaaaacacatataaaaagttttattcacaaattaattttcgtttacaaatatgccggggctgtaaaatttttggtactacatgtaaaaaatatgatagctctccagggtaccttattaaaaattataaaattatgttatctatactccctccattttaagttatttgttcattctagttttgtagtcctaagtcaaactttggtctttgactatcaatatttctaaaaatctaaaatctaatatagttaacacaataaggtttatgtttccagatttaacttgaataatactttcataatatataattcacatgtgtggtaaattattacgattttacagaaatcagttgatgttcaaagataaacatatttggaattaagacaaaactaaaacaataattaatttaaaattgagatagtagtaaaaacaatagttttatgtttctaaaacatttattttttcctaacaaggctgattatattaaatataagaaaactaaaacaaatcaaaggcataagcttaaccaatttaccaggaaaagagcactttatatttttcacttttatatgggagatattagatttaaccgcattatatatcatttgtaattgaggaatttaccgaaaattttatagaaaataattagtaaagtccgtatgttccttgggaaatctaattaagaagtatcatataatatcgcagcctcaacataagagcatacaaattgtaaaacaaatcagtttaaaactagagtttgtaaagtcaaattataatgaattgaaattgtatatttttttataaaatacaaacaaaatgactcattcaattgctataaatatattcgcatatttaggtataaagatttctggaactagaaatagctagctttaaaaaaatatatatatgtgccaattgtcaaacagggactaataatttacgccaagtccctttgaatgacatttctaagaattctcgctgacatacatcttctgtcttatggtatcttcagaagttcagcgcagcagtgggcgacgtgaccatcacagccgaccgagaaaacctcgtggaattcacgatgccatacacgtcgtccggtgtgtcgctgctggtgccggaggagaacgactccaagccaatccaatggattttcgtgaagccactgaccagggatctctggcttgccaccatcggcttcttcttctacaccggcttcgtcgtgtggatgattgagcagccaagaaacccggagtaccaaggatcaagtgtgaggcagctcagcactgcttcctactttgctttctccaccctgacgttttctcatggtaatatagttactacttttactcctccagttcctaaatatttgacgccggtagtattcatgttttatttggatcgctgatcttgtcttaataaatacttgaaaacgagttatattatcggactgtgttgcatcgtaaatataaccatataacttttcattcattacaatatgatcatttaaaaataatttatggtcaaggtaagacagttgtatagtcaatagtgctagttattcatgaatggagagagtacagcttgttgtacattttttccaaacataaataaagcacatagttattataacgagatctttttttactttgaaaaaggtaacgagacgtatgacatttatagtgtaaattttggtctcctttaggtatatttttagtattttagtataaaagggtatggttatttcatactggaaattgtggtacctcaccaaagatcataaaattgctcctttgtaattgcatcattagaggtttacttggtttctttcaatgttcaaacaggtcaaattatcaagagccctttgtcaaaaattgttgtggtgatatggtgctttgtagtgctgatcctagtgcagagctacacggcaagcttgtcatccatgctaactgcaaagaggctccgaccatcggtgaaaagcttggatcagctcctccttaccggtgactatgttggatatcaaaatggatcatttgttggctcactcctgaaaaaacgagggttcatgccatccaggttaaggtcttatggaacacaaaaggagtatgctgaagctctgagaaaggggtccatgaatggaggagtgtcggcgatcgtcgacgagatcccttatttaacttcttttttatccaacccccaatatcagaaagaatttcagatggttaatcgattctacaagacccccggatttggttttgtaagcttctcaatcttgttcactttggtagattcagaattcttcaattttcttttctttttgacaattagtatatcgcgcaaagtttttgcgtgttctcgaaaaacattcagatgtgtggtgcttacatggagaaattcaatatgttcttttttgtctaattagtttgcatcatgtttttgtattcaggtatttcctctaggttctccactggtgcatgatctctctacagctatcttgaaccttacaggagagactgaaggttcaaaaattgaagagaagtggtttggctcatctgaacagtccacaggaggtgatgcaaaccctagcagcagcagcagcagcagtgactcaaaccctctcacactccaaagtttctctggcctcttcatcatcagtggctgcatctctgctctgatgctcctgataagcgttgtgaatagggtaatttgcgccaaatgcgcaaaggaagctcgtgttcatgatgtggagcatggaggcagtactagtagcagttccactgaacaatcaagaccacttcagattgttgttgacagcaaccctgaacctgatcaagctgtccaagaagttgcaaatgatgggtgtcaggatgcccaactgatgcaggcaagtgttggcaatgaaaggcatcatccagtgcagaattgcatcaatggcccggtacctgaacatcatcctcagatggagatgaacactggatgatatgtgtcagcgtggttatgtacagtacccctttgaaattgcaaaaaatcagatagcatttgggctttgttttgggacccgggaatttttcctgattttgcagggtctgaatagttgtatctgaatgtttttgcaatccaaattagggccttaatttggttggatatagttatgtaggagtagatattttagtgggtttattcaccatctagagttgttctgttttgacggttttattgcgtcgatgtaaatatgtaaaatattgtgtaaattaccagttactgagataaaaacatgaaccgatgatgaactttgtgacttgtcagatgagattccccaatgcagatacaggctgtgataagttgaagcaatgctaacttttcttgttgatcatttgacaccgtgtttagatccaaagtttttcttcgaacttccaacttttccatcacatcaaaacttttctacacacataaacttcaaacttttccgtcacattgttccaatttcaaccaaactttcaattttcgcgtgaactaaacacagcctgaatcagggaatcagtacgtgtgtccactcttttctgcttgcaagaaagtcaggttgcttcgcttggaaaatatactgattgtagacctaaacattgacagctctaaatagcgaaatgtgcagaaccctgaattcttcgagggaaggaattttcaaacccaaaatcaaccttctgcgtaattatctatgacgcatcggatcacacaagctacgtagcaagagagaaatttctcagcagttaggatgtactccctcgttcatagaagttactaatgatttttgaaactaacttggttagcagttataactgactagactctttttttaacctaaacctatatgctttgaaaataaccaacatatattttgctagaaaccaatgtatttaacatgttattaaacttttgatgtttgtactgtcaacagtaactattagccggtgtaaccccatggatttagcaaccagtagtactaatcacctcacttttttcttctgggaattactgtacaccactcaactgaaaattttcagatgtgcacggtgcatccatggaggaattcaacaagtttttgtgtaattagtagggtaattttaccatccttgagaaagtacctagagttattatattttctagtgcaaaatttgatacctctaggtaccaaagtatctcaagataccaaaaattttactgtaaaatttagatacctcaagatactttctcatctcaaggaccgtaaaattgatcgaagctcatgttcatgatgtggagcatggaggcagtactagtagcactgccactgaagaatcaaggccacttcatattgtcattgacagcaaccctgcacctgatcaagctgtccaaaaagttggaaacgatgggtttcagggtggtgatgaaaggcctcatccaataatgcagaatggcatgcacaatggccctatgcctgaacatcatatcagatgcagatgaactcatgaacactggatgatatatacttatgtacagtacccctttgaaattgcaaaaacagagagcatttcggccttgtttgggatgcagctaggaactgatttttgcagggcctgaatagctgtatctgaattttttttgcagtccaaatagggcattaatttggtttggtatgtactagttatgtagatattttaattagtgaatgcatttattatctgaaattgctctgtaccggagcttttgttgcgccatctcatccttcactgcggcgacgtggacaacggtgcggctcgtcggggcgcggcgtgaggatggccgtggtcgtggtttcctcgccgacgccctggccgccgcttcctcgccgtctctggcgatgaaccctgctgccgccgcctcgtcctcctccttcgagtctctacccttcctctcttgtttttcccacgattcttctgacaaaagctggtttctttcgatgaggttatcggagccaaacgaggctacgcgaaccagctcaagtcatgggagccccaccccttcctctcttccacgtatgcactccgcctacgtggctctacattgccacacgcctcgtcttgcattgtaaatgatcttaggctgtgtttagatccaaagtttgaatccaaatttcagtctttttccatcacatcaacatgtcatacacacacaatttttcaatcacatcatcttcaattttaaccaaaatccaaacattggatccaactaaacacagccttagtgagacagagaactggaccgacagtgaactttgaaacttgtcagtgtcagatagattcaccaatgcagatacaagttgatatcaattcagatggttttactagggccctgtttagtaggggtgaaaacggtacggaatatttccggattccggactggttttcgaaaacggaatcagccggtcggaattttttcggaatttttcgaaaacggaatcgaaaataataatagcagttttcgacggtactcggaatcggtcggaaactttccgaaaactttctcggaatttccgacattacaaagtccataaaacctcctgtgtccaaccggccagcccaacacactagtactagcagtagtcattagcccagcccaacactgcaacacactagtaatagtgtactactccactgtctagccggccactaactagccgagagagtgagagacacagccgccgggtgaggatttgcagtggcggcagcgacaccacgcgccagatctggcgctgccggccgccgtcccctcacgccgtcgccgtctcgtgccaccgccgtcagctcgtctcgcgccgtcccggccatcgccccatacgctttcgtcctcgccagtcgccaccgccgtctcgcgccgtcctcgaccccgccgttgctcgccatccccgcccccaacgtctcgcgccgtcccggccaccgcgtctcgtgtagtcgctcgccgtccccgtccccgcccccgacgtcttgcgtcgtcccgggcaccaccgtctcgcgccgtcctcgtcaccgccgccgactcaagccccactggtggagtggtggtgactggtgaatggagaacctggagcgaaatttttgtgccttggtgtccctggtttgtgcttgttttactaacatatgtttatatagtggctgactttatacttctactattgctgaactatgtaattctcagcaatgttttgtgatgaactatgtactatggctgacttgctgttgttgcttgttgaagttatgcaactccatgcaatatttgttatgcaaatatgaagttacagactgcatagattgtgtttatgatggtactgctgagagaaacaattggatttgatatggttgtgttttgtgatgtattgttgaatgttgagacttgagatttggacttgacaaagtttgaccctcagtttgaggggtttgtgtattccgataaatttttgttaccgtatccgcgccggttcgttttcgctccgttttcggtttcgataatattcgtttccgtttttgtttccgggggtttccgattccgatttcaattccgaaaaaaatatgaaaacgaaacgataaaggtcgtttctgtccgtttccgtaccgttttcacctctactatttagttccaaaatatttcttcaaacttccaacttttctatcatatcaaaattttctacgtacacaaacttctaacttttccatcacatcgttccaatttcaatcaaatttccaatttcggtgtgaactaaacacgccctagatgttaaagcagatgttatcgtcttttattgttgaacattatgtttacacccaaatttggcacctatggacgaaatagggaaaaattgacaaagtttggaaagtgacgggtttccttcataggaccggtcagaccacaggtgtgtgggcggtctgaccggctagtagggccgttctgaccgcagatatgtgggcagtcagaccgtcagggtccgagtccgagtctgttttcatcgggtctcgggtttccttgctcgggaaggcatgtttcgtatttcctttggtttctatcccgagttggacgtggagaagagcctgtagagggtaagaccaacccctatttaaaggataaggccggttcattgtaaaacccccgaatacaatctacttgaatcgttcttttactatgttttctattttaccctagttttagtccatctttatcggtttgcgccgtaaaccatccgccgccgctgcgagagtgtgacacctctttgtaggtttgtcctgaaaaccttccgttttgcccacaagacgggtagttatcctcatatcgatctaaatcggcctagaggctgattttgatctctaaatcggctccgctagccggtttagcttttctttttgcaaaacccatcttgatttggccctttggctagatcgaggtggttagagactctatatcaccgcaaggtgtttaggtgttgcaattgtgcttgtcgacttgtcaaaaaagttgccaacacattaaatccgggtaggcttgacaagtatgccctctgtttttcttacttccagaatcagaatgaagaaaaccagcttgtttaggttgcaagactgtagacctgaacttgcgaggctgattgtgacctgaacgttgacaacgttaaagagccctgaattcttcgagagaaggaattatcggcctaaaatgaagcttctgtgctagtatctatgctacattgaatcacacaacacaaggtagaaaagaaagagacatttctctgcagttaaaagttagaaagcgtagctactagtgacatcatacaagtaagactctcgtgcatatgcatatgcactcctccagacttgattcaagtcagtgtctcccagttcattggagtgcagctctgaagaagtcctggatttccattgcagataaccaggaagcaattttacgatggtttctagtatttctactagtaaaaagcctgttttgctatggttttcagctagatgatttgacatgttgcatgagaatggtataatgtttcttctggacagtactaaaataaacaagcgtttactagagtatgtcagtgtcacactgtcatatcagttcagaccaggagcgccttgccgataaaagggttgagtgagtcggtgctcgccgtgagatgtgtttgtttattttagtacgaaaggggcagtaattaaagtaatgaaccgaactgttttttttttacgcgttcccgaaaaattgttctttattgcgtgcgataagattaaccggaccgtgagagacctaagttatattcatggttgaatacttagcaatgtcaataggctactggttataataaatgtgtaatgtatccttaattagctagataacaaggcttgacaggtatactctctgtttctttttgg

SEQ ID NO: 63157 - DNA, 3452 bp, Oryza sativa
tgcagcccagcttcttctcgtaattatctaacgggttttaatttattaactcaatagcaaaatgcccatacttccctacgggtaaaagttactgttaaatactagaagacataatcaaacatgtataagagcataagaaattattttaaaacaacaaaaaccaattccatatttattaaaataaaaaacgcaaaaataatcctctccctctctttaggtcaaatgtggtccaaagtcctcccttcttcctcccaagtcctcccaagtcctcttctcctcccctccctctcccttctcttcagcccacatcactcccccgcccgggatagattgagcaaacaaataaagaaggatatgacaaaagtaagatatgacaaaagtaagggatagtaactggtgtgatttttaaaaactatttaattagaaatacgggggtgataaggtttggtctttcaaaatcttaagacaacaaggtatctatttaataatatttaagtaaaatcatactaaaaatatatgattttgtttgggtgctagccgcgcaattgcgcgggccacccagctagttatttatataactatacgttataattctatcacaatatattgagatacgtagctaaaaattttagggacaattgcttatttgatcatgttctagatcttaactactaatctgacttacttttttaattttgactatttcatacttatttttttaactttgactatttcaccctactttttaaaatcgaagctaccgtttgacctatatctccctactccctccgtcccaaaaaaaaaaataacttctgagatgtacttggacacatgcttgtccaggtttatctacagaagttggttttttatgggacggagggtgtacaccgttaggatttcacttaaaaaataataataataaaatatttcatcagtttctaaatttttgacgccgttgactttttttaaatatgtttgaccgtttgtattattaaaaaatttaagtaattattaattcttttcgtatcatttggttcattgttaaatatacttatacgtatacatatagttttatatatttgacaaaaatttttgaataagacgaatggtcaaacatatactaaaaatgtcaactataccaaatatttggaaacagagggagtattttatagctcaaactggtcaaaatgcccctcaaccctatccccaaaattcctcatcccgtggtccacactcatctcggccttctcggcggcgcggctagctagctgcaagcgcgctttcggcggaggcggcgcgcagagggcgcacggctacggtctcggccgtccgtcgcggagggacgacggaggctggcgcgcggcggagggagggacgacgacgcgccatacctgcctgcccctgccgcctccatcacgtacgcccctgtgccgtgccatgtcttgccctccggtatggttagcctctgctgcttcatttcatcctctcctgcgcgcccatcatctccatgcgccggctggatggatgtgttgctaatctcgtttgaaagaattaattattttctgaaccttcttatccaacgagattttctgaattatgcgacaatgctatgtccttgcgattaactctctgtatggtgagatatctgtttatctggtttacgtacgtgaagtgcaaattaaagctttgccaagttcctgttaattcactagcttgtgtctcacatttgtctgcaagtttcctttaatttacgtttgtcaaacctttaattatcaaaattcgtcaaatctaagacaaattaatttgtcaaacctttgtcaaaatcgggtaaataaataaaaacttttgataaagtagggtcaaatgagcaagggcataaatgatatttttattacaggttaacaccgttatgttgccttctcgtaatagggtcaagtgtgatcttcatttttaaaaaagagggtcaaatgagcaaacttaagaaaacagggttaaattgggagttaggctttaaaacaaggtcaaaaacacaattgccccaaaattttatgcataatgaaggtatattttgacaatgttggctatgaatttattgtctagcactctacatacttacttacaaattgtagtagcatatttgttgtgataacactcatctggtagaaggatatatttatgatcgtggataattccacctgcacggaatttgagagtattttttttatgttgggctaaaatttgacatgcaaagtcatccccacctccccacaccaactacaccgtctgaatcagagctaccttcctgtaggtgtctcctcggcacccaacccctaaaggccgtggatcccatatccatccgtccatctaagttgaggacgttcgctgttcatcttaattcttttttgaggatttttttattattaaaagtttgcggggagttcatcctgacttgttcactccacgaattcttagtttttttttatttaaaattttcttatcttatgtgggccaagtttgtgaatggttattgcgatggcagtatcgtagaatcaaacaagcagtacacggaattttacaagtatccataaaaatatagtggaggagggaaaaatggaaatgttttaattttccatatgtacttgacttctcctatgaaatgcgcctaacagaaatgtgcaaatatatgcaaagaattattgtaacagaaatgggcaaatatatgcaaagaattattgttgttgttgtgcagtgaagttcatttttgctcataggacatgagaatattggattgacaattgacacgaactaaccttttttttttggtccctgattcagaaaccgagaggataaatgctgttgtgaggaggaacttaggaggtttgcctgaagtttatcataagaaactcaagattgctgtgccactgaaacatggctttagagcttttgtgaatgtaactgaccaaggtgtcactggctactgcattgatctcttcgaggctgccgtgaataagttaccataccgtctgatttatgagtttgttgtcttcgaccgttcttatgacgagctagtacagagtgtatcttcaggggtaagccttactccctctgttttaatgacattgttatataatcaagtactaatattatatatcttctggttcttgctaccagatcaacgatgcagcagtgggggatataaccataattgctgatcgagctagccatgtggagtttacaatgccgtacaccgagtctggtgtttcaatgcttgtgcttgcggagaatgaatctgaataaaaaatcgaatgggtattcttgaagccactgacaaaagaactttggtttgccactgtgatcttctttctattcaccgccttagtaatttggataatcgaacatcccagaaacatggagtaccaaggatcgaacacaaggcagttgagcactgctct

SEQ ID NO: 63158 - DNA, 722 bp, Oryza sativa
  unsure (1)..(722): unsure at all n locations
tagtggatcccccgtgtggcgcccccacccgaagccgccgacgacgatgaggccgagcggcgcagagtcgtcgacgccgccgctccccatccaggtcgcgctcagggtcgccgcgctgaaagcggcacatccagcgcctgatgagctgccgcgcctcatgacgttgcagttcctcgccggtcagctctcccctgtcatggtcaaattgcaagggatcgattctcctcaactcgggtacatccaacctgtcgtttgattgcgaatccatgtagacgaagctatccagctgcttggtgggtgtggcgccgccatacgacggcgacgaggctaccgactcaccagtgaactacgacctctcctcatgctctcgaatccgcttccaacatcatcctcgtcaccgtatggtacgccgccaccgctcctcctctgcctgacgacgaggctgacttaccgggagacatttttgacaccgggctgaccagcacgtcgcggccgacgacgacgtacacctgcgcgagctccggcagcgtgcgcgcgcgaagagggaggaggtggggacgtcgacagcgagcacacggagagagggaggatgccgcgcgggagcaagccggggctccgagtccgccagagtccacctccacggcgcccggccctgcctccacctccgnggccaccgcccgggcgcccaaccccgccccgcctccacctccgggcccacaccg

SEQ ID NO: 63159 - DNA, 31168 bp, Oryza sativa
  unsure (1)..(31168): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgatgtcttatgttgggctccgtcatggtagtgtaagttaggttagctattgatgtggtgttgtagttgtagttttcgctcagtttttcctaattaactagacactgtaaggtttggtcctgttttctccttaaaatggaacaccttcttcttaatataaaacgtcggcaacggcctgaccgttcgaaaaggaataaatcaaatacttttgaaaataaatttaaccaatagcttaaaaatgaataaatgtattttttgaagtaggagtaaacaattatatgaataagttgaataagctctttagtaatggattaacctgagagttgcgaattcatgataaatagaaggaaggaaacaaatatactatgtggataaaatgaaatagaagaatatgactactatctcacacactcggagactatctataaatccttggcatatttcaaaagtaccaaaatgccattatctcactacttctccttttttcccatataaatggttgaacaagatatttaaccatacaaaaattataaaattaaatgaaataaatttatgattcttaatttttgaaaaaaaatacatgaaaaaaattcaaactgataaaagtcatatataacaacaaaattaaagtcaaaagaagtaaaattacacaatccatacggagtacaacttttttttttgttactttacgtagtactacagatttaggcttaggaaagtgtgattttacgatgtgaattacactttggcaatcttttattaccgaaatttaactttcggcaatccatttattcaattatttcattttagactaggtatttttgaatttgttgtaattttgaccaccccgaggcaatgtttgtctaatggaaatgttaaataattttccacccaccaaaaaacatctttaaatcctaaccattcattccccctctttcatttaatcataacccttcatttatttcccaatcccaatcccatcccccattttccattatccaaacagaccctaacactttttcctaggtacttccaacttctccctctgcaaaaatgtgacatgcgtgtaaactgggaagattgtcaacatgagtaaggttgtgtttagatgtaggagtgaaattttttgtcgtgtcacatcagatatacagacacatatttgaagtattaaacgtggtctaataacaaaataaaattacagaatccgcctgtaaactgcgagatgaatttattaagcctaattaatccatcattagcaaatgtttactgtagcatcacattgtcaaatcacattgtcaaatctgtgtaattagtttttctttttgtctatatttaatacttcatgcatgtgtctaaatatttgatgtaacagtgtgaaaaaacttaccaagggatataaacaggtcctaagtcagtgacgatgtcctcgcggttatcgttggactcatgaatagagcagtaaaaaaaagacaaaagaaaaacgtagtacgaagagcaaatgttaataaaaagatgatttaaagtgaaacttagattagataataaaagatggtccaaagtgcaaaattacaattcacttagaaaaatttaaattttacaaatttagttcgcttaaaatctagcaataccctatttatttcgaacggatttatctgatgtgttagatttttttttgtttgatttaatttgtttttctattgtatcattgtagggaaagacattgcccaactgcatgtctgcatatatggctgtgttcgctagagcaagtttcatgcacgaaaaacggaacagtctattagcgcgtaattaattaagtattagctaattttttttaaaaaaaaagatccatatgatttttttaagcaactttcatatagaaattttttgcaaaaaaaaagcaccatttaacattttgaaaaatatttagcagtttaaaaaacgtgcgcgtgcaaaacgagatcgatgagttaggaaacgagccccgagcttactggaaatttggagtagtaagcactacgcagttacgaaagtaacgcagcaccgaagaaaatcaacggcgctaatattgtctattacctttgatatgctagtcaatcaaaacatctataaattattatcttctgagatgaaaggtttaacatcggctgacagcggactcaaatagttaatgtacaatactcagacattgttagcattagaacagaagaaatggttagccaatcagtcggatgccgtctccgtgcagctcggaaaggaatgccgcattgccgcagcttgcaaccatgtcatttccttggcggaagacatgatgatgataagtcatatcatcgtcctaaacaatattccttctattctttgcttgtcacagaagcctcagtccgcaattgcaggacgaaagagtacaactactgtacaacttgcacgggctgcaaaatcataggagcccctcgagcacaagcgcaatgaacctttaagaaaccacctcggtatcccttgctgacaacctgtaactttgtttgaaacaagtccagcaaacgcagacccttttgagtgacaccgctgtccttgtctgggctctgttttactcacatatcatcgttgttcacaaggcagtgtgtgtacttgtgatcaggaaagccttctcgcatctgattggagtttatacatcacatttcacataagagttgcaccaggaagagaggaggttgcatctgccgtttgcattgcagcaggcacaaatggaattggtgcctggtgcggttcattgatgaagcccagaactttcaaaatctgtctgcatttgcagaaatcaatgacaaaaggcatgttatgaatatgaaaaggtaagacaagtgatactatggaatctttttgcagaatatcgtgtattaacgcgccactgatcaaagactcaataggacccaatgaaacagttttgaccaaataattgcagttttgtaaaatacccagctaaagttgtaacaaagtgatagttttgaccaaataattgtagttttgtgaaatttactcatatataaaacaaggcaataaacagttgagaagtgggtgctctgctagtatttgtgtcaactagtcgtttttggtgaatcagtctgttggtggtaactatatgcttaagtatttactgcccataaaatcaaaaatgtaaaacgaaaaaggagcaagctgtcaagactaataataatattgggaaagtacctgggcaagatgctgtgcatgttccgctgattaacaaaggaacaaagaggagttcgtagattggggtacttattcaaagctatttcaagctggggtggaggtaactaaaagtagcattgtgaagccatgtcagtacagtagtgtattgtatatcaaggagtgcatattttttataacatacatgcaagaatgcattcagttacttaacattgtacctgcaaaataacatcaaacgagcgtggctgagtctgatatgccaattttaagaacccaacccacagctttggcattttccatatctgcagcatgaaaaatagcatgaagcttaagaacagcagataaagaactactcaaaaaatattgcaaacaaaagaactactcaaagaaattccatcctactgttttcgcaaaataaacaggataacaataagaattgtgacagatgaaaatgttagcattatcattgatttgttgaggcactgataagtttgtgttttcatacacatgattagtgtacagggagcgtgactaaactacggatgttaagttacaacacttaagggcaccctctggtcagtatttgatgtttaggacaatattcagtcaaacttttaaaacccaaccatcaacattttttcaaacgcttagttttaaaaacaaaagaaatcatatatgtagatttgcctcgaaaagtactatcataataattaatatcataaacttattctaatataaaattgatagtcagaatctcaggatttagtttgagcaaatcttgccctaaacatcaaatattagatatagcacagacaggtatccaagataatgcagaaaagtgaatggttaatcagtagctggcaaggaaaatcaaacaaataatgtaccataactaacctgcttattaacaagcctggagagtatttccatgacaaaatcaacctgatgaaaaaaataatgatcaatattttaaggttttcatatggttttgcctaaagaggtttatttggaatattaataaaaaaacaaaaatgacaagaaaaggttgtatctatatggaaaatatattttattacatcttactgatagacaatcatattcatatattctaaaatgatatgaaaagtgatagcaaataaccttccaacatataacaagatatataaattgcgcataaattagaatggaaatcactgtaccaaagctgggaaagcatcaagtgcttgaataactgttctcatgaaaagaagtggaattggtacattgtcaacctacataacaatccaaacagttaatcaaagagaagaatatgtaaaagaataataggtaaagaataacagcagtcaagttagtaccaatttattcagtgacttctccaaaacttgctgagtaaataccgtgcgctgttcaaagcaagctgtgcaagcatcagtgacctgaaaatattttcatttccatcagaaacgagaaaaaactcatgtcaaccaagaaaaaggatatctactgcacaggtgcatatgcatgtctgtcttgaactcttgatacaaaatccatcaagacatccaatttgtgtactgggcactaatttatgctgttgagatgttggaatataatgaatacatcaacataaccaatagctcaccttcttcagggcaactctatccttttcaggattaatatcatgaatggctataagaacttcagcaggggttaaagccggaccagtatgagcagatccctgtcaaaaggaaatttacttaaaccccatccaagaaaatttttatatcctaataaaaatcaacttacaaaatgcatagttaataataagcattgacatggttgtttcctgtcaatacaaatattaaataattttcgcgttagtatgcaagtaatttacaatcacttgccaaatgtgccacaagaatcaagataattagtaactccctatccttctatactggcatttgaatcggcaaaattcttccctcaacagttaaatgagatgctatgattaattgtcaccaactatgatgatctcaatatatattccatagttacaattctactcaaacaattatagttacaattctactcaaacaattgcataattctgtaagatctatgtaatatctattaactgaatgttgaataaggacaaatacgatcacctgcaatatccgagcaagtgcatcttggaatctatcaggtgggagatcaactagtcttggaaatatgggcagcacctgggaccagtgtaaaacaatcaggtcaatatgtgcagcaaaatgcagccatatcatgatgacaaaaatgttaagttcacaatcatgagaagcattcagtacttgctactccgtagacataaacaaatgattttgagaagaatagattataaacaaaaggacaacggaacataaaacatattccaaaatccgatataataacttcaaaatgacttttggcacgtatttattatcaactgcaaataattttgctttctagattgatgtgtaactcaaaaataaattagaactatttcaggttgacaccctacgattattcttagtctacagcctgataaagcatccacgaagtacaaactgaatacctatgagtcaccagaaatgaaatcttaatcgatgcttagaccttcggtgcatcagctagaattctacttgcttggacttggacagattatcacaaatatgatagcagaaattattttttttttaacctttggctagaaatattatagtccctctgtcccaaaatatagcaaattctccgcctactccctccacttaaccaatcacaaccattcctcattcaaatcgacctacttaatctccacggaaaacctcaaaagtgtattttggattttgggatggagggagtagtgaatctagcgagctacttcctctgtcccaaaatgtaagcattttttaggttggcgtggatattaaaaaagtagatgtgaatggttggacaaggtatgtgattggtcaagaagagaaagtaggtgaaggagaatggttgtgattggttgagaggaggaagtagctgaagaaatagcttcatgttgggacaaagtactgtgctagaaatagctacattttgagacggaggtagtagcatatacaaggagagaattacaaactgcacactgcatgatctgaattaagtggtccatgccaccagccaatttctaagtgccattgcatagcgactaaattagctatcctgacaactcaatccagattgtgcaaggcatgcaagtatttctatttctcaaacattatcatggcaaggcaagtatttatatttctcagataacaagcaactagacagttagacagttagaagatgcataaacaaaatacaagagaccactacctcttcctttggaaatgaggataacaacggaatgagaatagatgcatcctgccagagaaaattacaagattcagcaaaagcactaaataaccaatactactaagacgacaaacaaaacaatttgcagtatgatgatacacagagcacagagcaggcagaaattcttcaaaccttcagcttggttttatatagatgtttaactgccgctacaagttcggctgaaggagttgaatcttctgtcagagtttgcaatatctttaagaagagaagataatgagtataaggaatatccatgcttcaataatgcataatgatgaatcaagagaaaggatggtaataccaaggtaacaagctcttcactgccttcaggtgggttatgaataatagccagcatctcagaacatgaggatcccaggtttcttacaagattgggtatatgccaatggatacactgcatgattttgcgacgtaatgagcagacagtggttgtgatccaatagtcaaaattcaggactttagaagttgaaagtagaacctgcttgacaacttttggagaccttccataaacattgaacagatgttgaagaagaatgggcctctggaagaaggaaaatggttttactacctccggcagaaaaaaaaaacagaacaagctaacattgtttacatctacagaccttcgtgcaaagtgcaaagaacaatgaagtatggcgtttggcctcagatacagatactgcagattgcttaggtgaaaccaaatcggtcttattgcatgtactttcagaaggttcagcatctgaaatatgggagccactaaccgaagtttcctggctgcctgcctcaaactgctttcagaaaaaaaaaaacttcaatatcagtcaaatgttcaatcaaaatgcagtgtatatgtcaaaacttaagacatttcaatggcatctgaagaaaattaggacatttgatctcttgtatcattgagagtcaaactacagtggaaaattgaaagaagtataggggaaattttgattaggaggagatattagaagtcaactaaactaacttttttctgtgtgtggtgtgtgcggcggcgaggggggggggggctacactcgattgtgtcataattaacccccacagaacatttatagtaagttgggcaaatgcttgagcatgaattgacattaaatgtgaaaaggtgtttacttattttgatacactgcaacaaaaatactaatgttgatttatcaaactagagttgaagtgtggacaatacaatattttggatgggacagtaacagttcccatcctgacgtccatatttttttttacagtaaaacaaatacaaacagaatagactatcgttaaggagaaaatatgtaggcctcaaccatacattgcatttgctactgttgagttcagaaatagaacaattaggatggcacatcagttcccactcctagttgagtctgagtgcatgataaagcaccaagcataacaaggaaaatcatcaagaattacctcaggtgaagattctttcaaggatgtgaaattaatgtccgtctccacaccatgtttattagcaattgccaaaagactgtcgatggcaaactgctcaactctttctgatgcgtatgttagttcatagagtttttttgtaacctaccaaaaatacaaggattagcattacaaaaccagcactaaataaaaaaatggcaaattaacagaacataagcatagaggcaatgatcctacagaccaatctaactgcctttcccctgacttcatcttgagagtgaatggcacactgcaaattcataatacaggaaacatgataagtgaacatagacacatagtaaacccatatcaacattgtccttaattcacaaaaataagtaaacatatcagccataaatatgtttaatcttggattgcaacagacatacagacaaaagtaactttccatatacacatcaccaaaatgcttctagtgtaaaaagcagaagcaggtttaattcaagttgtcttacccttttcgttacattagaatgtgaaaagatgtcaaaaaaaaattaatcactcaaaatgatttatgataagatctaccagttaaaaaggaaaagaaaatgcaaaccttaagagcaatatctaagcaatcttgtcgaagtggaggccgtgctaagataagactccacacggttccaaggccttgggtgacacgatcaccatcactgtcctttgtttgctggctgttgccttgtgacacacaaatatcctccagtaatttaagcatagactcaggcaagtatggtgcatcacacagaaatttgctaaaagatttgtctgaagcaggtagcgagtgaatcaaggaccttgcctaagaacgaaagaatgaacatatattaataccacccaaatttcaaccttcagagaaaatacaaaacaaatatcaaaataaagttttcttgcttacaagtgatataaagaagttctcataatttttagaagcaggtaaggtgctttctggtgaatcagcaacactcacactgtgcagctgatacagcacatgcattgccagttcatgaccctgtaaatcacatgcttcagaagttaaatagtcatgcaatgatagttacgaagcacctaacgtgtggtgccatggattgtgatgacatttaggggctcaaatttgcatatgacaactgcagctagagacaagacaaactgagcaaactcgacacagttaaaatctctctctctctctctctctccctctctctctctctctctctctctctctctgtgtgtgtgtgtgtgtgtctttctctctgatcaaggttgattaaccagcacaaggtcaaccagaaggaagcttcaattagctcaagcgcactacagacaggacgttcaccaataggatatcacatgtgagtccaccaaacccagaatcactagaatggttgagaaccctagagaaacacaacagctgccaaaagatatatagctcaaataggatagaatgggcaaaaatgacgttagctcaacgttatgcatattcaaacaaatccagctcagacacctcgaaatatatttcaagcataatgttgtgctcaggataaagctccttctgaaatttggttccacaagttcagtccaaatatatatataaaaaaagagctaatcccagttttctttcttaactgatatctgacaaaatagaatgatctaaactcatattacaatcataaaaagaccacaaccaataccaatgtttaaatgctaaagaacctaaacccaaaccaaatcctttttttaatccaggttttgttatcctagcaaatttgatcgattgaacactggatgataaccgcctccgataatgctaaatgcaaagaaagaagtagtacgctatcagtaaagtacctgatcatgataatggtatataatgtgtctctgaatcaaatccataatattgtcatcagcagtactctggaataacagaaacctggtgtgagaacagcacatattgaagtatttccagaacactagcaaagttagcttggggattaaaattactaaacatatatgtcacagagaagaaacaagtaataatatgtcaggccataaatattacagtaccaaaagaatacctgggcaatcaaatgagcaaggagggaaaatcttgtgttaacgctgtttttcttgtaatcatcgattatccgtctaattgctaatttgtgcaacaagattttctcatcgtcacttaattccagatgagatggaagaactggcaaatcatgattagtagtatcctccagcgttgatgccttcaaaactggggaaaatggatcaacctccaattccacgctatccaattcattgtttgaagtagcttctggagacaatggattgaccatctctttatcaacaccagaagaatgaaatccaacatctgctaatgcctgcacttcaaatttcggctccagttccaaggcatcatccaaaatctcactattttcctttgggagtgattgattgggttgacaagatgtttgctgcacgtcttcatttttagataggtctcctgaatagtctaaagagttttcaaccttccctgaaacaggataaggtacatttgacaagttatttgtctgatgcacgccggtggtttcccccttcacatgtatggaactagtggctgcaggggcaactgtccgacgaggatcaaggcgacgaggatcctgcaatacattgacagttttcacaatatgcactttctgttgactgcaaaaaatgtgaattaaagatagatcatatcatactcttcttgggtcacgcttagaatcatgaacgccagacacaacaggcacatctgacattgacatgctgactccatctgcaggaagtgcaaactgcgtactgtagggcattgagtgggagtttgctggcaagttttctgtcaggggactggaggaagattgaattttcttttgctggccattgttgctggtagctaatagaattgaagtttcaggtagatgtttcattgtttctattacaatgtcagccatgacatctgcttctactgttgagatgagaatgccaagggattcagctcctctttccccttcagcaagtaaagcaccaatcatttcaatcatcttctcaacaggagacatatcacaattcaagagagctggatcagaggaatgatccacattcgcttcattgtcaacctgcatattagaataatcagatgctccctgaaatggtgggtttaaagcagcagaggtatcaaatcttgctcttttagctacgccatcagctgtagcaaaagcatcacttgatctggcagcaggatatttccgactaacatctccgtaaggcatatccaacgttgaaggttcatcctataaataaaagaacactttaacattcctcaaaggaacgtgcacaaccaaggaaaactaaaaaagcaaataccaaatttattaatgctgcaatatatatgcatacagcagtacaggcattaccttgctagcacgagaagcgcgctcaatatttctagtcatcttctctacttgcctaataatctgttctgttgcttcaccagggctcagaacacgaagctgccttaccagagtatccttggactgtccagacaagaatggccacaattaatttcagaaataacagggagcatacaaggcccaattaaatgcacgaacacagttaagtccatcaaacaacatgaaagcaggaaaggaaacatgatatttacaaatcctatatagacatgggaaagtagtaaagccagatcctagaacagagctaaaaaacccagttcatttagttaactagaaaaagcaatgggaggcagtacaagctactttatatgtattataaaatccaagaagcattttaagctcacacagctcactagttgatactacgagtatttaagtattattagcattcatgtgatggcacagttacatggaacttaatagatgaaagaagataaccagatatccactaaataattagaacagaaatgcacaaactggaccatataagtcattagttgattattatacacagccatccttcatgtgtaaggaaagcagccattaagacaactatacgtcctacatctattatcagtgtcactaactaatttcatcaaaatttatcattagataatcattaatcaagtgacaatcatttcacatgacatttttgcaagttagctaagttaatttgttttcgtgacaataaaccacaaggacaactttacttttttttttactgaaatgaatggctttcggtatgattatttaaacagttaaatcaaggaccgtgcactagaatctactagtgtaggcatgtaacactaacaaaacaagctcaaggattaaaaaactaaacaggagaacatgcaaaaaaaaaagaaaaagaaaaagaagaagaagaagaagatagatgagtacattttgtatactttgaactctagaaaatggtaaagatggcatataactataaggtgagctcacctcaatcattgcctggcaaggactccttagaaaccctaaaaaagctgttttcagggaataccgcagacttgcaggatgagctccttttgcaacctccaaactagggtcaaaaccaagtagcactggcagtatgcgttcgtagtaaacaggtctattctttgcaatagctgcaagactggaaagtgacaaacatttatatttccaaaagataacaacatagtttgcaaggttgtactgatagtaagataacttccaacaggaaaaagacattccgaacattaaaatcttaaagtagcaggcaaccacatggacatagtacagttgcaagctttgctcattggtaaacctcatcactgcccatgtctgttgcggccaattatataactgaagtaaagaacacaaaagcctaaataaatgttacggtacccacttcacaaagtacaacactatggggatatcactatagatgtgtgacaggtcagagacaacataagaaatagctactgtgcataaaatgaaactgaatcagaaacaacagtttataaatgacacaaatagctatccgccaatccatatatggaggcgacaactcaaaacgagcagaaggtagagggaactggtacagagtcttacgaattaatggtgccaactaggaaggatccttgatgagcacaagctgactgcagtatatccacaaggaggatgagagccctgtttgcatcagcttcgagaacagcagggttaaggctgggatggaattgagataatcttgaactatcaaacaacctcctgttccttcctgtttgtacagcgaaaatacatttcattactttgattgcaggaccacattatgcccattaattctttgcaaaaatctgccttaaaataccttcagttggctgcatccggtcacttttggattgaggtgcgaaacacaggatccatgtttcaatgaactttacagcaaacagtttagtagcaactgggacagactgttgtatatcacatgaagaatagcattagtcttggattgagcagaaacaaagaactaaaccatcaattcaagtttcaaagtagtcatttttttttttgcgaggaaagtagtcattagttacaaagctgtgtattttcagtaggatgagcaaagaagaggtagtctggctccttttcttcatatcatatcacaagggcagggatgggattactgtggaataattcccactttcgtagtgctctgtgctcaacatagtcacaaatacactccacaaaagaaagtttttccagagcactagatcatagttttacataaaataaagagaaacagtataataaaaaacctgatatatgtaggttttgtactttcattttatctgctaaatagtgcttgcaaatacacaacagaacaaccacagtatcaacgtattattgaaattacgcaacgcatgaacttgtatgctactaacctcatggatcagattatggactgcatctttaaactgcttcgtccaagcccacatctcttcaagccaagcatcaacccttccacacttattaatctacattcagcattaaaatggaaagtgagtaccaagagcaagctatcagtaatatcttagtgataacactttaagtagcatcaattcaatcaggagaaaattttgaaagggagacattacttcatagtgattctacataacgttttgcattttcagaactaaatgaaaacatatgggttttctctgaccctactgtgtaaaatactaccttaaatcttcacgggtataatcacaaaaccattgcttgtaaaatagtcaaaacaaatagctaacaaacaaatctatgagcattgtatggctcaattagtttttaactactgaaagaagcttcaagttgttcttgatcacatagagtcctattaggatagtaatattttttttataattacagtacaaatgtaagtttaatgttttaacatgtgatccagtggataacattttcctggaagcttcttcaaggttataaagtcacagtttacaaaaggaaatattattctttgctagtatcaatcagcactagttattaaatatgaattgaacaaacatgacacatttttcacactgcttcaaatgtatacagctggtacagtttatgttgtatttatgcagaatcttttgtcactttgtaagtgatatagttgtgtaagattgtcgacttactgtagtaaagtcactttaactgattgatttaagaaaagaacaccaaattggcatgcaacagcttctgttccaactattctagcaccaaactgacatgcaactacttctggtccaactactctagcacaaatatatacgagacaaagcacgctccttcaccaatcgtctagaacatagaccattggtaaatcatcagaaaaaatgatttctgggagtaaaagtgaataatagaagcaagctagacacagtattaatggagtcacaaggatttaaaggcttgttcactggatgcaccatctgaaatggtttgaccctctagtggtatcacaataagatttgcgattgccgagcacttttagcatactgacagtagagaacagacagtactactcttcataagcactttatgatagccagaggctgtatctgtcctgcataaaactgacccatgggaacatgtgaaacagaataaatgaaaacagcaaacagcaaagtactgggtttatgcagtgcctccaataatactgaaagagcaaaacatgcattgcaatcaagaagtgctggtctctgaggttataaacacgtcttttccaagaaaacaatttaatattttgtatttcctttggcacaatttgtttatttctgagacatactcccaaaacaattaggagaagcaagtaaaataaacctcgtcaaacgataataccagcatcgcaacggtagtaattacaacaacaatggatttattcattaataaatatctgttttacaaaaaagacctgaagtgtcatctcttccaatacagcagcaaataaatttgtcccactagctatggattgattaacaaccacaggatcatcatgtttcagaaatgatagcaaatttggcatcagcacaaccaaatcttctgttacatttgagccaagctctctcagcaatctgccatcaacaaagaaatcaataagaacactaaaatagtttctgccgtgggtaactagagaacacagaaataagcattagatatattagtgaactatatgttaaaaattaggtcctttttattgcttgagaagttaacaaacttatttccactttaacaagtcaaaggagatcaaggcgtttcatgcaaaaccctgaaaaaagatatattcgatcaaagtacacgcttccaaaccatgcaatcagatagattatattaccttaaacaaaaatatttctgcatccaaccgtgttttgaccctaaatcttctcaacaaagttcaaataataatttaaattagtgcctgagtatggattatatcccgtgagtttttcaatacaatgaggtcaaacagacttttcttcactgccctgtcctcgcataaaataaattccccgttctcaaaagttagatggcatttagtacttcatataatatgaattccttgttctgaaaagctagatagcatctagtagttcgtataaaaccaatcatcagttattggcagcgtatacaaaatttatccatattcatgctattaccagtgctcgcctaaacactagaaactattccccacacactcaacaggcattttattgaaaatctctaacttggccaaattcgtaatcgtacaaaagcagagctaagcacatcaacctacaataataaatcccacagcaaaccctataaattaagttctaccggagcacgagacgaatcacggtgcgagagctttatcactcgtctgaggattttatttctcgagacaagagagagagggggttcgccgcttaccttagggcacgagacgaatcgaagcgaggggaaggcgcatcgccacgctccagcggcggcgccccggcagcgtcgcctcgcggctccggccaccgggcgccgtccgcctcgaactccatggccccggggggtgtgagcccccccccccccccaaaaccctagctctgggctgcagccccctcccggggaaggcggccgccgcggagagctagggccccccgtatctgtggctggctgggaggtggaagcagcggttgcggcgatggggggctggtctagggttttgatttgggagggaaggccgccgcggaggaggcaggcggccggtggaaccgggcggggcggggcgaggcgcgggctacgtggggacgggggaagagagagagagagagagagagagacgggacgggagggacaacgaggagagagagagtgcccacaccggtttgcgcgatattatggaggcgggggagtgggatactggcgtgtggggaccctgtggtttagctgggacccacgtgtaagtgtgtggtccgtacactctgttgaattttttttatttataattttttttattaaaagttttacaaaaataattttccattttgaaaattgacggaaggagtcgcctaccgccctctgggaaaaatcgccctctcagagggcggcgaaaatgacgtggcagacgaccgttcgctctcgggcgacggccgtcaacgaaatttgcaggcggcccccttgccgccctccgctagggcgattttatactgtgcggggggccgcctgcaaattggcggcgaggggggcatggaattttgcaggcggcccccttgccgccctccgctagggcgattttgtactgtgggggggccgcctgcaaatgggcggcgagggggcatggaattttgcaggcggcccccttgccgccctgggggagggcgatttttgcctctccccctataaagcccagtccctcctctgtgaaattttattatattcactaaaaatccaaaaaaaacaaaagagagagaggggagggcagcagaaggggagcggcgaagccctgctggttcgctcaattcatcataggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaaggtgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatctataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaagatatgttcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaagattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgatagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatattcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagacttcgtgttcgagtttgaccgtctccagccgagcgacgtcatctgggagccgtacacagaagaggccgtcgctgcgagagcaccgctaggactttcgtccttgtgcacacgcgaccaggcttactgactcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagatccgcaggggcgttcgccacctcttcgggcgcgttcgccagctcttcctctcacggagcgtcgatccctcgcccacacggtactttactttttattaatactgttaaatacctgtacgaaactgatggtccttgtccagcagaatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaaatgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaacatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttaaatataaaaagatttgataactattgatatttatacaaaaatatagagcacagtacaaaatcgcccttgcggagggcggcaagggggccgcctgcaaaattccatgccccctcgccgcccatttgcaggcggccccccgcacagtacaaaatcgccctcgcggagggcggcaagggggtcgcctgcaaaattccatgccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgactacttccgtcaattttcaaaatggaaaattatttttgtaaaacttttaataaaaaaattaaaaataaaaaaaattccactctgttcaaggggagcttgctacgtggttgggccagtggagcggaggcccatcttgcccgttaagcgatcagttaagtggaatttttttatttttaattttatttattattaaaataattacaaaaataattttctatttaaaaaatttacaaaactagtcacgccatcgccctcgccctcctagaagacgattttgccgatatggcagacggccgttgccctcccataacggccggccacaggggacaccgatttttttttgcaagcagtccccttgggaccgcctgcaaaagggcggtgaggcggcgtggcatttttgcagacatacttaagccttagtctcaaactctcaatgcttcaatagcatttcttatctctgttgaatgtcaaaaaaaaaatcttaactttgtgttataaaaaaaaactacctctactactgtaaaagtggagtcatcatacttctcccaccacatagaaaattaaaaataaaaaaactgaaagataaaattgaatcatataaaaaccattcgtcagaaatcctcctaatgtagctataaagcgtgagcatagaactataacaccaaaatgcatcattcctgcaggactgcaggtcccctcataatactggaaacaaatcaaggctacttcagggcgttgacagaaggtttgagggttcttttgtcagttttgtgcgagagcggaagaaggtttgggtttagagcataccccaaaaccgcccgtaccttttaaaggttcagtgcctaaaatcgaaatcatttgtaggatagttggatgtattcatgtatatagtattcaacaatacatcattcatgctttcgcacaaaaaaatccttcaacatggctagatttttggttaaggtctaaaatggtcttgatagccatcggatcaggcaatcaagataagatgaaaatgaagatgaagattaagttttttacgcaaaacgaggtggtattaacgtatgattgattgagttttaattagtacaaacttaaaaaatagattaatatgatattttagagcaactttcatataaaaagcttttgcacgaaacacaccatttagcggtttgaaaaatgtaccataaaaattttaatcttcattcaattcttgttagagaaaagaacagcaccaaacgtaacatccaaacgcagaaagtaccaaggaagaccacaaggatagatgcgaaggggaacaactatgaaagtacagaacatggtgctacaagcctcttcaagctagagactactactgccttgaagcttcaggttcagttgctgttgtccactgctgcaaattgcactgctttgttggcaagacaacaaagagtatctagtgtgtaaacttgtttcccaacttatgcacaaaatattcattgtcaacttgatgacagtattctaatttgctggtgactagtgtgtgaattattatggagacttgtttcctctttggagcagaaagtgaaagaaaaacaagtagcagaacttcagataaaacactatccgggaactacttttgtttttctgaaggatccagaataacagatcgagtttctgaacgatcaaaaagagaactgttatgtcaatctaacaaagtagagtgcgaaatcaccggtgttaaaaggtgaaaatattggaaaataacatgctagccctccatacatgattatatacatcgatcaaagaattgttaaccctagattctggaagtgaaatccagaacaaaaagaagttgtccgtccatatcccggaggacccggactacaacaaaaatgcgtgatgatcagtatgatcactgatcagtcgcggttgcagagaagcatgacaacgcatcgccggatgatgtacagcctcgccttgtgctccttcaacattctgccgaggcctcctcttctcccttggctccttggattgcccatactgttggagaaatcagatcacacctctgaagaaaaaagacagccctccttcacaagtgtttagtgcttaagtgcttctgcttagcatggtgatgcctgttgcatttggcgtgcttatatagaggagaagcgcccaaatctctagctccttttctttaaaagaagccttctattgtctagctgtaaactaccaataatatatcatacattttgatgtactggtaatatttttagagtgggtagctgcaagtactccacagagcacatgccacggtttctcaacttgcacgaagtgtgatgcaagatcgatctgggggacaacgcctctaaaaattttgtggcctataatgcctcatgaatcttgctctgggatttgtttagctatacgtatggctaacattccaacttgtttgacactaacttggttctgtctggccctggccatacatatctgagtttctgtcctcggttttgcaagatcctgatgtgctgagatcgtcagattcccccaaattaatgatctggaggctaacttctggtcatcaatgatctgctgtgttattgatatgtctgcaaagattgcagacaagtacatgatcgtagattgcattttgtttcaaatcagtctatagaggtttgtaacttgcaagcacctcacctaaaggaataacacaaactaacgcaggcgtcggcagttttgcgaccacatactgtagatgatgcatgtgtatccctacctaattcttaccggttaattagtagcagcaccaatactgtagagagtaatagcggattttgggttcttctatttgttgggctaaatcatcggacgtaatacgaacaatgaccactggttgaatagcaagagaagattgtaaatgtgttacgggttggcaatgaggagctcatcagccattaacaatttatctggattacatgtttgcaaatttatcttttgggagggtttttaacactctcccttcagctttgacagcctcttgtcaaagactcaaagtgcaaaacctgtataaaaacactctctttcttaatgaaatttggccgacctactctttggccggcccggcatacatgtttgcaaattgcaacaattaacaacaagctcttgtttgtacagattacagacacgtacatgatatggattgcatttctttaaaatctatctatagaggttgcaacttgcaagcatttcgcctttgttttctgaaagggaatacgaactaaccacacagccgtagatatgcatgtgaaaccctaccaaattctcgccagtcagcacactctggcagtagcgtctctctctatttgcaggactaaatggcacgtcacctgaacacgaatcgctggttgaataatcagactgcagagaggcttgagtgtgctgtcagttgactactaggagttcataagccagtttagtagtagtaacagttttctcacttttctctggattgcaacaacggcaagcgctcttctttgaccggcttttaaaagacacacagagccgtggtcacacaatttgttatgccaacgttagcgtttgtgcccaccgaggttttcagtcaactggcttgtgcgccaatgtagcgattctgtcccgtagacgagtgatcgatgcgatggtataggacgtacgttaaacttgaggtgccggccaaatcccgtagccgttttaacttcgtcctgatgcgatgtatcctgcatatgcatgtccaaaatggatggatcgtgcttagctcatgggagtagcatcgatatattggccctgtttggatctggagggctatttaatagcctttcagaatcttgctatttaagagtattaaacgtagattattgataaaacccattccataacccctacgctattttacgagacgaatctaacaaggtatattaatccatgatttgctacagtgatgctacagtaatcagccgctaatcgtggattaatatacatcattagattcgtctcgcaaaatagcctaggggttatggaatcggatttatcggtaatctatgtttaatacttctaaatagcaagattctggagggctatttaatagctcggagcatccaaacaagaccattgtattattgtgtggccagtcaaagagtaacttggatagggccggtggcttgttatatatatactggattagttgcgctccttaaattttcagaaccatatggaagtgtactctctccgtccaagaaaagacaaactctgggtttccgtgtccaactttgactgtccgtctcatatgaaatttttttataattcgtattttcgttgttgttagatgataaaatatgattaatattttatgcgattaatattttatgcgtgacttgtctttttaatttttttatattttttaaaaataagacggacggtcaaacgttgggcacgaaaaccagagtttgtttttttttgggacggagggagtagacgtgtatcatagcaaccctgacgaactgatactaacgttcagatcgatggttgattgcactgcactgcagatgaaagaaaaagattcttgccgctcggtcaaggcatggaagcagacaggacgtattcgcaaacctacaaagaaaaggtaattaatggctcgcgatacgacgcattggtcagcgatgacgaacaacaagcgggttgacggctgtatcggcatacccggcatcggatggccgatggcggatggcaacattagctgcaggatccgatcgtgtatcctggactgtttctaacctccctgaacaaaacgaacggacgttaataatcaagcaccaggcggtttgactttaaatgccggatggacgagccgacgtatcgatgatccatctggttgctggatcgggccaggaaagtttgcaggttggtgcatgcgtttgcacggaactcaccatgagctacccacggtcaaggcgtcgtacgtacgcattgcacgtacgtacagctcgatagctgcactggaactgcacctagctagcgcctagcgcgacctacattgaaccttccagcgtccgtccaagtgtacgtacgatcagagctagcgcgcgccgcgcggtatataaacacatcaacaagcagccccgactccatcgcgcacccacaccgtcgtcaaagtgtttttttggcatgccagcgcccggttaattagctggctctcgcgcgcggacgcatttgctagtagttgctagctagctcactcgctctcgcggcagagagagccagcgacgaaggagcgcgcgccgcgcggagaccatggagctcgtcgtcgccaggagccacggggcgaagaagcgcaggggcgccagccagctcggtggcggctgcagggtcgcgcgggggaacgaggcgaggctccgcatcatcttccgctgcgtcgcgctgctcgtgtgctaccgcgactgattggccgatcgatacctctggcaccgacggacgcggtcgggctgccgcttattctgtttgtttcggtgtgcgtgtgtgttcacagtgttgctgtgtccgtgttcgtctgatggtgcgtgtgtcgtcgtctctctcgttttttttcctcgccggtggcttttcctaccgatgacgtccttcgtctcttttttgggccttctttggcgcaggcgaattagagggtacatataccgcatcttcaggcaacatggatgtgatatacatggtcagatttgatcatttcacaaaaatggggaataattaagcacttgataacagagtgcatatttgcgtagtttacctatttgatcatgtgttcatgtattccttaaattttcaacggtctcgtgattgtttgcatgataactaacttgatcccggagaacttcatccctaggaaggggcttgaacaccaacataagttaatataactttgtgttactccctccgtgtcctaaaatataagcattttagcatagtgacacgtcaaaacattttaaactttgactattaatagcaaaaatatataaaaaatcaatcatgtaaaattgatgttactagatttatcattgaacaaactatcataatatgcaactctttttatttaaaacaccttaattttatagatattattggtcaaagtaacattttgaagaccgtgtcagagttcaaaaatatttatattttgggacggagggaataggaaccagctgggctgcaacttggagtggatcatctacttttcaagaagtccaagcgaacccaagagacaactatacataagaagcagcagcacttccaggaaatcatcgaacaaatcaattggcgagcggaagctcttggcggtggtgacgacttgggtggtcgggggctcccttgtcgatttctccctacctcccttttaccactacttgttctagaagcttctggcaccttccaccacttgtatcttcctatttgttccccatccaaatatctcctatgtactagactttgctgctacttgtacggctagattgttagttgagttggtgctgagattggttgatttgggttgctagcaatctggtgtcagagctcaccaagcctaccaaacaagctaccatggcaagtgaggataaatttgacacgcttttgaggcggattgaggagttcaagtgaaggcgggtggaggcagatcagacgagcgctgatttgctatctctcaagacggtggtagaagcgtggatgaccaaagtccagaagaatgccgaagacttgcaaaattcggttgggacaagcagtccaaggtgacgcccaccatgtgtttgacaaaatgctctagctccgacgtcaagcccaattcccctattgtttgtggtggtcacgtaggccacgactgacacgacctctatggaactagtagttgttgagaatgccatccgtgcaatctacatcgacaatcgttactaagtaactcgttgatcagcgagtggaatcatgatgagcaactcgttgatgttatcatagatgaggcctttcacagtgctctaccctggaccggtgctatggggcgacacggaggattttgtccgacatgtcgcgtggaaccaggaccaaacttggttgctcgtccccaagcagagcaacgcgcaaccttgctcggtcgaatccacgcgccgccagaaaaacacgaggagcgagcgctgtgggcgtcgatgcttggccgcccgtgacctcgcgcacgcagcactcggagaaattccagattcgcccacgaaaaaatcccttcccgcgcctgcgattcatcctaccgccaccgagtccttttgcccgcgccggcatcggccttgccgccatgaggacaaaatccatggcggcctcggcatcgattggaatggcgtcggagcagctaccacccatctcaagaacccaaatctcactcacaaaggatcccccattcccacaagaaatcaaatctcattacattacacaaaaccaagaaaagattcctccactcccgtgccgagatccgacgccgagctaccaacaaaatcacaaaagaaaatcaagtcacacaaaatcacacaagaaaaatcaagaacacagaacgccgaggcgaggcggcggcgtcgaccacgctgcccgttcttgagccgccgccaagaacgttgaggaggagcgcgccctcctcccggtcgccgccttggccaggtcaacgccgagctctgccgccacgcgcaccgagatccgccgctgccaccgccacgcccctggccgcgccgacccctccctgcctccgcatggcggcggactgaagctgctgccacccctgagcagaaactgaaccccacctgacggagcgtggggctcctcaccgggagaccgcgcaggtccccctttgccggttcggccgggggcgctaagtgaggttcttcaccctcgatctgggaatgttcgcgagagagccaatgcacaagacacgggcgatgtagacaggttcgggccgctgagaagcgtaataccctactcctgtgttatggtggatctgtgtgtgaaggagttacagagagctggagagcaaaagagttcaggctctagaacccctcttcctctttctgtcctctacgagctcaggtattctcagagtcgtcccccctattcttgttctggatctccctgagctcaggtattctcagagtcgtcccccctattcttgttctggatctcccctctctttcttcggtgggcaaggtcctccttgggggatccactagt

SEQ ID NO: 63160 - DNA, 3466 bp, Oryza sativa
actagtggatcccccccgcaataaatgcggttatggtgagcgccgctgtgctcacctaacccgcacaagtggcgccaacaccacagggggtcggggcgccccagccctcggggccgaaacgggagcggcccgacccctcggggagacagagggaggggtggccacgtcaccctcgggcccgacccccccgagggggtcaggccacgtgggtgagcgcggctgcccaagcctctagtcacgatactcccggtcccatgtcaccgacagtagcccccggcgttatgccagggcgatcgcccccctcgagggaagcgctcgggcgtgacgccactccttaggcctggtgacaggtggggccggtctctacaggcgggcagaaagccagccatcgcaaatcgtgcgcatcggtaagggaaaaccaactgaaaataatgagcggcctcttcgcgaccgctacattactcgagcagcgcgcgaatcgggacgagctgattcgtttcgcctggagacatgatgatggcgctttggtcggcgagcgtagttaacgcgcgcacgatatgtcccatctcggctgccacggccgcacatctgcctcgtgcgccgcaaacgggcgagcggaattagtggaggtgtgggcgcgagaaacgagggggcgagatagtgggcgcgggaagcgaggagccgggcatagcgttggaaagggtataaagacgccgaggaagagattcgtttccttcctctcgccactattccccttgccttcgccacttgcgctccaactcttcgtttcctgtgccctaccctcgccgcactcgctcgctctcaagctcctcctccgccggcgtcatggcacggggctccgcaccgctcgacggtagcgtgctgccgccttcccgcatcgtgagcgagaggcaggccgggctgccgcgccgatttatgccggaatctgccaccggccgggaggtggtcgagctgggcgagggacgcccggcgccacactacccggggcggtccgtcttcttcctctctttcgcaatggcagggctggtcccgccattctcttctttcttcatggatgttctggagttttatgatctccagatggcgcacctcacccccaacgcggtaatgacgttggccatcttcgcgcacctgtgcgagatgtttatcggggtgtgcccatctcttcggctgttccggtggttcttcaccgtatagccggtgtcgccgccgtcggtagtcggtggctgctacttccagccgcgggggccggtgctgagccgctacattccctgcgtcctccgcaagaagtgggacgactggaagagcgactggttctacacccccctcgccgacgaagcgcgcctccgacttccgagccagcccccggcgcaggcctccagctggcgggcgccggtagatctgggagacggctacgacgccgttcttgaccgcctggcgggtctgcgatcccaggggctcacgggggccatggtgtacggcgactaccttcgtcgccggatcgcgccgctccagcggcgcgcccggggcgcctgggagtacaccgggtccgaggactacatgaggacccaccaggggggcagatgggactgggcccctgaggacttcaagatggtggtccaacgggtgctgaatctcagctccgtggaggcatccctcatcccccaaggagtcctccccctctgcagcgatccagatcgcgccaacatcctgaccatcatgtaggcggtcggggcgtcgggggagcgagccccccgaggccacgatggcgcgggcgggagccgcagggggaaacaatctaccccgggagggggtcatgcttctgggccccgcgacgggggcccggggggcagccgccctgccgacgcccgggggaagaggaagcaggagggtaccccttccccatctcctccccgagggggcggggcagtgcgtgccagcagcaggcgcccagagggtgtcgtgccgacgtcgcagcccgagggggagcgaaagaagaaacggctccgcaagatgggggggaccgagtcatgccgggggaacctcatctcgcccccgaggtggtcgtttaaccgacctccccgcaggtttgttcccgcgcctaccacggccgtattcattctcccatctcccaaggcgagttttcactcactcgtttctttttgtcctctggtttttcttctgcctcagcgagatcccgtcgtgcccctcccgccattccaagtccggccggtccgaggccgaggagacggcggccgcggaggcccggaggcgggaagctgaccggcgagaagccgcggaccgcctccgggaagccgaggaagctgcccgggaggccgtccgggttcgccaggctgaggaagccgcccgggaggaggccagactccgccgggccgaggagtccgtccgggaggcggaggcggcgcgcgcacgccaggcggcctaccaagcccccgacccgactccgcccgaggcgacgacgacttccgaagccacccacgacgaggccgcgggcacaccgctcgggtccgacccctcggacgatgttcgggacgagccagcttcgggggacgcccccgagtccggcacgtcgatcggcgggccgagccgcgcggcgcccacaccgaggcggctctcccctctgccttctgccgccccaccgagcgcggagcccctcccgcaggccttggccgccgcgaacaccacggtgttggacgggttaagcgcccagatggaggtcctgcaggcggagcgggcggagctcgacgcggcgtgggcgcgcgtcgaagaggggcgacgctcggtggaggccatggtggaggcgggccgcaaggcacaccgccggcacgcctcagagctcgaggcccgtcggagggagctggcggagatcgccaaggaggtggaggaggagcgggagactgctctcatcgccaccgccgtgctcgacgaggtacgggacgacctccgcctccaatacgggagccgggcggcggagctagagaagaagctcaacaccgctcggggagtccttgacgccgccgctgcctgggaacggcgggcggcggagaacgaggcggcgtcccggcggcgcgaagaggcccttgaggctcgcgccacggcgctggaagagcgcgccagcgcaaaggagagggacctggcggaccgcgaggccgctgtcgccatccgggaggcaacactggcggcgcacgaggccgcctgcgccgaagaggagtccgcactccgcctccgcgaggatacgctcaccgagcgggagcgagctctcgaggaggccgaggccgcggcgcagcggctggcggacagcctgttcctccgcgaggcagcgcaggaggagcaggcgcgccgcaatctggaaggcgcccgcgccgagagggccgcactggctcggcgggccgctgagcccgaggtgcgggcaaaggagctggac

SEQ ID NO: 63161 - DNA, 13241 bp, Oryza sativa
ggcgcgctggactcgtccgccggggaggtcgaggccctccgcttggcaggcgaggtagggcccggcatgcttcgggacgccgtctcccgtctagaccgcgccgagcggcaggcgggcctctggggcgagcggaccgcgaagtacgccgccaaccaggggggcctcgcccagcgcctctcagagatggctgggaccctccagcggctccccgaggagctcgaggagacgatcaagtcatcctcgagagacctcgcctggggggcagtggagctcgtactggcaagctaccaggccagggaccccgacttctccccgtgggcagcgctggacgagttccctcccggaaccgaggacggcgcgcgcgcgcaggtccgggacgccgccgaccacatcgtccacagcttcgagggtacggcccctcggctcgcgttcgccctcgactccgacgaggagggcggtgacggtggtgtggatgacagcgacgacgaggctggcgacccgggcgcgtcgaagtgagcccccaggcccctgccaatcttaaatagctctttctttcttcttccgaggccttcgggcccccttcttgtatagaccaatttaatctgcaatcaaataaagaggaaatttctgtgtcaattctatttgttgtgtgtatgagacgaggatggtctgtgccgcggtccttctgtgtcttggcttgaacaagggctcgtgcccaggtcccagcctcaaacggcgggggtcggggctagtgcctggggagatccatgtgtcgagactggccaggccgggagcgtggtgaccgagggttatggatgacccgattgtgggcctttgccgattcccccccggagttcaccacaccccggggcacggctcggttctgggccccttttggcgattttagacggcccgagccaccgagggcaggatcgagcacaagcgtgctaattcaagccaagattcttcaaaaaggaaacaatggcacagacacagtccttaggaaatcgaaaatgtttttattgaaatatggaagagaaaaaaggtaagtatatgcatgtggtagcccccggccaaccctgcacgcccgggggggtgcggggttggcccgagcccgagacctgacacccgacccccactaggggtagaagcgacgaaggtgttcgatgttccacgggttaggcaactctgtgccatcgcccgtggccagccgaacggagcccggccgggggacgccgatcacttgatacggaccctcccacattggtgagagcttgctcagtccaacacgcgtttggacgcggcgtaggacgaggttgtcgacgcagagtgatcgggcccggacgtggcgctgatggtagcgccgcaggctctgctggtagcgcgcggctcggagggccgcgcgccgccttcgctcttccaagtagtcgaggtcgtctctgcgaagctgatcttgatcagtctcgcaatatatggtggcccgtcggccaatagaaaccctggcgaaaggccttgccaaccaaggtgcgtgaggcggagtgggctccgcactcaccttcatgaatatcggcgagaagctcgacgccttgttcccgaggaatgcacttcaggaggactccgttagccgcgcgccgatacagggtcccttctaccagcacgtagcgcttggagatgcgctggacgcgttcactccctttgcggtcctcgggtagagtcttatctgtgaggtacgcctggatctcagcgatccaagcgatcaatctaagggagctgggagtgctcccctcgggtcccgaggcctggactccgacgggcctcgggggccgttcaggcgcgtccgtctcccctagggggtcgggtcgcgccgacggctgggcaagcctttcttcaaaggcgcccggtggggtctgggctcgcgaagaagcgagccttgagagttcgtcggcgaccgcgttatcccgtctgggcacgtgccgaagctctatcccgtcgaaatggcgctccatacgccgcacctggcgcacgtaagcatccatctgcgggtcggagcaccggtactccttacagacctggttaacgaccagctgggagtcgcctaacaccaggaggcggcggatccccagtccagctgccaccctgagggccgcaaggagtccctcgtactccgccatattattggttgcccgaaagtcgaggcgaaccaggtatctgaggacgtctccgctcggcgaggtcaacgtgacccccgcccggcgccctgaagagacagggagccgtcgaactgcatcacccagtaggcggtgtgaggcagctgcgcggggcccgagctggcctcggggacagagacgggctcgggagctggggtccactctgccacaaagtcggcgagggcctggctcttgatcgcgtggcgtggttcaaagtgcaaatcgaactcagagagttcgattgcccatttcaccactcgtccagtaccctctcggttatgcaagatttggccgagggggtaagatgtaaccactgtgacccgatgcgcctggaaataatggcgcaacttcctcgaagccatcagaatagcgtaaagcatcttctgggcctgagggtatcgggtcttggcgtcccggagggcctcgctgacgaagtagacgggccgctgcacctttcggcggggccgatcctcttcgccaggggccgcattcccagggcgctcttcgtccgagaggccacgcggggcgcactcggcttctgtgccaacgacctcggggtcggagggcgacaggcaccgtcggacaagcgggcagagggccagctccggctgtcgggggcctcgggccgccgttcggctcgggagcctctcctccctgctctctcccgggtcgagtcgacacagggtggggatgcgcggagtgagggttgttctcgtcgcgctccacgaccaacgccgcgctgaccacctgcggggttgccgccaggtagagtagcaacggctcatctggccccggggcgaccaggactgggggagaactgaggtacgctttcaactgagtgaaggcccgctcggcctcctccgtccaggtaaacggcccggagcgtttgaggagcttaaataggggtagcgccttctctcccaacctcgatatgaaccgacctagggcggccatgcagcctgtgatgcactgcacatccctaagcttgctgggggggcgcatccgctctatagctcgtatcttctcggggttggcctcgatgcctcgggcagagaccaagaacccgagaagcttgcccacaggcacaccgaacacgcacttgtcggggttcagctttatgcgggcggagcggagactttcgaaagtttccgctagatccgagagtaaggtctcttggttgcgcgtggttacccaaagaaattcgagtagtacgttgaaaagtaggacctgcattctttaacccgaaaggtattgtcgtataacaataagttcctatgagggtaatgaatgcagttttttcctcattctccctagccatgcgaatctgatgataaccagagtatgcatctagaaaacacaaaaggtcgcaccccgcggtggagtcgacaatctgatctatgcgtggcagggggtaagggtccttaggacatgccttgttgaggtcggtgtagtcgatgcacatccgaagcttgccgttcgccttggggacgacgaccgggttcgccagccattccggatggatgacctcatggatgaatccggcctccagaagtcgcgccacctcctcgcggatgaaggcttgacgttccggggcctgccgctgcactttctgccggatcggccttgcgcctggccgcacggcgagacggtgctcaatcacctccctagggaccccgggcatgtccgccggtctccaggcgaagacgtcggcgtttgcccgcaggaaggagacgagcacgtcttcctatttgtcgtccagaagaccactgattcgtgtggtcttggacgggccgtcgcccagggcaacctccttgaccgagacctcgtcgcatgtgatcatccgctgcctcggggcggctgggacggaggtgctgagtctctcgtcgccacccgcgggcttggacaccgcggcgaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccccaggatcgcgttgtagggcagactgaggtccgccacatcgaagttcacccgctccgtgcggaagttagcggaaccaccgaaggtgaccgggaggtcgatatgacctagcggccaagtgtgccccggcgtcacaccgatgatcggctgggacggccggagcaccatccctggggccttgatggcgtcaaaggcagcgggggaaaggatgttgagggctgcacctctgtcaatgaggacacgccccaacttcacattgcaaacggtgggggaaaccaccatcgcgatctgtcctccccgggcaacgcacggcgggtggtcggtctggtcgaaggtgagggcaacctccgaccaccgcgctcgtcgcgtcgcctcatgggtaggggccgcggccagaagctctcgcttcatggccttgaggctccggcgagaagcgtgagcgcacgctcccccatcgacggtggcgatggtggcctcaggctcctggaaccccaggttatcgtcgacatcctcggcggtggccttctgcctggcctcatctcgccggttgccggtgggaggcgccggggccttgccctcacggcgctcctgcctcctctcctcctcccacttcctcgtccgctcagccaaacttttgaccgcgcggcagtccgcgaggtcgtggagggaggtgttgtgcacggaacaccatttgccggtcgggcgttccctgctgggagcgcgagcctccttctttttgtcgctcgcaagcctcccctttcgggtggcccgcgaagcgccctcgacggcgaggacgtgaccctcgtcgtcgaaatgggccgacctcttcttcctcctcctgtcccgccgccctgaccgagcggcgaactcgggggcggccgaagctgccacaccggaaccggaggagttccaggtctaggcctcctccttgcgagccacacggtccgtgagctgaaaaagctccgcggtggtctggggctccttggaggcgatcttctcgagcatgcggttgtgccgcacgccccccctgaacgcgtagatcaccgcgtgtgcggggatgcatggtatggtgttgcggacttgacagaaccgctgaatgtacgagcgaagagactcatcgtcccttcgctgtaccgcatgcaagtccgcttcttcacctgggcgcggatatatgccctggaagttcatagtgaactgctggcacaaatcctcccaagagtggaccgatgcgggtggcaagttcattagccaaccccgcgcctgacccttcagggccatggggaggaaattcgccatgaccctgtcgtcacccccagcggcctcgatcccggtcgtgtagacctggagaaactcggcggggttgacgcttccgtcgtatttttcggtgatggtgggccggaaccttgggggccaacggacgttccgaaggctcgccacaaaggctcgatagccgacaccgccaaccggggacacggggggtggcccccgtgcccgggccgaagtggcgctccggacgaggaagcgccctccgttgcgtgggcaacacgacgaccattgcgccggcgctcgatattgaggcgggcatccggccccccacgcacatcttcttgggtcggaggcgttgacgagggaatggcggacgaacggcggttgacggccgccgctcgccgcgccctccgcctcgacgacacggagccggcggtagcagcgccagaggccttggtggcggaggaccgcccgccggcgcctaggcgatgctgcgccgtcatgaccaagtcggccacgtcatccagccaacgtcgggctagagtctctggatcggggacgacgggcgggtgacgcaggagcgcgcccgcagcctggagcgcgccctggggcgtgctgccatcgccgtagacgaggaggcgacgctccccgtctcgccgtccttctccatcgcccgtgggtggcgaagtcgcggatctttcgaccccctcgagcgcctcctcccacccaagacttcggcgagaggggggcggtggagtacgagctcgacggcgcgggttctgctccccgacgtcaccgctagcgctcggagagaggttgtgcgccactgcccgttcggccattgggctgagcgggagaagcttggggcacacgaaagaggacgagggcttaaaaagtcacacgcaccccctacctggcgtgccagatgacggagcgtggggctcctcaccgggagaccgcgcaggtccccctttgccggttcggccgggggcgctaagtgaggttcttcaccctcgatctgtggaatgttcgcgagagagccaatgcaaaagacacgggcgatgtagacaggttcgggccgctaagaagcgtaataccctactcctgtgttatggtggatctgtgtgtgaaggagttacagagagctggagagcaaaagagttcaggctctagaacccctcttcctctttctgtcctctacgagctcaggtattctcagagtcgtcccccctattcttgttctggatctccctgagctcaggtattctcagagtcgtcccccctattcttgttctagatctcccctctctttcttcggtgggcaaggtcctccttttatatctcaaggggataccacatgcaccacttctacctacccttcttttgggtggggatccaccctatcttgatcagaacttggctcgcgcctttgcttggaagctaaatcacagcttgtccttgagtgaggcccagcgccgtcactcgcctgacacaggggatcaccctgtcattcctccattaatgggcggagatttgcaatggccgctgtccgaatgaccctccgatgggatgggtcatacctacctccacttcgctggaagcagatgcaacgtgggagcacggtttgtctgctgatgacgtgaccggcgtcagaccagtcacagaccggtcattcttgtccaccacgtgtcagtttagcatgtcgcacgtctgtccttcttcatacaatgacttctttgcaatggttgcgatgaagcctggaatgtatctagccgggactggcgtgctaactccaggagttagcacaccggctccggctagggacgagtgcctggaggctctcatcattccgacgggacggggcgaggcgtgtgacaggccgcctgctgccacctaacccgcgatccgaccgatctgtgactggtcacatactgcgaccggtcacggaccggataagcgagcgcgctgcgctgtattaaatgcggcgtggcgcgctcgtccaacccgcaataaatgcggttaggtgagcgccgctgtgctcacctaacccgcacacgtggcgccaacaccacagggggtcggggcgccccagccctcggggccgaaacgggagcggcccgacccctcggggagacagagggaggggtggccacgtcaccctcgggcctgacccccccgagggggtcaggccacgtgggtgagcgcggctgcccaagcctctagtcacgatactcccggtcccatgtcaccgacaccaccggcggccggcgccgcctcctccctctgccgccgacgcgagtacgccgcccccccgtcgtcgccgccgccacgaggccgctgcagccaccgaagctggtgatcttgagcaccacctcgtgggcgatggggttcaagaactcgcgcgagccggcaaccgcggctgccggagaagtaaagccggcgccggcggcggagggaggagagccggcgctagccgctggtggagggaagaggggagccggagcggcggctgaggcagagtgcttctcggcgagctcgcaaccgggataaggagaacgggagcaatgtggagagttcgagagaagggtagttgcgagaattaatttcttgggctgggcactcttggtcccctgcattgtggtcccacgtaaaagaaggaaggtcacgagattaaggtcactagcactgtagggtgtgtgacttagagatgaatttagggccaaaatccttgctggattgggatgaaggcacggtagcgtgccttgcactgctactgtcctgagatagcacacgtccctatggttgttgaagaccgcggtagggatgacgaggttatccaccgcgccctccaaaaggcaggagaaggggatgcaggccgtcggccttaggtgattgggaaaggggctgcggctgaggtgtttggatgccgcgaacccccgcaacgcctcgtcgatcacatggaggaaaaagtacaccgaaggtccctcaacttgtcatcgagttacaaaatcgtccctcaaccgcaaaaccagatatatgacatccctcaacttataaaaaccgttcactataggtccttcagtggttttgtatccgattttatcctacgtggcggctgagtcagcgtgggacccacgtaggccccacatgtcaggatgccacgtcagcctctctcttccccttcctctcccttcctcctctctctctctcactcttctcttctcttctcttctctggggcaagccggccggcggctggggacgaggcgacagaggagtaggcggcagcggctgtgacgcgcgagaagacgagggcagcggccggtcaagaatggcaccgacggcgctgcgtcgccgccgccggcgaaacggccccgcgcgggtgggcgccgcggcgttgggcgcggaggcggagccggggccgggcgccgcggtggtgggcacggaggtggaggcggggcggggttgggcgccgcggcggtggccgcggaggtggaggcagggccgggcgccgtggaggtggactctggcggactcggagccccggcttgctcccgcgccgcatcctccctctctccgtgtgctcgctgtcgacgtccccacctcctccctcttcgcgcgcgcacgctgccggagctcgcgcaggtgtacgtcgtcgtcggccgcgacgtgctggtcagcccggtgtcaaaaatgtctcccggtaagtcagcctcgtcgtcaggcagaggaggagcggtggcggcgtaccatacggtgacgaggatgatgttggaagcggattcgagagggccgcagcaatgaccgccgtgtcgtccaatcgtcgccgatgggagcacggcgagtgcccagatgtagaaaccatggatggcgtcgaggacgcacatcttcagagacaggatgtgttcgcatgaggagaggtcgtagttcactggtgagtcggtagcctcgtcgccgtcgtatggcggcgccacacccaccaagcagctggatagcttcgtctacatggattcgcaatcaaacgacaggttggatgtacccgagttgaggagaatcgatcccttgcaatttgaccatgacaggggagagctgaccggcgaggaactgcaacgtcatgaggcgcggcagctcatcaggcgctggatgtgccgctttcagcgcggcgaccctgagcgcgacctggatggggagcggcggcgtcgacgactctgcgccgctcggcctcatcgtcgtcggcggcttcgggtgggggcgccacaccaccggcttcttgtcgctcgtccgcggcgggggcgccgcgccgccggcttctcgtcgcttgttcgctgggccgcggccggaccggagtggcgagtgtcgacgacgacgaggcatgcgaactggtgagcggtgcggacctcttcatcggtggcgacatcaacgacgagggcgaggtcgtccgcgcatacctcctccgcctcccccgccggccgcagccgcgcgccgccatcgccgacgcccgacggcagcgacttgatggcggcgtcgtcgagtcgatttccgcatgatggccgcaaccgcacgccgccatcgccgaccacactagggggacggggaggccggcgagcccgcgcgccgccactcgggagccaccgtcgccggccgcacgcgttgccgctcgtgcgagagcagagagcgagggggaggaaggaaggagagaacagagagaagagggggaaatagagtatgcgctgatgtggcagcctaacatgtggggcccacgtgggtcccacgctgagttagcagccacataggataaaaccgggttaaaaccaccgagggacctattatgaccggttttggttagttgagggacaccggatatccggttttgtggttgggggataattttataattcgatggcaagttgagggaccttggtgcactttttccatcacatggatggcgagggcggagaattgatctttggggccctcgctgaggcgcacgtagatcgtcagggcctctaccagaattcgtagtttgattggagttataatagcaagacgctgcatcgggatagcatacatgcgcacaattttcggtccagaaggaagcagatccgtcagatgcgcctgacgcggatcgcgtcgcgccactggtgaaaccgtcgatggcaaagaaaagagtgtataacaaaacgcacggcagaagtttgtccacagcgtagggcttattgggctctcacaggcttctgacttgctaagtccactgaaatcccaggccatcaccaaatacagggccgggattttggcccattccgaacgacgcatcgagggaacgggccgaatgcgtgtcagtgtgtttctgtgccatatgcaagcggaccaactgccggtcgactccaacgccagccgtctgcttcgtcctcacatccaagtccggtgagcggtggcgagcctgggacccggcgagacaacccagctaccccgaccgacttggaaagggagaacgcaaccgtcccccgcattcccctcctcttcagaatcagcagcgaatcactctcctctctcgtagtccctgtcaatccgacgccgtgcatgcagttaaatcttccaagccacacgaatccgcagttttgtcacaggtgagacgtgcctgtgaactggcacggtggcaactcacctctccctacctttctctggtaccaaacctttccaaggaagaaaccaagctgcatgctgctgcggtaggaccaccggtgttaggacacactggagttgtcaatcgtctttacagccaaaccaccacgcatttttcgttctgtacagcataaaatatgaatgacttgtctgtgctgagattctttcttctatcatgcctagcgcatgctcacgagtcaagccatgcgcagaagaaaggtttaaccaaagttttaagggtaatttggaaacatgtcattataactttgcaaagtttaagatatgtcattggtatctcaatgacatgtaggacctacatgagtcaatgacatgtgagttagaatgacatatctcaaattttataaaattataatggcatggttccaattttcccaaattttttaaaccgtagcttaattgggcctttttgacaatgttggaccagccaacctaaacactttcatggaactgcctggtaaccaaaccagctgctacactaccgcttttgataggagcagcagccggcctgaattgactctagcttattgccttcgaattaggcttgaaaaatactactacttagtactctgttacagtctaaaatatgagattccaccaattaatcaacaatccaacaaaccaatcatctggacacgctgtctcaggcggccattggaattttaaattcgagaagtgattcattttctaatttaaatccgagtatttaaaaagtttcatctctcctcgatttaaaagaaatcctttttatagcttctgctcgtcaggctttagaaggtgtgatgaaaagtgccaacgcgccttcacatttggcaatatcggaaaaacgaagccttcctatttatttgccgttccgtgcaccgagcaatctcgcggacgcgtagccggaaatcgaatcaggccgcagggctgagagaaaaaaataatcagaagcaaaggggggagagagagagaaaaaaaaaagtcgaggaggcggcagcaggcggcggcgagcgagcgagcggaggaggaggaggagcagagaatgtcggcgctgcagagctggcgcaaggcgtacggcgcgctcaaggacaccaccaccgtcagcctcgccaatctcaactccgacttcaaggtccgcgtcgagcttttgcaccctcccccaatccagtggcgcaaactggttcagttcatccgatttgccgcaaccgactgggggacgaggagtccaggagggggaggcgtttggatctgtgttgtacgcatccattgggatttattttagtttgcgatgtttttcttttcccctctgtaggatctggatgtggcgattgtgaaggccacgaaccacgtcgagtgcccgcccaaggagcgccacctgcgaagtacgttgattcgtcctcactaccaatctgccaatctcctatatcctcgcttgcgattttctgcttaatttagttcagtgtgtgtggaatcagatttgagaattgagattgttcggtgggatggagggtacttgctgttggggttttccccattctctgttgggtttggtgtttgatgggttggtggttgtgttgcagagattgcagcggcgacgtccatcggtaggcctcgggcggatgtcgcctactgcatccatgctcttgctcgtcgcctcgccaagacccggaattggattgtaagcaccgtgcactcctgttgagatttttcgtgtttatgttttatgtttgtatcttttatgcttaggttgcgttgagcgcttgccatactgtagtcgagtaacaggcgggttgcaaaactgaaatttttgcagtatataaatgtagtcatttatgtaactgccgcagtgtaagaagttaggatactgagcttgagctttttgtggtttagcggtggtacagtggtgctaatgtgggcatccaaccatccaggatagtagaatgtacatttaaattatgttaccgcttatgccctcgatatatctcaaacttgaaatataacttaactcaattgattaacattctctcttctcta

SEQ ID NO: 63162 - DNA, 37669 bp, Oryza sativa
attgtgaaacggagggagtaaatcggcttggtcccaaacaagtttttctgatttatggttttcgtgccaccacttcaacagcagatcagcaatacttcagacactcttcagtgttctgttctatttgcaagtattcgctggtccacatctggagccaattaatgtaacattcatttcatgcactatgtaggttgcactgaagacacttgtggtgatccacaggcttctccgggatggtgatcctacattccgtgaagagtttcttactttcacacaaagagtgcggattttgcaattatcaaacttcaaggatgactccacccctgttggttagtagagcacatcaattttctttagtatcacctcctaaattcccattgtttctaatacaactttttatccagcttgggactattcttcatgggttcgtacatacggtttgtttttggaggaaagactggaatgcttcagggtcttaaagtacgatattgaagctgagcgtttgtcgaagcagggtcaagggcctgaaaaggtttggttattatcaatctcatttggttattgtagtcaaattagctaccatgattataattagagttacaacattttgtcaattattggtttctatcttgctgaattcttcatattgtgactttttcagggccacagtagaaccagagaattagattctccggacttgctggagcaattaccagcactgcagcagttactctatcgacttattggatgtcgggtgattttctcttttgccagtttggactaatgggggaaataaacattctaaaatctaattttccagtctgttttttgtgaagataacctgacagctttctttcttcttatgcagccagaaggagctgcaaatagcaattatttggtgcagtatgctctagctctggtaagctatgttttttcttttacaccagtgtttttcttcttgtggatgcagatgtgtttctttttattacccaatcgctccattgcaaacatcttggttgccttggcacttcataatttgtcaggatgaagagccatatcctgctattactgatataattgagcagttccttctctggactagagtctattcttagaataagggcatcttttgtgcaacattgtatctgtgctatctttttgctcatgtcattgcttgcttgtacagatcttttgcaatattttgtagagcaaactatgatcaggtggtgatgccttagtagagtacattcctagaaattttcctttgttaaaatggttttatatctatatactatcttaggacatttggacagttcttttttcagaatttaaatcttttggggcattctattttgtgttgatatccttagtcatataaggaaataaaagtttctttggtgttttttgtaataacattctggtcataagaaaacaaaaacgatcactgtccttttatgaattaaatttccagttagtgttatgaattaaatttcttgatagttttagtaatttaattttatattagtttaacttggtaagttgagtgaatctccttgctttgcacaggttcttaaagaaagcttcaaaatctattgtgcaataaacgatggaattatcaaccttgttgacaaggtaatttgtttttatattgacagcactatactgtttatttttgttctggcaagttgtgcatactaatattttcttttgttgctcgaaaatgatgcagttttttgagatgccaaggcacgaagcactcaaagcccttgaaatttacaggagagctggacagcaggtgattctaagattctgaaggatggttatctgaaatttgtggtatttcaaagatgatgataatggtagaaataacactgttatgctctaggctggaagcctatcggacttctatgaaaactgtcggggattagaacttgcaagaaatttccagtttcctactctgagggaggcaagtatttttgtgctaactgtgcaacttcttgtattgtaaatcagaatcagataaatcattgtcatcactttctttttctatatttgttccagccaccacaatcattcctttcgaccatggaggagtatgtgagagaggctccacgcatggttccaattaaggaacctttggtcagttcttagttaaaatgacctgctatttcttttaaaaatgccttctacgtttcgatatgcctcctttatattataataatcaagcagcagccctgatgatgatgtttgtgcaatatttatcttcaattgaaatttgaaaccatagcaaaagaagaatcacatgtgttgtgtcaccacagtaaaataatcacatgttgatttgtactaaaataatcattcgatctataaaacggattcttaaactcttaataattgttatttcaccaggagtttcctgagagactcctcctgacatacaaaccagaagaatcagaagagattcctgagcctgtttctgctgaggaggaaaaaccacaaattgaagaacctgctgttgcagtgccatctactgaagtagttccaccaccacctcctaaacctgaggtcgtagacaccggtgatttattggtaagtagaagaaaccatttactgcatgctgcactggttcatttatcacaatttaatgatatgtatgctcctagggattaagcgatccaacccctagtgtatcagcaatagaggaaagcaatgctttggccttggctattattcctacaggtattttgtcatccttcaatccagtgatgcctatcatgaaccttgtgttagataattctgaaaattgtgtgcaatataacaggtggtgagacgtcaacaagtggcacagctacactgcaagataaaggatttgaccctacaggatgggaacttgctcttgttactaccccgagcaccaacacaaactcaatggccatggacagtaatttggtgggttttcttactctttctctgaggatatttatggttagtataatgtcccgctttggatttggaaactgttattctgctgttagtggctcctgccagcttgtcttggttttggatcggacggggttttagccatagctcccaaatcaatctggctggaaaagctttgctggttcattgttggtgaaaacagggagcacaactactcatatatatctgtttatcagaaagcatttaagtgagaaaaaatgataactttgtaattggtgtgaattgcaagtaaatgatttatttcctagaattaatggacctcatggagtcttgggctaatctagaaagtggttgtaacaaacttggttaaggttaagtccatgaaagacctgctgacatgctctgcttctcaaagaaaaagttcattatgctagcaaattctgcaatatctcatcctaatagtgattaactttgagcttggacttttccttttgcgttttcaatttatttgggcaaaagtgtccccaaactcaactttcaggtgaaaatcacgcttttcatagacacagtctttggatttgcttctaaattttaatgactgagctgatagttggcatctttacaatttgttctacttttatacttatgatctcataatggtaatatttaaaattttgaactgttgagtgattcgggttgggttcagtaaccatgtgattttttactccatatttgccattattggtctagctgatcaggccaaaatttattctcttgtttttgtctgcagggtggtggatttgacaaactcattctggacagcctatacgacgagggaacctacaggcagcagatgcagcagcagcagctgtatggttcagctgcccccaaccctttcatggcgagtgatcctttcgctatgtcgaatcaagtagctcccccaccatcagttcaaatggctagcatgactcagcagccccagcagatgcctatgatgatgcagccaaatcccttcgggccaccactacagccgcagcatgcaggcattgctcaggcacccaaccccttcctcgatgctgggttcggccctttcccagcatcaaatgggatgcacccgcaagccaacccgtttggaaccgcccaacttttgtagggtcacagttaacacacgagatgggcacttgggcagtgcaaattcaagtctattgagttgcatattgcatattcagaagtgagatttgcagatgtcgcaatggtatacatactttgtattggcttctcttgggctgtgtggccgcttggcgatcttgattttttgtagttcaagcctgtaaacctcctgtgcagtagtatttgtttttttttttcaccatttgtgacggcggctggtctgggacgattctccttgtaaagaaatttattttctctgattcatagttacatgtcaaaaaaaaaaggtcgtaaaactggtgatagctaccagagtatatatacttttgtaactaaagatattttcagtttagactttgtgcatcgaactgtaggagtagcaatggcaattctgctatgatagcttggaatgctcgcggatccatatcgtggcatatgttacagctattcttttgttttacccccaagttatatgtcttatatggtcagaagcacgccgacgaaacgacagtagagggatactccctgtcgctcgtgagtgtaatcacgtgggacaccgggttcgctacctcatccatcgacgtggtacgagtaattcttctcatcgattcaactttactcctagagattttactccggtcctataaaaaaatatcttgaggtatcgtgtcacaatcctcaacccacccactgatcaatgcccagcaccggaagcaaccgataattcacagcagtaatcactcaagtaatttggatacaattgagaggaattagcaatgtagattgggaagagaagcgggggactgggaataagagaacagagcctaggattggaagaacagagagatgagaggaaattggagagcctaggattggaagaacatagagatgagaggaaattggaggaggaagaagccttggcttcagttctgttgatttcttcatcgatgcctcatatgttgctgttccttctcttttaaaggcatgcaccctgtttgtctggatcaaagccccgtgcctgaagcccggcccataggacgtggcattctcccttcctttagtttcggcttgtccccaagccgatgcctttgatgcctccaggattccatattagttgcaaggagcatagtgtatcatgatcattaagcaatagtgactcccaaagcttgttatcctgcctttgcaatgtttgtccttgaggtcctggttcggaaagctcctcaataatttcccgcaaccaggatttcttcagtgaaacaaccgtagttattaccctgactagatgataagaagaatagcccaacccgagatcgacaaactgatcacttgttgcaaaccatccaatgggtctgggccatattacaaactcctcatctgaagttggtagctgtaacatgtcaactggaatcacttcattcagattaattaacttggagttcagtgatacccatgaatatgtgcaactctttgtataccagtcactagtcttcatagtaggctgtagacattgcagtactgcactagagagaaactcacactgtaatgtccaatttgtagcatctccaaacaatgccatagtcttcaccaataagaaatgtcggttgtcatgggaagccatccatttttcaagggatctgctacacaaacacaccattggcacaactactgaactggggcaaaaggatggattgagtgcatgcattgttagttggagctcattatactctgcagaccagagagtgaaaactgaaacctgaacctctataaaagttccacccgaccaagaacacttgaggttgtgccaattatgcactttgccagctaagagaggaattgcactcttctgttgacacctgattacctgccagtactcatgcttccataaccccacgatagtatgacttcctttaatcttgcatttgcatgaaaaactctctctagcatgcgcaagtaatgtaacagcacatgcattaagaggaggtgtccatggtattttcagctgagccatctccctccaacaagaatgtatttttccacgcaatagctccaatccaatcaacaattccaagcagttcatttccttgtatatagcagattgccactgtgtcgagctttgaaagacttgatcatccagcactaatagtccttgaatattctcccatacatagctggaaatccaattcatatttacttgatgacatatctccaatacttccttgatcacctcatttaacagaaaataaggtggtggccaaggcctcaactcaatagaacacgtcctctctgaaatcagtgtttttgaagcctcaccttgacaatcaacctcaatggaattgagtacacagccaaataattgtagtgctccaacttcagctttagcttctgcttgagaaggtggttgccggggatgtaagagcttcgtcatcaccacgcctcagctgtcttgactcaaccacggatcaggccatggtaaaggccgagaacctaaggtcatctcagccttgtaccatggaattgccgctttccaaggtggtactggtggagagctacctgttttctgtagtgtgaacttggagttcacttcagtgagctcaactaaatcctcggtggccatgtcatcgtcatcatcattgatcatttgttcattgccttccgtcaaacacttggtggctgtcaccatgcacaactcattagtatcaaccaagctgattgaattggcctcattactaacctccaatgtgttggggactgatttggtgttggtgcttgtagctgccacaactctggtgatatcaacgctcgtagttgactcaaccttgatgtcgcggcatgtcacgagtatctgattgatcatgtcctttatctcaacacacaaatcatggaaggtcttttctgatttatcctccgccttgcccatgtcagcccaattctccttggtcgcggtgagggaaatcggtggcaccacaactgctgattcgtctgagggcgtggatggactcatggtggccgggaacacatgttctagagtagtagaagtgctcttggcatcagacttgatgttggcgcagcttggtaccggcgtcgaacacttggtgggcgtcatgttgacaccgttcccgttgaaaggatgcacgtgctggacatcaagtagacaacacccatcatagatattgcgcccattggtgacagatcgagccctctctgcatcacagcttgaccggaaccacacgaaggcctcaacacccaaaggactcgtggtgaggacttgcaccgccacagctccataggtgttgtaaacttgatgcagcacctcgctggtcaccgggtaaaggacttggctcacttggacacgaagagcagcgcctgcgccatctcctagccagctcggcatttcaccgaacacctggcgggcaccaccagcactaacccctccacggctcaaattccgcctccaaaggtcaccattgcaactgtgtgtcgcccaacacgcctccttgcttggaatcccacgaattgactgctctgataccatattgtcacgatcctcaacccacccaccgatcaatgcccaacaccggaagcaaccgataattcacagcagtaatcactcaagtaatttggatacaattaagaggaattagcaatgtagattgggaagagaagcaggggactgggaataagagaacagagcctaggattggaagaacagagagatgagaggaaattggaggaggaagaagccttggcttcagttctgttgatttcttcatcgatgcctcatctgttgctcttccttctcttttaaaggcatgcaccctgtttgcctggatcaaagcccagtgcctgaagcctggctcataggacgtgacatatcggtatctcatagtaccaaatcgttttttatcgttgaacgttgaatctatctaggtaggatggacatggttagattaaacgatcgaagatactttgatagtaccggtacctcgaggtgttttttttttaactgaagcaaatctcttactcgtattgcgctcgtgcgtgtgggcaaaatgccaaaatcgatggcagtactgctttgagttctcgctttgatcttcacaaagttttcacccttttgccaaccgaacatggctattcctctacgattcagttttatactagtgccacaacgagcagcgtgcaaggtcgggggatgcaactctcaacttttctgcttcgttcgcttggttacacgcgacgatcagcgaggagctgcacgtggtccgatccttttccttttgcttggggagtagtaccatgttgtcgagatgatttcgacgtggcgagacacgatagagtgtcgtatatcagcacatgagtacacgaggcagcgcgcattagcgccgtctggaacgaaaggcatattttctctctgctgcatcacaacacaggaaaatttctttattcgagcgcttcgattctgcaccatttcacatactccctccatcctattttagccacggtcgtggattttgtgttcaatgtttcatcgtccgtcttatttaaaatatttttataattatatttttattatattaatgataaaatatgaatagcacttatgtgttatttatttttaaacttttttctaaaatttttaaataagatggagagtgaaatattagacacgaaaacttatatccgtacttagaattgagagggagggagtatagggcctgtttagttcgcgaaataaaaatttttgagtgtcacatcggacgtttgattggatgtcggaaagagttttcggacacgaatgagaaaactaatttcataactcgtctggaaaccgcgagacgaatcttttgagcctaattaatccgccattagcaaatatggattactgtggcacttatggctaatcatggactaattagacttaaaagatttgtctcatgatttactccctaactgtgtaattagtttttcttttaatttatatttaatacttcatacatgtgtcaaagatttgatgtgatgtttttgagaaaaaatttttgggaactaaacattgcctaaagatttctgcagaaatactcctgtgattcggccgctttgaatctgcgcgggacccgaatgaagccaagcgcaccacctcatctcaggcaaaacgacgaaaagaaaaaaaaaatctgatctgctcggatctcgcggtcgatctgatcgcgcgctcagccgctcctcccctggatccttcttctccccctctcccctctcccgcctataagagtccctccctcctccccttcgctgcgcactcacctctcatcgtcgcacgcacgcccgcacctcctcccctcccccctcaaaacctccgccgtgatccggtggtggatgcagcctcgtgggcgatccttcaaccgccgctcccggagcttctcccgcgcccgcctcgccatcgaggggtcttaatctcgccggcctcctcccttctctcagactctcagtcgctaaaccctcccctctaaaatcgcactgaacgaacggtcgaacgatcccgccgagatggacgccgcggccgccaccgctgttaatggtaagcagaaggacgtctcctcccccccacggatcggatcgggcctgatctgttctgttttgccctgcgttttgttctcgttctgcttgatctggtttggggatggatgggggcgtgggggtgttggtgttggtgtgttggattttgcggatctcgttcgtgcggagggcgttgtttttgcggggtgatgttctgacgcgtctgcgtttgtgttcgcaggagtgcttgaggtggaggagaggaaggcgcagaagagctactgggaggagcactccaaggacctcaccgtcgaggccatgatgctcgactcccgcgccgccgatctcgacaaggaggagcgccccgaggtgataccacagtgccacctgcctaattccttctccgctgtccagtgatttactggtgcttagcagtaatttctgtgaaatgtactggtcattttcttatccgcttactagatctggggcgcgtgcatgcactttttggtacttttcccaaccaaatacagttcctacgtggtagtaagtggcgcgtggtaaatgatgaaccgggacaaactggtcggcatttcgtgcattgcttttctagaattgttcaacacagatgtactcaaaggagaacggaggttggagagcctggtgttcgtttttcttttgagagagtgactgatgttgactcgtatgtttttgggtaatccttgagtcaaaagtgatttttcttaggccttgtttagttagggaaactttttgtgtttggttgtcacatcagatatcggatatacggacacacatttgaagtattaaacatagtctaataacaaaaaaaaaattacagattccgtcaggaaagtgtgagacgaatttattaagcctaattaattcgtcattagcaaatgtttactgtagctccacatggtcaaatcatggcgcaattaggtttaaaagatttttctcgcaatttacacgcaaattatgtaattggttttatttgtccatatttaatacttcatgtatgtgttcaaacattcgatgtgatgcgtgaaaagtttttgttttgggaactaaacaaggccttagcaaaatggagtgaacacttgacatgacagcagaccttgacatagtagcatcacatagggtccatattacataaggtgtttcttaggtagacagctgaattgttgtcactgttttacttaaaggaaaaattctgttttgctgtttcctttttccagactagaagatgatgctagaccttttactttaatgatcacagacctgtttgctgactgtacgaagtaaaactcttttcacaagaaaaatacccacttaagaatttttggggactgtactcgcacgagaatgtgttactgtaactgtcaataatactaccattagcaggtgaatgagattgttccctctcactcaattgtcacagtaattattaacctttttaaaattagcatagtcacattgattagacatgttttttggatgctggaaaatgttttcctggacttatgttctaacgtatctcttctgacacttctgcagatattgtctttacttcctccttacgaaggaaaatcagtactggaacttggtgctggaataggtcgcttcactggagaactagtgaaaacagctgggcatgttcttgcaatggatttcattgaaagtgtgattaagaaggtttaacattcacatctcatttaaaaccttaaaaccagtttggtagctgaactatgattggcttcgctgaactatgattggcttcttttatctctacatgaatgttatgcctgattcatttagtcttgtgtgtcgtttcttgtagaatgaaagcataaacggtcaccacaagaatgcatcctttatgtgtgcggatgtcacatgtccagacctgatgattgaggataactccattgatctgatattttcaaactggttactgatgtatctttcagacgaggaggtaatgagcagatagtacttaataggcctcatatcgtgtctcatttcaaataaataagcatatttaagatctgttgcgatccttctttgcacatctgaatatgtcttgggaaatgaaccctggatgatataaatcgactttgtgttgaaacttggtatgtcttggctatgtcttctgagtttgctaactcatactgttactgtaggttgagaagctagtaaagagaatggtaagatggctaaaggttggcggctatatcttctttagggaatcttgtttccatcagtctggagattcaaaaaggaaagtgaatcctacacattaccgggagccaaggttttacactaaggtcagtatgctaactatcttgtttctggttcccttctatcatttgaatctcaagcttgacagttcaaggttttctactagacttgcctcgttaaatgttacccactttactgaatctaaactatacacacagtatgcttatagcagcactgagcaatgttatttgcgctactttgtaacaagttgtgatgattgaaggctaacagattgatttaaaaataggtgtttaaagagtgtcaagctcttgatcaagatgggaattcctttgaactctctgtacttacttgcaagtgtgttggagcttacgtgaaaagcaagaaaaatcaaaaccaggtacttctttgtccttgcacatccacatacacactcatgtcctgtgatcaagtgaactgatggacttgatgccatactatgcagatatgttggctatggcaaaaggttgattcaacagaagatcgggggtttcaaagatttttggacaatgtgcagtacaaagccagtggaatattacgctatgaacgcatctttggagaaggctttgtgagcactggtggaattggttagtaaatgcatgtattttttgtcatttttaaatcagtaatattctaatttgttctaatttgtagtatgcctattcttttatcttcgttcaccagaaactacaaaagaatttgtggacaggctggatctcaaacctggccagaacgttcttgatgttggatgtggaattgggggcggtgatttttatatggctgacaagtatgatgttcatgttgttggtattgatctttcgataaacatggtttcttttgcacttgagcgtgctattgggcgtaagtgctcagttgagtttgaagtcgctgattgcaccaaaaagacatacccagacaacacgtttgacgtcatctacagtcgtgatactatccttcacatacaagtacgttttacacattatttacaacccatttggatgttttgtttcttcctggtttattgctctacagcctacaacagtttaaatattttcagcttgaaatggactgttttaggcaagccctgagaacctgtatatacatttgtagtaattgttagtgggattgtgggaaaaataaattcttggaactatttgaattacctgccactaaatatgttttaccctttctttgatgccagaacaactgtgttttgaccagtgctgtttttgctctttgcaggataaaccctcactatttaaaagtttcttcaagtggctcaaacctgggggtaaggtcctaattagtgattactgcaagtgccctgggaaaccttcagaagagttcgcagcttacattaagcaaaggggttatgaccttcacgacgtcagggcttacggacaggtgcttttgctagctacactctatatgattaatagtactgtttctttcatgaaagtgtagagctatggtaacatctgtttggtaaattatccagatgcttgagaatgctggtttccatgatgtcattgctgaagaccgcaccgatcaggtaatccccctctggagctacactggctgcattcccatattctcttcaactgaaatgtagatatgattttctgtggtactgatcatattcaatcttgtattgcagttcctcgatgttctagagagggagcttgctaaagttgaaaagaacaaaaacgagttcgtctctgatttcagccaggtaatttaggcaaaactgcgagtttagtagctgccttctttccatgttgctggtatgcacatcaaattctttgtttcacttattttcaggaggactacgacgccattgtgaatggatggaaggcaaaacttcaaaggagttctgctggtgagcagaggtgggggctgttcatcgcgaccaagtgatgaatcaagatgcgcagcgtgggggggactcgcaaataaattggtttcatgccgtgtgtccatcatattacatttttgttgtcaagttatttaatttcgaattcggtgtacttcttgtggagcttttgatgttgttgggacaaaaaacaaaaataaccagagttcagcccgcgttgttttcgacttcttgagctggaaagttcagttgcataaagaaaattcaggtgtactcggtgtgaaacttttgatgttgtttggatataaacaaaaaccaaagttcggcccccattgttttcgacttgttgtagagctggaaagttcagttccttaaagcaaaagcgttatccgtgggcaattgcagaacagcaagccggaataactagcggcgtgaagtcctcgcacttcatgcatctcccgtcgcaggctcgcagcttcccgcgttagtttctacagggaccgggagggaagccgaaaccgcaaaacgagccaacgacgccacatccgtttctcacgagccaagtagtcaaccaggaacgggtccagatcccccacgcgcaatgcgcaaagggcgtggacgtggcggagagagacgagaggcaggtagctgaaaggaagtagcggcaaccggcagggcaacacgggtggcatggacgatgacttcagtcttcagagtttggccaagacacagactctcttcctctacaaggctgcccctacctgcctgtctgccttgcctgtaccgctgtacgcgcgtgatggcgccatgtgcattgctgcatcttctcctctacaaccatcgccgcattcctgcattttctctttttagagaatgctagacaggcgggcttccggagttttagagaatgctaatcagctccctttttctttagaaaaaaaaataatcagctgcttttatctcaggtgcagactccagaggtcctactggctactgctggcgtggggatgcacagttctcaccgcggtaaacgacgaacttggtaaacgaacttgcaccgtccttggatttgttcctccctgcaacgtttgtcttctcttttgatttgtaaaccaaagattcgagagggactgtggtgatatatattcttcttttcttacgatggcagatgatgccgttccaaccgtccacatgccattgatttttagcgtcgaatggacagtgtggtcttgaaggtaaacgccaacattggttctgtgtggtataaaagtgacccaagggctgcacacatacacaaaaaataatgacatcaagaaagaaaacaagtggcaaagctccacattatcatgctcaaaaccaatgataattttcgatggtcatcggtgaaactaaaaggttccattaggacacagaaaattttacaaaaagaatcatagaatatagttaatttcttaagtactacttaatacaaaattccactaaatttactcagttgaaaggagccaaaactaccacccgtcttaaaatggaggtacctaatacaatatatgagatatcatctgatactatcaatcactatagcttatccatagtactatatgagccatattgtaacttgtctaaattcatagtattggatatgtattacagtattaggtagctatatagcaaaacaaaggtagtacttaatactccctccgtccaaaaaaaaacaaatttagaactgaagtgaaatctggataaagatatatctaaatttatggtataaggatttattacatttagcactaggtatttttttaacagagggagagggagtactctgtattttagcctagaggcagtaacaccttgcccttaacggaagttccgtcataactgacgctgatcccgcctgtcccacctgtccaccacgccgcgaaatcgcgaatcccccaccggcccgagccacgactggccagccactttgcacgcccgtgccgcgcctcgcctcgcctctgtgcgaccggcccccgcacccacccgcgcacgacgcagacgccgcgcgcgtcacgaggcccaaaaatcgcaccaaaagctacgggaaaacacaacaccaccaccaccaccgcccccccacgtctccgtttctccgccgccgcggcgatcacaaggagatctcccctctctctctctctctctctctctctctctctctctcctcgcgctcgcttttaaatgccaccgaggcccacggtgtgggctggtccaccgcacgccgcgcccgcgcaagacgccgacgatgccggcggcgaagaggtcggcgtcggcggggtcggtgctggccctcacggtggccggacgccgcgccgcgcgggcccgcctctgcctccgcctggccgcgccgctctcgttcctgctcctcctcgccgcgctgctccgcacccagcccctcccggcgccgccttccgcgccgccgccctccgggggccccgctagggtcgccttcctcttcctcgtccgcgcgggcgtccccctcgacttcctctgggacgccttcttccgcgtgagccccaatcatccacctccgctgattttcgtttagttcgttcatttgttcgtccctgtttgactattcgattggttctgatcgaccgggtgttcggcagaacggcgaggagggcaagttctcggtgtacgtccactcggcgcctggcttccagcttgaccgcaccaccacgggatcgtcgtacttctacgggcggcagctcgccaggagcgtaaaggttcggccatttcttttgcgtgatctcttgcttctgatgtgatggcgtgtatcgacatgagacctgggtacgatttgagtagcgaggaatatggttgtgccttgcaggtggcgtggggcgaacctaccatggtggaggcagagaggatgttgttcgccgccgccctcgaggatccagcgaaccagcgctttgttttgctctctgataggtacggtacattcccccacatgcgagtgccctgttcttgctcgtacatagttcaaattttatggggagtggaccatgattaaatgttcaactgtggtctgtggctgtcagactcgtgattggtttaatagctgaaggtttagtaatggcaaatcggcaagtgaactcgtacggaaccagtttgtactttgcaggactctatagagggcattcttcttagtgatgcatttagattgtggtttcctgttgtggtgctgctaaggtttcttgagaagctctctcgcttttgcttggtctcataagtaatgttagaaaaaaaaatgcaactgtgaaggcatcccataattccgtgaatgccttttcttggtttcccttgtgggtgctcaccttgaagagtttcccatgatgagtgttacccatctctataggttagagagagttagagtgacattctgatcatattccccactagtcagtatgctttaagtctttatgttgtagtttgaatttcaattttttttatgtaccaatgtttatcatcttatagacgttttcaacattaacatttcaaaatatccttttctactgcagctgtgttcctctgtacaatttcagctacatatatacttacttgatggcttcgactaaaagttttgtagacaggtaagagtaaaaagatcatctgaaatcttgcaagttcatgtttgttcctataggctacatgccatatttcaatttttatttctcaaaattagtatgttgatattttccagttttgttgacaagaccgagaagcgttacaatccaagcatgtctcctgttatcctaaaggacaaatggaggaaaggatcacaggtttctgtaatttcttgccattcttgttcttgtaatcagtatttcatttttattcagagttttacactgaaccatctatcctctcatttcagtgggtagcattgaccagaagacatgcagaagtagtcgttggcgacaaacttgtcttgcaagtattcagaaggcattgcaaggtatattgccttttgagtttattcttttcgacattggagtacttgcttagcttgatttagtccttttcaatccttcacatgttaacccatttcaagaaaattagttattaaccaggttactagtctgttccaagtatccttttcaatttccctcaaatttctgctgtaaatgttagaacctttgtgacttgaacttcaacttgtttagcaaacatgttagtaggtatgtggcttgcttatatgggatgtgaatgtgagactagttttctgttcccttgtttgtagatatttgatgccttacagtgttaaataatcaaatgatactatctaatcaattaagaacgatagtatcctagtgctctgctgcctcgatggcaatgctttgtctgtatatatatgctattttttaggggaaaaaaatgccaaccaagttgcagcataattgtctgagaaaagttccatcaaatctatatatgttcagttcagtcaaaaaaaaaaatctatatatgttcagaatgggggttttgtgctatacatttacattttatcagcaatactttttctgatagcctatatcatccagctacataattactgcatgataagaatatatatatttatcttagccaattgtttgttccttgtagaattgtccttatgcacaatgcgaactgattatgttctcattagattaatccaacttctaaaagttgtgtaaaactgaaaaaaaaatgaatggagttaaattgttcttatgctgaattaagacaactgttcgtatttattttggtccattaatcctacatattcttctatatgtagcactaacgattctattgaatttgacctgattgttgcagatggtagtaactaaggctttgcttggacagaagcctaattatgtaagtgtttagtttaatttggattccttttcagtctagtttgaagagaggatcattttaacatacattggctaatatcatgtataataacaatcattgactttgtcttccaattcttaagtgacaccatttctttaccgtaggtataaacaacttttcatatgtaatactatccttcgctcaatgataactaaagcgagtttttattctgctgtctgacatgtagttttatatgatgtgaatacgaatagtcttttttgttttctcttgatcaccaaaatcaaatgatttatctcatttttacacccttctaaggaatgtttcattatgtacccaatagtactgttgttccctgaattaattatatttatcaatacctacgattgttgcacttattaagtattatgcttctcttgcagcgaagattaggatttggacttcgtcgaaagcagatatcggtaaagtttcaaccggtcacattctcttttatctattctcaagatgtcaagcacgcattcagatggaactttcatatatttatttgacaaatggaagttcagattgtcaaacttgttcatatgtttgcatatgaaatgctaccgtcaatttcaagctgttgctcacatcacaaaagtttcttgcaattgagctcttcactgagacatgatatccatgctaaaccttgcagaaaggatctactcgaatggagcatgattgcattccagatgaacactatgtgcagacattattttcagtaaggcttgttattgttgatattgatttgcagactgcaggacataatcgtatgttcttcacaacaattcataatgtttcccattcttttaactttgtagatcaatggacatgaaaatgaactggaaagaagaactttgacatatacatcatggaaccagtcctcagatcctaaagacaaaatgacttggcatccaatgacatttgagtatgagtcagcaagtcctgagcaaatcaattcaattaaggtaatatctgtggattttgttttgtcatctttttttttctttttcagttggcttgtgaatgataaaaaagctctagtgttctatctcacttgtttgcctcacaacctgtccatctcgtaggaaattcaatttagatagtgtaatcaattctccttgttttgtcctgaataaagaactaatctactcagaaacatgtatctgcatagcagaggtcctttccagtttgcgaactccaacctttgttacaaggaatgtgtttccatgtttatgttgactggtttccctgtctatactacctgatgttaaattctattcctaagaataaagtcagacaccgcatcctgtagtgcaggacctctaccttctatggcacgttattctgttaattgattctcacttaaagtttgctgcattttacagggtattgatcatgtgaattatcagatggagcacagaactgagtggtgccaatgcaatactacatccgttccatgtttcctatttgccaggaagttctcctacagtgcagccatgcatctattagaggctgggacggtcggtccactaaaatctgctctactggcttaactattactacaaaattttgatcacacgagttctcatttttagtttatcatggccggccatagtttatagtccatcagcatcattaggttcagtagcatctgcagctgaatctgcggagcgaccggagtaccatagtgtattattattgatagtgttcagatttgtgcatagaccactgggacagaagaggtttgatgtacagagcatcagttttggagcttgtcagctcggctacattgcaatatccaacgacagaatgaggcaggatcagatcaggtatcttgtgacgaagaatgaagaatgctcaacccttctcccgatggtatttactaattacaggataggaaagctgtaacaatatcttgataaatgatcatatacacattaacaaatttaataaagtacaaagaaaatattttttgttattccatttttccgcaagagaaaaacatcccagcaatttatctgttacaagtttaatctcatagtattatgcaacttatgcaagcagggaatagatgtaatcgccgaataaaaatggaaaatataccttttaatttaatattttatgtttatatatatgcatgggaatgatttgtaaaaatatacctctcccgcatgatgggaacgtgggaccgttacaaacacgcgacatagcttcggttccgcaggtcggaagcgcggaatagggtcgatcgcgctgccctgtcacgcgggagcgtggtggagaacgcggtcccgcgtaaccatggcgcggcaccggctgcttagcagaggaagctagcttgcgcagctgcttagctatatatattatttgctttgatttgctttgattaaggccagtgtgattaattaggttaattaagtaattggtgccgcaccactggcatgcgggagcgctggtctgcgccggtgccgcgggatggttctgcggtaccgctcgtcggtgccgcactatggttccgcgggaccgcggttccgcgcatccgtcccgcgggatcgaagccgtgccgcgctgaacgatctgaccgcgtattgatgctgtgattacatagcgatcccgcgttaacactgtgcggaagaggtatatttttacaaattattcctatgcatgtatataaatgcaaatatttaaaaagaaaatatattctcaaatttttttctgtaatcgccaagctgttcagcacactggtcatgttgtgcaatacgaaatatcctgctagccatatgatccatggaacatataatgagaaactatttttcttatttatcaggcacgttcctcgttgcaaagtcccagaagttagaaacctatcacacctatgctatacatcccaacaagaagccaagaaccagaataatccacgagatgccaaaattggccttatttttcagccgtgttctacttgctcctcttgtagatcttgtgcagaaaagatttcagaaccgctcgtactgcttcattcggttgtgcttcgatggctgagatcagcttttcatagctctccctttcatactcagaaaacacccgctgaaagatttaaaaaaaaatcaggtatgataaatgaatttgtcatggcaggaaagcacgcggcaactgcagaaagaaatgagtaaacagatacagatcacagcattttttgggtaagcgtctcggttgcatataatatcaaggcttcattgcatctttttgtaaaaagtcgaacattcaaaatcaaggattgaaggctgaaacttggctggattataccatcttaagaaaaaaaagacatatttttcaacattgaacgacaaaatggaaaacaaaaaaccattttatgtataaaaaatattttaaaagaaaacaaaaataatgggggaacacctggagatgaagttcgttatatagatccttcactttggcaacacaagctggatctgatttcccataattttcctgcaatcatgccattcacagaataagacgtcatgcttaactatgcaaagatacagtttagtactgcgcgggggccttacaaacaagactcctttttgtttctcatcagcgcgctcaagtgcttgaacaaatagccaagaacacttgaaatcttcaatgtcacttcctatctgtggtaagattgcttggggatcaagtccaaagaacatttgatagtgtactatgaaacttgtgatagtactgcaggagtgtacttaccttgccaataatttctggttcaccaaaacagtccagataatcatcctggaaagaaaaccttactagcgatactgatatgaatgaaaacagaaaaaccaagaagagaagcattcaagtggaaaagagaacgaaacatcaagatgatcttacctggctttgaaagtaaacacccatctcaactaggatatgcttcacttgagcataattgtccaaactctcatcaaacaacagcagtgcgcatgcaaccttgtaaggttgaaaaagttttgcttgtgaataccaaacaaaaacaaccacaaaactcaacctcactacgacatgtgcacaagcatttttccacaagatgaattacaagaagttgtttctaggactatcaagtttcattctgagctatatgtacccctgtttgtgaggaaccatgctcatgagtcatgagtcatggtacagcgaaagctgatcatttgaattagatttctaagtttactttgattagccacatattggaacagtgtaagtattcatgaaaagtataaaacatttccccaaggggcagcaaaagcggaaacattttctcagtttgaagaaatcgacgagcaacagcctgaattgatgctataaaagtttcaaaatattatatgggagtcattcatttttaccggcaaataaaatgaatagtaagctgtcttatattccacaatgcgcctatatctgcataaaattcaaaaatgattattatcaagcaagaagagtaaaaatgaaactgacaaacaactgccttctagggcactaagcaagcagtatgtcagtatgacaccatggagaaattcgtaattcagtggcatacacatgtacattatacttgttcagatctttccttccttcatttgttgtaatttgatctaataactggcctgaagttgtctgaatttcaacctagggaggaagcaacaaaattatgcttcagtaatgaaattggttctcaaataagagaaatcctaagaatgtaaaactacctcattgaataaatctaggagatcaacatagtaactttttccacgaaaatagcgcctaaagatccttgaaatttggctgcgaaggacgagtccatcatttatagctatgaggccgacctgctcaaggtagaaaatatgagctaaatcaccatttaaccaagacaaggaaaggactcaaattgtaaacagcattaatctacatatctatatcattccttgcatcttatgctagttactagataatcaagctaataccatgatcaaacctatccctagtgtggagctgccccttgctatttagccaacagtagcatctgagaacaatattatcatccgttattatttttaccttttcctttgtttagttggagtacaatcataacattttaacaacactcgagaatctacagtaacacaaggacatttctatgtggacaagttaatcctacttgacaaaccttgggaagcctaaaccaacagggttttcctcgtcgagtttgtgagttatccattatatcatcaagaaccagaaaataggcctgaagctgcaggttactcaaagaacaaaaaagtttagaaaatattttgctaatattgttgtttcataatcccaggtcactaaatcatacaagtatcatgtacccattcgatgccccaaccaaggatgcatgcaagaaacaattcctcctcgctcggttctgttgcgctagcagctttcagtattttgtagctctcaacaacagccaagccacggttcaattttcctgtacaagagcagagatcttaaatgactaaatcacttgccaaccatatcgcaatgtgccattgtttggtttggtcgcattgtttctgaatagcatgtttttctcaccaccaagcacgttgtagtccagcatctgttcagagataaggttcagtgattttttttttcagctaaacattgacaaattgcatttaatacccaaaaaaaaaaacaatgaagaagttgcaacttgcagatcgtaccaaagctaaagagacaaaaaacatcaaatatttcatgtattgtagtttatctaattaaggacagtgccccccaaaaaaaaagaaaaaaaaacttgaggagttacgagttgcactgacgctctcgagccattggatggcgtcgtcgttgaagtcgaaggaggggtccttgagaagctctgccttgagtgtgccgtacacccgccggaacgtcgcggccgctgtctccgccgccggtccgctcgcccccgcacccgcggcggccatagaccccagacccccactccgccgcgccgacccgcgtccgcgtgcggcaggcagagcagacgagcggcgaaggaccgaggagcagcgtgcggcccagccgtcccgatggcgacgacgagacggggcaggcggcttccgttgcgttgcgtccggtgtgcgtgcgtggcgcgcgcgcgcgcggcccaatcgatctcgcgcggtgggggtcgtgacgtatacgtcgtgtcgcgttgcgtcgagaaatttgctgcggtttctccgattcgtcacgccgtgcgcgcgccaacgtgccgtgcgtgcgtgcgtgggtggactggagcgagcgacaccggcggccgcgctctcgtggggtcgtcgacgacgtcgttggcggcgtcgtcgttctcgacgcctcgcgatcagacggcgacgtggtctgtccccgcctgaaaggactgtctgtctcgaccccggcgggaaaaatcgcccgcgtctccaccactactttccctgcgcgggatccagaggcggtgaaggaccgcaaggatttcagacttcagaactatacctgcactgcactaccatcagagttacggcgtttcagcgtgcgtatgtttcaatcttcagatgaaaatgggaagcagattcagccaaagaccatgaatttgatgggtaatcacaatagatcagcaggatgaaattgtctgttctggagtgtggcttaggcaattcaattcagagtttcagagttctgactattcaagcaattctgactcgtatacaaaagtagtacctctctagccctgggaagtggcaaaaggacttaaaaaaggaggataaatagaggtaaaaatgcaattgcactcttgcagtaaggttggcctggttaaggccctgtttcttttagcttgggattattataatctagattattgagtcagattactataatctagattgttataatctgtagtagaataagtggttagttgtttctttcctagattattagagcctagattattgggtttgcaagtctaaagagggagtggggtggcatgatgggtaatttttcacccaataatctagaaaaagctcacctaaatgagcttatcagattataataagctatcttttagcttactcctaataatctggattataataatcctaagctaaaagaaacagggcctaagtttgctcatccgaggtgaagtgcgatgagtaccgctgcgccaatccgcagaagccaagcgttcctcccgtatggatcatcaccactttggttctactgtctccaacacatagatccacagcttgctcccaaccagctaaggtgtacattggatccaacaggataccagtttgctgcgcaatctggcggcataatgcaatttcaccgttcagcaccttgccaaatctgaacaaaaaaaaaaaggccccaagaaaaatcagtattcgaacgcaaattctaaagattctaatagcaagaactaaaggcatgagaaggacataattattcaccaaaacaaataataatcagaacatcaagtccacttcaaccgccgactataatattaccaagaaaattactagatactaataaggaaactagtacttagtaaatgaacaccctcaaattacaaaatcatgaatacgtccagaatgttctgtaatttatagtgacatgccttgaaaatgacccaagacaacattgtattgcagaaacacttgagaaagcagcatgtattgaataaaatgaatgctcagtaaaatgcagcatattaaattaattgattgaagcataccgtcttggtgaaaatcgttccacccattcaactaaactgtcaccaatatcattttctcccaccatttcatggtagttgttatggcaaagcttcttaaagtcagatattaaggacttctctcgttctttatatctttcgagtgtgtcagcaagcatgacagcagttactctccaatgcaatctgcaaggatcgtgagaaaaactgtgatctctagcaaagatggatggagaaagcaacaacatagacatggaaatactaggtgatgaacattttgattgacacgatttttaattagtattgcttgaccaagttaaaatgcaccacatttgtcatcagagacattaatttatcccaatttttctttgatagatcaagtgcaagaactgttctcattgttgtgctttagatattccaaaagtatctccaacaacaaagcctttatataaaagaaatggaaaatcatgatacctgtaataccattagaaactctcaaaagttcaaagtgtacaaaagctgtaatgataactctcaatttattctggcagcataatatgcaagtagtattaacaaacgcaccctagacataccgctccaagagctaaccccacagctgttgtgcctgtcccagcatctaccacgacatgaacattctcatgtttatgaaatgacgacagattgtaaaggtactccactagccgaataacacctgaaggtacaacaaagccatgtgaaatatgcaagattcccttttctttggggcccaagttaaaggtttcagattaacaagtgaataagaaaacaacatactgtgaaagcaaaattgactgccctgatcctaatactcaaagtgaaaattttcaacctataagcaaatatagcaatacaaggacacatgcattctaagttatgggtattagattattctgttgtcgaaaatttatttttactgatgaacggaactaaaatcaggagttcagggcaaaaacagtccattacttacctagcaatgcttggacgtcaccagccccttccttaataataactactcttctcgaaccaatttcacaaccattatcttcatctaaaacaaaatcctctttgctaatatcatcagcccacaacactgtaccacctgtgcctgcaacttttctggcgtgattgtaaagcatttcatctctgtgtgcgtacactgaccgagaggcataagccacattgccaaacatcaaagagataagattgtagcctgtcgggatatctggctgttcacctctcagcaatatgtgtggcctcattccccactcagcacagtggaccgctaatgcagtaaatgaaaaaaaaaaagtgaatgctatgagcaaagcaacattttcgttggactcaaccgaattcaagaaagaaaagcagcacattcactatatcagcgcgctaatcaagggacaaatctgcatgacctagagagcaattttgcagggatgcattgggatcgtttaccaaggcttataaggtcatagctcatgtaaagaatgaactggaaattacacacagattcaagtggaatgaagaaaaacaaaatgggtaatccatatctcaccagtggccgcagcatgggcgctctggcaacccccacaagtcacctgcaatccgaagtccagaacagtgaagataccatcagatttgaaaaacaagatgtgatcaaggctgggtgaaggggaatgcaacggtgagcacggacaacgtcagtagcgccgcggcggcgcaggagcggcaggagggcgtcgagcttgcgggccttgttgccattggcgagcgggtggaggagatcgtcgcgcaccacctcgaaccttgggcggccctcctcttcccccttgcctccgttgcgcttaggcgcggtggtgaggttggagaacgcgaagtggtgaggaggggacggcggtgagtgggaggggaggacggagatggtgtggacttgggtggccggagaaggaagcatccactccgtggcggagagaagatttgcgaccgtcctgccgccgccggcgagcgccggcgatggccgcatgaggagatgggcagatggcggccggggacgggtcacgtaaagtcaaagtacgccttcatgaagcgttggcggagaacatggagtgttggtacgtgagacattacggtcctgattgggtgttgttcggagtagcaactactatattgataaccagtttacgagaatttggagaagctaaaaaataactcttagtttcttttttaaaaaaattctgtaaatatatttctcaagatctggatgaaggttttgattataagaagctcgctaaatatgtctgatatattggtatctcaggtctcacgatacaccatattttttttcttttcggtgagtggataaactagaaaatttggaaaccattctcttagacatacaactacaagtctacaaaccatggagctaactagggatgaaaacggttggaaaaaccctataccgttttcattttctttttttttcttgaaaacgaaatcggaacggtagacccggaaatggtaacgatatcggtaatattggtatatcggaaacgggatcatcggaacggaatataccgatattggtcgaaactcgaaagtcaaaaattcatgtcgaaattagcggagtgtggcatagcacacatttaactatgcacgtagatattttttaactttattcttgcatcatcacactccacataacaccgttatatgataattaatgatatgataataagtttgacaaacaatataaacaaagttcaacaatgcttcaacatcgataagttgagaagaccaaagttcagcaaaatccacatgcaacgtcatagggttaacaatattttccctagtcacttccacttttttataggctgcaagcctaccaagctttcttcattcataggcttccgatgggttgggctggctgagccgctggggaactttcggattcttttcggaattttaacggaaattaccatacaaatatggttaccgataaaacggtcggaaaaagcccgtcccatttccgctaccatttccagaagatattaccgtttccatttccgccaccgtcggttactgaaaccgactaaaacggttggtgcaaactggaaacggtagccggaagtttccatactgttttcacccctagagctaacccataacttctacagcaataccaacagtaaatagtctcattatactttggtcctaacatgcactacatttcacgacaatatttgatttgccattaagacctttttttctaaagatctatagggaataattccaaattaagatcaatataacctatgcaaatcgaacgttaacgtgcataccaaatgaactttgttaggacttagggtacgtttgaatctccaacttaatttagcttttcattagcacgcaaagtgagataaattattagcacataaataattgagtattagttattacaatttaaaaaatatgtttatttgatttttaaagatatatatatatatatatatatatatatatatatatatatatatatatatatatataaagttcttttttgaaaaaaagtataattcagcaatttgaaaaatgtgttaatgaaaaagaaggaagttatagtttagaattgaagaaaagaatgcagacttaggagacaatcatcgtcaacaatttatttcagtgagatgatgccatgatgacatcatgcatgtgacatacatatgctgccatgcaagtgaatactaacatggcaataggcaaacttacaatttcaatgacaagttgtaagcgcaaggaactgacattccggctccagctactactacatgctagaaaaatgagtggtagaacaaactgccagtcggagacgacaacaagggaggtggacatgaccatataactgattggaaaaggctatacgtcctaactttttcttaaatcaaatggttgagatgattgttagtaaaagtttagtaagaaaaatttagtacggtagcattgctctaattgattggcatatcttgatctttgatggcactatggcaatcaccttacagccaagtgaaaggtgccaactaattgagatggagagatttgtctaagaaatgaaaatgaattactccctctgtccaaaaagtcccatccaaccaaaatctcttgtattttgggacggagagagtacttggctaaaacatgcatgctaaggccatgtttagttcccaaaaacttttcgtaaaaacatcacatcgaatctttagacacatgtatagagcattaaatatagataaaaagaaaaaactaattgcacaatttgcatgtaaatcgcgagacaaatcttttgagcctaattagtctatgattagccataagtgctacagtaatccacatgtgcaaatgacggcttaattaggctcaaaagatttgcctcgcggtttctaggtgagttgaaattagtttttcattcgtgtttgaaaaccccttccgacatctggtcaaacgtccgatgtgacacccaaaaattttcatttcaccaactaaacataccctaattatacaataaaatcatcttaggccttccttagagtggaggaagctagaaattaatagaggaattgaactaaatcctgttaactcctctaaaatccctgattattttttttaggaaaccccgttagttttaagtcctaacgaataaaattaaattagctggtcacatcgagcattcatatgctcctccttgcatgataaaccaacaaaacattatgcgcctgaggtgattgacacatccacaaagttaagatgtggcgcattattcttcagtagtgcaaattgagaatatataaaggcaaaatccctatcaagtatcaaactgtattggagaaaaagaaagcagaataattatatttgactgaaagcagtaggaaaatacataagtattactaaggtattccctgggttaatggttacaaatattttttttacataaaggagaagaaatttaaggatactgacaccaaaagcacgcaccgaaaaatattttcgtggagattttggatggatacctaaaaaatgcagttatgtactgtagcctattgcatcttttttcattttttaagggtaatactagcctattgcatcctggaaaggtacggtacattttgttccttgtacatctgtagattcgtcagtgtgcctttttggtttttctttgtctacccgatcgagaggagtctttcagtgtctaggtggtgtccaattttgccttattatcatgggacaaaaattagtggtcctaaacttcataccaagaactagtttttcttggttcgtccattacgaacagatgttgtcgttaataaaagagctatttcaagtcgtcctatcaaagaattttcatatatatatactcgataatggtcttccaaactatcagtggtgggcaattgtttggagctatatataagaaaagagtcatacatatgccactggatgtgtctatacgattgcaagtaatctgagaaatcccgttgacgaaaacaatatgcagttggcatgaaaacaatatgtttgtacccttatacacatctctcacaggttcaatcatgcattaatttactgtagcatttcaatctaaattattgatcatgaatcaaatggtcgggcgtgcgcctaattatacacttttatcattgtcctcttttggttagcgacacggcaaatgatccatattccttttgtgctactcaacctctgctagactaccgatccggatgaaccgtagagaatgcaagtatactactgttacctccgtttttttaatatataactcaattttgtttaaaaaatgccaacaaaatgtcaattgcgttatatattaaaaacatgtgatgtgaaccaaaccattccttatatagacaattgtattcttagccatgttagtaactctaatggtgatttatctttattttcccaactttgtaatcttatcctattttttttactaaagcttatgcttgcccggttgcccctattctgttaggatggctttaacaatgcgaaaaattcatgctaaaataggagcaaaattcatatcaataggcttgatatcaaatcatggacaaaattacaaatccatcgtgaaagtagggacaaattgcaagggcaatacatgtctttacaccattatattaagtcctctaagcgaaacatcggcaacacaagattcagttaagaaacaaggataaaatcacaaagtataaaagaggcaagaacacatttttccgtttctttgtaaatctgatgcggtctcagccgaggttggtacggtagatgcacgggcgaagggaccatgcgtgtgtctcacctgatcgactagccgaggtcggcagtacagcaacccatgcctgatggaacagctgatgttctcgcctcacctaacaaaactttagacttcagttgagcttaagtctgaagtctgaactcgagtcggaataattaatcgctgctgtcctggcctagatagcagagttcctttcacaaccttggtcgttgtctgtttgatatgagtcagtttttggtcacgtagtaacctttacgttgcaagaacaaccaacccgatcgatcgacaacaacgcgagctaggcagagaagatgaaacaccaaaagggaatcagcgtgcaatcaaagttacttttgacagatatctattcatcttgaccgcaaagcaaccattaccatacatgtaccaatcgaccacccgaaaacaacagctgagaaaaatttccttgatcatcttttattatattatctgtcattcggagatcgagatgatgcctatgctagctaatcaccagctatagacataagaaattttcagtgacactgccaattaataatgcaacatcacgcaagcatcagcaccgcatcattgttaattcagaggaaatctacttatagatctccgactggtggtacaaacaacttttgttgggacaaataaaataggttgggacaaataaaatagagaggccacgtcctactcttaccaaccattgtagttggcggcattaattagacgatctgtaggtatcgatcatatttcccttcgaggcgagaactacaaaagatcatatatgtctcaatcatcgaacaatgcactctacagaatatctttaccaaacttaattaagaagagataacgaaaaaataaatgaaaaggttggcgaaaatatgatataacgcacacatgcacacgaaggaaaagaaagagttgattaatatggtgaccccaagcgctttacatgcatgcggtctgataaaataccagtagtacatttcattcaattcgcaattgttaattggatcatatcggttagttgaactatttactctctccatccacaaatataagcgttcctatctttttaaaatacagattaagataaaaacaaacgaaagttattctttgtttctatttatgataatacccctcattttacaggccaattatgttttgggtgtgtgcatatgggttagcagctaatgaaaagcacaacagcaaaaatataggaatgcttatatatttgtgtatagaatttaaaaaggtagaaatgctattatttgtggatggagagatgacataaccaaattgaattaagataaatgaaataccataattactttttgagtaaattgtactaacggtaaaaaccactacttgaaaaaccatctatcactacaggaaaatttatggcgagagtacatctctcaacataatccaacatatgaaaatttgactaatttaaaccaaaagaatctatcggcggatgtatagaaaatatgaaaatttaaagcccttaaaacttatatgttgaaaatttatattgcaacaaacttaatacaaggaactataattgtgccaacaacaattacatactgtgaggtgctcaaaattattaatgcaacgataatgtagcatggacgaagagattacgccaatttccacgaaaataaaaattatggcaataaaattgccatgtcgcaatgttagttttccacgtcacaatgtggctatagcccactatatattgcaacaaaaaataaactataacaacaatggtacatttttttaatataatttatcaattgcacgaaaagttagatcatggtaatagaataatacatttactacaaataatattttgttgcaatattttcatggtgatagaaaaatttcttgtagtgtaagttgataagtggatatgatctagtatataaacttaggaattaaacattcaagtgcaacaactggcctgcaacaacttggccagtaggtgtacaagaacgacgatttagaatttggtgcaacaacttggctacgtatgctgttttagttattgagtgctccacaaactttttcatgatgccaatataccattacatagcaatattaaggatattaccttacaatacttgatttaatctataggaccttacaatccttgttttaatctataggaatcacactatttatccaatttgcaccatcggtttggattttttttatttcaccttctcaaatcttaaccgaaatacaatatttttttacacaataaaatttaattgactttttcattattgaatgacaaaaattatgtatgcttatagacatacacacaagtatattgataaactaagtacttaaaaactaacgtgtaaaaaaatacttgaaataataacgttgttgcaacatttattaagttattgtattaaaatcgtactcaccttacaagatgttatactcctacactcatttgttaagttctttttactagattgcacctatctaccaagttatacgtgcattagcacactcacttctaaagttcttgttctaaattccacccacatgccaagtcaatgtacgatgtatataatttagtctaattttttaaataaccaacacacataatctactttgtttcacaccctaaatatctcctgggcttaattaattgcacataaattaaaggaaagtcaattttaaccttttacatgttccaatataaaaagaacggaatggccatcgctattttaaaattttcaaatcaacaaaaaaatatttttctacttttacggcattacgtacgagggaccataaacatctcctggacttaattccacatgaactaaaggaaagtcgattatagtaacattatacatattccatcataaaaacaagggttaattggatccatatcgttataaatttattagttttaaaaattaccattacaattcaatgtgtatttgagatataccactacttactcttttagcctattttataaaatttattaatcaaattgtccatgtcttcttcctccctctctcctcttctctcttcaaccgtatccaatccctctagcccatggatccacggcatagatgatagagcgagcctcctcacatgcagccatggtgttagggtcggacatccggcgagaaggaggttggcgtccatgaggatgagcagggtagagcgccaaatgccgcgctagccagttgagagcgtgacattcttgacagggaggtgggagacaaccatacggaggatgtgtccatggttgccgccaccgattggggaggttttggagatttggggttttgggtgcttggctttccgtgacgagtaccgagtgaataatgcatgctcgcctctatagtcatgagtgttgcgctggcctcgctgctgactaccgcgtcactacgcttgagctccgacatgttctatgctgccgagctcaagcgccgctgccatccgcaccgtcattggaagaggagtgcagagcgccaccgccgccacgctcgatcgtgggaggaagaagagtgcagcggatgaaggtagcagataagggataatttggtccaagaaaaatataaaaaaatacagtgaagggatatatagtgacatatctccgatttcaacatatttataatgacattgtttcaattaggtggatagtaatggtatatttttaaaccgtaaaatttaacccaaacaacaatgatgggacggtcatcatcattttttttttcaaatcaagatgtgccctcttatttgtttttgtacaagtgaccataattgcacacgaattaaaagacattcgacctttagcaccgcacagattccaccataaaaaaacagaagggaatgatcataatcgttttattttattttttccgaatctacacaggagaacatcatatcccttctgtttctgtacgagtggccgtgaccatctcgcgcacatgaattaaagggcaatcgactttaaacactttaaattccaccagtagttaagaaactgccgccccccaccatacctccagaaaatattttctacaacactaggtactattacaatatacgagcaatgctacacgtaaattttttttactaaacttttactaacaatcatctcaaccgtttgatttaagtagatggaagttacaaaaaaaatctagatgcactcataatatgacacattagtgttattagtaagaaaaagttagtacgtatagccttttccacaatatacctaggtgtaggtgtatatatgcggtttaaatattatataaatttttttataaactttgataagatagattatgataatataagacaccacacaaagatacatgtctaaatttgatctattacattaagaagaaaataacaaattttatttacgttgtacaatgtactatgcattttctgatttttaccctcaagtcaaaagtcgaattttgcctgacatgtttctttacatacttatataatccaattaatataactattttttaaatttttttataaacgcttaattcacaagcaaataacgggtgccaatttgtgtggttgtatctaggcccttgttccactgtacgtctgtaccagtgtatcactgcatgcggagggactcagaggctgtgtttagttccatgtcagaattgaaaatttaaagaaattg

SEQ ID NO: 63163 - DNA, 12139 bp, Oryza sativa
ttgcctgacatgtttctttacatacttatataatccaattaatataactattttttaaatttttttataaacgcttaattcacaagcaaataacgggtgccaatttgtgtggttgtatctaggcccttgttccactgtacgtctgtaccagtgtatcactgcatgcggagggactcagaggctgtgtttagttccatgtcagaattgaaaatttaaagaaattggaacgatgtgacggaaaagttgaaagtttatgtgtgtagaaaaattcgatgtgacggaaaagttaaaagtttaaagaaaaaagttgaaatctaaagagggccagagcacacaggcaaactcaggcctttgtttagttccaagagaattttgctcaaaatcgtcccatcgaatctttggacacattcatagaaattaaatatagataaaaaaactaattgcacaatttgcatggaaattgcgagacgaattttttgagcctaattagtccataattagctataagtgctacaataacccacatgtactaatgacggatcaattagtcttaataaattcgtttcacggtttccagacgagttatgaaattaattttttcattcgtgtctgaaaatcccttcttatatctggacaaacgtttgatataacaccctataatcctaaaattttctttttcgcgaactaaacatcccctcacagcacaggcaaccgatggatcggagagggcatatggtgccgatttatttattcgcttttgatatccatcacgcagccgctccggttgcgtctttgtcggccactcaccacgagagcgcgcgaagagacccgacaaatttataaaacggagacgggcagagatcgagtagcctctcacttaaccagagattcagaggagcagcagctaggtagctagctgagagaaacagtaactcttgccaatggcgtcgactgcaggtagaggagaggatgatgagagggagaagaagaagaaggaagggagcggcaacgacggcgacgccgggaagctgccgttcctggggatgttcaggtacgccgacggcgtcgacaaggcgctgatggcggtcggcacggtggcggcgatggcgaacggcatgtcggagccgctcatgaccgtcgtcttctccgcggtcatcgactgcttcggcggcgacgacgtcagtaccgttctccaccgggtcagcaaggtattgtcacacgtactgtggctgagtttgtttgtggtggtttctaaccacgactctctcgttcgtgcggttacgcttctaaactgttaaatgatatatatttttttaaaaaaattatatgtagaagttgttttgaaaatcatcttaatctatttttaaaaacttttagctaatacttaattaataatatgctaatctaccactttattttttgcatgggattaattcccgacccacaccgagcaacacagcctatatatatacgtacccgcggcctgcctgttgtggcaactctgatcgatcgggcggcagtcagccaggcaccgggtggagtataatttttaccggtcaaattatttgaaaatggtaactgacagaaacgaaaacggtaaaatatggaacgaaaacgactgttgttttatcaactgtttttatatttaagtggaaattatagttttataatatagtaatcaccatatttctaagaataaattcacaaaactataagtagttttgctaaattatcataaaacttcatatttaacatgatgtatcgtaaaatcactcacttatcactaaatttatcacagaactacatatttaaaacatatttaaagtattgtatcacaaaactacaggtttaatataaatttaatcataaatttcggacatttataactcaacatagtattagtgttaaggatttaaaccccaaaaatctgtagttttgtgataattctattattaaattgatacttagccttaaacttataattttgtgataaatttattgttaaatttatagttttgttatacatcactttaaatctatatcttgtgataatttagtcaaaatatctgtagttttatgaattttactctatttctaaatatccaatatttgtgatacatgtctctgtttgacctatagtttaacttctcaaccaaatagctattttgagtacattaataaatataagagagattctaatttatatagtgcaagtttgaatttccgtgatcacaacatatagccatgttaaatcaaatatgtgattctgtagctcaatgattcctgcattaagtactgatttccaattgattttctgatatttttaataccgtttcgatttccatttttcaaaaataaaataaaatatagccacagaaatgattaaagtttcttttccgaccttttttttttctaaatggaacattagcgcgagaccaccggacgagatgctctcgtacgcgtagcggagtatgttgtctaaatcgcgtttaatttactgtaggtgtaatcaactacgcttcgtttggctcaccttaattacctcaccctgatgcaactgcagtttcagatgtccggtcacgatctaggcgtctctagtggagtcaatccgttgcactagattacgttagtggtccgcgcttgcttggtactcccttcgtttcacaatgtaagtcattttagtatttttcacattgatattaatgttaatgaatctagatagatatatatgtttagattcattaacattattatgaatgtggaaaatgttacaatgacttacattgtgaaacggagaaagtagtagtagttacctagacgcgcggcaagtgggtggaatcatggaacaatcgtgatgggcccacgcttgtttcatattgtcgtggtttttaataatcttgtttaatgccactccttaggtatgtttagcgtaggtgtttgacaaatattatcttaaaaaagtgtttggcaaattaatttcatttattctgagagaaaaatagttttacttattttttttaaatgaaccacactagacaacgtgaaatttcttctgacaaaatagaataaaatacaagactacagaaccggaggctataatcatgataaaaaaataggatactacaccacatgccgacaatgcgggaaggagcgtagcaccaagcaaaccactggtatgaatttatagttgatccacgtatgcacatcccattgaatgggacctcccaaagcattacctccatggagaccattagggataaaacgtttggaaatggtagcattatttattatttttagagaaacgacatcagttcgtagatttatgaatttaactatttagtagcgactttaatacaacactgacatattttttttaaaaaagtaaattttgtatatggctagaaatagaaatggtaaaaaataacattattttgatatttatttttatggaaacgatatcggttcggttgggaatttccgtaccattttcacccatagacatcatgacaccgaagcattgtagccttttcaagaaatcttagatatgattttcacatagaggatcatgttagtgaaggagaggaagattacttggcaatgctctcaagggggatcgcagcacccaaagcgtcgtcctttttttagcttaggcttttttgcatggagcctacatgctttcctattgccgttgtggcctcaccatccacctagccagccacaaccattcaaaccattgccaacacatggctaatgcgcagcgacacccctctacccgactcctcgcgaattgttctcgctcttgttacccgacccatttgtctcactctcaccgtggagctccatatggctgaatctagaagcagatcggccacaatttttttttgttttgggtaggggtgggggtggggggctctataaagaaggggagatcagatcggaaaaaacaagatggcgggacaagatgactcgccatcaccgttctcaagatgcaacagccctcctcccctgctgcctaagccactggcacacccctcaccatggtactccttgctaccatatctagaagtagacctgccatacaaagagagagccaagccaggtagcaaaagacaaactgcagccaccatttgactctatgtggccaaatccaagcactttatcttgtcaacctcttctccacaactagccaccagcctcatcatcgatctaaaggcatttgtctccagccttcatgcgggtgggcttgccccacagccatcaccaacctccacacctagaccacggtcgccatcgtcatgccttgcatccgccgctccaccatgtgcattggcctcctgcctcaccactgccccccgtcagccaccgaccaccttgcctgaatatggacatctaaagtagcaaaaagaaaaggtttcatggtatgtaattgggccatgtaatcaactaaatgggaccattgaataaaataaaagaaactatgccaatcgttgggtacatacatagttcttcctagtctccactaaggaaataccctatatctagctacagaggcatggatctaggcactgccatgaccaccgctcgtctcgaacacctcaccgtgaccactctagtgcacatgagggggagaagaaaatagtcccacctttgttatcttgcagccgtctggacctctgatgagtagcttaggtggtgcaagggaggtgggggtggtggcagcaattgcttgagctccatctggcctggtcacccttggaagtgacacggataggagaatgccttgaagatttcaaccactttcattttaatttgtgttgcaaacgacaatactattaagctttgaatatatttgttttcaaaaaaatgatctgaatatgtgaaataattaggaggtatatgactaatcctaacatataaaacaaactccaacatccacaataatttgcatgacacaatgactacaaatcagacatatatcatatcaaacttgtatcaatttacaatattaatttggtccaccgacctagttgtgaggtttcatactttaggatcgcataacctcattttatacacatcatttaaatagttatcaagaattgaaaatgggatgataatttatattatgattcgtattttgccctacaatagaattttttttttgaatggagcctacaatagattatgatttcatatttcaccctacaaagtacaaacttgtaatgctgcattctatcaacaaatttagtcacatttatatttttctccatatgtatattgagtttagccttacaagtttgtaaagtcaaatatgacatggtaatttaggttaattttttctaactatttattaaggcatgaaatgactttcccatggtaaccttaatattggaacggggaaaaagatagaattccagtttgtgcttctatatgacttactttcactcaatatctcaaaatgttttccctattatgatttttttccttttcttttaccctctagcattttcttttacccaggttgttctgtattacatctacttgggagtgggaacatcaatggcttcttttctccgtaagaatgcttaatctcaagctatatgttgggggcatgtaaaacaccacaattaacatatcgcctcatagtacatcttaacgatgtagatgagagaagggtaagagaggaagggcatatatatgcacaactatattatgagcacaaagtacaaacgagtgacattagttgtcatattttatgtctcttgcatatgcctatatgttgaattttaagttgtttttagttgaacttccaaaagaaaaatacccctatcaaccattgtacatgcccttaaaccatcaactccgtagaaattatttaagatcactagcaagagtaacatagcgatccacacaccaagagtataaaaatggtttctaaagttgttgaatgtttggctattttaatgtcatagttttactacttgttaccattcctgaacttcatagtcagatcagcaaaatgatattaagaggttttggtctattacttcatgagacaacagattaattaattacatttgccacaattagaaagcaaatttaccagtaattttctatttacaaattttctggaacaattggacatgttaacaatgcaacaaaatttctgtttagttgggttgtacattcacatatgacagaatctcatgagtgctccatctacctattccagaggtgtcatgttggacaatggctggagaaaggcagtcggcatgcattcgatccttgtacctcgaagcgattatcacacaagacattgcattctttgatgtggagatgacaactggagaagctgcttctagaatatctgcagataccgtactgatccaagatgcccttggtgagaaggtaacaagactaaaaagtacactagactagtctaaatgaaactagaagaaaacttccattagagcaccatttgaaaagatgcacatgcattgagaatttttttctttggaaatagcattaactagaaagatgtgtttttagtgttactgggttatatatttatatagttcatccccacaaaatatagttaatgttatttctctcttctctcatgaagccacatcatcataattatttgtagtctttagataatagatctatggtacaaattgtctcttctttcttctctcacaataattagtatcaattatacataaaatatgctcaccgtgcactatatttgcaaccacgtgcaaattatataaacattagaagtcattttgttttggtttaaaaaagcatactgcaacttatttgtacatattaggcaacttaatttctcacagcaacatgtcagggtaattatctagtttattaatagtacgacactctgtttttctaaagagggggggggggtccaatttcagtacatagatttccatgctcatgacataatgcaaagatctgatgtaacactaataatttgactactcatgttcaggtaggaaaatatatacaggttttgacagcctttgtaggtggttttgtcatcggattcataagaggctggatgctggctcttgttgtgatggcttgtatacctccaagtattttctcttttgcattagtctctcgattacgggctcaaatatctggaaagacgcatgtatcatatagctatgcggggaatgttgttgagcagaccattggatctatacgaatggtatgttctaattatttcaatttatgacaaataataatgcttagttttgtacatcaataataatgcttacttgcaactatttaacataaaaaaacatttaaaaaaacaggttgtctccttcaatggtgagaagagagcaattacaatgtataatactctcataaaaaaggcatacaaggccactatcatggaagggattatcagtggttttggaataggctctatcttttttgttgtttactgcagttactctcttgcattttggtatggtgccaagttagtcattagcaaaggctacactggagggcaagtcatcaatgtcgtatttgcaattttgactggttcaatgtgagtttcctaattgttgactctgtaacatgatatgctagagcacactagtacatatactaaacattttgatatagtttctcagctaccatgttattatcaagtaaaaagactgaggcatactaggcacttgatgcctacttctacaatagttagaattaaccacattacaatataatactcctttgccatatgccaaaatcaagacgaataatgctaaaaaaataaattaaattaaattaaataacatgacacaactattttgttacaagtatagattttgtaaagctttataatttttcatcatatatgtaggaatagggtttgcaactccatgcctaggtatccagttctctttaaaaagatttcttgttattgatacaattgttatttcacccaattatctaattattatggtattaacctatgattatactaaataccatatttctcaacagtgttacttttgaagcataagataatatgaaacttgttcaactcaacaagtggacccaaacttcatgtgtcaaataactatgtagtgatgatctgcactatttggtcaactacaaaaataggttttttttcttctttttttttgacactaaatgcatcttttgtttgtaacagggctataggtaacgcatcaccctctatttctgctattgcagaaggccaatctgcagctcataggttattcgaaataatcaatagaaaaccaaatattgacatcactggaacttctggaataatattagaagatatcaaggggaatgttgaactcaaggatgtgtgctttagctaccccgcaaggcctgaacagttgatactagatggcttatgtctacaagtacctaatggtactacaatggcaatagttgggcaaagtggaagtggtaaatcaacaataattagtttggtagagagattctatgacccacaggatggtgaagtgttaatagacggaattaacatcaagaccttgaaactccactggataagaggaaaaatgagtcttgttagccaagagccattgctttttatgacctccatcaaagataacataacctatggtaaagaaaatgctacagatgaagaaatcaagagagcagctgagcttgcaaatgcagcaaacttcattgataagttgcctaatgtagttcctagatacgccatttgtttccaacagtaccatatatactagtgtattagaattaactatcccttttatcttcacatgatataggcatatgacacaatggtgggtcaacatggtgctcagctttctgggggacaaaagcaaaggattgccattgcaagagctatccttaaaaatccaaaagtcctcctgttggacgaagctactagtgcattggatgtagagtctgagaggctagttcaagaggcactaaatagggtcatgatagggagaactacactcattgtggcccaccgtttgagtacaatcaagaatgccgactgcatagcagtggttcaccaaggaaaaatagttgatcaaggtaagccatacttccatacccattacttggtattttctccgtactaaataatcattgtgaatcagaggtagttcaatttgtttctccaaaaatgaatgtcccacaggttcccacgatgagttgatcaaggatcccgatggagcttactctcaacttattcagttacaacagactcatactgaagaaatgcatgatgtacaatatagtgaggtgtcaacttcaagacttaaaagtagaagtttgtctttggaacaatcaatgatcaatgattctcctagaaatagaagaaaaaactctttagcaaaacatattggctcatctggatccgatggattgcacaagcatggtcttacagatgaacctgaagataaagaatgtggtgacaacaaggatattaataaagcaccaatcaggcgactttttaatctcaacaagccagaagcacctattctactattagctattataactgcttttgtgcatggacttttttccgatatttagtataatgatgtctggtggtataagaactttttactatccaccacaccaacttcgaaaagattctaggttctgggctttgatgtgcattctaatggcaatcatttctctggtatcgattcaattagaatatttcttatttggaatggctggtggaaaacttatagaacgtgtccgctgtttgtctttccaaagcatcgtccatcaagaagtttcttggtttgatgatccttcccattctaggtttgttactcaaatggatttataagtttcattcttatatctaacactttttttgaatgtcaattcacccttctaaattttacagcggatcacttggagcaaagttgtacattgatgctttgaacatccgacgccttgtgggagataacttagccatactagtgcagtgcattgtaacgcttattgcaggatttactatagcatttgcttctgactggaagctcacattgaccatcatgtgtccgatccctttggtgggtttgcaaaattatgtacaattgaagttcttgaaagggttcagtgaagatgctaaggtgaaaacaaagtccctagtatgaacaaagcaatttctaccatttctgttttttatataaaaaattcacagacaatcctgacactttccacatttgatgaagatgtgtgttttgttagatgacacctaatttggtattacaactgacatatttcatgattggcatcgcataatgaatttttttcttgcaatattagtaaatattgttttgctaactgctagcgatttctacaggtgatgtatgaagatgcaagtcaagttgtaactgaagcaattggtagcattaggactgtagcgtctttctgtgcagagaagagagtgattaaaacatacaaccaaaaatgtcaagcttcaatgaaagaaagtattagaagtggaatggttggaggcctaggtttcagcttttcatatttaatggtgtatctcacatatgctctttgtttctatgttggtgcacagtttgtacatggggggaaatcaacctttaaagatgtcttcagagtaagagatacacatttggcatcacttatataaggttgtttttattcaatgacaatatgtcaatcttgtaatcgctttgcaggtttactttgctttagttttcacagcttttggaatttctcaaacaagcgcaatggcatcggattcatcaaaagcccatgaatccgcagcttcaatattagcaatcatagacagaaagtccaatattgactcaagcattgatgaaggaatcatactagaaaaggttaatggcacaatagaattgaatcatgtgaacttcaagtacccatctcgcccagatgtccaagttttatgtgattttaccttaggcatcccctccggaaaggtacagttaacttggtacttttaattgtttttcctttacttctaagggtaaaacatttagatgttgtgcacccaaaaaaaaaagcagcaaactaggagcgctttatttttggaggaaatatcttgcttcctacaactattgtgcttgtacgctcttaatatagggtgtgcactcaattgttacaaatatgagttcctatgcactaaggtttgcctttttaaacttgatagttcctacagtatgttggattgccctgatccttgtcttctcatcctcattgagcaaggcaagagaactaaatatgcctttcaaatgaaaattaccaataatacaaatttctctatatttattttcctttataattaaacttgtactgacatgctataaaccaattgtcatatgcagactgttgcacttgttggagagagcggcagtggaaagtccacagtaattgctttgctggagcgattctatgacccacattctggcacaatctcactagacagagtagaacttaaaaacttaaaattgagttggttaagagatcaaatgggattggtaagccaagaaccaatacttttcaatgacacaattcatgccaacatagcatacgggaggaaaggacaagtaaccgaagaagagattatagctgttgctaaggcaagcaatgctcatgagttcatatcaagcttgcctcagggatataacactactgtcggagaaagaggaacacaactatctggtgggcaaaagcaacggatagctatagcaagggccatcttgaaggacccaaaaatacttctattggatgaggctacaagtgcccttgatgctgaatcagagcgcattgttcaagatgcactagatcaagttatggtaagcaggaccaccattgtggtagcacaccgtctgtccacgattaaaggggcagatgtgattgcagtcatcaaggatggttcaatcgctgaaaagggacaacatgactctctcatgaggatcaatggtggagtctatgcatcgttggtagacctacactcaaagacaacataaagagatgtatttttttctcccctaggtttgttcatctacaaggtgggaaaatgcacacaatgtatgcatcaaaaaaatatggaacatca

SEQ ID NO: 63164 - DNA, 11771 bp, Oryza sativa
  unsure (1)..(11771): unsure at all n locations
ccgccgtcgtccgcgagccccgccgccgtctgctccgtcaccggccacggccacgccgttgcccgccgtccacgccgtcgtccgccacgcccgccgccgccatccgcgttgtcgcccgccgcggccactgccgccgtccgcgccatcgccggccgcggcctaagctaccgcagtttgcgccgtcacccgccacgaccgtcgctgccatccgtgtcgtcgctgaccgcgacctccgccgtcgtccgcgagccccgccgccgtccgcggccacaccgtcgcccgccgcgaccgccgctgcagtccgcgtcgtcgcccgccacgaccgccgccgctagcacgagctctgcagaagaacgagcagaggatgggagaaaaggggaggaagaagaaagaggagaatgacaggtggggtccattggttaatagagagtggaatgtggagagtctgttggaatagaagataaatttcactctctaaatttttgttaggctggccaaataggtatttggagagtcaaaaatggccacactgttggagatgctctaagacaatacaggtaaaattatactattctttgttttcatggtttcagcgcattattagatgaccaatgcatatagtaaacaaaaaacatatcactcattccctctagtccttcaacatttatctaaagtgaaaattacctcataatctatgaataacgggtatttctacaattttccactagcagaaaaataatcgcacaatatgccctaaatttaagcttcaagaatgaaaacttcacataatttttgcaaatagatttgtgagaaatgataaatatttcataaaatgcaagtctcataaacttactatttagatttggtttttggagagaaaatttagcaggattacctttcgtacatcaaaagtctaacggacactatggtgcccatcaagggtagggacaagggtgagacaattaggcttgaacgctagaggtggcaatggggcagggcgagggtgggttggataggaacatccccgcccccctcctccgcgggttcactggccctagccccagaggaatagacatgacgaaatcaatgagtgctagacttaaaaccaaattcccattaaaatcttatacaaaatattgtgaaaaaaatgaagatataaagagacttaccaagaacaaatcaacttagctagggatgaaaacggtcggaaaaaccttttaccattttcatttccattttttaatcgaaaatggactcagattggtagatctgaaaaaagtagtgatattgataatatcagtattatgtcggaaaaggggccatcggaatggaatctaccgatattagtcagaagttgaaaattcatgttggaaacaacggagtgtgtcataatcacacgtttaactatgcatgtcgtgtaactaatgccgcggctcaccttttagctcaatgttcagagctaaaaacttgtaatatctaccgtgatataatccctgagccaatccaggaagtactgctgtctgatcttaattaatctaagagacaccgcattatctataaaaaaaaactatgcatgaagatggtttcttttggctccgccccacccacaattgttagagcatctccaaaccaaattatagcaaccacatgaaaaaaaatgtcctccaacagcctctctaacgggctgaccaagctatcccgctggccaaaccctgctagcaactggccaaatctagccagccacaacagttggccaatggtgtgccccatgccctctcccccttcccgcaacctctcctcttccttctctctccttcctcaagggagcacccatggcgagtattccagcgtcgctccttcccgcctcatccggctcccccggttgagccgccacatccgacaccatcacctccacccccggctgcatccggcgccgccgcttgcactcctctctgccttcccacgccgccgcatctgcccctagccacatccgcccctgtccctgaccatccgacgccattgttgaggttgccgttgccgtcaccaccgcctccccccagaagatggccggcatccccctctgcttgaggagggcccgagccatccccacaaccgtctggttgcgccgctcgacgacgccgttctgctgcgggctgtacggcgtggtgtagtggcgctgaatgccctcatcagcgcagtacgacgcgaattcagccgctgtgaattcgccgccgttgtcggtgcgcagcacgcgcagcttgcggccgcactccgcctctgcagcagcctgtgcatgcctgatggcgtccgcagcctctcccttgctgccgaggaccgtcacccacatgtagcgggagaggtcgtcgacgagcagcaggaagtaacgtcgtcctcctggtgtggccggtgtcactgggccacacaagtccccgtgcacgagctcgagccgctccttggctcggaagctcatctgctggggaaaggggagccgccgctgcttcgtcaccacgcagacgtcgcagagctgctccacgtggtcaaggcacggcatgcctcgcaccatctccttggcactgagctgcttcagggcctcgaagtggaggtgcccgaagcgctcgtgccactgccacgcctcgtcgtcccgacgagcggcgaggcaaactggttgtgcgacctgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggagcctcggacgctggagtcgaactcggtgaagaactcccgtcggccggtcatgtgatgggtggcgccggtgtcgaggtaccacccatcagccttgtcgttgctggagccgttgcagagggagacgagtaccttcggctcatcaaggtggaggaaagccgctgcggccggtgccgctggaggtagctcgatgcttgcgtgagccaggagcagagccggctcttcctcctccacccgtgcgacgtgggcctggccgcgtcgtggctgtcgacagtctttggcccaatggccaagcttgccacagttgcggcaggcgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctccctagtgagatggagcttcccgccgatggtgatgggccccgagaaaggctgtggctcatcaccatcgacgaccttgaggcgacctaacgcctcctcgatcaacatcgtggagaggtccagcagagattcgatcgagcgagcgatctgtctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcgggactgcagcgatgagggcatccagtgcccgccgatcctcgtcgtagttgacgtcaccgtaccggactgcctcccacatgtgccgcacctggagcctcaccctcatcaccgcggcccactcgatgtagttggttttggtgagggtaggccacccaccgccgggaccaaagtccctgaccaccgtctggacaccgtggtgaccatggcgccggtcaggggagagagagccgtgctgcctgcgagggccgcgtgcgagctccgggctgccgccggcacgcctgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcggcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagactgagcgtcggacatggcgcacctccggggggctgctgcgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccataccttcccgagggaggttggatacatatatatatagccatagctggctggatggctgctagctaattgctgcccacactagtctaaaatttgaacgcaatgctgtcctagagagcatccaaactgaataaagcataaaggagatgctagatgctgtcctagggatgctaaaagcaaaaccgaaagatgctaaaagcaaaactgaaaggatgctgtcctaaaaggggaaaaacaacctaaaagcaagagaaggaccacaaagaccaaagaccacaaggcttattccatcatagttagtgcgtacacacagacacagttgaatttactgtctgtggctaccaagatcatacgttcagaaccataggtctttcatgcaacaaagtaacaaactaccaaagaacaccctctagtttagcatcaacttctcaaatcacaagtagctagaatttatggctaaataagttatacaccatcaaaatatacatcattttactcggaattagagcggagttgtacaagtgaagcatatgcaccatccttgatccgcaatagtgcttcatgctttcctttttctgcaatttttccttccttgaggactgcaatcatatcagcccctttgattgtggagaggcggtgtgccactacaatggtagtcctgttgaccatgactcgatccaatgcatcttgaacaacacgttctgattctgcatctagagcactggttgcctcatcaagtagcagtatcttagggtcctttaggatggcccttgcaattgctaccctctgtttttgcccaccagatagttgcacccctttctcacctaccactgtgtcgtatccttgtggcaggcttgatacgaactcatgggcgtttgctgccttggccacagcagtgatctcttcctctgttacctcactgtgtttcccgtatgttatgttggcacggattgtgtcgttgaaaagcactggctcctggcctacaagccccatctgatccctcaaccagctgacttttaagcttctaatttcaactccatctagtgagatattaccagaatcaggatcatagaaacgctctaataaagcaattatcgtggacttcccactaccgctttctccaacaagtgctatggtctgtagaaaaggaaggaaaaggtttagtcataactatttcagtgcatggaaatgctgagatgcaaaaaataaaatgtaaagttgtgtactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagagttgtgtatcaacacatatgatgtcacggaagtggatgggtcacactcgcatctattttgaagtatgttactagttgtattatgtaaatagttcaataatcaagttaattttctgatggaaattttgggcatgcactagtttcaagaaataggaaaaaggaagacaaataggtgaatgtggaagtataccttttgggaaggaatgtgcaaggtaaagtcactgaatatttgaacatcagggcgtgatgggtacttgaaactgacattattgaaatcaatgctgccagtgacgttttccattatcgctccctcgtcgctacttgaatcaatcctagacttccgatcgataatactaaaaatggaaatggcagaatcccttgcctttgttgcattagtagacaatgcacttgactgcgaaacaccaacggctgccaaaactaaagcaaagaaaacctgaaaagcatccagcccatttgtgaatgatactagaattaatattcatataggcaattgttacttgaaatactttaggatttcttactttgaaaacatctgaaaaagtagtttttccctgacttacgaactttgcaccaacatagaagcaaagaccgtaagtcagatataacatcaagtttgagaaacttaagccaatccctccaacgattccgcttcgaattccctgttttcttaaagcttcacatttcttgttgtatattgccaccactcttttctctgaacagaaagatgctacagttctgatgctgcctacagcgtcagccgcaacttggtttgcatcctcatacatctcctgtataatgagatcccattataatggcaatcaatttaattctagatcacttgtctagatcattctcaataaaacagcaagcaatttttacagttgtaagctgtaatgtgtcaccttagattcttcactgaaccccttcaagaacttaacttgagcatagccctgtgcacccactaaaggaattacacaagtgatgatcagtgcaagcctccaatctgccgcaaaagctatggcaaagccagtgattagtgtagctacagcctggactataagggccaggttatctcctactaaacggcggacattcaacgcatcgactgagagccttgtaccaagtgccccactgtaagaaataagatggcctcttagcattggtttaaatgtaaatatttttttataaaagataaaatagcaaaagtacattagagtagcgcacctggaattggagggcttatcaaaccaagcaacctcttggtgcataattctttgaaatgacagtgtacggacacgctgtataagctttcccccagcaattccaaacaaaaaatattctgctgggattgaaatcaaacaagcaacccccagaacaacagacatcaatgcccaaaatctagaatcttttcgcagctgatctggcggttcatagaatgattttagaacacctggcattattataccgtatagtggcaaaatgactccatgcactgatgctgctatagaacctaacaaaagaactggcacttctggcttattaagattaaaaagccgtccaaatggtgtttttttaatggccttactgtcagagtggtcaaccttttgttgttcgcttgtcattccatcctcatgtatatcaacaggcaatcctaaggggctcttgaaggaatacctgttgctcttgctgagaaaatctttagttcttgatcgtctgaatgacaaactagtactttttgatctggaatctggtagtttatgcctttcatcacgatgagtctcttgtagcctaattagctgggagtaagctccatcgggatccttcaccagtgcatcatgaggacctgtgtacgcaggacatgttttggtataatgaatcatttaaggttgaccgcagaaattttctataatagaaaaacagtgcatttcaagttaattcaaccttgttcaactatttttcctttgcggacgactgtgatgcaatcaacattcctcacagtgctcaaacgatgagcgacaacgagtgtggttctttctaccatcattctatttagtgcctcctgaactatcctctcagactccacatcaagtgcacttgttgcttcatcgagcaaaaggatttttggatctttgaggatggctcttgcaattgcaattctctgtttttgtcctccagagagctgagtaccgcgctggccaactaaagtatcataaccctggtatgacatgaaaacattgttagctgattatttcattaatatacaattaaatttgagaacttggagcattcagtttttcctttcttacatttggtaacttgtcaatgaagttagctgcatttgcaagctccgctgctctcttgatctcttcaagcgttgcatcttttttaccatatattatgttatctttaatggaggccataaaaagcagaggctcttggctaacaagaccgatcttccctcttatccaatcaagtctcagtttcttgatgctaattccatctattaaaacttcgccagactgtggatcgtagaatctttcgactaggctgataacagttgactttccgcttccactctctccgactatagccattgttgttccactcgctacttgtaacgacaatccatccaatatcaactgctctggtcttgcagggtaacgaaagtacacatcctttagctcaatatcgccattcatatcttctaaaaccatgccattgttatcatcggaatctatctctggtttcctctcaattgttttgaacaaattgtatgctgcagattgaccttccacaactgcagcaactgcaggtgttgcattgcctaatgagctgtcacaaacaattggaaagtgccatgttcagaacattatataccatatcaaatgataaaattttaatggctattttgttgtaaatctttcaactttaatgtgattttaggagaaatagcaagtaatgtaggtaaagcagtgaaacccaatgcaatcgtttgcatataacatgtaatgtacttctcaggagaatattctcttcgtgacgattccaaaagcctagcgtttgtctacttctcctgttagcgcagaacatattgattaaacctgctcttgcaattgctaaggataccttgatttagctattaggtacttatgtctatatctcagttcatgatccccttttactaactggaattaataactactccttagcaattggtatgtctgcctaaaatggtaatagggcctagggattatgtatagtcaagcaattgacttgaccatcaaactttaagttcattccattctgtttacaagaaacaagttactttcatgcattggcaattagcattgtctttttgtaaatagtaatcaagaaaatattgaaaataatttaaggtaattctgaaaatcatcttgaaatcctgagaagttttctaaaaaacacctgagaaatgaacaaaactgccatttgcacttctaaaattgcatgctaaccagccttcttgattttgaggtaatatatataaatttcttgttatatttccatcaatccaaataatacatgaatagattgggggttcattattgtagtgcactaaacagcatgtattttgatatcaacagtggaggatttgctgaaacttacgatgcaccggtcaacacggcaaacaagatagtcatgatttttcctcctgtgtaacctttctcaatgattagctttccaccataccagaaggctaatccatagctgccaaatacgacgcacatgacagagcccatgccaaaaccagtgataatgccttcctcaatagtagccttgtatgacttctttataaaattacggtacattgctatcgctttcttctcaccattgaaggacacaacctgttaacacaggatatttatcaaacttactgtctgctactccaaaaaaagaagtgtgttatagcattaaacaattcatataaatatgtgaaactcactgttcttatagatccaatggtctgttcaactgtgtccccagcatcactatatgatgtttgtctcttgctagaaactctagttagggcctgtgcagaaactgcactggcaatagcaattaacggtagcgatgttagcatgacaagagtgagaagccatcctctagtgaatgctatgataaagccaccgatgaagcttgataacagttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63165 - DNA, 1387 bp, Oryza sativa
atgttgttgtactgacatccaggtggtttaggctctctttgcagagtagatccaatggaagagtgccggtaagcgcgttacccgataagtccagcattgtgatctggggaagaatgttgccaatgccagaaggaatggagccactgagtctgttgttagacaaaagaaggccttgaaggcttgccaatggtacaggccatggaaggacaggtccacccaatgcattgaagatagatcaatggttgttatgtttctcagctcagcaggttccacaggtatagtgccccttaacaagttgtcttgcaggtgtagctctaccagtatcgaacaattgttgattgctctcgggatgtgaccagtcattctgttccgcgacagatcaatcaatccaatgtgttgcacgtactccaattcagaatgggactcgcgcgagaaagccacgcatagctcagaagggatagcgcctgacagccgattccgggacaggaccaaggtgttgagctttgtcaagtgaaatatggccttggggatgtgccctgtcagattgttacagctcaagtccaatgtgacaaggtttctgcagttgaagagctgtattggaatgtcctcaaaaagcatgttgccactgagagacagtgctgtcacattccttatagccccgatcgatcgagggagaggtccttgcaagtagtttcctgtcgatgctcaacgattgcaagctcaagagcttaccaatgctctctgtgatcatgccagttagctggttatcactgaaagagatgtccaagatggttgatgattcccataacctgtcagggatcatccctgtgaaattgttatgtgacaaatcaagtgacaccagtggtagcaaagctaagtattctggtatctctccgtggagatggttatctagcaagcttagctcagtaaggttcttgcatcccttaaatgtctcatcgatactcccggtcagattgttatcattcaatctaagtatctgcagaaaggtgccttgacatatcttggcagggatagatcctgacagccggttggattctgcagagaaactaaccagatgtaatggaagacccggtagaggtccgtcgaacatgttctgcgcaagcgatatagatgaaacattactccagttctgaatccaatcaggaatgtggcctgagagtctgtttccttccacatcaaacaagacaacggcaactaaatctgcaagttcttcaggtatagtgccagtgaagttattgccggacagaactagagtagtaagcttcttgcaattgccgagttctttcggtatgctcccagtgaaccctgcactcttcgcaatcagctgcctcagattgcgtagctcaccaacagatgctggaagctc

SEQ ID NO: 63166 - DNA, 1225 bp, Oryza sativa
atttaaggttttcgtaatttcccatttttaactttagttttgggccgctaagaatctatactccttataaaagagagcaatgttgccacctcaccaagtttttttttatttaccgactaccccatcatgttttcttccaattactctacatgctttaatgttataaaataatccttctacatatgattctatcttatttcatctagaatgaaattgtcccaaaaaccttaatttgttttaatccgtataaaagcatgattatttagctagtagaaatataaggtccatactctatagtctatagttatttatcgccgcttgtacacatgtctttgtcttataagccgctactcgcattaaacgagagatatattaaaaaactactaaccgaaacgtaattacttgtccgatagtagaattgacttgcgcttactaattacgtttcggatagtagtacaactactccaactttaaagtttaataaactccaaaactgcacgcttgtactgctatggtcgtagtagagcaagtataatagtagactataagccggttaaatattgaggtggaggagaaaagagaggagagagaggagaagcgggctataaacttacagccggcttagacacaggaaccaagaaactctacgagagagacatgtgagccctgtattaattgtaaggagctaactattatatgggtaggctgagagaatgctacacagaaccttataaccaacaagtcggctgtattattaggcttgctcgtagtagaagtaaatgtacgtgacccgaggccgcacgaccgaatcgaaaccaatcaaccaaacgagcgggtcggaattcgggggagaaagaaatggatcgtgcttaccaaaaccgcgtcccggtctcgcggcggcgccggcagccggacgtagcagccgcagcagcctaccgcagcagggggatcccgcggcgcctgcgtgggctcgccggagcgaacgcgcaggaacaggacgacacagatcgatgcgcgattacgatccgtacctgatttggtttgatccccccacccccaccccacaatgcggttgccggcgaacggagcacgaagaccggtggcgcgggcggaggcgcgaggtgcaatcaacgccggcgagggcgagcgggaggcgaacgagagcatgggagccatggcgatcgacgagaggggaggatttatagtggggagagggagagagaga

SEQ ID NO: 63167 - DNA, 1035 bp, Oryza sativa
tctcaaccaagaattgcacggaaagcaagccgcaacaactgaatttcaagaacacgaagccctccttatcccctcggacagatcactccctccgagtccgatgactagtcaaccactaaccactgagccagtgattcttggggagaagaggagtagaaatcggcgcccttttcgtgggcggataagaaaaaagggggcaagaaatacgcatcaatcatcgggtaggatgagagcgacggcttgtgggatttcttgcacccaaaaagcagcaacgacaaggagcgacatgaaagccaagccaccattgaagcatccatccgtccattcgagatccagcaaatccatgtccggccatccccgtgacactagcagtgagcgccgcttgcttgcacgccggagctaccgctcgtcgtcgaattacgacgccggcattgtccctgtcaaaatcgcagcaacgaaagctggccgcggcgaggggcgtgtgcacttcacacaggcatttttcaaaaaattttttcttcgaacttccaacttttccatcacatcaaaactttcctacacacataaacttccaacttttctattacatcgttccaatttcaacaaaacttccaattttgacgtaaactaaacacaccctcagtcgtcgctgatcattttggatgtgtttcccaacaaacctccgtcccataaaaaatcagcctaatactagatgtgatatattctaatactatgaatctatatattcatctgattcattgtagtgttctagatttctttttttatggagggagtacaatttgtagagtaccattaatttacaatatagatttaaaaatatgtattataaaataatagatttaacaccatttaaggtagttttcatgtttgaaatatatatttcattttataaaattgaagctaaatttatagttttgtgatacacatatttcaatatgtacgtagttttacaataatttgatcaaatgtagttttataaaatttactcattaggagtcattaggaggttgtcac

SEQ ID NO: 63168 - DNA, 1202 bp, Oryza sativa
aattagaaggacaggctaatgcgactgcatgtctgcatgctcgcagcttgctcaataatgtggcatcagagtgcggaaggagtccaagattcaacattaattgcagggcaatcagactgaaattcccttctttttttcacggaagtttcaacattgaataataagaactttggtttccactctaaattagaaaaatgtgtatttctgtgcatgccaagcaagtaatgtcacctgtgttaatgcatcaacaagttctccatctatgttgagtgcttctgtacagctacttatagcctccttgcctcttccgagtttaaccagaaccttacatagcccaagataaagatgtacattgtaagaagtatgatctggatccattgctagggatgccttgtagtcctcagcagacacacgtagcttacccttggcagcattatcttcagcctgcatgcacaccatttgatcctattactatgatgcagtaagcccctaatttgttgatacaaagaaatcatactcacactcttagtcttcttcacaagatttttcaacccaaaatatgctttcttcagttctgaatgttcagggtctagacgaaggcctttctggtagtgcctaaacaattaatattgtcatcactgtacaaatatttaaagctagcacatttatctagtactgcatttgtgtgtgcaggcacaaacaagcatgcacttgtccaaacctaaaataccagacacgctttacctggatgcaacatcatgatcagcaaggtagtaatatgctcggccacgaagcaacaaggcatccaggttatcttcatcttccttcagaataaatcctgtttctgagataacagttgagtagtctttaagtgctagcaatgctttagccttgagaagcttcgcctgaaaaatccatttttagtactgcagcttactgagacaaaattagatgaaatatttatctgtccatggttcctactatcctctgaaatatacctttaagcagtctggagaaaaaacaagcacaattttgttgatgtaatccaggacttttgagaagtcatgagactcaaactggccataagcagactctaatgcattttgagcctgaagcagttgagataattccttttccactgaagaactcccaggttttagctccaggtatttgctatagtcaccctccgcttccttgaacct

SEQ ID NO: 63169 - DNA, 716 bp, Oryza sativa
gctggatcgaaaccggcccaagtagaggcgcgtgctgggcagcttccccagcccaggtccaggttgcggcttggggaggagggagtgcccgcacgtgcgcataatatgccgtgggctgaccggcaggccgggaaaaagtctattctaggtccctcggccgaagaaaagtaccagctaggctgggaaaaagtctgttctaggtccctcagccgaagaaaagaagtttaattttgtgaagtagaaatttgacgaaggctagaattaaaaataagaaatattgaaataataatagcgtagagtcacggtcattgttgtcgcggaagggaagcggacggccagatgcggctgctacctaccgtgctacggtcatcgatcggccgtcgattggtctgagtttgctcgcttattcgctggtcgaccgtgctgctgagccaccccgtagatctacccatatcttcagagtccatgttgactcgcaccgtataaaggtggaaatcaaaccggctttgtttttttatctccctttcctcggaactatatttctttctatcatttgagactttttctagcgagcaaaagtaccaaaagcagtgtaagaataacttcggttagaaccaaaaatttttagttttaatacaccgtagcgaagcacgggtattttgctagtacaatatcaaatagagaaagtaagcggtcatcagattgatcggtgtaga

SEQ ID NO: 63170 - DNA, 717 bp, Oryza sativa
agcgtttagctgatactctgagtactgagaatgaggaatcttgcacaacctacaacatgctcaaggttcacaatatcaaaccactctcctgaacattcaatctctctctctctctctctctcaatgggttcaatgcaatctactgcaggtttctcgcaacctattcagatggacaaaggaattatcatatgcagactattatgaaagggcactgataaatggtgttttaagcatccaaagagggactgatcccggggtgatgatttacatgctacctcaggcccctggacggtctaaagcggtttcctatcatggttggggaacaaagtatgactccttctggtgttgttatgggacaggtaaataaaatgcttctgagttctgcttatttaacactgctgcttttacatgaaaatattgcggtaacagtttgtcaaattaataccgtgattttagtattactttgcttgtgttttcattcgaagttgtgaaaatttgaattgaaaggcaatttatcaggtggcctgtttctttatggatcttctatttcatttacagggatagaatccttttcgaaacttggcgattccatttacttcgaggagaaaggagatagaccggtgcttaacatcattcagtacataccaagtgcttataactggaaagcagctgggcttactgttaatcaacaactaaagccaatcagctctttggaca

SEQ ID NO: 63171 - DNA, 1428 bp, Oryza sativa
  unsure (1)..(1428): unsure at all n locations
taatggttgtccttactatcctgtaatttagaatatgcagccaaagaggaaacgttttgtttcttctgaaattgtaggataatttttactgagttcagtgcaatgttgtgcaattatgagttttttttctgtggcattttcgtatcttggtaattgaaaatgctgctgaaagcctgaaatacagccattctgcaacatatatgatgcagtagatgctacttcctctgtttcatattctaagtcattttagatttgtcctaactcaaacatttctaagtttaaccgagtttatagaaaaaattacaacactaaattagttccactaaatttattattgaatatgtttttatagtatatttttaattttgtgttgaaaatattgctatattttttttataaatttgatcaaacttgaaaaggtttaacttaggataaatttataatataaaacagaggaagtatcatttatctccattgttctggcttttgtccggtaaacacaagagggaaaaaaatcatctgttcttatcaggattgcgtgatatacactataatggcattagtataacaatataagatcagagcaggtaacagcagtttaagtctcataaaatacatctccagcgactgagaggacgacaaactggagattctatccaattcaataaactactgaggaatctcagctgatcagagctcaccattagtgcctgcattgtttaatgcatttcggcttaacacccggcaaaggagttgatcaatgtacccatcatgcctaaagaaacccacccaaccacaatggcacaaatcaagggggaaaagaagtcatcctctgcaaagaattttttggcacaacttggtttattctgcaatccatagtcatgccaatccatagtcatgccaatcaagtgatataacaaaatgtaagcatctgtgaaattatccacctaaggatttcaattggataatataaggggggcagaatttggtagcagatgtcagaatctgtgaaattatcaatcgaatcagaactgcagctgccttgccccaggaaattaatcgaacaaaatggttatcttcgtgacaccaatatgtatgctggttcagatcacaagttaatagatgtttgaactttaagtgcagattattaantanatnnnngattactgaaacagaacagcttcacatgctgaactttcagtgttacatgttgcagatctaatcccnnctattctcagtcaccttaaagaatgaccatttggggatagagtaataacctgagaactaacttgtcttttgtcacaatttcctctcagatccgattttcaatctagagtagacccagccaaaccaagcgcaatccggcaaacttctttgaacatacatgaatttgaatgcgcaccagataaaggtgcatacataaataat

SEQ ID NO: 63172 - DNA, 821 bp, Oryza sativa
ccttacatgtgccatattttggccaacaaccaacgttggattgctagagctatcaactcttcttgccatgtctgaaactacaaaacccatttatcctatcttactataaagttatcccccactaactccttaagcttaacatgcaaagatgccacatcatcatctactaatccactaattaacaagatgtcacatcatcatccactaacaatcatcacatttaaacatcatgcaaacatgctatatatttatagtttttataatttaagagcttttcaaatacaaacatgttaaattatcattcaacacaattcacataatgtttcaatgtatatttttattatgttttatgatatcctatatacttatatagttcatcctcacttagttagtgcttaaatgattaatctatggtccaaattatctttctccttttttcctctaattaagtcatatcacatcaattatttttagcctttagatgattaatttacggtccaaactatctccctacttttcttctttcataaagtcataccaccttactttttacgtttgaataaccattctacatactatttaaatttaaattatcataaaccacattaatttacttaatctgatgttatctagttattttacacgttattttttttgttatcatattaaattcccgcagcaatgcgcggggtttcacctagttattactatgggcatatttggtgcagctccagatatagcaacatctctcttggatcttaagcctaaccaaacaaaaaaagtttcatctaaattggagtggagctggctagagcgctctc

SEQ ID NO: 63173 - DNA, 817 bp, Oryza sativa
ttaagccaggcagccactttttttgcaaattctgaacctgacatgcctgctgcccctgtacctgcagcccaggttcatgattggatctcacagaatatatctgcttcactggaattctctaccgagaagtccatatcaaaggaagttagccagcaggttacttccgatataaaagatacacaatggctgatgccaatgctagtaatgcaaggaacagcacaccgactggtacaaatcctgcatactacagaaacacaacatttgtggaaggcttctccaaaacttctgttgtcaagcacgcgtctgatgtcaaaggacattcagtgaaggtatggatcatagctgcttaccataaactatttttggatgctgaaaagactacaaagatatgtcacttttcacatttctacatgtttgcattgtccactaaatcccccgggggggggggggggttaatgttgataaaaagaaccatttatgcgaatctagtttaaaacagtttcaagtgttttcatatgcttacatatcttgaatgtaataatttattctagtgctactcttagtacaataaagaatatgttttaatctctggatttccagtggagtattagtttgaaagggaaaaacattgttagccacatctgggtgattaaggagatgatggcttaaactggcattatttgggccaggatatgtaaaatgttaaacgaagcgaaaaatttagatagctatattttgggacgcggggaaataggctgctaagtagaattgggatgagaaaacaaatatgacaactgttctcatgatgaaaattttt

SEQ ID NO: 63174 - DNA, 4549 bp, Oryza sativa
  unsure (1)..(4549): unsure at all n locations
cgatgtattgggtatccgannnnnnnnnnnnnnnnnnnnnnnnnnnnnnnnatcgatcgatcatcggatcatgcatatgaaccgaagaacagaacagctcgccgtaatcatattattcgatcatgcaacgcgagggtcggcccgggcggccggcgtgtgtgaactgcgcaaatttgacctgatggacagtgatgaatcgagctgaagatggacggcaggatttaatccctgccgcgagaaccggagccgcaatgcatgcgtgtcgactgtatagatacaggatttaatcacgggcagtttcttgtttcacatgtactccgttctattaaaaaaaaccaatctagtattatatgtgccacattttattactacgaatttagacatatatatattcagatttatcgtactagaatatgtcacatccgattctaaattcgttttttatcggacggacggagggtgtacacatcctacacatttttctttctttttttattttttttaagaactacgcatcctactcctacaacaaggtgcattaatgtgagctagctagctagatagccacaactcatatccttcatgcggcatgcatgcatatgccatcatccttgaattgcgttcgatatattattgctgttttcttgaaaacttatactccatatatattattgttgttgtagatagacatggataaaatgctcttgcaccaaacgtcatgactcgggatacatatagtgctcaaatatgaatttcgcaagatgtatagatttatttatttcttcaacaaaaactggaccaaagtttggatatgcgtgacatgctttttaaaaattactaaacgatatgtttcgtgcgaaaacttcctatataaaagttgctctaaagtttggatattttacaaaataaataactaaaagtcaattaaaaaattaatcatacgttgataccatatcgttttgcgtaaaacacttaggccgtgtttagatgctgtaaaaaattggccaattttttttgacgtatacggatatacatttgaagtattaataatgtaaactaataacaaaacaaattacaggttccgactataaactgtgagacgaatctttttagcctatgtgctaatcatgacgtaattaggctcaaaagattcatctcgtgatttacagccggactgtgcaattagtttttgtttttgtccacatttgatgctccatacatgtgtctaaatatttgatgtgacgaaaaaattagaagttcgatgaaaaaaagttggaatctatacacaaccttaatcttaatcttcatccttatctatatatgaatttcaaacaccaccatggtgttcgaatatgaatttcgcaagatatatagattttatttatgacgtactacttgtacgttcgttgagcgtgtattaaagcccgtttagttccccaaatatttttccgaaaaacatcacattgaatctttagacacatgcatgaagcattagatgtagataaatgaaaaactaattacacagttagggaggaaatcgcgagacgaatcttttaagtctaattagttcatgattaactataagtgctacagtaactcacatgtgctaatgacgggttaattaggctcaaaatattcgtctcgcggttctagacgagttatgaaattagtttttttattcgtgtctgaaaaccccttccgacatccggtcaaacgtccaatatggcacccaaaaatttttatttcctcaactaaacacaccctaagtgaacacatttatatctggcaaggtggacgcggtggtgtgtaacctgaatttttttttagaaaaaaagacgcatcactctatatatacgtgtgtaccctgcaggacaagccagtgtcacacgacgcctccgaattcattttcgattcctctcctctcctcttcttccaccgcctaacgaaccactcgccatcaaagcccccagagagcgcgccatggcggcgcagcggcggtggccgacgtcgacgctggcggcggtggcagtcgccgtagtagtactactggcggcgtcggcggcgacgacggcggaggcgcagtcggcgccggcggcggcgccggggccagcggggccggtgctggaccaggcgtgcctgacggcgctgctgaacatgtcggactgcctgacgtacgtgcagaacgggagcagggcgcggcggccggacaagccgtgctgcccggagctggccgggctggtggagtccaacccggtgtgcctctgcgagctcctctccggcgccggcgactcctacggcatcgccgtcgactactcccgcgccctcgccctccccgccatctgccgcgtctccacccctcccgtctccacctgcgcaggcaatcaatcacctccctaatctttaatcttattaatctcccccaattatcactttaatcacttctagtagcagtagcagcagcactctctccataaaaaaaaagttaaactagatttatatcttaattacttattattggttgcatatagagatatgtttctttgtttttgttatatgcatactaatatactactatattaggtaaaatggtttcagatttattatttgatttcgatgctactcatcttttggcatatgcatattgagcatacgagtgaaattgatttgacagaatcgagcaaatgattgctagaattggtttggtttttgttatatgcaggatatataggtcttaatgataaaagtaatagctctatacttttggtgagggtatttgcttttgattagtaagcatattatgggctaattaagtttgggaaataattaattttgcagcctttggattcaatgttccaatgggcccaacgccgtcgccttcgccggcagccgtctcgccctccggtgagggcccacagttccctggtaagcatgtacttgctctcactaattatgttgttcgttttgtacttttaagaaaactggagttattaattagcttgatcattcgccatagcttttgttgagtagaattgtagaaatatgaaatatccgtagtttaattttgattgtttgtcagtgatggctaaggcaggaggttcacaattttgaaatgaagtattaggaatttaatgtatgaggagcctccggctatagatattttagtttgatttagtttggcaaagatattgttctagttcagtaaatcagtcccttttagcgtttgaaatatctgaaattgcccaccttttttttttttgaaattccaacatataaaagctgagtaatacacacgtcacataccagcaaagatttagggaagcatctaattttaaccagagatttgtgtttccagccggattttttttttcaaataatcttttttcacgctgtataaaaaagatgctgatgaacacatcactactaatgcatactacaccagtaaatacgtctcctaactcacattgtctaatatgctttgccttatacacgcaaaaaaaagaaaagaaaaaagaagagggaatcgttatggttgttgttcatacaatttgtgatgatgctatcatagaggaataaacatttaatcggctacatgtacaaaagcatcatatacagtttatgatggcaattaattgctcgacagtaaacactgacgtgccgtaccgttaggttcatgtgcctgtcacgtatttatacggccgctaaattcgagttcatgtgaccttaataacttcatctgcagggacctcaccgttcgcctcgccgccgtcgacggcgacgccgtccaccaacgccgccgccgccggccgctccggcgaccaccttcgtcgccgtcggcgtcgccattgccgccgccgccgtcgtcgtcgccgggatgtttagaatcgtttgattgatccgctcaactagctatcattttctgggggtgatgtggctgtttgtttgtatggtccttgctgatcataatcaaattcctttttatttaaagacgtattaagtaactataaaattccttttgatgtaaaacttgctggattccatgacatttgtccttgcaaggacgtatatacttatcttgttcatatgtttgatgtgatgactcacaagtcgtcatgtaaccacctagtgtggtatgtgagaaatactagtactttttctggttttatgttgtcacaagaacagcatgagcaaagttcaaaaaaaaaaagagaacagcatgatgataagaaagttcttccttggtgcagcatatctactatacttcctttagttacattttaagataatccaaaaaataccattaacaaacgtccaaatctaagaaataccatcgacaagtataaattctaaataccatcgacaagtataaaatctaagaaatatcatcttacaaacgactttgttctaaaattaccatcatcattagggtttcgtccattccgcatttgggataaaactgttttgtacgatgtttttttttagaactcacatttttcgatgacatgggtaccgagctcgagttcgcctatagggatcggcacttcaccgcgcg

SEQ ID NO: 63175 - DNA, 2216 bp, Oryza sativa
  unsure (1)..(2216): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaagaattgtgttaaatgttatctcctgttcttgcagagggcaggatgctactggcgaggaagtaatcaagccttatactccaactacgctggattctgatcttggacggtttgagcttgttattaaggtaaaatttcacaaatatgttccattttgaatttgttagtcttgtctcgctagctttgtgcgtaatgtaaagctatagtccgtcagaaatgcaattatgtcaattcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttgagctcaaccgccttctttacctactttctcatttatatgtaacactctcactctgtctatcatatctttacacttactacttatttctcactctactacataccatcatcgaatatatattttgattttatgtttggtcacacactctctacttatcattattcttcctcgattgtagatctatttaattcactacattccaattttatcaccccatctcttatcgtattccattctcacactccacacttgccttgtcattacttcagccgctcacatcatgccttctttctttttctcattagttcgtttaacttagtaaccattctccatcctcttccagcctttatttatatccggttacaatcattcttacgctactctcttacttccattccctttcctatccatcttttatcttctacaaatataatgttcattcatcgtgaggcttctgttcctcttactccattctacttaggtcgtaatcaatcatcgctctctactcatctctctcctgacatttatcttctaatagtgtgcatctcttgccactagctatctgtcatcatacccactgatacaagtaccggcatccattctattcatcaatgtagttcgacatcgtctgtattctttccttcctgcttcactcatgtacagtgataacgaagatgataatctccgccgctcaattttgttgcgcactattgtgtacaataacacaattttggttttctccctctcaccacatccttaataaacgggagtttatgtctgctaaacaccctgtgcccggtgtttctgttacacattcctcacaaagagatcaagaactctattttctgggcgcggccg

SEQ ID NO: 63176 - DNA, 15619 bp, Oryza sativa
  unsure (1)..(15619): unsure at all n locations
caatttgttttattttttgagagacccccccatactctagggcgctcgcggcccttctttgaaaataaaacacaccccgtcttcacaaaaaatggcctaaaaaaaggcttcccctcgggcaagaattggggacccaccaaagggttgttttttaattccggccggtcgcctttagagaatgggaaacaaacacagtgttgtcacagagaagaaccacaattgggaaattttgggccaaaacctctcaagcacccatttattttaacccttccgtggataacacaactcgcccanaaaagcagttcccgttattatttccattggagttcgaaacaatggttgcaattctctcccaaggaacgtggaaatgcggctgttcccatccatgaatctggggttcttaagcacttctcccaagccaagccctttttcaccactttccattgtggtacaggtccaattcctttgtgtgtaataaacccttgtcgaaatagggcttacacggatcccattgggaaccaggacccatttctcccccttttaatgattgggcatcaagcgtgaagggctcaatgaatcttttgaaagcatctggggttaaggttaaaagacaagaagtgcatcccccttttggtggtttccctgaggtagcagtagtatatcaattgagaaaggcataagatatattaccaaaaatcatgggaatcataattacaaccaaaaaaaaaggaacatcgggtaggaaatttatacctgcaacactttttttagcacattctgacaaggttgaatcttcattgtttgtgccactttctgtaaactcctgtttgacaaatgtgtgtagagaaaatgatgcaataagagatcccaaaacaaattcacaaaaccgctgagaaagtaaaggagcccatgcttggttgtggcctgttggctcagatttctctccttttcttttaaaaaaacaccgtggagacaatggagtaaagaaattacctcagctagagggaaaactgtttctccaccttctgcaacatctgttaagtacataagaacagtagctatgcgatgaccaccacggagagtgttaacattgtcgctgaagtaatcatagtgccgttcatacttctcgccgtgcttataccttaacacttggatatcctcaccattctctgattattatcacataatatgtacaagaaaaaaaataaaaacacataaagttaacataaatttggattatgtatgaaggaagacaacatgaggacacataaaaaagaatccctactatcaatccccacccaaaaagaaaaaggaaaaannnnnnnnnnnnnnnnnnnnnttcaatgacatactgcttgaaactaacctttggatgaattagccccaaagtcaggtaaggaggctcaacattaaaggctttactttgtttattttagaaatgaaatgccaagtggagcataactattttagaggctttcacttcaagactgcccataggtacaggaacgaaaacaaaggcccagagggaggttgattattaggtgtaaaatgacaatatctcacatgtgtaagttatgaattatatagaacatctaagaattgcatgaatagtaaagtgcattgttattgtcttaatggagtcaaatacctttaggaagaaatgtccacgcagcaattttttcctctataccagcaacaattggatcctacaaatttggacatgattgttcattacataagaattatgtaaatttaaaggaaaattctcaaaattgggaggaagaatcctctcatttagccaagaactactttaagttatattgcacatctatcttcatacactaaaagaccccctttattcaaagatacttttcaataaaaaagatgaactcacactccggatgaacaaataattcaaagaaaaaaaaacgttaatcaagacctaacctggctcttgcggatgaaggtgccggagctggtgcgggcgtcgctgagctcgctcttgccggacaggttatcagccaccgctgacctcttgagctccgttctcgcctaaaaaaaaacataaatcctctaaaaactcaatgaatcctgggcatacagagttcaagcatccacaagaactcccgattcatgcagagaaaagaaatgaaaatttgttggattggggaggtggtgggcactgacgagggagacgaggtggttggcctcgtcgtcgctgaggaaatgctggtagaggaacaccctgccatggatcacgcatcagtcagtccatccaatgtcgagatcgagacgaaaccaagaaccaaccgatggcggcgcccgcgcgagcgagagaaagtgaacctgggcttccaggagatctggcgggagtggtgcgggtacaccacgggcgccgggtacaccgagctccccttcccgcctccacctccgcctccacccccggcagcaacgccaccgcctccgccgccgccgcagatgaggaggaggacaagaagcagcagggcgccggaagtgggagccccgagccgcaccggagccatggcagcggagaattctccgtctccctctcgcccaacgaaggcgaggagaaggtggaggtggagatgaaggagaaggcggctgcggcggcgagctgaaggtgaaagtggtcgccgcgacggtgaccgccacgcttcgcggcggagagggaccgagtcagtgatgaggagggaggagatctgagccgtcgaaatcccgcgccgaggagatcggacggccagggcgcaccgggaaatcgtgcaagcagcgaactactagtaacgaacgggtaggtgaggtgagcaacgccaacgcacataccttggaaatcacgatgttttgcttcaaaattactctgtgttttttcatataacggacgttttttttactgagaagtgagaaacacagtattaaacatatgcgtcctcagcgcgcgtacacttacaccctacacatacgaacacctttaaaagactaggcgtatatcggctaccactgaaataataattagccataaatacaagcacccgtgtcaaatctaggatttgaatttgggtggactggttccaccacgagaaatctaaccagtcgtataaaagtcatataaaaatggagcctcaattactcctcaattttaagccatatttgttttaaagttatttacaaaatattaagattaaaaaagttctcttttaatcatactaatagtcaaattttagattatttataattgtaccataaaatatgattagccagaaatgtatggatttttatttattggaatcagtgttccataagttatttagactatggtatataagtgctataaatatttatattttgaaatggatgaagcactaccttttacattctgtcttgcaaatgaaaaagaaaaaaacaaaacaaatggggagtctgttccaagctagtggcttcctgaccagggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgcgtggtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctgttcctgactccacaagaaagtagtttagtcatcagactcggtagacaatggtttttcagcggttgttgcttgtctcttggaccacagtagctacttctacttggattaaaacaggggcatcaagttcatcatgctgtctcatgttaacacatcattccctcgcataacattgtcaaaacagtagttgaggaaagaaaggacaacatattttctactactagctgattttgttcagtgataagaaacaaatcaggtaacagataaggctaattgttgaagccaaataaagatgtggtgatgtacagttcctctgcagaataagcttcgtgcactaacaactgcactcatttgtcagggaaaccagaaatgctgacctttcttgttaagtttgcatttctggcttccagttgcagaaccctctaaggctctaccgttgaacttcaaggtgagcagaattcagatataaaataggtttgcataaatgttcttaatgtgattgaaggaatgaaattcagctgaaaatcacaaaagtttgtactcattcgtgagaaagaagtcgatcgaagccagacaagaagaccatggtgcacttggccaggtgaccaaaattatactgaacaaaaaggaaaatttacagacgtagctcaggtgaaacatccactgtacattgtaatcatacttaatttgtgtttatccatgagatagtcacataataatcggcaaatcaaagccaattatgagatagatagatagatagatagataacataatgtacattttggaataatgcctcgttctcagtacaattttgttacagaaaagttcaaactgatcagacagacacaataatacaagggggtcaatggattctggatagctatgcataggcacacttgttctacccaaaagaacaaaaagaatgtggaaaattgttcgagtataatataatcacctttccctttggaaagtatatatgcactacattttctgtacgacttggtaatcacctttcccctgtcacaaaaaaataatctgctttggaataaatacctacaggtgccgatggaaatattcttcagtatcttagtacaagttgctgttgctaccaatttaatttccaatagggtttaggtcccagaacctgtgcaatgcccatacaaattagttttgtccatgcatatactgaaaattatgttgtttttatggtaaatttaaatcaagagtcaagaagctgcatacctttattgcccttatttttattagccttactcttactagttggtaagagttcttcagcacctattctgatgttggtattagatgatcgcctctttgatctgctctcttgtatttcaacatcaacaataaatgttccacagacaggacggtgatccgaaaatttggactccccacggaagtaggacaactgcacaatgccatctccatgccatagtattctgtcacacctgaacaagttgaaactattaacatttgaaatgcaaaatgtgcagcagtagtgcaatgcacacagccagtacaccaagccatttgtctgatatatatttgttagtatgatgcaatatttgttcatgtgaatgatttcatcgttttctatttctacgacttcaaccatcatttgtccaaatgcgcactggttcacgtcaagaaacccaaaagatgttcctcttctatggtaatataagatgataatgttggattactgaagttgcacacaagcatgtggacaaattataatgataattaaatggtactaacttaccaataaagttgtaacctgacacagtgggaatacatttttatagtaaaactaactaatatgaacacggtacataccagccgggggttctcctctttttctttgatgtggcagtctctccagcataagaatctgagttactagaatacttgtatgtgggagcaaaatatatcttctcctcactccaacccttgaacacccttccagacttgcgctcgatgttaagctgaaaaagagaaggcaaccatgcatgttaaccaaaatttcacaagatataagtagattatagcctggctagatataattagaacatagagcacacatacccagtagaagttcttgaaagtttggttttatcgtttattactttagtcctttccttctgagaggaagtttcaaaaaacagtgcatcttttgagaagtttacctggtccttttcaaaaagggcatcccagttattttcagtaagaagtttcttggtatcttcatagctcaaggaaatacggtagtttagatctcccagccatatcactcgactaacaaaataagagaaatcacaataattagtaaatgatgattgacaatgaacaaatccttcgcagcatgtgtagcatgagtgcatgacttactcgtggtcaagaattttctcaggaattcttcgcccagctctacaaatcctttgaaattgcgtgagtctcagtatctctaaaacatctaaattccgcctcagctcatcaccctctttctcacctgaagccaaatggctacagatgaagcagaaacttgtctggtgcaccgtcatgctcactgatatacatccctgaagccaaaagcaagtgtggcataaatatgtaatctacacatgagaattgtgaagaaccctcattactatgtcacactaaaaagaatggaaggagctgaaatgtttgctttagcatctgtgttgctctgttagtctgtctggtgtaattctgaaggtcaggagtagtctgagactttgtgtgtaagttggaacctggaatgcttgtagaactactatcatttcattaatgaaatgggagaggtccccctctctttctccaaaaaaaaaaaaagaaagaacagaaggatgacttccggctattaaacattatcaaaaaacatgtcaggctaaatctgtacttattaatataattgtgaccattgtaatgctttaattaacaatgacatcccattacaaggttatgaagataatacttctgaactttgatttaattcttaccttgtttcccagatagcccattattccacgacctatacaagacgttctcacatggcctatatgatgcacaagttctttctttgcccacaccgtgataaaaatcccaaccattcgtttgcacgatacgaggttgtattttagctgatccctggaggcagaggcagcagaattcattccatcaactatataaccacaaggatcattcgatctatcatctgtatcatcttctgaagagtccgtctcattagcatatgcttgtggacatccaaagcaagcatctttgtaggacttcctagtcatctcaactgagcaattgcagagtttgagcagttttctctgggttggcatgtaaggcttcctgatagacttcaaggaggacttctggaagattgcagaactaccactagctgttcttgtgcggctggagaatgaggcatcaaggtttgatgaagacagagacgaggttgaatcaagggaagaagatggcttgtgctggaagatatcagcattactgtcaactggtttgtttagcgttcggtttataagagcaagccaccttgcagctggttcattgtcttctacgacaagcacattaccagcattgagagggacaatttcctgaaaactgcataatatcataagagaatgtgtcaaaaaaaaattagaaaagagacagatggaaacagcgtcttcggttcactgaatgaaacaaatgaacactaaggaaaattagctcatcgtggcaaagcaagcaagttagtaacatcctgaaatcactaggaaacaaattaaaaggagctatttttatttttcatatcactcactaactgaaatatgaaaaatatgtaagatggtgaaaaattggtgaaataacttaccctaaaacataaatatctgaattgtcatcagcaggaaggaagtcatccaggtttaattcagcagtaggcgtgtttcctccgacattccatgtagatacaaatatcctatataatgaattaaaaaattaaagacgacctagtccgatctaagaatgtaaagtatgacaaaccgacggcataaagtatgactcaacatgcaagtttagctgtttgacctgaaaggttcagttttagtagtacttgaagagtgaccaagtaaatggctgaggcgtatgctcctaacttctgcaaaaacttcctttcagtccaaagaaccaaaaaataatccaatcaaaacaaatcagcacatgaatagagtgaggcaatgtggcaaaaatgctaaacaagaggccacctgtaaagtgtcttgaaggggaaagaaaattgtgactttgaggaacttggcccggacttaacttcaattgacaggaaaacatggaaacatttagttgctattaccctatattattgtcattaggccaaatcaacgtaattgtattgaagcaattcgggcaaaatgtgaaatttctgacacgaagttatcaagtatgaaactagagaataaatgaatcctagcatcttcttaaacatatttgaactggctgtctcctcatatatttctcattatacacaatgaaacgaggttcagttgaccttatgaatgtagttggctgattgcccaactgacttgagcaattcccctgattcaactagatgagctgaaatttgataaattatgctcatcttcgtttcaatttatcactatcctacaagacaccaattcagtctagatgcacaattcaaaaagaaagaaaaactaacctgcagaacagctttggtaatctgccctcttcacaactttcttatcttttgttccaaaaagttttggccggcaaccctatagtatacaaccaattacaaagtaaatactttgatttaagttcagtatgaaaaaaaaaatattagggccaaaacatgcaaatagagcacagtggatctgagaatagaattatgctgctatgttttatttttgtgagtgtattgtaatgttatatgaatgatgtaaagcgaaaagcacaaaccttcatcttttcatcatcatctgggaaggccatcccctttcaagtcagagaaaaaaaaatggaagcttctcctttttccagtatcaagcctgaacaaaaatttaacagaattaagtatcgtcaactattcatcataattatactaaaattatgacagtgccatttcgagcaacagttgacgtacaaaaatccactacctagtaagtctcatgaaatattatcaatgcggtctctcatgaattacatgcctgtaaatactgtaagagattccaagtaataaatcaaacatttcccgcgccacaacgccaacaaataccaaaagaaaaagtagttttcatgccaaaaatctcctttctcacaactcattatccttctcaaaccaaagaattcttccaccataatttctacaagttgcgaacaggaacaaagagaaatcgagcatatggaatcagaaaacaaaaattcaattctacagatttccagcagcaggatgaaacaggaacccacccgctcgggcgacgaatcaaaatccggccaacccccgcaagaaaccctccacccccacgatctttctcctcctccaagagcaagcaagcaagccagcctaggatccctaaaaccccagcagcgaagaacccaacgggtccccaaccactcccccaacccgagaaggcgggggcggtctcagccagcaaccgcgagcgcggcgcggagctgctcccccctcaaacccgggtcgcggtctgctctgcgagccaaacgaggaggaggaccccgccattagccagcccaatccccttcttctcccctcctcctcaccaccaccaccaaggacttcaagattaaactaatccgccatgccaactgctagcgagcgaattttctattgccccccccgcattcctccgcgactccgccgaagggtgggggtggttgaccgtgccgccgcggcggcaatggaaaagaggtgaaggcgcacgtccgtcgncgcgcggcgaaagaagggggtggnaatttggcgcggtgggaaggaaagtgaagacggttgggtggattggcccgtctgtcgtggtgtggtggtggtggtggtggtcaactcaactaatccatgatgagtcgaaggcttaaagcaccatctttctcaaggcaccatccttctcaagagtcaagactattttgcttgatggcagacagccagacagaataatgcaatgataaatatgggaacatctttttaagtaaatttcataaaactacaaatttaaaatcttatatcacaaaactacatgttgaatggagtgtcaaaaaaaaaaaaggttaagtagcaaatatatcacaaaactacagtgctaatttatcatagaactacaacatttatatagctctaatataacgttagtactagggatttagactctagaatttgcggttttgtgataacttcaatattaattatgtagttttgtgataacttcaatatataatatgtagttttatagtaaatttaccgctaaatttatagttttgtgatacgatattttagttttgcgatagattagtcggaatatccgtagttctgtgaaatttacttaactgtttttgttgattgaactgattttggtaaagttcttactaaatttaacatggtttcaaactataccagtgtagattggtcgatatggttgatatgaaacacataaaaatgtaaaatctaagagcgtaagaccggtatatcagatgtaattctacttttttaaatttactgtatacaaattacaaccgtacgtagggagatactcctatatgtgaatattaattctattaccagttttatataaaaaacataatcgtatatgaaatccaatccaattgtactttttatgtagctttgcacggggaaatccactttttcatctttaaacctcgacaactcattttcattagagaaacaattacttacggatgtattgcatcctaaacataatcataacgcttccgcacatcctagcctaaccatttaatggtattttgcggtcaaaataaagcaataataatcgccactaacaattacttaaaaacatagatagtactagtgaaatttttactagacaaactttagacaagtttaaatataatcatatatgtttgcatttaaattcattccaaatccagttgttttaaccaatgaaaaaaatagacgaacaataattaattcatttatagtttgacaaataaatccgagtaagaaatgacgtggtccataaaaaagaagatatgatttggtcatgaggccacgagctcgtgggagggatgatgtgggatcatcatctccatcattaaaactagacccctcaagagaattagtggggtgccatgatgggcatttaaaactgatcatgacagcgattttcgccctccatgagagatctagagagggaggggcaatcaagagaagaaagtcatatatgtgcaacccaaagaaataagtagaagtagggggaggcctactacataataacctttaaggtacacatcaaagcttggtcttatctgaaaacaatgtcccttctactttagccacatttagcttgagataacttaacctcgaagattctaattatagcaccagcttagtgcttcttccccaaattacagctctgtgttgatcactgccatcatttgttttgagttaacaaaatgttttgacaaaagtagtagtacatctgtagaatttattttggcatatatatatatatataatataatgtggggtttgtagttttttttttaaaaaaagtagatttcacaaaactacaactatttggtgataactatcaccttgttacacttcaanccaggtctctcattgcttagagtgaattcgaaagagctggctgtggcagcagcagcactgcagctacaggactcagcaagcaagattatgctaggggagctgcagcgccacagcccagctgaaccgaacagacccttaatgttcaactgatgagccgtgaaaaataaataaatgaagcaataaaaataatttatgggtaaaacctttatatgtatgaccttaacatattaaaaggcaatactggacaaatacactacgataaaaaaaactcaaaaccactctaaaattgcgttttaaaattcaaattttgattgtggttgataagctaacaagcaaattatggaattgataattcacaaaattacaacaatagtaaacaattttatcagaaaactacaactttgtacactacatacgacatgtgggcctaaattacaatagcttcaatattccatgtgtgtaataagggctctaaacttatcagacaaataaaactatagttttctataaaacatagttctacacagttctctaaggctgtgttctttcccacattttccaactcgcctctctcgtgttccatacgtacgctttttaaattgataaacggtgtgttttttacaaaagttttctatacaaaagctacttttaaaaaaatcatataaatatattaaaattaagaaaatacgtcgctctgttttgcatgcacgagaggtgaagcctaaatgactaactaaagttgcagcaacatgatagttttgataaaatagttttaatgtcccgaaatttactttaaaaaatggaaccgaatgcttgtgtgcccagcaggcggacgtaatctcctcgctgatgtctcctaggaagccagcacatacgtacagtaacgtacaagacacaatgcatttttgtatgtatgtaataccaaatcaattggagctgctgaaaagaaaaggcgattgctttgctgtcaaagatttgcaatcttgtgcataaacaagcggatgaattgatgcactgttttggctgtacaggacaggagctggaaaagaacagacaacagcttcgctgtcacaggtttttgcatctatggacagacataaatggcacgtacagtagttgtttttcttctcataatcaaatggtacaagttggtcattctttaatcacctgagcaacgagttagctggagcaatgaacgttccaaccttgtgtccaaaattctgattgaaaaaaaaataattagtttcattctgtctgtctggaattgaacagcattggcacaaaaatgatgggctacaggaacttctgaccccaactcaagtaggtgttgttttttgctttcactcaaaatatgctgacctgacattctacttttatcgggtttaaagttcgcctatatcttgattaaatggcactagggtcagacaatttctactgaaggtgaacgaaaatgttgtccatcgctgttatttcggtattgttccactgtggaggcttagaattggaactgcatttccttcgtgtagccaagattctccaggtgttcagccatggctttgttcatgggaggaggtccgcatctcaatatctgaaaggagcaaccatacattgtcacacagatgtcctgcttggtagatggaatacacttcaactattctcttagcaattgtcggttccaagttccagaaggcacgctaccacagaagacatcacaatgtgacacctacctgaatgtcagcagcaggtgccgggcaatgggtttggatcatttccattgacacaaacccaacaccaccattccagatttctggaggctgctcatgaaaacaaagctgatggtgtaaggtgcatggtaggaatttaatgcaagccataatatagtagtattagcagtaagtagtagaagatgggactaccaaagtagacagttcaggcatgaaattattgcacaccacagtacaaagtactagacctcagaacagaaaacaaacctgatttaatacatagtatatcttgaagcgatcgggataggtttcaaccatactatccaattcttcctgcataaatcaaagcgacaagtaaatgagcagcagcaattagcaaacatcagctttcaagcacaacatcgtactacatattgaaccacgttcatcttacagaaactatgcagtagtctcattcagttatcgaaaagcacatatgaagcattacttcaacaatggaaccttacttttctccaacagatctaaagagaaaggactctacatagcaaaacaagctacaatacaaggttgattgtgttcatggttaggccactgagagatagtttgcatatcatctttgactttcaattaaaaagtgggctgttaccagattattaaggaagaagattatcgagacgacatatatggaattctggttatctggtaacaaagtacatgtcctgtatgatattttcaaggtttctgtggtataacctgctaactttgcactacaactagacaaactaccctttattcaaaaaccagacataccagattcttattcttaatatcataagctgaacggatagagcatatagtatccaagtctaataggcacccatgaattgaagcgactttaaatataacaaacaccagtaaggttaatcactggtggagaactacagcaattctttcaacaagatcatacctttagaagaatgtcatcatatgtgacattggcatagattaagtgcactttcgtattgtcacttgggttttcaagaattgctcttgtgacctacagtaagggaggacaatgaattgaagaacacaggtgtctcacatattaaatgccataaaaaaaattggtgttggaaagggtcttacttggaacattggggtaatgcctgatcctccagctaacattccaaatgctcttacttgcccaggttggtatttgaagcgaccctaagtcacagacaaatttatacaggcacaaagatttataaccaagtcagagaaaaaattatacatcacaagaatggccaaatacagcatggaaaatttctgtattacttacaacagaaataaagccataccttaggtcctctcacagataaatagtcaccaactttcatctcatgaaaatgatgagacattcttccttggggatacatcttcaaaatgagaaggaaaaattaggggggaaaccaggaaagggggatgaattgacataattgcatttctgacggactatagctttacattacgcacaaagctagcgagacaagactaacaaattcaaaatggaacatatttgtgaaattttaccttaataacaagctcaaaccgtccaagatcagaatccagcgtagttggagtataaggcttgattacttcctcgccagtagcatcctgccctctgcaagaacaggagataacatttaacacaattctttgtaaaagagaaccaaaagatatgagagaagcaagaagacatatgatataacccccaacctgcaactgatatgttggccaattggaagccccagcacagaagcaggggttggtagagcaaatctgaacttggccacattatgactgatctgcctcttctccacaagcttaaactccttgaagttctcagggtccaagcagcctaatggaacaaatcacagcacaaccattcaggatgagctatgaaccaaagatgatactagcttannnnnnnnnnnnnnnnnnnnnnnnnnnnnnnnnnnnnnnnnttcacnnaggggggtggttcaacgccatc

SEQ ID NO: 63177 - DNA, 17719 bp, Oryza sativa
  unsure (1)..(17719): unsure at all n locations
acgttgatgtcnnnnnnnnnnnnnnnnnnnnnnnnnnnnnnnnnnnnnatgatactagcttacttcaagaagacattaacaatcacaaaaccattctctaaatgctgcagaacagatgcaagcaaccgatggctaaggccgaagacatcgctaggtaaatgaccactaaatcagtgtcggtgtatcacagtggtcagtggcagtggaagctgcagcgtcgtcgagtgaagagagatctcgcgggtgcatacccttgggcttcttgctgctgcggaggaggaggaggaggaagccggcgccggcggccacggcgacgacggccaccgccacggccacggcggtctccgtgctctgcccctgcaggaactccatgccgccaccacctcgtgccacaggtccttcccctcacggctcccgccttcggcagatgcggcggcggcggcggcggcgaggtggaggggagggaggaggtggattggcttctccgccatggctgacgtcacccttgctctcatctccgatcattcatgggccaggccgtgtagtgtgggccgcagtatccggcctggttcacacggacctgtatgggccgggttccggcccatgtatggcccattttaggcccaaaaagtgcaggtggcacgttgacatcggcgagtagaccaccagatcgtcggtccggatttaacatttctttatcttctagaagtaccagcttgtgaatattctatgagaaaaaaatgggatctttctgaggagaaaatttggttctgactaggagaaattagataggtccagttccaaaataagtatagtaagtaggagtactaatcaggtgtaaagtatgacattgacaggcaggtggagtacgtcgtgattaagttacccaattacggtagaggttaattaaccttttggaagcagatttaggttgaccaagtaaaccatatggttgcctttgcccctcttggcatttcaatatttttttaaccttttaattttttgtttttcaaaaagaaactatctaaaaattatttgaacattttaaaaatggcactccatttggcgtaacaaaacatgtgataaacattggacatggcactgctgtcaaggtttagatttagtaataagtttgggatggtttatttttaaaaaatttaaaaggttaaaatattttttaaaaaagaaatcctaacggttcttgtatttgaaacactaagtggtttaaaagaagaaaattgtgctcttttgccccataattgagtgattagtgttcatttgctacacctgggaaatcatcaccaaagccacatgtcatacacatggcatatatgaaaaaaagaagaagtaaacaacatctactcatgtttggccaaattacaaatctccttttaaagaaacgatttttttagacaggatcatttagcaaggcctgaacagtgctgttaacctgcaggaataagcaaaataacatatttgcaaacgaaagtaatttgtgaataaaactttatatgtgttcttagcgatctaagagcaaagctgaaaaataaacttcgataaaaaaaccttaaaattggcttcaaatttaatgttaaaattttaatctttggctgataaatataagtataagcgaaaagataaggccctcgctgcctagctgaaaagtatcacaaataccatcgtcgacagtttcgctgaaaagtatcagaaacaaaatattttgacaaaatcatttatatctttgacatttcatatcttattatttcgtaaaaaaaagattataacaagatttttctaataaattgaaaatggtttatagaaattaacacgccaataatacaagggagaagccaacagcatactagtctggtaggtagttttgcttttggatgaaaacgagttcttatcagccaaactccaatttacagatattaaaaaatctcccaagatgatcagcggatttgcgtgatttgtatgcttagtcataacaaaactttattggttggagatttgcgctaggatcatataaaaaaaactttatcttattcaagaacgagagaaaaaaaattggtagtagtacgataacctctagggatggagtaaagtatccagctttgcagccacctgccctctgaacttcttgttcttcgtctcacacttcgcccgaagcaaacgagaacaagacgaccgcctctatccaatccaatatcccagtccaatcgaaaggttagtcacttcttgatttgaattttccttctgcttaatttgatacaaaaggggattctttttattttcgttccagtgttcgaaatcatggagacgatttctatctttccccctttgatcgcttgtatgttaatctagagatttttctctttaaaaaaagaggaaattttggtgggggaagatgagtcctgcgacgaaattatacggggtgcaatggcgtgaatcttgagcagtgccggaatccggtttcttgttcttttaacccccaaaccaaagacttctgctgcgtttttattcctctttcgggggggatagcatcgtgttctctgaaagaattggaatcgagcacctgattcttggagagggaatcttggctcttgatctctgccttccccttcgcaaagatctatctgtcagtgctgtgcctcatcccccccaagtgggtcttttctctgggacagcttgctgcccctgttgatgaaaaacccaaaaaaggctaatttatttcgtgtgttggatgcaaagctaacccttgttctttgttcttgatgctgatctgttgtgagatctgtatgccagcaattgtctttgtgaaatccagtcacggatggatgccgtagtgttcatcttgtttcagttcttcttgattaaacttctggcaagatgctggactctttcgtgtagatgataaaaaatgtgtatgtcgtggttgtttgcttgggaatcttacggattattaacttattatggtgcccggttcacagatttgcgttttgatcgtggtgccgtcaaccgaaggatttgcaagatggcagaagctgcaatcacaaggtactggtgccatgaatgcgagcaggccattgaggaggccatggtggatgagatcaagtgcccatcctgtggtggcgggttcgttgaagagatgaccgatgaggagattgagagattgaccaacaggcagccagagccgggtttctcgcaatggaaccctattgagcatccaggagaaacgatggacagcgacgatgaagataatgatttaggtcgtgagtttgagggttttatcaggaggcatcgacgggcatcaactctacgacgcgtgcttgacagcatccatgatgaccttgcagatgaccaagaaagggacagttccattctgatcaacgccttcaaccaagccctcgctctgcaaggctcagtgcttgatcctgatgagggccaaggtgaccaaggcggttcaacaaatgatgatggcttactggaggagtatgtcctcggagcaggtctgagcctgctgcttcaacatttggctgagagcgacccaagtcggaatggtacccctcctgcaaagaaagaggcggttgaagcgctgcccactgtgaaaatcgaagaggttgtcagctgttcagtctgccttgatgatcttgaggtggggtcccaggctaaacaaatgccatgtgaaacataagtttcattcttcttgtatcctgccatggcttgaattacatagttcctgcccggtttgccggtttgagctgccttctgaggagacaaaagacttgaacgagcctagcaacattggtagagtggaggacagccatgagaaagtcagagctgatggccctggaaacgtcagcgagagcagtaacagaccctgggctattgttccttggttgaatgagctattctcaactcgtgaggcacagaatgctggaggtgtttctacggatcaacaatcaccgcacacttctggaaccaacccaaatgcagggcacagttgatttctgctgctgttgcgatttgtgaataatgatagtacaagtgacccagattggtagaactgttgttttccatacctatcatctcccttggatggatcacagcataaaaagcttgccaggcattgtcatatcatctgtgctcatttgctttgcttcagcttactgcagctaaagtcggttctgcatgttgggacattgatttcgtcttggctctgagaatggcacaccactcatgtgtcatgattggcatattcaggaagtgatggtgttagctaattgccaaccatcagccataaatcaacttcattatttattacaaacaaggcgttacagattcttgtaaaaattcatgagtagggaagtgcagctaagactgagtttttgaagcagttgaagtgttgccgaaatttaaacatgtgggtaaaaagtctacagctctggtagttttacaacgttgttttgatggaatttcttctatatatggagctacttcatgctaagattatgtaaattgtgataatctgccatggctaacactacttatcctttcttcgaaagtgattaaatttcctgagatgttgagatgaacctttgtggactggaataatttgtttttctgcttcatgagatgttctgtttgtctgcttacttgtaacaacagccgcaagtttattaataatctatcatctagcccctggtttattaggcggtttatatataaatgatacgacatcttaggagatcgcatctaaatccggttcaacttttaccatgcagcaatccttaattgaactctggacttggcaatggtccgtggttgtgatcaaaagaaccgagtttagtgtctctgggatcaatgctggctttgcattattcatcctgttattattcgttacgaatgtacgaggtgctcaggcatagtttgatataaattaattggtattggtatgggtattaatttagagaagataatgtagattattttgattcttggatgattggcaagagctcctacctttctttaagctcgtttggtacagagaagtctttgatcatcatgattgagagttttcgggttttcatgtacagagaactctattcatcttttggttgaaagttatgggatccgaactgaactttttttttttcggaatgaccgaaggaggtcatccaatattattaagataaagagaaaatgttacaagaaaagttttacatcgataactggctgtcgaggaaggatgtgcaccagagcacacgtcccgaaccaagtgccaaccgcccaaacacacgccacagagagggaagtcgagcaccgaaccggtcgtcgctatgcgagaccgatcgccaccgagccaacaacactaccacggagcggagactctaaaaaacgacgccctcacgaaggtcgcgacgccgaatgacgccgtcgtcgtccatccaaagactggacaaggttttcacccagaactccttgctgagagaggaggggtacctcaatagtgccctcaggaggattaccactcctgaaagcgtagtcactgttggcccaaagaaacctagtctacatttttagtccaaataagtttgagctgaaagttatacttttggttataactcatcgtaatacatcaaagctacgatgagttataactgagttcagttttccacgtggatcaaagttactcagttttcagcacaaaaactgagtatgtattacgatgagcgagtttttgtgttgaaatttgatccacgtggagtagaaagcgagaaatctcagttcaaataatctacggtaagatttaaaaccaacccatacagaagttgaaactgggaaggaatgttttcttcgaaaaaagatatgcaccggaaaaaccaatagggaagttgtgaaaactgaactaattgtaacagcggtactgaggggctctgccgatagtcagaaagctcaaacatatatgggtgtgtttagttcacgccaaaattgaaagtttaattgaaattggaacgatgtgatgaaaaagttggaagtttatatatgtaggaaagttttaatgtgatagaaaagttagaagtttgaagaaaaagtttgtaactaaacaaggcctatatatgttttcacaagaaggcttacccgtcaatatgttagaagaacattcaattttgaaatatgttactgtagttaactataattgttggcagttagaaaactcacatttttacaatagggaatttagctttccaaaagaagaaaaaaaacaagagatagagcctcagctccagctccacatctcctggagctagaacccagccaaacagtttcagctccacctaaaatgagagtggagctggatgaaactctctcacaaaatgaactagagaagtggagctgggtttaggcagctccacaactctactccagacccaactcctgaagttaaatttagaagttggaactctaccaaacaggcccttagctgctttataccactgcaaaaacgaaagcttcaggatttgccccctccaatgcttcatgcaaatgtggctcttaattaggtgcacgtatcaatgggctcctggggattcagatggccggagctcatggtcaaataaagccacgatgaaggcaactgcaaaactgatgatcgtgcgaagcaaaagacagacgcacggccacgcaccaacgcgtcgccaactcgccatccacgaccgcgacgagctgacgatgccattgcatttgcacacgactttcggttagcccagccagacagcttatcagcttcttcagtagatgcgcgcattgacaatgaatgaattgagccgtggagcagaccgggttcggccgatcgccttccaccgtatcccgcaccggggatttgcaccgtcagtcaggtcggcggcaaaagattcggctgcccctctccggcaaccggttcaccagcgcaaaaaaatcatcctgcgaagaagatttgagttgcataagtgtgatactgtttagtttacaagaatgtggtggttttctcagtggatcatatcaaatggtcacttgatcagagatggaatgggaaggcaaagaaagcattccttactgagacctcttgactttgctccaccagcatcatctgggactggaatcctggatggcttgagtccattcttcagttcaattgatgaaaacggctgcaaaaagttgtccataggccacaagctatgctgttaatacaagtacagtgaaacaaatgaggcagaaggactaagcatatgacacaaggttcgatctaattacgactgttgactgatgaaatttctgccacccgtaccaagtgatttgcacatttgcaatgtggcgaaatagcacaaacgaagttttcagcaggtggttggtaacatggagagagtgcacctccaatcctgcgataaaccaggaagcgaaatgtggcacaactgctcacattctaagaggaatatttctcatgacaacgactaatgctaatctgatcattggaatatgaaaaagtgaggaagcccaaaagcactgaccaggagtagaaattccatatgctccaacgatactcccaaggaagaaatatcaaagatgcccccctcattgcctcagtgtaatcttatataaccttagattacgttcaaacaaatctagctactaccacatggcatcagagaacattactacacccgcagtcataaacaaggtaaaacatatagagtgcaaatttggcattagataccatatcaggaatgaatccttcaggtgcttccccaaacccccagtgcccatgaactacaagagcatcacataaccactagaccagactagttgatcaagaaagcatccctgaacagtaactatcactaagcgcaagatagtcgtcgctacgatagtttatttgcacgctcaggcagcatatattctgtgaaagctactgaaagcttctgtgctgcgcaaggaatattgagattaggatgccggcaaggcgcatcagaaaaaagacgagaactgcgcatctaagagcattgatgagaaagaaaattgtattgtgcagggctgcagggcaacttgaagatgaacacagatgccaaggacaacaagaaagaattgatgctgaggagattgcttgagcacaagaatcccttcattcactaagctcatggtgcctggacaaagaacctacatttacgagataagtaacccatgcaactgggatggcttggttccaaccggatttgtactttgctttgtatggtaccaatgaccaatttacaaaggatgatcaagaagattggaaaaggaactcttctcagcaaaaagggtcagaaaattaaaagggtccaatattattgacaattgaaagattctaaaaataaaactgtttccttatttaccacaaaaaattaatagaagaaaaaaaaacatccatcttacataaacaaacaaaaaaaaaagaacaacaagaaactcttatccctttttttctattgacctgatcataataacaattaagagacacctataccctggggtgttgactctgcattgttagctcatacaaacaactcactgcaatcctactgttgaacaggcaaggcatgcttgcagatgcagaggcaactcaattgaagaggttgaaagatagatcagaaagttccaggtcatatgcaacttacaattctagaactgctaccaggatcagtctttacaactgcctgcgctcccacaagtgatgccactttgcaaaagatgatcagcatgggataatgctttagattctctattgataacttctttatatgtcgaaagcacgacagcccaccctccagtacaactacaaacagcaacaacatgtaatatctgttaggtagatacgtcagaaaaataaactatggtaagtagaaagagaaatataacctgtcgtatcatgctccatacccatcacttatcagcactaacacagcagtagatgcaacagctttatgactggtaaaatgagtgtcataaacatcatataacaaagataaaataatctcatatcgcccatctaccctaaatctcatgaggttcttacttccggaaaaagaaacatagcacagtagcatgtaatggtaagcaataccagtggccatcacagaaagctcttaatgggagttaagtgcaacatcaccagtgacagtgaaacaaaaagagagatatattcctgatagttcatttcattgattaaagaacaccattaaattgtgacaggtgaaagctcttactagtggtcccaggtgtcgacatatgccattggcacacttctaatgaggcacctcttcaatcaaccgaatcacagaaaagagcaatggtgcaaaagtacagtaggtgaacacccttaataaattgcatataaggtataaggcaaaatgataacatgtaaagaactctgacagacttggttacaggagagcaacaaaactaagatcagagtatctacagtacaggcatccttaagagccaagcaagaagcgctataattagtattgtgctactgttttagaaacaaacgaagggggaaagggaggggctagacctgcatacatttccaaacagatcacatctagcttttcatgtcgaacttagataagaagcacgatggaacaaactatctgcctctactggcaaaagtactgaaatgatgatagttgtgaaacatatacagaaacatagtacctaagtactgtttctttgactggtgatgattacaatcaaagagatctggttcaaaaggagcttatctcacataaaaagcataagcctcttggtccacagttctctggactgaaatgtgaatatgtaccaatcttaggaaaggacgctgatggaacttatgcttgttcatattccatatgctttaaagtagtaaaggacagaataaaattgacagaatttatgtttatgtaggatgtccttacccacaaggaatctactaccataacattaagtgtcctttttttcatttaaacaaaatatacacataccaagtaccacccagctataaacaactaaacattaaacaggtaaaacaaaacaaaatgcaacagtttcaaaatactaactaaataacaatccatcagctatgatcatagagtactcaaataatttcatctagtgattatctttcacactccaaatagatcagatagcagaatgatatgccagaaagcaacattcaaaacaataatttgttccaattgtgagtccttatcactatagtatatacatactttcagtgatttattcataaaaagcatgaagaggaagagaaaaatggtttattcataaaaagcatgaagaggaagagaaaaggttagtgcatttttaaagactttttttttgttttgggggggggggtggttaatttcagaggtaactataaggacagcaccttatgttagttggcataaaaaatattcgatcattgtttccaagatgctagattctatgttgccccatataaggaacccctcacaacaaactgcttatcaacctgagaagaccaaaagagtatcaatagacctaggcttggagaagagtgctggctttggcactgccaaaagagaagcactcataacagtttcgacgtgtgatagcaaagagaagaaacagactggataacacaagtaagaaaggatagtgtaaatgcttgcctctttatgtttccattcttctaaaagtgtgtattaattttgcagcagatgtatcaccaacatcagggtcggagtgacctcttcactactaggacatcctttccaatggagcggcatctgtttctgcatggaggaaatacacaaggagattctgggctggttctctcaactgacgctaaacctaggttgaaatggacacctgagttgcatcagcgatttgtagatgcagttaatcaattaggtggagcagagagtaagtataagattcttatcttctcaatgcactagaatagctgagttctaacattcattttaatcactcagaagctactccaaaaacagtcatgaggctcatgggcattccaggactcaccttataccatctgaaaagccatctccaggtacctgacaaccaggaatctcccatttaaaatagtactaaaaaatttcagtgcaattcataatttcttgaatgtttcagaaatacaggctcagtaagaatctccaaggtcaagctaatgttgggacaacaaagaatggtaaaaacaagtttaatttccattgttaccactacaatagccacatagcaactcatggatgatgacaatttgcagcccttggatgtacaggtgttgctgataggattcctggaacaagtgcattagcgatggccagtgcaagcgccattccacaggcagagaagtaagaaatttcccatgtactttataattgtaatccatctgaatagtgaagtaatagtcccttttattgggtgcaagaactattcaaatcggtgaagcactacagatgcaaattgaggtgcagaggcagctaaatgaacaacttgaggtgaggtactgaccctgtttgcataataagatcttaacccacgataggcccatagagtagatggacatgacataagataaaaaaaaattcgagcatccagtcagcatgcccacataccaactaagagcataagaaaactgctatgaatgctgtatcatcttttttgtatccttcacaacagtgattcccaccaggaatgacccccaagataactttctccctctagtaaaagttaagcgatgttcagaatacatccagccaaacctttagaattcggtaccagtatctttatgaataagattggacatatgtaattgatcgggtagatctaccccaaaaattcctttcataacactattttctaactatattctcaaatcattgtacaatagaatagacagtattatgtaaagattagagaacttggatactctcctncagtttggcagcaaactatttttagaaaacagctaagattaatataatgcatatagtatcaacaatatgaatggctcaatggttctaacctgaagctaatttggtatcaggtacaacggcatctacagctgcggatagaagcccaagggaagtatctgcaggcagttcttgagcaagctcaagagacccttgggaagcagaacttgggccctgcaagcctggaagatgcaaaaataaaaatatcagaactggtctcacaagtttcaaatgaatgtctcagcaacgcagttacagaaataagagaaagttcaagtatacacagactagagccaaggcaaatccagtttgttgaaagttcagccaataactgtttgactgcagctgaaggattcaaggagcataggctacaaaaccacggggtactcaaagcatatgatgatagtacattattttgccgaaaacagtcccaagatcaagaatctcaatattcccttaacagaagcttaagtgagcgtagaatgggtcatctgtatagcggtaaacagtatcacaaatcagagggaagtgacagtgatacagaggttctacatgagtatatcacgcctcaaaagaatggcggaggcagcacaaccagttcaacatcaggaagcaaagaaataaatgtagagaagctatatcttgatgaaccaagctgcaaaagacaaacagttgactatcaaagagaaagcaagctactagattttgatcaacaaagttcagggaagaatcttgatctaaatactcacaatatagatgataacgatcaagggtatagacattttgacttgaacggcttcagctggagttgattagctgacaatatgtaatacaatcaaggagaagaaatgagcttacaaaataatttcttccaaagttataactactttaattcttgtaatacattatgtaggccgggaaagattgtagctatctagagttgtaccataggttataaataattcaatgatgtatgaacaagctattgcaaatgttgagttgtaccacaggataactaacggaagacagcatattaattatggcactctcaatatgaatacaacggaaagcacgcggatatattagagaacagaaatgcaacaagataagcatagaaaagtacaattaacaaactgagaaatacccattcacataaaagaggcagatttgatgatgtgccactcttcagattgaagcttgccaccccatggcaattacatgtggggtcctctgagtcaatgatgtgtgcgccaagatggcaaatcatcataacagaaatctaaagagtggaaaattatcaaatctcaccagaacctaagcagtaagggggggaaaacaccagaaaccttaccgtctaaataacaccatcacctcaatttaataacataacgtagaagttattcatgccaccatgaagctgacatttcaggtttagtggtcagcaccaacatatcaggtttagagcttagtgctgcttgaaacaaaaaagaatgaaaaaaggacaaaagggaataactcatatattggtggactattgcaaatactgttagcaaacatttttcaaaatgtaagtgcaacagcaatgggattgcttcctccagaaaaccatccatgttacatagtactccatagcacaaataacagccagagtataaattgacaggtctggtcatcaacaaggtatatacgagttatcagatagaagtctatccaccacgcttatttatatacccaagaggaaatggccacttattgcataataatccaattaacagctgccaaccaaggagcaggctacttttgatttggcgaccgatcataataagttcataagacatgtatctaccacttttatttctctccttatgctcaattatactagctacaagagcagagcactgtgatagtattgctatgtatgtaacagcaagttcttatgatgaagcagtaacagcaatagccaaacagttcatggccatgggagtaagcggctgcctacttcttgatccggcgcaccttcttggcgccccagacctccatcctccccttggggcacccgcacggcgagcggaagatgagcacggtgcggccgttgggcggcgccatcttcctgagctccgcctcgagctcgcggtgcgcgtcgccgagctggacggggcgcgccccggcggccgcgagaagcgcggcgcgtcccccggggagcgggagcaggcgctgctgctggccgcggacgcactcctccgtctcgagctggatgtcgaactccaccgccttgcgcagcccgcggcaccggggcttcccgcacctccgcgcccggtgccccacggcgtcccacgccaccacacccgccacggccgcgatcgccgccccggcgcccgccgcggcgaacggcgcgtagtacgacgacgccacccccgccgcgtcgaggtcggacaccaggcccccgacctcggccgccaccatcctgacgtagggcgtgacgaggaacgcgagcgcggagacgacggccagcagcgccaccgcgtcgaccgccgccatcgcggagtggtcgcagagggacgtgaacagcctccgcctccccctccgcggcgacgacccgcggcgggggcgggcgggctcggtgccgcaggcggcggagtccgtgaaggcgtcgncggcgtggtggcggtggcggtgctcaaaggcgcggaggaactcgatgaggctgcggcaatccgccatggcgaggaggagcaggggagggcgtggcggcctggcgggtggtatcgaattgggaattggggtggaggaatcgatcggtatcttgatcagatgggtcggtgggtggtgtggggtggtacggtggccgcctgcgaccgcgagccggtcggtcggtcggtcggttgggatgggggtgcgggccgcgtgcgtggtgggtttcacgttggtcgcctcatattttcggttaaatgaagtactccatcaatatgaattaaaacaaggcatgatttcattttttttctttgttacattttggatgattggatggaagtgtttgggcaaaatctccacccaaaaccgctaaactgtttgtatgtcgaatgcaggctggtagcagataacatgtcctgagtgtgcggtctaatgcttcaaagcaatacttatgattaacatgagattcatcccaaacaatgagagatgtttttgcatcatgtaacatcctcaaattttaaactaaaattaactgcatcatgctggcttttgattaaatttgtttggttcaaaaatctatttgattttttatttaaaattggttcaagtattagagcccaaccaatttactctaacttattccctttattctaaaccctagtgaatttgagcaatttctctcaaattcaaaccatagattatttccttagcttatcccaatattagtggagatttactatactctaaaccctagtgaaacctttccaaactcttagtttgaattcaaatcttttctagggaaaatattcaaaaattctgatttttactgttcattacactcaaggtgctcgacaaaatgcccagcccaactagagcagcccaccttcaacccaatcttgtgcaaagtctaggtttggtcctaggggatcacaacccactcaaaaaccgtggtttagttggccttctcctccccttcacgcgcgctctttggcagccgaccttgccgcgcgctgagccgccgcgcgttgatctcgggatcgatcgcgcgtgcccgaccgccttggcgcaccgtcgcccgtccgacgccctcagcccaccgccgccgcaccaatctcgacgatgacaaagccgggacgacgaccgccgcacgaaatcaccgcttgacgccgtgcgcacccgtccaagccgccaccgagtgcgatttcgcttctacccggggtgaatcgcgccaattcttgccgcacggttggattggagatagacggtggtatcccctctcacaattcaaaccattcacccctgagccggctgttttcaccctcgccgccgccgcgcgtcgcgctcggattggcgccaacacgtcgccagccgaatcaacacgcggtcaagccaatccttcgccggtaagtattcaaacgtggcctcccgccactcaaatcgatctttcccgccctctctcagcctctgccacctttgcctcatccaaatcccgagctcatccatggcgataacggtgcccaagttcatccgctcctcctagccctataaataggaccccaatcccttccctgtccatcatcgatcatcaccacccatagccccataatcccgaagctctgcttcaccaatccatctcatcaaccaccctcgccagtcggtcgaacactttgtgggtgatcgactccacccctctccatccatcctccgccataaataacacttagaacacctatatcataccatgttctagtatattaagccctaaccaaagccctacgtcgagttttacctcgccgcaccaagccgagcactgccgcccctgcgctgctctgttcttcgccgccgcgaagtttttccggccgcaatccgtcgtttcaaccgatctcggtgagttcttccatttcaaccatttacatactacctagattccatttgagcaatccctttgcactatcatgtcaccctctgagctgccgacgtgagcacggccgccgcctatgtaggcgctcgtcggcaactatgttccgcaccttgccaaaggttggcaagctgccgaaatccctctagataccccgtagatgctctagaacccctcccctaaccatgtctaactctcatcactccggtcaccatcacaacctaaccgtgccaccgccgccctagccgctaggccgtccacgcatcaaattaactcttctgccaccgctcgccgccgccggagatccctagctccctcccctcttcggccacaaccactttctccctctagcgccaccgcagtcgccaaccctagcgccgccggcttgaaatggggaacggctggaggtagaagaagagaagagagagagactgatagatgggacccacacacagtaccatttcacttttattcgattttcaaactttagaagcccatatcttttaaaatatagatccaatttcagtaaaacttggaccaatattcttctaaaatcatcctctatctattgggccctttttgctatttttgcattttatttaaaactcttttttgatttgaaatttatatgtctaaccctaagtcttgaggatttctctgacactctagataatatcaatcaatctcaggacatcgagcangggcaagtaacatatacctcgtgatcatttagcctatatnttacaaattatttatttattatagcctctattcatattctatttttatgctaaaattatcataggaccccaatnattnanattgcctatttgctaccatctggntaaataccctatactaaattggaccataccgtagatttgatgaattccggnggctaggattgctaaaccggaataagtttaccaggncctcatgtcaacgcatggttccaaccgcaattcttaattggacacaactctttttatgtaatatcaaaatggcccctcggtatggttttattttaagacctcgccgagagcacttatccggaaagccacttacattacagttccgggaa

SEQ ID NO: 63178 - DNA, 2371 bp, Oryza sativa
  unsure (1)..(2371): unsure at all n locations
aaaaaaaaaaaaatcttttttttttccccccccggccgggggggtaaaaataaattaaaataagccttagggggaagtcctaattattgtaaaaacccttagtattgtaagactttaacgtatgcaatgaagaaccagttatattgtatgtatcaatttttactgatccagggattgatacattaatctcagtcggatccaagttgttagttttgggctccgacaggactggtatcagagcatatgtttgactataggatgaaccttaaggactattaactaagctaagtttgaatttatttcaagcttaccttttaaggggggtagatttaatccacgagcatgtattataatatcatttgtgtatttcaggataatggcagaagagcatgagcaagaactcatagaaactgcaattactatccatgataatgagtgcactgatcaactaatcaatttgatgactaaactgaagataaatgagaagccggaattctattcacatgcttatcaacggggagaacgttgggaatatgatatgaccgtaaagatcaatcctccacgaggtgaacgtgatatgtattacttccgaacacgtcataggcgggataccgtgcaagctgcactatatgatgtgtccagggaggcttttctacgtctcaatcatatttaccaagacaggttgcaacactctcagctattcttatcatcctatgcgagagccgggcgaagactattgcaccctccagaatgtggattatcatgaacaaccagtaaaagcaactatgtctatctggatggaagccgcggatgacatgtatgaagaagctctggaacatatggacgtacaacgtaaacgtcttgaagaagctgaatgcagagaaaatgttcttaaacacaaatatcgtatacttcatgaattatatgaggaaagagaaaaacaaaattctatcctcaatatttgtgttgcaggagcagccttttgtcttcatcaaatcccaaatatggtagtgatgacgatgatgatgatgatgatgatgatggtatagaaggacatatctcaccagtacgtgaaggtgaaccagatgggccaaatcctcatgataatggtgagggagttttacaatgtttaccaccatcaccaccaccgttgtatcctattcattctgatgatgaagcagaagaaatgcattcagctatggatatcagtgagcctagtcaagaaccagaaatactaaggccaaatcgggtgtttcatatcaatgagttaaatactgccccaatctggactgaatctccagaggaagaggaagatccggaagaacgagagcttgagacacaagaacatctttctatacatactaatgatcaagaaaataatgaagacccttactcatgctctgctcccaatattactgcatcaacttctgcatctcctcatgaattttcacacttcgcacctgcatcattgtttactaatcccgcagaaggcagtggtggatggctagataaatagaagttatagatagttagaggtcttaagtgtagaatagatagttatcctactcctctctaacttctatgtgtgattacctctttctttggggtatgggtttctttggtttggttctttgagcatacatcatgtacaacttgtccataaataaaagctatgtttaattatggatgttgactcccctttgagaagatatcaattaccccattttctagatgagtatgggcaatggcagtacgggtgaaagagaaacaggagaaatcccttcaccanatcctaccacttttgcaagaagtatggcaagacaaactcaattattacaagccatagcacaaaatcaaaggaagtaaggttacagcgcacatgcagaaattatgagaattaaaccaccagtcttttctaaatctgaagaaccctatgatgctgaagaactgctaanggcctattgaaaagaanataacccttngttcgaacaagcgaacaagaggaagtaccttttgccacccatcaccttgaagaccagccattgagtgtgggaagctatcaagctcctatagaagatcctcacatattattccatggtggaattactacagttttaaaagagctttatatccttcgctgggataggaatgaaaaaatgaatttcaaatatgaggcaggcttttgacgtcaggatattttgataaataacgacctggtcaaatgcggctctgatatcanagaaaaagaaaaatttgaggttttataggattcgtgtaactttggcccacgtttttcaaacttaaatttcaaccccccccaaaaagggttgcttaaaaaaactcaaaggcgagagctctgagaaaagaattc

SEQ ID NO: 63179 - DNA, 1234 bp, Oryza sativa
  unsure (1)..(1234): unsure at all n locations
agagttgantttcattgatanaacnnnnnnnnnnnnnnnnnnnnnnnnnnnnnnnnnnnnnnnnnatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctattttcaaatggatccagccacatgtccatatcttagccaagattctccaggtgttcagccatggctttgttcatgggaggaggtccgcatctcaatatctgaaaggagcaaccatacattgtcacacagatgtcctgcttggtagatggaatacacttcaactattctcttagcaattgtcggttccaagttccagaaggcacgctaccacagaagacatcacaatgtgacacctacctgaatgtcagcagcaggtgccgggcaatgggtttggatcatttccattgacacaaacccaacaccaccattccagatttctggaggctgctcatgaaaacaaagctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaggggaaggtcacgatgggcccatcccctataaacagtttttccctcttaacggggaccccgttttataaggggctttgtcaaagggaaaaaccacaccttttggggttttttttatataagggtatttgctcttcgccctggtgaaaaaaaggggttacaaaatttaccgattttacaaaataacgcccacttttgtggggggtttctttccaccag

SEQ ID NO: 63180 - DNA, 7061 bp, Oryza sativa
  unsure (1)..(7061): unsure at all n locations
gctggcttganttgcagnttctccnnnnnnnnnnnnnnnnnnnnnnnnnnnnnnnnnncaattctccttagatataggagatcctttactgactattttgtgatgatttaaacatctagtgtcattttgtagctcttcctttaaatttttctctcaccgctgtgcaggccgctctcaggcttctttttcaacacattatgtaaggagcctgggtatctcgcatttgacaccatacgctgcggcaagcttctttaccctgagtcacgctttgctgcattaccagagcccgtatctttccttgcatccacgcgtggccttgtctgcgtctgtggaaagacaacaggcttgtactatgtaaccaacacgaccaccttcaagtgggttcagctaccacgccacagttgtgatcatggagaaccagcagttgtcatcacattcgaggaacccctgacatcctgcttcgacggtgctgttgagcattatcatgtcgtcgctgccttccacctcaagggcagcgtctggacatctgagtcatactcctccaggactgggaggtggactattgctaaagatgcccctcctgctgtggaggtgaaggcggagtctggtgttggtacactgggctgcgccttctggcgcacttcccttgggtctatcctctgctatgacccggggaaggacctccttaaagtcatccctgcccctcgagtggtaaaccaagataccgtatgggagcttgggcaaatggagggagatcttactgtgacctgcttcaaggatgttgacggtttcctcacattgggcgtgcttaaaataaacaagcgactgtttgatgataaggttgctgcactctggacagttgtcggctcattctccggggagaaggttggcaaaagggctatgttgctccgctcacaaggcgccgcagaggtcgttgtctgggaacccttggaggagcgcgtcgtcgccatggaccttgaaggcctcgttactggcaactttgggcccctaaccaatgaagggtgtactccatgttttgttccttacgttccatcgtctgtgagtatttgaaggactgacgatgatcaggaataaaccagatgtgattagcatacaattgtatagtataagaaatacacctccatgttacgtttttgagctggctggcaggaccaaccctacctgatatgagattttaccatgttaggtttttatgcttgctggcaggcccaaccaacctgacatgacatttaccacgttaggtttttatgcttgctgccaggcccaaccaacctgacatttcggctggactatgcattcttttttcttgtcttaacccattcattcagcacttttacttgttcttccattctttctgtaggagtactttttaccatgttcctgttgttttctttgctttttctggaataaactacccagtaattttctgtcatgtaattgtaattgtttgcgtgcatgtcttaatacggcaagctaatcacatctcgtctctgacaagttatgctagatcctccgtggcaaaatttgggagttcagtgtgttcttttttgtcaaagttcctcactcaatgtatgctggtttattataacggtcacgcggaataaggtgtgtctagttcgtttgaaaaaaaagttaaaagtttacgtgtgtagaaaagttttggatgtgatgtgatgtgatgaaaagttaggggcatttgggatgtaactaaacacggccataagaatgacacttcataggcagtccccctgcaaccctcgagaaaggtggcaaaggggcctatagccaggtaaagagcaagtataactattggcttcacctagcagtccacgtaatcatagatcaatgtgttaatttataagcattaagcagaaacatcgcaagaccaagtttagacaccgatttgcctttccaagttcctgccaactgtaataaaataattactttattgcctcattttcagcaccaaagttaaattcagtaaagttagattcgataaagcgaagtatataagagcaggtacaatagcaggctataagccaactgcaaacatattttaagaagataaattaggagagaggagagcagcgggcaaacatattttaagaagataaattaggagagaggagagcagcgggctacagatttgtagccagctgtagcacggactccaaaacgcaacgtgtctatgacaggtgggactaggtattaatagtgtagtatataactattgtatgaatgagctattaaattggctatagataaattggagctagtagttggctatattattgaacttgctctaatggcaaacataacctggggtatgcattttttaaacactgaaatacatgacacatggatcaagctgtcagtgaacatgcctctcatcagaataacttttaggatatggagacatgcaaaagtcttagatgctgcaacattactcttcagtttgctggagttatcaactgtttattgcagacagtaagagaataataagagcttaattgttccaaacaaaaaagaaaaagaaaaacttttattcataaacttgaaactgaccttcaaactctccatgcacagcaataacgacctgtcaccagtaaaataaacaggaaatccaatctagcgcacaatggtctgtttcagcaattttcaagttttatatgatctatatttgcacccacttcacaagttgttcttgtggcggcaattcagtctttacttaaaaacaaaatgaaccaaacaacaatgtgttcatctgaagtccaaacggccagactaaaatggatttacatctcgatgaggtctacaaatccacggtctccaatcgctcgtccatccgagctacggttcaaacaatcaacctttcagtccctactcaaagcgcccagtcaatgccaagcacacatgtagtaacataggctagctcaccaatccatggtgtttatatatacaatatgccatacaaggcaaatggttgcatcgagaaaatagtacaagtacaacagaccagttactgaccatttatacaacagaccaattaaagttgagacttaagagagagtatgctcaaagttaatgcctctaactatattatttgtttttgttttgtgggcttattctcctatactggttatgttattttctttgtacacaagcatatatatatatatattccttcttttggtctatatgaattgaatctagttgatgtgcacaaatctagatcagaaagaatgtgtcttgttgtcctggattatatgttcgtttatatatacaacttgatgaagttctttacattgcaaaagaatcataggaaagagtctgaacattgaagttattcaggatatattacaaaattttgtctagatttctgcatttaacatggtgccttgaggcagcgcaactactgtacatgtaactagagatcaaggctgcgcacctagagcttgctcattgggttgccaaacaatgcaagcaccaaacaagtaggttgcaaaaatattttctagataaactgaattaacagccacatgatcaatctaagtaatttttcacataggtagttaacagccgttcgtttgtccaatgtgccaactaatccaaataacaaattttagttccatcactggatatatattcaagtaagattcatgtgttattagttaataaaggtcctaccactggatataattgatattgtatacatcaatgaacgaacaatgagtaaatgataacggttaaactgttgaattttttgagacataacaatatatactaacctttagtttcgtcataataaatgctcaacaaattaatgtgcacaaacagctgcatacattaccagaatcatcacacttgatcttggtctgctagaaaacttgtgcttgtaaaccaaaaaggctaaaaaaaaaaaaagacacgcacacactcccatacgtggaaccatatgcaagatatcatgacctcttagataattaagtagatggtacacaagcataacttagggtgtgtttgaggagaaggggattgaggagattagaaagatacgtaaaacgaggtaagccattaactcatgattaattgagtattaactattttaaattttaaaaatggattaatatgattttttaaagcaactttcatatagaaaatttttgcaaaaaaccacaacgtttagtagtttgggaagcgtgcgtgcggaaaacgatgtgcattctcactccctatcacccaaacgaacgcatccttagtaagaaacacggaacgtcaaaggactactagttattacagtgaagtgatttggggagcaaactgctcttactgcagtaacatgtggagtgatgcaggacacaccagcggcagatggttttccatcaaaatttccgccaatattcagtaagtggctcccccccatcgtcgtattcgcctaactctttttgtaggtaccaagagtcgacaggtagtcttaaatccctatcctttttggcgcgagctaattcctttacgtctttatgaagatactggttccagcaatatgttctctttgcattgaacttgaatatacggaagcggcgaaccatctgagcatgatcatacttcctgttgtatgacttgcaatagcgctcaaataaggcccacacggcttcgtccgactcaaggtcctcttttgtcacgcactttccatcatctatatatcacaaccaaatcactaattttgcaaacattacatcagtaaaagtgctcaagaaaacagtgaattgtacgaatagcatgcaccaattgaatgaatttaatacagaccagagatggatgtattcctcctaaatcctaatccccctgcctgcctatatagactatgctaaattggagagctgcaccatgaggacagggagggatcagggagggattggttatgatttacctggaggttcactgctgtagcggaaggagaggcgggcagcgtcgtccagtgggggacgaggcttcaagcgggcggcgcgagatgcggccgccgcagctaagcgggcggcgcgagatgcggccgccgcagctaagccggcggagcgagatgcggccgccgcgtcatggcgcgccaccgcagctaagcgggcggcgcgagatgtggccgccgcttgacgggcgaccgccgtcacgagcttcgacgccattgttagggttcttcggtcgggctttgtctgttgcacatctcaaacaaaatatcgatgatagtagtgtgtatgctgcgtttttcccccttttttgagtttttttatgttgagtatttttgcaaaaaaaaactcctcgcttttcacggaatatcgtatatatcctcgaaccgactgacaccctgttatgttttatttggaaaacccctcggtttgaatagaaatacaatacaaatgccaagtttagttccaaactatttctttaaactttcaacttttccatcacatcaaaacttttctacacataaactttcaacttttccataacatcgttccaatttcaaccaaatttacaattttagcgtgaactaaacacacccgatgaaaagaaaattctgtttataggggtagtgctataaacatgaaaaagacacgggctttcatgaaaagcagtcatatctacctcaaaggcccaagggttaattggatccatgccactgcatattaaaaaaataccactactatttgcgatatcggctatgtgccactggaatttggggaaattggaactatgccaattccgtccagttttttgtcaacctccgtcatctctctccctcttcctttcttcggttcaggagcagaaagcaagcgcgccgggaggaggttggtagctgcagcaacgagtgttggggatggcggtgcggcggtgggcggggtggcgaccggcgcgggggcgatggccggggacctcgcccggggagtgggcgacgacgatactggcgcagtcctgcccgccggctccgagacgaggcgctccatattcagctgggatgacaagttcgtcaaagcgcaagcattggtcaccaaggcactaaaacctatcctccttctgattcgttcttgttcatgtgaatccaaatttctgcttaatttggattgtggatgttaacattatacaattaatcttgtattcctgccgctttcctccaagggaagctcccggccgatggtagtcacaccgagatgaagaccaacctagaccagttcatctgcaacctcatgcagcactccggcggcaatcgaaagatggggcagagaacgaagatgtacactcgataagagcaatcgaaaacaacacatatcgtattaatagttcattcgcataattgccttaatctgttgggtgtttacaccttgttatacattttaatgtcccatgactactataaggaggtaagtaggtctagaggttgtggggtgacacgtgtcgtagctgagtcggtcgacccaccctgcctaatgggtagatccgcccttgacgtgaccctggcgtccctcgtcctcgctgtgcacgtcgaccacctgatggcgacgagggcggcctcgctccagtgcgatggcggcggcggccgccggcgcagttcactgcgtccgctcggtcacaggtggactacatcctcggcgcttgacgacgacgacgacgcaggcgcagccggacctccctcatacgatgatgacgacacctcctgttgcatctacggtggaagagagagaggaaggggaaagagaagagaggggagggatgtggggcccacgtgcagtttggggctaacggggatttttgatggaaaatgtgatgtagtggcatggttccaattttcctagatttcagtagtacgtagccgatatgacgaataagagtggcattattttgatatgccatatttgcacttttgcagtggcatggatccaattaaccaagggccaaaccctacccgggcgtgttcccaattccttcccaccgggccccgaaccggggggggggacctgtnttccgcgttcgttcttccacgatgccgaaaa

SEQ ID NO: 63181 - DNA, 13461 bp, Oryza sativa
  unsure (1)..(13461): unsure at all n locations
aggggggcctcctcccaggaatctcccctgggaaagatgtgctccgggtgtgaacagggcattttccccatatgccccctccgggtgaaaggagaatcgggcacccttatacttaaaaaatgaaaaaaccgttggaaacggctaaaaaaaagtgataaggccgcccttttaaagaggagtggggagtgggtattgcgggaccaaaaggccggaaccncatccccttaaatacccctaaccttggagaaggagcggtgttttgtggctcctttccccttttttccaccggctatctgggacggctggttcttcctaaggtcctcactgttgccaaaacctacgcctacacgtgggttaacttcgaattcttgcgggttcggcctccttggcagagggttctctttctcgttttgaatgaggtaaaaccagccgctccgtgcactttccattcttgtcgttgtagccccgtggctggcgccacttctccctctggatccggcggcatccccttcgccatctacccatccctcctccccaccgcacacccttttcccctttcatccaacactaggtctcaggcggtgccttgatccctccacgaggtggtgtgttggcgaacctgctctacgtcgccgtgtcttcttgagccttcaacgaggaggacacaaatccatggcacatccatcaacgagggtccggtccatcttctcctcgtcgtctcagactatcgactgtaccttgcctcccctcaatcattctcctttcatctctcccatgtcatcctcttctctaaccatgatttgtttgctgtttttttaggggatgactggtgctgcagccatccgaggcacaactgaagagaaaattgtagtccgtgtggattgatgccaattgtatcgcttgcctcaaagagtaagtgcatgctcttgttggcctcaaaattctcttttgaaattatgaatctgggaatgggttcatttaaaaaaaaagatgattctggcaatgaatgcatttttttttactaattgatttgtgtttgcatcttggatttagagacagaataacaagggatttaaggagataataaaaaggtagagatagttacctcatgtatctttttttttctcgataatagaaatgttcgattgtgtctggtgtgccaggacctctgtttatcttggataaagtaaaggtatgtgttagtattatggtacaaattttcaactgactaatatggtactcctagcaagttatactgaacatttctttcttcatgtaactatgttcatggcgcaaagtactaggaaattgtaaacatccgattgggagatggaaccactcggtgtggccaaattctggaagttgatggtgaaagaggctgttgtgcaggtcatcacttctctattcttatgaaaatattgttttcttgggattgtattttgatttgcattaaccctatggttgttgcattattcagaacacttgaagttttattattgggttacttgattttcaggtctttgaagacacttcaggagtggacaacaaatacaccattgtgcaattcacaggtggtttatgtggtttgaacgttaagattctttagtaggaaccaacacgttgattatagatcccattcaggagccgcccgttcttaagttacccacaatgatcaatttagtgcttacaaagctatctatctctcaatatcgaaatcttcgcggattctcatgcaaatagaccctccacgtagcgtcatacgaatccagagttagaccccctcctatagccgtcggatcgcagatgtacagtgacggatctctgtggtggacctcgttgtaatatagaagattttaggtgcatttttttgcaaaaaaaaagtcaggcccttctctccccttcgccaccactctattcctccaccttcgaccccctcttatccgccacctcgccgctctcccctccgacctgcgccgacgtcaccgccgcctccttgttattcgacccgccgtcctacgccgacgtcgccgcctcttcctcccgctgctccgccttcggcgcccgaggccgagcctcccacgcgttggcgcgccgttcagtcctctgtcctctgatcccctcctcgtcgctatatgtgaagaggagctcggtgtcagcgacgagctccggtgaggacgctgcctctcccctcaagcttggcggcggcatggcaaaggggctcctcgagcggtggcggtgcagatcctcgccagatagggcaacgagctcggttgctgtgcgcggggatgggggaggagaaaattcacatccatcgccgtgcccgtctacccagccgccttttgattcgccggccgcctcagacggaggccgttcgccgtgcacaaaagggcgtagtgccgaggaccacgctatggcagccgccgttggacgccgcgatgtaggagttccctcacatggtcccctacgtgttcacgccacatgtgattaatttccaccgataattaaaaaaaaaaggattttcttttgctcttggtggtttttgcgtgatacacgatgctactgaatattgataagattggctccaaggaatggattggttgtcaaaattaattgtcacactcacatgttttgtcttggtctgaaatctgatgagttggccattcttgacatgcagtacaagggtggtgcagctgagggtggcagaagaccaatcatctggaacatctttgaacaacgaagcacgcccgccccgtgtgcgtctttcacgacatgctctggtcccgggtttcttcctgtggtcttctagcgttagaagaagtcgtgtccgtcccggacatctgcaacgtcctcttacgcctttttttggggggacaaacaaagatcaggaaaagacggaccgaacccattcggtgactttcgcgggtgcccttactgaaccgacttggatctgaactacgattcagatcaagtcttaccgaaattggatttccttttcgtgccatatgtcgcttagactttacttttttcccctttctgtcctttcctctatttgttcgatagggtcttcaatctggacccaggcatgttaattacatctctgtttggctctgccttctagctgtgctatactttcaacacaaatcaagttcaattaggtgtatttcatatatatctacaagcataaaatttgtcctatttagtaaccagaaccaggtcaacgatgtaaatgcaaaaaataataagctggattcacaaagacacaaatgatatcatagaagtatcggaaaaaacatgtatatatgtctattattggctgaaatatgacaaatagtctattatatgattatccttgttggtgagttttttatgcaactagagcagcctatcttttgtcaatggtcatagctttgttgtaagaaagataatactctttggatcttcctatgatagcccagagagtatcttgacctgccaagtttatgtcatcaaactattttagttcagtataggtcctatcagttaaagctactcgcaggcattattcctgttgttgtcagttcacttgtatagttatagctttgacctagctttgacctatccaactagctttgacctagttggataggttaagaaatagaatattggcaatacaatatatcatgcaattttctaaacatagcttcacaaaaatatggttcattttattcctcacagaagaaaagtgttcttcattttacagtgaatattccttgaggcattgaagttagttgttattgtgccaatgttgaaatgttcagtatatttggtgaattgatgctctatttctttgcaaaccatgatttctgaattcttctcagttgctactttggtcatgacaggttaaatgtgttataggagtacttcagcttttactgtttcatgagttcaaaatataaattgatctttgaggaatgaaaagcaaatgttctcttcagctatcttttctgaagttcaaatgtgtcctttgattgaattaatcttctgtaacattttgaaacctccagactagcatcatcatctctcaatactatcgacattaattcagtatccattttattaatccagtttcacattttactttgatgttcttaataatcttcagcggaaagagatgttctacagctctgcactttatctctgcctgttagtagcactctgaagaacagcctaagcttatcacccatcatttcctctctctccttttctactgtcttcattgatgctgctatattgaaattgcattttgatattggttctttgacaactgtggagcagcttgccaagacaaaggcagctcatctgctgaagtatcctgatgcgaagatactgtggatcggttgccctacatatctttgcattgttgctcttaatataacaaacgccagtcgtgtagcttcagattatttatattgcagtatatcaagaacatagctatacgatgtttggttagagatatcaactagctttatgataagcagctttcaatccatttgtcatagatgggctagcaggcagccagtcactgtgtttgtgcacatacacaaagtgagaacattgagattcttagctcaaatccaaagaatctgatattgtcctcctcttatccacatgataaaagctaaagctaaagtgtactaattcaagtcaaaggtcacattgactgtgaagtgaaataatatacatgtttgtaaccaggaaaaatagtatggacaagaccaagtaaagacgagaaattatttccctctgtttggaactcgtcttgctttgatccaagctccatatactttatcttgacacaccaaatataacctcaatttgtcacctttcctcctcctctcttagtcttaaaaagagcgaaaacttagctttacactgcactgcaaccatgttacacatatatatgcatgtatataactttaggttcacagatagcgttaccacatcaaccgaaaaaaaaatatttctttcaatatttggttaacaacttcttataaaagaaaacactagtatcagcaaagaacatggatcatgtgatctgatcatctgagtaactgatacaattatcttgatgtagtatttgctaaaaaaacattaggtatgcataatcaagaagcatcgtctgacttttgcccccccttttttttcatagatttgctctttcattgtgagactaatggtatatcaagtcctaccgttttactttatttttctctcattttgctttgtctgtgaacataacaatatatcaagttataactgctttactcaatttgttttctagaaaaagttcgtttatttactgtgagcatcgagacataaagattatgcatctacatggcaggctgtatcaggggtgctgcaagaaaatattttgagggaacgttactacgaacatatcatgtacactaaagtccgtatcaatgcatacaattgctatgccgttatgatgtgcactctatatcaggaatggatttattttgatcccaaaatggacgctaagattgctgagatgaatccgatgaatgagaatgaggttgattgggctatggtttattggttttatcaaagttggtacgacaagatatggtgcaattcttctatgtgcctcaacgatgacttggatagttatacttattgtcttttgttataagcttttttttttttaaaatggaagcatcatacacatgtgagctgtgtaatttaatattttcaaacattttaatgaacatcagatattggagtattttcggaaacgaaatgcattaccatgtaactgtgtatgcacataatttccctgatttaaggccactctgcaagaacactaggccaatcactgtgagggcgcggcaaagctgcgccaagttttctagtttgagctgaaagaaatgctcaagttataactcaacttcctatatttcattttgctatttctgctgtaaaactgctggatgctactatgtactaaaattagtctcatcaccaggagtttcaaagaacacaagtagcccctgtgacgtttatcgtctcaatttgttttccttatacaagggacgaggaaattactgctatttgtagtaggtaacaattgtgtatgaccatatcctatttcccgagctagaagaacttatttctatatgaattatcctgcttttcccctttaacaaataagcaataagctctgtgcattttatcctattgagagaaaacagctgcctgaatccagtgtagttgcctgaacttttgcagtggcacaggtatttagtttgatcatagtccataccgctttgtctcttgcttctttgtttttagcccttataaatatcacagttggatgcttaggttgaggtgtcagatatcaaattgccaacttgtgaagctctcttatatgcttgacaaaagttaactcttaggccatccacaacaaagaaataaacatacaaaccctttggttggcaaaagtcacgtgtgtgtatgagaacttaaccccaacgtcatacgagaccctccattgaccagcaagtgtatattcagcaagtcctaatgacatcctactcactagtagtgatgttgattggagacgaaaaagttttgtcctcgaatttcgatatgaaagatcttagtaaagtctcatttgttctaggaatagagattcaccgagatagaagaaaaggggttaggattatcgcaaaaggcatgtctatgcatgcaagtaagcctacatctgctcccatagtcaagggcgatagttttgggaaatttcaatgtcccaggaaccagtatgagttcgatcaaaagaaagcggttccatatgcttcagctgtcggaagcttacagtatgctcaagtatgtatgtgccctgacttagcatttgttaccgggatacttagcagatataaaggaaattcaggattaggtcactgaagaatggtaaagaaagcttgtgcaaggcacaaaaggcctcatgctaacgtacagaagatctgattccctagagatagaagggtattcagatgcagattttgcaggagatgtagatgataaaaagttcacatcatgctacatattcactctcgcaaaaggggctatttcgtggaaaagctccaagcaaaccgtcgtagcatcatcgacgatgtatgccgagtttgtagctagttatgaggccacggggcaggcaaaaaatggttaaagaagtttgttcccgagttgaaagtggtcgacagcattcaaaggccattcaagatgtactcacaacaataagtcaagtggtgctgccaaacacattgacagtaagttttatgttgtgaaagtgaaaatccaggatcagacaattagtctcgagcatataagaacaaaggaaatgttagcagatctgcatgcaaaaggcttaccgcccagtgtgttcagagaacacttggcaggcatgggtttttacaggaaagcctattatccttggattacaaaagaaagggcctagtgtttatttcgagatggagaggtgcattgtagtcgttgcgtctgatggttcaatggtgactgtcatgatgaagcgtactctatgcgtcaatccattgagaagtaaatgttgagtaagagaagtaagaaaggcggagatcgaatgggagaatattagttgcgatcctggggggaatcgggaaaacgattccccactccgcctacgctccctgatcgggggcgccagccgatctattggcagtgggcccctctcacgcagcgctaatatataaagagagggagctggcgggcgcgcgaaccaaggttggtcgccgcacacacggactccccacaaaccctagaagtccctccgatctaggaagcgctgaagtgaggggaagcccgccgccgggtgtcgcaccaccatcactgacaccgacaccgtcgtcctcaccgacgccctcacatcaccgcaccatcgccatggctgtgtcaagctctaagaccggcaaaggtatgggttctctctctctctttctctaccgttcactctccaaggcaatcacccattattcctataagctagagttgaacccctagatctcacatagcaatcctaagaatctaacacatgcctcagtcagatttgagtggtagcagaggagcgccggcgagctccatctctccccggtggctgccatcctcggcgccgtgaggtggccgccactgaggtggaggccgaagctgcggtccgccggcgcgcgccggccgtcgttggccaaagacaaccctcgtcggtcgacttcctccacgacgccgaccccatgcgccggccgtcgttggccaaagacaaccctcgtcggtcgacttcctccacgacgccgaccccatctcaccgagcgctgcctcgccattgtcgactcctccactccggggaccgccgctccagctagctcctacgtcagctcccgccgccgcccgccaccaccactccggcttatgcccgccgccggctgaaggggacagtgagaaagaaagagagaagggaggaagaggggaggaaaaagaaagagagaggatgacatgtggggcccacaagtcagtgggacccacaattttttatgtgtgtgaatgactaacgggtcccgcatatatggctttaattcaaatgccacctaagcgccatgtcaaccccatagactggtcaacaccgctacgtcagcgccacgtcagcaaaacctctctaaaaatcaccaagggaatcaaattgtaccgatttaaatagttcgggggtcaagatatccggttttagggtagggttatggattagattcgggtcacttatcaggaagtcaaagtggacttattccaccaaatttgtaccggcactccactctctggtccgtgtggtggcccatggcatatggccgcccaacccattcgcaagaagaagaagtgccactggcactgggccgaacactggtttacaggcctgggcctacaaggcgaacagcagcgacagcaatctttagcgaccaaaccgcgacatcatccccatccaaccccgccgcggattgggatcaggtgcagtctctatatcgactgtaactttggcagtcgcgtcatccatagcgtccaaattgaatcaaacggtgttcactgaaaagaggttcgtcatggctccacttgagcacaaaggggctgatctggccggcagtagcgcgccagcgaacggcggtcggggaaaggctggtgaactaaaaaatgagttgcccagctcttgaggatcccgtgcatggtgaaatgaaagaggaatgtaatatatatgttccttaatccgggcagcactgggttcttactacggatccgtccgctctcaatcgagatagtaatgcatctgtgaggttggagatcgatcgatcgatggagatgcatgacgaagatgaaggcgaatttaataagctgctaattaattgaggctgtgttctgcttcaattttatttttaaggaatggtgagcttctacttcacgcacgcatatcagcatatgttcaaggtctgcttgatggggagatgaatatatagttgatgacggaagcgggcaagcgggtgcttggggttggcatgttgaggagcgagagcggcggtaaggcgccgggcaaggagcggctagctagcagcatgctcaggcgcgcgccggccgcaaggtccggtagcacagcgccgtcgtgtcgacatgctctggcctcttggctttggtgtgttggtgttgggctgaggtagatgacgatgtgcagggttgccttaacgtttggccgttacattaattttgtacgtggtggatcacgcgactgctaaagttgcagtcaatatacaacttcacctgatctgaatccccccggcgctggccgctgccgcccacagagcactcgcagccgcagcgggcaacagaaaaatcgacgtcgactcgtcgtcggcgccgtcaccatcgtcgcgcgcggagaccccatcgacccctagccagaacggcagaaacgatgtgtaacacaacgagagcgagaggaggccgaggccccgcagctaaggtgatgttcggatctgggactaaattttattctatatcacatcggatgtttgacactaattagaagtattaaacgtaaactaataataaagctaattgcataaataaaagctaattcacaagacaaattttctaagcctaattaattcataattagtacatgtgtactgtagcatcacataggttaattatggattaattaggctcaatagatttgtctcgtaaattagtctaagattatagattgtattttatcattagtctatatttaatacttttaattagtgtccaaatatcaaatatccgatctaacgtagagcagatgccttttttatacaccacgtcgccaacgcggcgtacgtacgtacgtcgagctggaaagcgatgggaggaagcagccacgatgatactcgcgctccgcgcgcgccggcgttgctgctgccgccgctcgcggagtgcacggctcctccggaatccggtgctctccaggcatcgaatcatccaacacttttttttactggctaagcacgcataatattaataaaataaggtaataatccatattaatttgcatgggggtagaggcgaatcgtactcacacacggccgtccatggcttctgccgcacgtgcgtgtgattaattaactaactatatccatggaattggataacaagatagccttacatacatccacagttctgcccaccactatggacggaaccatatgatatgaagaaatcggaggattaattaataagagcaaaacgaggaaatcgtgcagaaattgacatggatattagtcttctccagtgcgtagcggtgtgtggtttcgtcgtttcgatgtggaagtcgcaggggaatctagtctttgtgtcaaagtcgggcgatcgatcgccgcccatcgacaagccagacagcggcggttttgtacgcgcgcacgcttgctgctgcatgcgctcgcgccggcgagcggtggcccgtgacacgcgtactgtgcgtgcgtaactatcgtgacaaaacattgtactgtacccacttaatgataggggttccaatagtggggtaactgttcttaattagccattagtttccattgtcacggattgttgaatcgacgttggtttcgaattttggaaatttttgttgaacgaacagtatcaatccaccgcgggaggcaataatcaaggaggggaaaaaaagcaccattgtgtgctaacaactcctatacactctcacagggaaaggaatggacaccaatcaagtcgatgctatgcgaggctggataccgctagcccaataaaagatacatatgggctctcggccatcaccatgtagaaagaattgtcgagggaggggacgagagatgagaagttctgcttctctctcgaatagatccgatggtaacatccaagatgtcgccgaaaattgaattgatcgaagatggaacaggcaagaaaagcaggatctcctagatgacgtctccaaggaggtcccgctgcttgtcaaacttggactcataccgccagagagagaaggaggcatcacaacaacgtacgccctcaagagggatcgcattgcctagagcaccaccgttatcagcccgaacatgaaatgtcatcaaggcgcctataacatacctctcattgttgttgtaacctcgacgttgcaccacaaaccgaattctgccatatgcccttctctgccacaccgatgctactccacctgctatttctcatcggacaaggagctccactgcatcgatgacccttcgtcggcttctttgcagcacccctccttccgggggcccctcaccccaaaagtctacgccaccctttctgtagacacgaagcaacgagcaccactgtctcctacattaatattgctatgccaccacagggtcacatccaccatgtcttcgagccaccccaaggcccctctcctctcatgccgtgtcaccacgccgtcgcaggcccttgctcaccgcatccacccttcccctgctgcggatacaacgacccttgctcggcggcaccccgttgcctcgtttctggtcccaatgcacatcatctccatcgtcggtccacgttcgcaacagcccgggaggctttagatccagacagcgggagggcattggaactgcccaagaggcatcagatctagtggctctggccctctccggctctccctcattgcctcctccgtgtctgaactctaccgtgtgccactccatcgcacaccgccaccacgtcctctactacgccggcctcctgatgtccatcagtctcctcatcagtaccggtcgaggagaggccggatctaggcaacaccaactcccgagccgcctcggtgccctagctgttgtggcatagttgggggaggaacagagtgccatgaaaccgtcgtggttgcggaaactgcatatgtggacatcacatccatgagtaaaattattacttcggataacgtgaacaaatctcaaaagttcattatttttttaatctaataataattttaggtattcactgtataagtgatttatcgtacataattttccatggttgcctggcaccagttgccacccgcggtgtcatactgagatgatgcatgagactgcaaccggccggaagtgttccttcctggcttcctcttctaccgggacgcgtcagatgaagcactggccacgtcactttcgttgcagccattgttgttgtcagcgtactagcgatcatttattcctcggcgcatataggggtacaaacaaagtcaaagggctccatcgaaactgcgtaatgcgtgccggtaagagcctctcctgcaattgcccgctgctagcaaatgttgtgcggattcttcctcatccaaatgcagcaaatggattctatatagcaacgaaatgctaaatctcagccacctcttaacggcaagacctgtttcagaatagaaaaatgctaaagcaatcttacttgaattcagctgcgttcgcttctaaaactaaaactttagacgataactttcttgtttttcgttagtttttctaaaccgtaaaatgatgtgtttttttaaaaggttttttctaaaccgtataacaattaatacttgattaattatatgttattggattattttattttacatgtcactgaaaagctaaaccgaattacatattcaaaatatgtactccctccgttttttaatagatgacgccgttgactttttctcacacgtttgaccattcgtcttattcaaaaaaaaattatgtaattataatttattttgctatgagatgttttatcactcatagtactttaagtgtgatttatatcttannnnnnnnnnnnnnnnnnnnnnnnnnnnnnnnnnnnatagtgatatatcaattcaaccag

SEQ ID NO: 63182 - DNA, 5522 bp, Oryza sativa
  unsure (1)..(5522): unsure at all n locations
gcgggnctttgaatgactatcnnnnnnnnnnnnnnnnnnnnnnnnnnnnnnnnnnnttgaaaaaattatgaaaaaaataaaaagacaagtcacgcataaaatattaatcatgttttatcatctaacaataatgaaaatacgaattataaaaaaatttcatataagacggatagtcaaagttgaacacggaaacccagggtttgactttgtttgagacggagggagtacattcgaaaggaacctctagaattgctttgagattgagtaaaagaatatgatccctcggtcttctaactccgttccctcttccttggtgctatctctattatcacatctatcttacccattgatttttcggtttcaaaaggtgtctaaaacactagaaaacatttttttcgtctattataaatttttattttttgcttcattaattttttttcacttaattgtagagcaaacaatggaagcacataggattttggaaagacataacacattctagtgttatgaatctggataggctctctatccaaatccgttgtattaggatatgttatatccctctaaagttactcatattatgggattgagggagtacctcttaaaacatgcccctgtgttgtggcatccgaggggaatatctcaacaggttatttccagaaattaaacaacaatattactagttcgagaaaacggcagacgcatatgcagcgtgaggttagtcagagggagcaatgattatagtacaccaatgatcgacgcagcgttaatcagtgtgctaactgattggagtggccgtagtcgcagtagcagtgatcagcttgggatcgcgacgagattatatattttcctttaaacactcactcatcacttgattttgaattgaatcgttcgacacgacggtctcgacagtgagaggaggaagaagcttccaatatctgattaaccgattaattaatcctgtattatattgacatcccaacgtgatgtgctcatgtgcatatgcatgtcgacaaaatcactgattaattaatttactagtttacttactatactactgctgcaaagaggaggcccaagctagcaaaagctttacagtcttcatccctgaatattttctcaattcgatctgcagttgtaacttgctagctatctgctctctactaattacaccccaaatcacacatacagcctctcgacttatgtaattagacgctggattaattatgtgaatttgctaatagctagcagggatatgaaactactacaagctgttccagcagcagcagcagcagcagcttcagcttgactgaattcatgctctcccaggacctttgggagggtcatggcggttgttgggtcctgacccggggtagtcgttcacctccacgtccatcctcgccgccggcctcctgccgagccctctcgccgccgccgccgccgccatctcctgcaagaacggtcacaagccatggtcagagttgctgtcactaacactattagtttgattcagaatttggcttcgtttcagaactggtttgagcactgtgctgcccgtattctgaatagtgtttgtgattttgcagcaacaaagtcgacaaacttaaattggagggggaaaaaattcagagattgcaggggatgagaaagattaattacatctggagagaggttcagagacggcgggtgttgctgctgctggctgctcaagtgcaggcttcctgcaaaagcaagaacgaatcaacacacaaatcacaatcaagaaacagttaagcacagagatcaagaactcgagggagaagaatcaagaaacagctacccatcaacgaaagcttactcgacatgggcaccgaggagacgagcagtgggaggaggaggaggaggcaggacagagccaggacggcgacgaggtcacgaggcctcctctccattgcgcggcgcatgcaggagcaaaagcagaagcaaaccgagccagacaaagccaagaacggccgcgagggcgaagagctcgccgctaggtgttcttggtgtgtgtgtgatctgtggtaggatgagacgatggatggatggatggatggtgtactgatggtgtttattgctggctgctgctgccgccttggggttttatagttggaccatgctagctaggcaggcaatggctctttccattttgttcttcttctctctcttaaaaggtcaacttcacatcagtagtactccatctagttatgacttatgaggaggaaaaaaaaaggtgtactccatcctagccgaatggctttaattagaagaaggtggtgacggatgcaatgtgtggtcatgactcgtggactctggtggggctatagagccttcgcaacacgtctatgtggcgagtggctttaaccggccacgttggagctgcaagtttagctcgagtcaagttgtgtccctttagagctacttctgacttgcagagagcacatgtgtcttgtttgacgagggcaatcatgtgtttgaagctacgtctcgccgatcgtgttggatgagcccatggctctaagctacgagaggtggggccttgatttagagctgggaggaggcggtggaggctagaaagaagacaatggtaaccactgggggtgagggaagagaggacaaggaggatggctaatgactagggagaagaagggcccacctactacggatgatgccactagatgctccactaccccaatccgatctgccgttagggagcctgccgccctattttgctctgtgcaaccccgacatgtgcaactgccgaggagcttgttgaccacatgcgtcgccaaggtgcttgttagttagatgcactgccacaagggaggtgatggccatcttcttcaccggtgaagagatcaatggaggtggcggcgatggcaatggaatagcgaaggttcagatgaggatgaccttcgcatggccaggtccgtttgcgaacgcttgtcctacttgctgggagagaagaggcagtggcggtggtggaagtagggatgaaaatggagcgaatatagacggataatgctcatatcatatttgttttcatttttttttgctagatatgaaaacgaatacgaatagctcggatacgaaaataaatatgaattatcttgaatacaaataacgattgaatatgatcggacacgaatacggaaatattttttttttcttggaacatgaaaaccaccttaacttctaataaaaacaaatatcatcatatataattagcttgttttatataaaatatagtataatttataaaaaatatttaaaagtttaaataatattaatagtgtgtattagtgttaagagatgagctactattaaaatctaaaaaggtagattgaaggtcgtagagttataaagaaatggtgtatgtctcacgacttcagcagatatccgaatagcactggtcatcgaatatccttatctgtcggaaaccccgataccatatctatcggcggaataggtcgtgactacaatatttacatagtatgatgatcggtgggaccaatatatacacgatattgagataaagagatggataaaagaatttttatacaagttcggatctcttaactgataggtaatagctcttactctgttggctgaagccaatgatgctcttatatatctgtatcacatctttactattataaaatttaaagatgtttttgtcgagatttttgttcattatccgtatttgagtgagtttttagtcgcttaaccatttggtccgtttatatcgctgaaaattaattaactatttgtatcaaatacgaatacgggaggtgcgtggacgtcgaatttgtttatgccgatgaggtcacatacacgtatatatgtacgacagtttggagtttgagtcttacattttcttggtacgtgccgatcgatcgagctgtccagcagccatggacgtacttcgtttttcagatttgcaacgtgaattatatagaggatatctctatctcttctctactgatattttcaccgggattttagtatttcatccgtgtttaaattagtttttaagttggttttctaatcttcattttttattatatttattggctctatgtcttctctacctctacttctctatctctatctctatctctatctatatctcttctctactactacctccgttttttaatagatgacgccgttgactttttctcacatgtttgaccatttatcttattaaaaaattacgtaattataatttattttgttatgagttgttttatcactcatagtattttaagtgtgatttatattttatacatttgcataaaatttttaaataaaacgaatggtcaaatatataagaaaaagtcaacgacgttatatattaaaaaatggagagagtattataaaagatgttctatagctttgatacgtcgggtatcaccgattcaaagattgccgacatgaatccaaacgcttccgttgctttttttttcctgcgctcgcatgcgtttcacttttgcttcgtctgcagcacatttgccccctccgattcggttttactgttgccacgatcaagcgagatggacttggcttgtactccgtggcgatgggagaggtgtgcgcctggttagattggaaggaaatactgatggagatggcctgcctgtgcatcgctgcatcgtttctttttcagcccagtcaagtataattaatagatcccaacgagcaaatatatctgttcacctcctgttatcgtgaaaagaaataaaaactgaaaattactgatgggagacaatagcgtggcatctcttctctactattataaaaatcaaagatgcttttgccagtactttagtgcattattattgtttgagtcggtttttaagttcattcgcttttgaaaatacaaaagaaattgtataagaaactttttataaagaaacttggatgctaacttgagacgaaagttgaactcctaattgcagctcatgattttctttaaaaaaaatccatgcgaatatttgggacacacatgcattttttctagtaagtataatatttgggctaacctatctagccatcgtcaacttgatggcgtggatctccacacatggtcgatgacaggtagtcttcttcctcgaacatgaacttggcgagatcagagataacactagatccctcttgtcagcctctgcggctccagattgggtatatctaggcttatctctgtgtttgtgtctggcggcgtgtattgatgattgggcctccactttctcctcccagggatcttgtatttatacccaaatgttcccttgtccatgtagaactagggaaacaagaatgtatacaatctgagtactccttatagtttccaatattaaaccctgctttttcttccttatctggaacacctttcgtatgcgaggcatgatttcgcattagacttggggccctgttgggcaacatcactaacttcaggcttttaagcttttttttttggatgacttccaacgaagcaccaaccg

SEQ ID NO: 63183 - DNA, 2233 bp, Oryza sativa
  unsure (1)..(2233): unsure at all n locations
agatttgaagtacacgattgatctataggccgaattcgagctcggtaccccccggggttgagcggtgacggcgccccgcaaatttccggggctggggcacggattgtaaaccacctgcgcggttgcgtgtgacctgatggggcctcgggatatgagatatgtctcaaaatgtagtccattccaacaatacaagcccagttggcctagcaagtgagacatataaaaggtaaatcctaatctcccaataccccattccctacttccactcccctgacccattctacacagctgccgctggctggctgtcaccgcgtcaccttcacctccgctcatcgccgttgtttacactccggctgtgctcatagtcgcgcttgcttttgcctacgcctctgctcggtgccacgcttgcattgttcgtagacgcgccaccgctgcctgctgctccgattggcggcgccttcttctcttgtcacacgacggtgcatccaccagccgcctcttcaaagaatcctctcctccaggtgcaccgggcccccggtcgagtggcggggcctcgggggggccggcggtggggattattttcgacccatccttcactttcagggcttagcccgggtggacccgcaatgaagcgggagcggtgccgttacaacccaacccgggtttgccccgccccgttgccatccccttttttctttggaatggacggaaactatccgctccattttcatccctaggtggaaggggataggccagggactttgaatgtgccctaggaagaagtgaattaatttgtgccctatgtgacaggaatacaaactttcttttatctcttctttgaatgtgcattcagcaaagaatgttggcttcaggtggttatagtctggcactagaatttcaatttgggagatatgcttcaagcagcaaaagcttcatatacttcatctcattttgtggagaaatttttatatggtgcttggcacatttggaagcagagaaatggttttatacttcatcttattcttggagcctggggcactataatcttattttttaggtaggtttctcggggacatttgaaggaaaccaaacggcattgacaagacggttgaatgacaatgcaaaaaggatgtagaatggtagcaccgtgagcccctccttgtactataatagaaaagggacatgctagaaaaaagggctaacttgtgtctggtttgaaaaaggcaaagtttgtatttctccagatatagataccaacaaaaagaacatgagtagcgtattacacctctgagtggcctgaacctgtataaatatcttgtgttcatatgcttggtggggtgctcgggccccacaaacttgttttctggagcatcgtgcgcaactagctcctggtcggatctttatttttggggaggggtctacacttccccgctgccagagaatcgctccttcgataatgttagtataaaattagttgttgggtcaaggagttacttctccgcaattataagtcatctcttatcttgagccatttgataatgttagtacaaatatatcaaccgttggatcaaggagatacttatccccattcattagtcatccttacccctcctcgacaccattatccaaatacacatcatgaatcatactatgccattttatcatgttagtataaaatcatcaatcattggataaggcagttacttatccacattaatttttagtaatttctaccccttctctccaccttcaattagatacacatcacaagtaaatcgaaacatatttgattatgtcagtatgatattatgaaccgttggatagaggagttgcatatctatatttaccggtcgtctcttatctaagccatttgaatatgttagtataaaacagtcaaccatttgattaaggagttacttatatgtgctcattagtcatctcttatactgttcttcacccttaacaaaatccccgtcattagggcaccttaagccttttgatcatggttagtataaaatattcatttgttagaccaagaagtttaccttgtctggtattttctttagttagttttctttccttctccttctctacnnttttaatnnaaatagagaaaaanngtccgannatatagccccacccacgaanctattgtggcggtacgaattaccccctcaggggatcctctagagtcgacgtgcaggcagacaagagtagtatcatcaatcactct

SEQ ID NO: 63184 - DNA, 7261 bp, Oryza sativa
  unsure (1)..(7261): unsure at all n locations
cgggccattagattctatgcttgctgccngcaggncgactctagaggatcccccatttttgatttcctgaggactgtgtttgtgccatcgtttccttttgaagaatcttggcttgaattagcacgctcgtgctcgaccctgccctcggtggcccgagccggctaaaatcgccaaccggggcccagaaccgagccgtgccccggggcgtggtgaactccgggggggaatcggcaaaggcccacaatcgggtcatccataaccctcggtcaccgcgctcccggcctggccagtctcgacacgaggatctccccaggcactagccccgacccgcgccgtttgaggctgggacctgggcacgagcccttgttcaagccaagacacagaaggaccgcggcacaaaccatcctcgtctcatacacacaacaaacagaactgacgcagaaatttcctctttacttgattgcagattaaatcagtctatacaagaagggggcccgaaggcctcggaagaagaaggaaaagttattaagattggcgggggcctgggggctcactccgacgcgcccgggtcgccggcctcgtcgtcgctgtcgtccgcaccgtcgtcaccgccctcctcgtcggagtcgagcgcgaatgcgagccgaggggccgtaccctcgaagctgtggacgatgtggtcagcggcgtcccggacctgcgcgcgcgcgccgtcctcggttccaggagggaactcttccagcgctgcccatggggagaagtcagggtccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggcgtacttcgcgtaccgcccgcccagaggtccgcctgccgcccggcgcggtctagatgggagacggcgtcccgaagcatgccgggccctacctcgctcgccatgcggagggcctcgaccttcccggcggacgagtccagcgcgccctgcagctcggcgatggtgtgttcagcggctgcgaggcatgcggctaggtcgccgtggcccgcggccgccccgccgctgtgcgctctcgcgtccagctcctttgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgcggcctcggcctcctcgagagcttgcccccgctcggtgagcgcgtcctcgcggaggcagagtccggactcctcttcggcgcaggcggcctcgtgcgccgccagtgttgcctcccgggtggcaacggcggcctcgcggtccgccaggtctctctccttcacgtccagggcgtgggcgcgctcctccagtgccgtggcgcgagcctcaagggcctcttcgcgctgccgggacgccgcctcgttctccgccgcccgccgttcccgggcagcggcggcgtcaaggactccccgggcggcgtcgagcttctcctctagctccgccgcccggctcccgtattggaggcggaggtcgtcccgcgcctcgtcaagcacggcggtggcgatgagggcagtctcccgctcctcctccacctccctggcgatctccgccaggtccctacgacgggcctcgagctgtgaggcgtgccggcggtgtgccttgcggtccgccttcaccatggcctccaccgagcgccggccctcctagacacgcgcccacgccgcgtcgagctccgcccgctccgcctgcagggccttcatctgggcacttaacccgtccagcaccgtgctgttcgcggcggccaaggcctgcaggaggggctccgcgctcagtggggcagcggaaggcagaggggagagccgcctcggtgtgggtgccgcgcggctcggcccgccgatcgacgagctggactcgagggcgtcccccgaagctggcttgtcccaagcgtcgcccgaggggtcgggcccgagcggcgcgcccgcggcctcgtcgtgggtagcctcggaagtcgtcgtcgcctcggcggagtcgggtcgggggcttggcaggtcgcctggcgcgcgcgggccggctttgccttccggacggactccccggcccggcggagtctggcctccttccgagcggcctcctcagcctggcgaacccggacggcctcttgggcagcctcctcggcttcccggaggcggtccgcggcttctcgctggtcagcttcccgcctccgggcctccgcggtcgccgtctcctcggcctcagaccggctggacttggaatggcggggggggagggggggggggcgcgacgggatctcgctgaggcagaagaaaaaccagaagacaaaaagaaacgggtgagtgaaaactcgccttgggagatgggagaatgaatacggccgcggtgggtgcggggacgaacctgcggggaggtcggctaaacgaccacctcgggggcgagatgaggttcccccggcatggctcggtcccccccatcttgcggagccgtttcttctttcgctccccctcgggctgtggcgtcggcagggcaccctccgggcgcctgctgctggcacgcaccgccccgccccctcggggaggagatgggggaggggtaccctcctgcttcctcttcccccgggcgtcggcagggcggctgccccccgggcccccgtcaaggggcccagaagcacgaccccctcccggggtagattgttcccccctgcggctcccgcccgcgccatcgtggcctcggggggcccgctcccccgacgccccgaccacctgcattatggccaggatcttggcgcgctctggatcgcagcagagggggaggaccccttgggggatgagggatgcctccacggagctgagattcagcacccgttggatcaccatcctgaagtcctcagggtcccagtcccatttgcgcccctggtgggtcctcatgtagtcctcgggcccggtgtactcccaggcgccccgggcgcgccgctggagcggcgcgatccggcgacgaaggtagtcgccgaacaccatggcccccgtgagcccctgggatcgcagacccaccaggcggtcaagaacggcgtcgtagccgtctcccagatctaccgccgcccgccagctggaggcctgcgccgggggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcggcggcgacaccggctgtacggtgaagaaccaccggaacagtcggagagatgggcgcaccccgataaacatctcgcacaggtgcgcgaagatggccaacgtcattatcgcgttgggggtgaggtgcgccatctgcagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcatgaatcggcgcggcagcccggcctgcctctcgcttacgatgcgggaaggcggcagcacgctaccgtcgagcggtgcggagccccgtgccatgacgccggcggaggaggagcttgagagcgagcgagtgcggcaagggtagggcacaggaaacgaagagttagagcgcaagtggcgaaggcaaggggaagagtagcgagaggaaggaaacgaatcccttcctcggcgtctttacacccttgccaacgctatgcccggctcctcgcttcccgcgcccactacctcgccccctcgtttctcgcgcccacgcctacactaaccccactcgcccgtttgcggcgcacgcggcagatgtgcggccgtggcggttgagatggggcagatcgtgcgcgcattaactacgctcgccaaccgtgaaaagcgccatcatcatgtctccaggcgaaacgagccggctcgttccgattcgcgcgctgctcgagtaatgtagcggtcttaaagaggccgctcattattgtcggcgggttttcccttgccgatgcgcgcgatttgcgaccgctgggtttctgcccacctgtagggaccggccccacctgtcaccgggcctaaggagtggcgtcacgcccgagcgcttccctcgaggggggcgatcaccatggcgtaacgccgggggctactgtcggtgacatggggccgggggtatcgtgactagaggcttgggtagccgcggtcacccacgtggcctgaccccgtcggggggggggggggggtcgggcccaagggtaacgtgaccacccctccctctgtctccccgaggggtcgggccgctcccgtttcggccccgagggctggggcgcccccgtttcggccccgagggctggggcgccccgaccccctgtggttttggcgccacgtgtgtgggttaggtgagcacagcggggctcacctaaccgcatttatagcaggatggacgaacgcgccacgccgcatttaatgcggcgcagcgcacgcttatccggtccgtgaccggtcgcggtgtgtgaccggtcacagaccagtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagtgcaagcatggcaaggaagtcgctggccattgaatgaaggttgaaatgggcgtccaccgggaaagctggcaagcggggcaggaggcgtgtgctctgcttgtcagaggtcacttccggctgtagactagccctcattgtaaaaagcatgtttcctttcttaggcagctagaggcccatgtggtgacccctgaccagatcaaaaggaggcccaggcctaggaggggaaaaaaagagaaaaaagagaaagaggggttgggactctagcgaaggggttctagagcctgaactctctctcgctctctggctctttgtattccttcacacacagatccaccagaacacaggagttgggtgttacgcttctcagcggcccgaacctgtctacgtcgctcgtgtcttgtgcacttcctctctcgctgacgttcctcagatcgagggcgaagaacctcacttagcgcccccggccgaaccggcaaagggggacctgcgcggtctcccggtgaggagccccacgctccgtcaggtggcattcgccctgcctcgccaatgccaatgatggtgtgctgtgtcggcttctccctgaagaagacgctgcagaggatgactccgacgctgggatacgacgacaaagccctttttggaattgcatttgacatgccaaatgttttttaaatttgtgatggtggaattgaactgtgaattttcttattagaggatattcaaatctggattttctttttttttacactagaaattatttttgcatgtgggtgaattaagcatgtcgcctgtgaaaaatcaattttcacaagcggatctcttagggtgcccacctttgaaaaccgtcgattttcacaagccttcaatcgcagacggggcgtctggcaatgtgcaaaattgcattttggccacctcgaaaaatcttgatttgtagtagtgcactcaacttatgtaattagatactttattaattatgagagttgctgacaactagcagagataatgcgaaactacaagctagctagttccagcagcagcttgattgatttcattctctcccaggtggacgtttagggttatggcgggggttggctcctggcgccaggtagtcattcacctccacatcggtcgtcgccgccaccatgccctggacggacatttctctccctggtggacgtttagggttatggcggggattggctcctggcgctgggtagtcattcacctccacgtccgtcgccgctgccaccatgccctggacggacatttctctccctggtggacttttagggttatggcgggggttggctcccggcgccgggtagtcattcacctccacattattcgttgccgccgccaccatgccctggacggacatttctcttcctggtggacgtttagggttatggcggggattggctcctggcgctgggtagtcattcacctccacgtccgtcgtcgtcgccgccaccatgtcctgcacggacatacacaaagccatgttcagaatcactatcaacattactatttgtttcagtatttagcctccagaacgaacatattcattttagaattggtttgtgaaggtagctatgaactgtctatgatattttattaacaggccggcaaatttaaatattaggggaatatagagattggaggacttgagaaagattaactacatctgcagagatgttcagagacgacaggtgttgctgctgctggctgctcaagtgcaggcttcctgcaaaagcaagaacgaatcaacacacaaatcacaatcaagaaacagttaagcacagagatcaagaactcgagggagaagaatcaagaaacagctacccatcaacgaaagcttactcgacatgggcaccgaggagacgagcagtgggaggaggaggaggaggcaagacagagccaggacggcgacgaggtcacgaggcctcctctccattgcgcggcgcatgcaggagcaaaagcagaagcaaaccgagccagacaaagccaagaacggccgcgagggcgaagagctcgccgctaggtgttcttggtgtgtgtgtgatctgtggtaggatgagacgatggatggatggatggatggtgtactgatggtgtttattgctggctgctgctgccgccttggggttttatagttggaccatgctagctaggcaggcaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63185 - DNA, 4201 bp, Oryza sativa
  unsure (1)..(4201): unsure at all n locations
acgatgatgtactcgattactatagggcgaattcgagctcggtacccccgacatgggcaccgaggagaacagtagtgggaaaaagagtaagctggacataaccaagacggcgacgagatcacgagacctcatttccattacgcggcgcatcaagggtagcaaccgaggcagccaagaacggctgcaagaaaaaagagctcgtggctacttgttgttctttgtgtagtgtgatctgtgttaggaggagacaatgatggatggattgatggcactgggatgagtagtggactcgcagtgttgctgccgctgccttggggtacttatcaaacgttggatgaagcatttacttatcaacattcatctgtgatctccttagcccctcctctccacctatatttagctacacatcatgagtaatccttatccaattgatcatgttagcataaaactagttgttagatcaaggagttacttatccgtaattataagttgcctcttatgccgaaccatttcattatgttaatacaaatatatcaaccgatggatcaaggagatacttatccccattcattagtcatccttacccctcctcgacaccattatccaaatacacatcatgaatcatactatgccattttatcatgttagtataaaatcatcaatcattggataaggcagttacttatccacattaatttttagtaatttctaccccttctctccaccttcaattagatacacatcacaagtaaatcgaaacatatttgattatgtcagtatgatattatgaaccgttggatagaggagttgcatatctatatttaccggtcgtctcttatctaagccatttgaatatgttagtataaaacagtcaaccatttgattaaggagttacttatatgtgctcattagtcatctcttctactgttctctacctttaacatatacacatcatgagtaacctaagtcatttgatcatgttagtataaaataatcatctgttagatcaaggagttacttgtctgtatttcttagttggttcttcctctcctctctacctttaataataggaaaaagtccgaattagccccccacgaactattgtggcggtacgaattaccccctcaattcaaaaaccagacattcttcaccctcaacttttcatatcggacgaattaccccctgatcgactccagagtggttttggtcctacgtggcacaaatgtggcagtccagttagcataaaagaataaaaaaatagaggagcccacttgtcaattttgcctcttctcttagtcaccacatgtgggccctatatttttaatttttttatgctgactggactgccacgtgtgcgacacgtaagaccaaaactgttccgaagtttgtcaggggtaattcgtccatataaaaagttgagggtgcagtttttgaattgagggggtaatttcaactgccacaatagtttagggggctaatttgggctttttccttaataataccttgatagtagcatcttctcatgacctttatagttccacctccccgtgacatatattgttttgaccaaaataatgcagacctcattgcggctggcattcgccttccaccgtcaacgccagtgatggtgtgctgcatcggcttctccctgaaaaagacactgcaaaggatgactctgccactgcgcaaaggatgactctgccactgggatgccaccgacgaagttcttggcggaattgcatttgatatgtcaattcttttttaaatttgtgatggtggaattgcattctgattttcaaattggaggatattaaaatctagattttcattttttacactagaaattctttttgtatgtgggtaaattaagtgtgccacctataaaaaattgatttttgcaagtgggtctcttaggatgcttgccttcgaaaactgtagatcttctcaagccttcaatcataggcagggtgtgtggccatgtgcaaatcgcgttttgaccacctcgaaaaaaaatcttgtttcgtaatagtgcacttgacttatgtaattatatactttattaattctgagagtcactgacatctagcagaaataatgcagaactacatgctagctagttccagtagtagcttgattgatttcattctcttcttggtggacgtttagggttatggcggtggttggctcctggcgtcgggtagtcattcacctccgcattcgtcgttgccgccaccatgtcctggacggacatttctctccccagtggacgtttagggttatggcgaggattggctcttagcgctggatagtcattcacctccacgtccgtcgccgctgccaccatatccctgcatggacatacacaaagccatgttcagaatcactatcaccaacattactaattgtttcagaatttagccttcagaaagtacatattcattttagaattggtttgtaaaggtggctatgaactgtctacgagattttgtagtaacatgccaacaaattaatttaaatcttacgggaattcagaaattgaaggacatgagaaagattaactacatctgcatagatgtttcgagatgacgggtgttgttgttgnctgctcaagtgcacgattcctgcaagaacgcatcgacacgcaaattataattatcaactagtcaaaacacatatcaagaattccaggagatctatgacgacgaagctttacccgacacgggcaccgaggagacgagtagtgggaggagcaataggcaggacatagccaggacggcggcgagatcacgaggcctcatttccattgcgcggcacatgcaggaggtagcaaccgaggcagccaagaatggccgcgagaaaaaagagctcgtggctactacttcgtttcacaatgtaagactttctagtattgtccatattcatatagatgttagtgaatcgagacacatctatatgaatgtgggtaatgctagaaagtcttccattgtgaaacagagggagtatttgttttttttgggtgtgtgtgatctgtggtcggaggagacgatgatgtatggatggatggcactgggatgggtagttgactcgtagtgttgggagaaagctacccatcggacgtccgatgaaaaaaaaacggatggtcaaatattgcagttggccaacaagtcaaacattaagttatatatggtgaaacaaaaaaatcagcaactgaaacatttaaatattttatgaaacatggtgaagatgcacgttgaaacaggtcgctgtcacatatgaaacagcaagtattaacggatacatgtgtttttctttcaacaaaatataatcatgcaatatcttgttgtaaagatttaattaaaacgaatacaatggtgcgatcggatcatagattggataaataatttaagagaaaaattattttgaagtttgctaaaatacatgcatgtgtgcatggatgagatggagagaaagtagtagcagttagtttcaaaaaatttatgaaaggaaaaggctatacgtactaactttttcttactaaattcttactaatactgatgtgtcatgctatgagtgcatctagatttttttataacttctatctacttaaatcaaacggttgaaatgattgttagtaaaagtttagtcagaaaaatttagtacgtgtagcattgctctttatgaaacacacggaagacgcacattgaaacatatcactatcacgcatgaaacatttagttttaacggtttgaaacacatgtttttcttttgacataatataattatatgatatcttgttgtaaatatttaattgcaacgaatacaatagtgtgattggttcgtagattggataagtaatttagaagaaaaaatatttaaagagaggaggaaagaatgaaaagaaatagctaggcatacatgttacagtgatagggttcgtccgatccatcaggccgctgatttgcagcatttttagtgtggtagatgaggcgtccgatatttctgtttcgtcggacgtgcgatataaagcgttttccatagtgttgctgtcgctaccttggggagggggggtacttatcaaacgttggatgaatcatttacttatccggttcatttgtgatctgtacccctcctctccccctatattagcncacatccgagtaccttanatncncanntntntgaatcccantgttttatacgt

SEQ ID NO: 63186 - DNA, 1951 bp, Oryza sativa
  unsure (1)..(1951): unsure at all n locations
cgggggtaaaggggtttgcaccaccgatggaggacccctccccgattaaacccacggctgatataaaaaggcccccttcctaaggaaaaagcgaccgttcccgtaagcgaaggtgtgacaagaaggcccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgatgtatatacatcggttgctactcctttggaggaaggattccagttttgtggagtatgtagttattctgtttggtctgatttatcatgactagctgcgcttctttgatagattctagatttgttagatgcgagggaaagcaccggtactgaggcgatatagctattgtgatggcgtagtagcctattcttgtgtgtgctatatgaaccagggaacccgctttgcagggaaggtttgtctcatgtttcttctgccagtagtcacccgacagttcacccctttctgggtttctggattcctagtcatggatggtaatccgatgcgcgtatgaactgcaatgtttctggttctcttgagtgctttgagcatttgaggaaccttgtgtgtgtcgcacagtcgcactcaggtgctatggcctttgtgattgcatagtagcctagttgattaatgtgcaagatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtggtggagggttaccttatgggccctctcccctgaataacgcgtttttcccctttagcctgtggaccccctttcttataaagggggtcttgttgccacacggtgcaccacctctcccctttttgtggttattttttttaatatagaggatattccgcctttcgcccttgtggaaaaaaaagggcgttttatacaaaattttccgcgctttacaaacatatatgcctccccctcttctgtggcgcgttttctccttaccaactgggcgggggttcaccaccattgtgtggctctcttccaacagtttgttgtcgccatataaaaacaccccacccccccacacttttggcccctctgggtgtttttt

SEQ ID NO: 63187 - DNA, 1392 bp, Oryza sativa
  unsure (1)..(1392): unsure at all n locations
ttccctgatttcttatatattttataatgtggactgatctatnttccacctcttgctttntactantcnnngnnggtttnaaanngttatttctgacanttncaannnnnnnnnnnnncnccctggctttgatgtctagctcactcatagccgaatncgagctcggnacccagcgaagggacgatgagtctcttcgctcgtacattcagcggttctgtcaagtccgcaacaccttaccgtgcatccccgcacacgccgtgaactacgcgttcaaggggggcgtgcggcacaaccgcatgctcgagaagatccctccaaggagccccagaccaccgcgtagctttttgagctcgcggaccgtgtggctcgcaaggaggaggcctgggcctggaactcctccggttctggtgtggcagctcccgccgcccccgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagagacaggagcgccgtgagggcaagaccccggcggctcccgccgccaaccggcgaggtgaggccaagcagaaggcccccgccgaggacatcgacgatggcgacgatgacctggggttccaggagcctgaggccaccgtcgccaccgtcgatgggggagcgtgcgctcacgcttctcgccggagcctcaaggccatgaagcgagagcttctggctgcggcccctacccatgaggcgacacggcgggtgcggtggtcgaaggttgccctcacctttgactagaccgaccacccgccgtgcgttgcccggggaggacagatcgcgatggtggtttcccccaccgtttgcaatgtgaagttggggcgtgtcctcatagaacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttaaatgtgacggacctcagtctgccctacaacgcggtcctgggaggcccgcgttggtgaagttcannnnnnnnnnnnnnnnnnnnnnnnnnnnnnnnnnnngttcttcactggcaantcaccatcg

SEQ ID NO: 63188 - DNA, 3191 bp, Oryza sativa
  unsure (1)..(3191): unsure at all n locations
gcgcgtgagtgctcattgactatagggcgaattcgagctcggtacccttatgtacttaacagatgttgcagaaggtggagaaacagttttccctctagctgaggtaatttctttactccattgtctccacggtgtttttttaaaagaaaaggagagaaatctgagccaacaggccacaaccaagcatgggctcctttactttctcagcggttttgtgaatttgttttgggatctcttattgcatcattttctctacacacatttgtcaaacaggagtttacagaaagtggcacaaacaatgaagattcaaccttgtcagaatgtgctaaaaaaggtgttgcaggtataaatttctaccgatgttccttttttttgtttgtaattatgattcccatgatttttgtaatatatcttatgcatttctcaattgatatactactgctacctcagtgaaaccacgaaaaggggatgcacttctgttcttcaaccttagcccagatgcttcaaaagattcattgagcctccacgctggatgcccagtcataaagggtgagaaatggtctgctacaaagtggattcgtgtagcctcattcgacaaggtttatcacacacaaggcaattgcactgacgacaatgagagttgtgaaaaatgggctgccttgggagagtgcataaagaacccagaatacatgattggaacagcagcattaccaggttactgcaggaagagttgcaacatatgttagcgatccaattgtaaataatcaacggtaactgctttgtcggcagtctgatttatacaggaatgggttaaaataagtaggttcatgaggtttttggcacaaattctaccagttttggttacttcctgatgacaacttggtttttgttaccattcttcaatggtaactggcaggaattagaaagcaactcattgttagtatccataatttatgctagatggagatgcactttatcagtgcaatttctttggagagcaggtttttgtttttatttcatagagttgtcgacttgagcctactaggttatggttggattctgccagaatttacaaacatctggtctggttttcatctgtaatccttgagttgtcgacttgaacctactaggtcatggttagatcctgccagaatttacaaacatctggcctggttttcatacctgtaatccttctcatttgtggtatatagcttcagtgatttttgaattcattaatcaaatctctttatcactctaattctgcattctgtactggaatatgttcaattgcctgctatctgtgtgcaactcaagagctttttactgaccaatgatgatgaacaaagcttcaggagagccagaactacggccatgtttgggaagccgaagattctgagaaatagccgataagtagccagctagtgataatctgtgttttctagcttttggaaaccactatttcattttatggattctatagcttctgatcctcagaatattgataagaattgaagctgtttggaagaaccggagattctgggagaaactgtaaccgccaaacctccccaaaaactggtcctgaaccttttgagtctgaactctgaaccatctcagggcaagtactataatgtctcatatgttgcctctaaaagtgccatattggattgagtgataaggtgaaagagaaaagtgagaagattgatgatgagtcacccctaaattaagaggcaacctccacacaaatttcaaaaagagtgcgagaagggtgtcttttatttcataagtgaataaaatagacaaatttagaggtggtagtcatatttgccctcattagtcatgacatctcctgttcctttctcacgacatgacgccgtccaactgcgagaagccctgcacaagcacacaagatccttttgggtgcttgcccataatgtggcagcagttgtagcagaagtgagaaccctgatgagcttgcagttttgcagcccagctcacatgggaacagaaaaaactcacaaatggatggacagttgggaattgaatttgatgatgctgttgcttgccatcttcattcattgctgctatcttggagtactgtacaaaatgtgcagtcggtcggtgcgttgtgtccacattcacaaccgccttcattcattcattcattcacttctatgtgcatcatgctggcaaaggcatttgtcattctgttttaactactttgctgtgaggttttcttttttgccgtgaattgtgtcacctgtagctttgcaaccatgaacagataatctggagctataaacagtactcactctagtaaaaagaagttgatgttggaaaaactaaactctgttcttctaacgtcaaacaaatttgaatgggtattcagttctctcaacgtacagtttttaattcaaggaatgtcattgacaagtgtccaaatctaagaaatgtcatcgaaaaatgtgagttctaaaaaaaaacatcgtacaaaacagttttatcccaaatgcggaatggacgaaaacctaacggtgatggtaattttggaacaaaatccccaaaaatatcatcgccgttagggttccgtccattccgcgccattgaatatattgttcatcctatagcacttaacggtgcggaatagacgaaaccctaatgatgatggtaattttagaacaaagtcgtttgtaagatgatatttcttagattttatacttgtcgatggtatttagaatttatacttgtcgatggtatttcttagatttggacgtttgttaatggtattttttggattatcttaaaatgtaactaaaggaagtatagtagatatgctgcaccaaggaagaactttcttatcatcatgctgttctctttttttttttgaactttgctcatgctgttcttgtgacaacataaaaccagaaaaagtactagtatttctcacataccacactaggtggttacatgacgacttgtgagtcatcacatcaaacatatgaacaagataagtatatacgtccttgcaaggacaaatgtcatggaatcccagcaagttttacatcaaaaggaaatttaaatagttcacttaatacgtcttttaaataaaaaggaatttgtattatgatcggggtaccgagctagaaaattcgccctatnngtgagtggtgttgattcgacncttcaaggccacg

SEQ ID NO: 63189 - DNA, 5442 bp, Oryza sativa
  unsure (1)..(5442): unsure at all n locations
cgccccccatttagacacccgcgttgttttaagaagcccttcttccaaagaaaaaggggacgttctcgttaaggcaggtgtnaaagaaggcgcagaggattctcgggggaaccctggtttttttaaattcgtgcggtttccccccttgacttaaggttaatttttttaagctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatatatacgtgtcaaattatataagcaatgcaacatatattcacacccagggaaatcggagtcccattaccatctctagtgtcggtcggagcaatatatccaggcggctacgatgtgcctatgtggagtcctggacgaacgaatattttggtggcatcccaaagtttttgtacccgtcatgttcaacggagcaaacgaaagagaccggcaggcaagcaagcggtcgagtggccattgtacacctgagagctgagctgagatggctacaattccgttgctttcttttcccacatgaaaccaagccggtaaacatgttcgttgccttgtgtattgggttaaccaacccagagacacccgaaaaatgaaaccgtgacagctgcacgcagcagagccacagtaacagtagcacagagagaaaggggacggtgatcatgcctgtaccatgaatgcaagaatgaatgccagctagctagatactcctacagtacatcacttccccaaccgtccgtgcgctaacatccgacgtgacgtgacggtcctactttttactccgattcaatcgccgtgtttagtttcaaaatagagtaaagtgaaccagcggtcctcaaacttataagggtgtgtcatctagatccccaaactctcaaatcgcatttacaggtccctaaacttgcttagccgtacattgcctgtccaaacccatttgactcggtctgctcgctgacatggcttgccaacgtggaggggaggagacagccagggtggtgcattatgcattaagccccttattttttcgccagccctcagacgataaatcccccactgtttcgcttttttttccccatcgagctaagccgtgaaaccctagggaggctcgattcgtcgcctccatcttcagttcgtcgccctcttcttcaagctcggatgcggggcatccaattggttccatttggcgtatctagagtgaagcccttcaatttgattggcgccatggaagggggctcgagttcatcgtcgacgaatcggcggaagggaaaggggcgtttccctctgattaagtgcccttgttgcgattgtgagacaatcattaggcgtgcggctaatacgcctgagaataaagggcgcatattttacacttgcccttgccatcaggttagttcttctcttctataatctgtgttgtggtggaaaattttcaattcgcatcggtttgctgaggttaattttgtacattttttgcgcagcgagatggaattggatgtcgcttttggtactgggaggaacaatatgaggagtacttgattaatactgggcatcttgcatctcgtgctgtgcatattcagagtccatgttctgctgtgcgtgttcagacaaatgcaatggttcaacagggtgcacaaccatatgttgaaaatgatgcagagcaaattgctgagcagattaaagtgcttgttaggaggatgaacttgttgatagacattggtagggatattgttgccttattgagatgtgtagtagctgcctgtgtggttgttgcggtgacaaatatgtatgctttctttaggagtggttgaaatgtgtaatgtgtgaaatgcactaaaaatgcatggtgtgtgatgaataaaatagccagtttctttaatctgcatctttgtgaatgttgggtctatacaaattttgaaggaatgcttgttcaattcatagaatatttgaggcacaatattgcaaaggcaaaatgaggcacacattcagtaaaaaggcagaacatccatttcagatactttcagcacttaagtatcacaaaatgcaactataattctggcaatcagcaagtagccatgcacttgcactacagcatgcagctgatatagcatatttttaatccattatatacatcacagtgtgttgacaaccaaaacaccattttttgtcagattgtcactaaacaaaatatattcccagctaactaataggcattaatttgttccaatcccaggtgcaggcttcttttttgatgcggcacttgcagacttcttgtttccagttgtggtctttcttttcttcagtgccactgacttccctaatttggtgttggttgtaagaggagctggccttgctgatggaatgttagacatgataaaggcaggatctggcaatgggcctagttgttgagatagcacagaactttgatttggctgcaaaattcagaacatatatacatgataaatagtttgcaatgacaagtagtttgcaatgtgagattgaaatgattgaaaacaacattacctgatcagccatctgactaaaaacagtgcttcctagctgtgatagtagttgagatgaagtctgagaagcagcaatatgttcatctatgacatcctatatataccataggtcatgtagttcataagacatgcaaaaaaaacatgtgcaacagaggagttatgttcagtgatattttacctggttgataacatttggttcttgttcagtgatattttgttgaatctccattgcaagtgattcttttgctgtggcaaccatcctctttgcctcctcagaactgatgccctgcttctttagtttacaaccccctgagttgtgattttcttctccacaatacttgcagtgcatcatcactccatgttttgtcagctttggaccatttttgccaattacttcatatggtgcctttctcctagactttttgggcctgccagccttcttctcatacacaggtggcttaatctcaggaccattgatattttcccatttgctcttgtcattgcagggccaaatgttgaaaccataggctttactgaatgcatctgtagtgtagcaattagggagaatactttcagcatttatcctctcatgcctaagacaggatatggcatgattacatggaatccctgtcaagtcccacctcctgcaatcacaatgcatagcattgatatccactatgtactgatattccctttcatgcacttgaaatattccctgcccagctggtaatgcataacatgtattagctgcatctgcatttttcagcaccttcttcctaattttggggcagattaagccttggaactgatcagccaactctttttgtttattgaaatgcctagtcatgagttgtccttttatcttctctagcatagtcaaaataggtaattctctagcttctagaatgtatttgttaaaaacctcgcaattattatttagtaatatatcacacttagggaattctgagaagaaagctctgacccatgtgtttggaggcaacttttcaagccattcataagcactcttgttcaaatttctcatcacatccatatttttgttccattcttggacagaagatgacctagcacatgcccacaattgattcttcggtacttctcccttaaactgaagctgaaagtttgagtacagatgcctaacacagaacctatgttcagactctgggaagacctgttggacagctggtattaaccccttctgcttatcagtcattatagtccaaggatatgtgttttcgatgcctagatcatttttcagtgtctccaagaaccatttccatgtagccagagattcaacctccactacagcaaaggcaattggatatatacagtcatttggatccataccaactgcagttagcaattgtccaccatactttgtcttaatgtggcaaccatccaaacaaatcaatggtctgcaaccattcagaaaccctctcttgcaagcatccattgacatgtacattggctgaaaaggctaccatcaagcttaggaagaaagaagtcccaggattgcttctcctcaattttttgccataatcccacaaaagcttgtactgctcaacctcatctccatgtatggtcttcattgcaatccttctagctctagctaatttgctcctagatggtgtcaagttccactgcagttgcactgtctttgcaaaactagttaggctcattttctcatcagccctaaatgcttctatatactttccagccaaccatttggatgtgcaccttttgagaatccactctttttgacaggtatgtctctcatcataagtcttcaccacaaaagctttagctctactgtcttctgaagtataaagattccatgggcacctttcttcacaatgagctcttatcctcctcctatcatttctaggcatcttgatctcaaccttattccttacattgtactcagtaattgcttgtctcaacttcttaacagatggaaaaacaagaccaaccttgaaattaggattgttcaagtcctcttctgcaaatgacttgaacttgagcctgacaccctcatcatcagaatctgctgcattaagctcttcctcatcagtatcttcactttcatctcctctaggcacaattgcaagatttcccttcaacctgcttcctctggctttctttcccttcaatattttctttcctttggccaccccctcatctatcacattttcatcaacataatcaacaaacaagtcatcatcaccatcatctaattcatagtcactatcatagaattcctcatcactgtcatcactctttgtcccactgtcttcttcatcacaatcatcttcttgttgctccctgttgttatgctcttttagattgctctgttactgcctgcttccttgttgttgcctgctactctgctccttaagattaccctcntgctgtaatatggaannnnnnnnnnnnnnnnnnnnnnnnnnnnnnnngttctgcaccgggaa

SEQ ID NO: 63190 - DNA, 2248 bp, Oryza sativa
  unsure (1)..(2248): unsure at all n locations
cggcgttgaaatgcnnnnnnnnnnnnnnnnnnnnnnnnnnnnnnnnnnnnnnnnnnnnnnnagaagcatgaacaaaatttcgaaaatcccaagttcatagcctgcaaaatcatgctgttttgaacttttgctaagctgggtgatgaactgatgatagaagaaggtgcttacaggtacgtgagctggccgagctggccgatgctgctgctcagtgttccctgcaggctgacgcttgacagcctcctgcaaaaaccagagacatccatggcacgatttcagaggaaggcccatcacatgatattggtggtaggaggagaaggagatggctgtaacttacagcgtcgtcaccctgccgttggtgcacatgatgccgtcccatccgccgccgcaggggtcgccggagttccagctcaacgggtagttcgtccattggctcttcagcccctcgagcgccgcagctgcacgcatgcatgcccaagaagaagatcatcaacaccagcaacaaaaaccaagcgattcttctccgggcaagaagatcctgcctgactttagaatcatctatggaagaaacggaggtgatcgccggcggcgaggcaagagcactcaccgtcctgggcgttggtctggcacaacaccgccggaacgcccgccgncaccaccaccagcgcaagagccatcaacacccgcggctccatcctgcgccgcgccgtcgccggcgaggcaagccaccgggagagctagcacacgcttgtgctctgcttgaccggagatcgtggaggaggaggtggaggaagaaaaggagaagagtccgcgcaaggtgcggggaggcgacgacgccttggtgtatatggtgggcgcgggggccggggagtgatggcgccaccaaccgcgggcgggctgaagacttcccttctctcgccgcgccggcgggaagaggtcaacccacccgcggatggatgatcagagtgtgagctcctcacgcgttcagacagccagacatcctccctcccgcctctgctccttcctcgcgccgtttggtcaaagagccgacctgcttatgcttaatcaatattagtacctctgtttttaaaagataacattgttaactctttatcacatgtttaaccgttcgttttgtttaaaaaaattaattagttataattttattgtaagttgttttatcactcaaaatactttaagtgatttatattttatatatttgtataaattttttttataagatgaatgatcaaatatttgtttaaaagttaacggcgtcatctattagaagttggaggcagtgctattgaaaaagaaaaaaagacctgcgctaatatagagtaattagtgtcgacttggattagttaaccatttaacctgttgttcagtttattaattgatctctctcaatcaggtcggctgttggtgtcaggtagccatcgcgggcatgatttcttattattttgtgtgttggccgtcgggcgcgcgaaatgggatcgtgaggcttaatccaacccacattttgatattcctttttgttaacattattatactagtactggtatatctatatcttaggaagaaggtgcctaggttaatgtgcaggttagtcgtcgtcttggattgtactcccactgtcctattctattttaaatacaaccatgagtttccgtgctcaattttaatcgtccgtcttattcttttttttataattagtattttattgttatgagatgataaagcatgaatattactttatgcgtgacttatgtaaaaaatttaaaaataagacggacgatcaaagttgagcacggaaaatcatggctgactgcacttaaaatgggacggagggagtacatttgtgcccgtgcagnttgtagttgccaatgcaggagaaagaaatcgcctggggaatcttggcctaaattgccatgtaaatccacggtaagaataatgcttcaggtccaagnaaccgangnggnnnntannnnnnnnntcctcnnngnnnnccnnnnaagggggttttgtacttgggatctctntgtgtttcttgataaccacaggaataatctgtggaaaaatgtcccctcatttgtggggagcccttcacctccttaaaaaggggcatcaaaaaaggcgaaaacttcgggtggaactataaacattttttaatcccatttcgttgtggggcggccaaaacctctataaagggtgaaatccttttcaccgcccgcctcgggaaataaaa

SEQ ID NO: 63191 - DNA, 4157 bp, Oryza sativa
  unsure (1)..(4157): unsure at all n locations
cccgcttgatttgcanatcnnnnnnnnnnnnnnnnnnnnnnnnnnnnnnnnnnnnnnnnnacatactaatgatcaagaaaataatgaagacccttactcatgctctgctcccaatattactgcatcaacttctgcatctcctcatgaattttcacacttcgcacctgcatcattgtttactaatcccgcagaaggcagtggtggatggctagataaatagaagttatagatagttagaggtcttaagtgtagaatagatagttatcctactcctctctaacttctatgtgtgattacctctttctttgtggttatggttttctttggtttgtttctttgtagcatacatcatgtacaacttgtccataaataaaagctatgtttaattatggatgttgactcccctttgagaagatatcaattaccccattttctagatgagtatgggcaatggcagtacgggtgaaagagaaacaggagaaatcccttcaccaaatcctaccactttggcagaagtaatggcaagacaaactcaattattacaagccatagcacaaaatcaaggaagtaaaggttacagcgcacatgcagaatttatgagaattaaaccaccagtcttttctaaatctgaagaacctatggatgctgaagactggctaagggctattgaaaagaaattaaccttggtccgaacaagcgaacaagagaaggtaacctttgcaacccatcaactagaaggaccagccaatgagtggtgggaagcatatcaagcttctatagaagatcctacacatattattacatggatggaatttactacagcttttagagatgcttttatacctacagctgtgattagaatgaaaaagaatgaatttcgaagattgaggcaaggctttatgacagtacaagaatatttgaataaatttacgcaacttgctcaatatgctgcctctgatattcaagatgaaaaggaaaagattgaaaggtttatagaaggactacgtgatgaacttcgaggaccaatgattagtcaagatcatgaaaattttcaaagcctagtcaataaagtggttaggctagaaaatgatcgtagaatggtcgaaggacttcgtaagagaagaatgaatttacaacgacaatcaccaactaggggttcactacaagttcggaggccttatctatttaagccatctttacccaatgcaagaccaggcatgccaccaatactaccaagacctggattaaaaatggaagactctccatgttatgtttgtgggaaaattggacattttgcaagactttgccctaatcgtcaaaatatgggtggccaaacttcttatcagaaaccatctgctacaggttttataaagaaaaatcctccaattattaagagtggacctaatcttggacgtggtcaagtacatcatattaaagcagaagaagcgcaacaagatcctaatatattgatgggtatgttcaccataaactctaaaccagttactgttttatttgattctggtgcctctcattcctttttatctgcaaaagccagttgaaatcagtctttacctaaagataatttagataaagctatgctaatacattcacctggaggaactgtattagtatcatctatttgtagaaatgttccgattaaattaggagatcaagtatttttaatcgatttgatgatactacctacccaaaccatagatattattctgggaatgaggcgtgtggccacctggaagtaacaaggatacaattcccgatgatgcaacagtcaatgctatcttgccttgccttcttatagaatcgtgcgcgagggatgggggaagcagcatggcgagggggaggcgaccgcgaccacgtcttcggtcatttcattgtttgaaaagtaaagactgaatttcaatgtaaaaatgtcaggatagacaaattcggtctcggtctcggtcctgaccgaaattcaacaacattttcatatttgcaaagaaataatggaaattttcaacacaaaaatcaccaaaaaaaatcgtgaacacgtagaagtaaagactcttattatgttgcatgcctagaagaagtagggaagtgaaaattagagtttaatcctattgaacttagtggattgtagattgcatttagacatttttttaattcggtcatttggtctattcgattaaccgagtaaactaagtgaattttgaccgaacaaaatttggtctttcattacataggaccaaattaatgattgaatttctcagtgtcggttttttcggttcggtctttttctacctaccctaccagcggcggcggctgtgagtgatgcgatccagatggggaaggagaaaaaaccctagaaagagacatgggctgactcgtgtgcgccgctcagatcagatcgaatggttgaggattagacagtgacgtggcttagttcctaagagcaggtataagccacctataaccacgtatcgagaagaaaaaataagagagagaaaaaagcgggctgcagatttgtagccagctgtagcacggacttcaatacattacgtgtgtatgggaccgggtattaatagtgtagtatatttttatagttaactattgtatgaatgggctattagattaggccagtcccaacccaagacactagacatagtttctataaactccacatcattaagaaactagtactagacactactctttcatcaatgcaaacaccactcttccatacttaaatttaatgctacttatctcacatgatgtcttgtatgttgtgtagaaaccatgtcttatgcaagacctgatttccttcgctttcctcatttattcatttaccacatcatctttcatcttaggtggtagtttatttaatgctatggacaccatcctaatcattgggttggggttgggaatggccttagagcaagtttaatagtatagccaactactagctccaattcatatatatccaatctaatagcttattcatacaatagttacacactacactattaatacatggtcccacctgtcatacacacacttcatctttgcagttcgtgctacagctggctacaaatctgtagcccgctgcttctctctctcctcatttattttcttaaaatatgtttacagctagcttatagcctgctattgtacctgctcttagctatagatgatttggagccagtagttggctatactattaaacttgctctaatagggatccaggcgattaaattactaatggcgatcccggcgattaaggccctgtttgtttcagcttaagattattgtaatctagattatagaactagattactataagctggattataataagccaacatagaataagttgctagctgtttgtttctctggattattatctgtttgttagttgttagccacccaataatctaaaaaaacacatttatagtggcttaccagattatattaatctggcttatctataactaatataaatattcgtatttttccggtcgtcacctcataggtgcagtgatttttcgtccccctcgccttcccccaaatcccagttggaattacatcaccaccaccccaaaaaaaatcctaatcggaattcaatcaatcacacaaaatatataaaatccgaggaagtattatacacacaaatttattcaaaaaaaaatcggaagggaagtcgccgtctaacccgcgccgttgtattaggacgccacgccccccaacttcccttccctggatccgcagaagggaagggcccccccccgtgggattttgagagccgccaacctcccgggggccaccccggggtgtggaggaccttccctccttgcgctgtgagggagacacgcccccccccgttgatgggggacctcctcccctttgtgggggggggccaccccctccctttgtgctcggagagaggccccccccccccctcttttttagaggaggcgcctccccctcctttgtgctttgggggaaggccaccccccccaattcccactttgggaggaggggcgcccccctctctctgggtccaccgccccccctcaaagctctgggagggggcaaaaaattatggaaagaatgttttgtttttttcacacccctgttgtgggcccttctctatgagaagg

SEQ ID NO: 63192 - DNA, 1290 bp, Oryza sativa
  unsure (1)..(1290): unsure at all n locations
ctctttacaaaatatttgaaccaaagtggtaattaaactcttaaaagggaccgggcttaattttaatgcttcccgctataaggcctgtttttaatttaattttgtaattaattaaaaccaatttcaaaagcggattataataaccaccaaaaatagttgcaaccgttggttccggaaataaacggttggtagtgtaacccccatattctaaaaccacttaaaagggcttccaattaattaatcggcttatcaaaacaataaaaaattcgtattttccgggtgtcacctataggtccagttttttttgtccccttcgctcccccaaatccagtttggattccatcaccaccaccaaaaaaaaatcctaatcggattccatcatccacncaattaaataaatccgaggaaagtattatccacacaaatatatccaaaaaaaaatcgaaggggaagtcgccgtcgaaccgccgccgttgtcataggaacgccaggccgccgtagctcccctcccgctggatccgacagaggggaggggcgccaccgccgttgggatgctggcgagccgccgacgcctccccgggcgccgccgccggtggtgggggaggacgtcgccgcgctgccggtggtgagggaggacacgcccgcaccgccggtgatgggggagccgtcgtcgccgctggcggggggagggcaccgccgctgccgcttgggctcggtgagagaggcgccgtcgccgccgccgctgctcgaggggagggcgccgccgccgccgcttgggctcggggggagaggcgccaccgccgccgcagtcgccaccgctcgcgggaggaggggcgccgtcgccgctgctcgtggggtaccaccgccgccgccgctcagaggcgctgaggggagggcggcgaagagagagataggtgggaaggaaatgggctagggtttctgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcgctgagattgctagataaagatgaaagtttcactatcaaacacaatatggtggggttccgattacaggnnnnnnnnnnnnnnnnnnnnnnnnnnnnnnntcggcactcaaaaccag

SEQ ID NO: 63193 - DNA, 8996 bp, Oryza sativa
  unsure (1)..(8996): unsure at all n locations
aagttctgagaccctgattacacnnngcgaattcgagctcggtacccaatttctccccgtccccgtccccgtaggggtgggtacccggcgggtccccgcccccaacgggaaaattgccatccctaggttctacagctacagctttttagaatctgaatgaaaatctagattgtttgagggaggatttgataactagtgcttctagaaaaatcttcagctactaaaagcttccccaaacaggctctatgtccgttctttctagtacttcatagaactagtaatttacccgtgctaatgctacggtgtaataatattttgattaataaattatattattaaatttcatgttagtcaaattacatttctagaatcagtctcaaatgttaatttaagacaaagagcaaaaatatcatattgtctgaaaaaaaataatttaagaccatcaactatatctaggctaaattctttcccacgagtctttaaaaaaagtatgttttcatgaaaataccgtgttgtactgcattgaaagcttttttgttaactttagttatcaaatatttaatttagttttataactaaatttgtaaaaataattcaataaataatttgttttagacgtgggcaagatttttttttactagataggcaccggcgaaaatcccggcatgacgagtgcgcaggtgtggcggtggccggccgtcgacggcgacgcttcatattgaagactactagcaccgtggatgctcgccggccgttttgcccctcagcttgtctgctggcaaagtcgtagactaaacagatggagtagtaaactaaatcacgtctactatttatttttttcctacttaaatattaattaaaattttaagtttgatcgaatctatagaaatgaaatgagtatagctcaactagattacttgtgatggaaacagctcatctgagctcaaatcatagaattgacatatatacttgtatttacggctaattatattttcagtgataggcgacttacccatcgacagataggcactcgtggtgacttcgttaatctcaggatatgccgaccaagtcttctatcgacacccatagtgacttcgtctcatcaacctcaaaatatatcggtctagtcttctattgacgcccgtggtgacttcatcgatctagagatatgctggtccagtcttctggaggtgctcataggagtgggtgtgtgcacgttttgagcgcatgcatttattctgtgtttctcaaaaaatatagacacgaaacaaatatattatcaaaatatattaaatgttaatgtgtttctagaaaagttatagaaaaatataaaaaaaaattttgacacaaaataaatatattataaaaatatattaaatgttagttttaataaaactaatttggcgttattgaccctgctaaaacttttttaataaatttggncaaagtgaaaacaatttgactacgaataaaatagttgttccaaatatacgcacttcaactcaaatataaacagaccctagtaggaagatgctctctcagatgatgtaataaaaacgaagagctattacaaaatggggaaaaaagatggttaagcatctcgcagaagaaaatgaaaaaaaaaagcctaagcaaagcagattatgatgggccacgggcccacggaccatacgcataggattcaacctgacggcccacatgccgatggatcgggcccatataggcctgttcctaacttccccaatcttaagcccggcccactcgtgagctctcccccgtctcataagaaaccctcgcggagcacacgctgctcccccctctccctcccgcgccgccgccgccgccgacaccgccgcatcgccgctgccgacggctgcgctccgaaggtatcgcgtcgaaatgctcttcgtctcgcctctaccaccgccgcagatagttcttgcagcgtctatgcctctgctgccctttacatttccctcgagcgactagaagaattagggcgggttggtcgttgcggcggtcctaggctagattcgagaagaagaagaagaaatgccggagatccttgagcttgtaaatggggatggtttcttcttcttctctcttatagttgatcttgacacggtgtagtgcggtgtatatacatctgttgctactcctttggaggcaggattccggttttcttgagtatgtgacaccgtggtgattccgtttgatttgatttaccatggctagctgcgcttctttgatagattctggattatttgcctagatgcgtgtgaaagcaccggtactgaggcgctatggccattgtgatggccgtagcagcctattcttttgtgtgctatatgaaccagggaacccgctttgcaggggagatttgtcccatgtttcttctgccagtagtcgcccgacagttcacccctttctggggttctggattacctgtagtgtagtgcgatgtatatacatcggttgctactcctttggaggaaggattccagttttgtggagtatgtagttattctgtttggtctgatttatcatgactagctgcgcttctttgatagattctagatttgttagatgcgagggaaagcaccggtactgaggcgatatagctattgtgatggcgtagtagcctattcttgtgtgtgctatatgaaccagggaacccgctttgcagggaaggtttgtctcatgtttcttctgccagtagtcacccgacagttcacccctttctgggtttctggattcctagtcatggatggtaatccgatgcgcgtatgaactgcaatgtttctggttctcttgagtgctttgagcatttgaggaaccttgtgtgtgtcgcacagtcgcactcaggtgctatggcctttgtgattgcatagtagcctagttgattaatgtgcaagatggaccagggtagtatccttgcagcaggagctaagctaagttgattatgcttctactgcctgtagaatccctacatttttaatagttaaaatttgagatgattaccctgtctgtgtattgtcgatatcttgatgtaggtttttaatgttccatgattacctctgcacaattttgttttctggattctagtcctgattcctttttcttttgatgttggaaatttggcagaattctgtgaggatttaagctgagaagatggtgctgaagtaagttcctgtgtatattttgttgtttcaatatgattgtagattgttttagtgcccttttatcctgtgcatgctctaggctatgtagttttttggttaatggtagtaaaaggttaatagcaatgatttaccaatgagtactatttcatatttggaaggtatttcaactattacttttatttttatcctacaggacagagctttgccgttttagtggccagaagatatatccagggaagggcattcgctttattcgtgctgattcacaggtcaggctgttcatcgaatgattgctttaatgtcaggatatttctctgcttagaaggttgttgtaaacgtattggtatattgtacaggtcttcctttttgcaaactcaaaatgcaagcgctacttccacaaccgcctgaagcctgcaaagcttacctggacagccatgtacaggaagcagcacaagaaggtattgtatctagatttaggcgggcgttttctcacctatatgcacatactctaactggatgacctttaacccttttttttttgttcactgaccgttgctttcttaaatttgttgggttgagccgaatgcttaaaatttgtaatgttgtattgtgcttgaaatgctaagttaattgtttcttaagctatcaaacctggattccagtaaatgtctgtttgtatgattaagtgtgaccgtctacattcaagattgcggttttttttactgtgcaaacatcatgttgattcttcaaataagcgccttgcagtgtttgcgtgcagataaaaatattgtatgtttgggtactttggttatgtctgtgccatgtagttctctttgtcagcttatgctcaattccttgtatatatgtacagttagtcatgctatgtattgcttccgatcagataaattctgtttacaccctttccccattttctgttttttaggatatccatgctgaagctgtcaagaaaaggcgccgcaccaccaaaaagccatactctaggtcaaattgttggtgcttcgttggaagtcatccaaaagaagagagctgaaaagcctgaagttcgtgatgctgctagagaagctgctcttcggtatgctctttccctgaatgattgccatttagactggttactggttccaacaaagtatccacccatggaatagaacattgccactctatatgggttacattttgccttcattttcactgcattagcccttacctcatgcggtgcctcttaacttctcaagcagtgttttcgtttgctgcctttgttctgcacagctcactgtatcattgcaacatgatgtttgctacccattcttattggatgtctgctcctagtgaactctctgttcatattcatgcataatcccctattgcatcttgtgtatgcataatcctccgatatacatttcgatgatgctaaaggactaaattcatctgagcttatgcattgtgcagtgagatcaaggaacgcatcaagaagaccaaggatgaaaagaaggcgaagaaggctgaggtaaccaagtcccagaagtcgcagtcgaagggtgccgccccgaggggttccaagggcccgaagattggtggtggtggtggaaagcgctgaagatttcttgatccccaggaaagggtcgcctggttctcgccggctgtctaaatcgtatctcatcaaaagctaccctgtagaacctctgttaaattagcactactgccaaaatgttttaacatcgccactggagataatgtcatgaagtttgaaatgctatgtgggaaaaatgtttttctttggttgtgttactattacgagatttgacttggcttaatgtttctgagcaaagtttgatgctgcttggcattttaatcctcttgtgttttgttcggtaaagagcattggtgttcatgtatcatgatctgaatgctcgttctgaattgacggccctagaaatcccatcgtattatattctctacagaaatataggcttttgaaatcctgttagtagcgttaaaagcgaatttgacttttaaagtttcaccattttttgcgaacgggtagcaggaaagctaaagtacgttcccttcaaacaggctagactttgtagtgtccgagtggtatttatttctctttccttatttacttgaaaaaatattcatgtgttgcaacgggtaaatgctattttaattttattattgtttacggtttagttagataaaattcactgtgggaagtcgtttggatatttttttcaggaaatcatgagctacaattaggttcgtatttcatctcatgctagcatgcgagtttttttaaagatttcttatacgactcctattatacttccaaaaggaaaacaatcttaaaatctaactcaaacacgcatctgtatttccaaaaacgaacgaacttaaaacctgactcagatacggatgacgtaccaaaataccagtaaaaacatctttaagttttaatttttataatagtagatatttctctttctttatccaggatttttgctatatgtatgagacttgatttcgtatttgatgtattaagtattgggtatcccatattcagggcattaacagcatgcatcatataagttaattttagggcattaacagtatgcatcttagtataagttaattttttttctttggtcttgcttaaaaaatagtaaatactctcttcatcccataaaatcaactactgactatgtatctaggtcaagatacacaatcaaaaattggtttttatgggatggaagaagcatgttttagacttcagatggaggaagtactccctccattccaaaatatgcaggttcttgaatggatggaacacatcacaatagtacaaatctggatgtcttaagaatttaaatgtctattcaaatttacagtagtaagatgcgtcacatccattctaaaaccctttattttgggatgaaggaagtattacttaacatattactaactgtattacgatggaccatgctactctgcattagagacgttgtaaggcagaggatcaacatgattactataaattatgggagttggcagccatccgatcaagggcataaggcctatatatctcaggccgagtttagctctaaatttaattttttcttcaaacttctaacttttccatcacatcaaaactttcctacacatataaacttctaacttttctatcacatcattccaatttcaaccaaacttccaattttgacgtgaactaaacacatcattactacactaaataaaagtgtgctacaattttcatgttattgtagataccataaatcgacggtattcattacattgatccactgttatactcacatacttcctctatctcataaaaaaccaatttagtactggatgtccagatttgtagataggatgtgtcacatccaatatgttagttttttatggacggagggagtactccctccattaaaaaaaatcaatcttaactataaatatagacacacgtgttcaaattcatagttggaccataattttcatggagaaaatgaacatttggccacgttcaaaacacggtttcgctagaatgccaccccaaaaacacggttcgataaaatgccaatacgaagcgtgcatctgttgtcactttgccattttcaccattttattcatttccaaaaagattttggctcctccgctgggtaataagacggaactgccccttatcaccctacggcgttgatattcttccccatcccctttcttcccccactctctctctccccttcggcatggcggtggtggcagtgcgagcggtgtgtttcgacaaagggagtggcgcagggacgaagcagcttcgagcagagacgcggagctcgctgaagatacatgcgcggggatgagctagagcgccatgaccactgcgagcttggcgcaccctttagcgagctcgagctcgagctctactcgtgtggaggtggaggtcatgggcgatgtttttgtcagtagcgacgacatcgcacggaacctcatcattgactatggctctggcaagatcgcgctcaccgccgcgtgcatccacttccgtatccctagcgctgccctcaactcccccttccaccactgcgtcgcttcggtcctcccaacaattgctttgctgtcactaccaccgaagaagaagccacttccgccgctgtcaccgacggcggttgctaagaggagcccacaaccccctcagcctttcgtgcttcggccagtgcggcggtgtggcccctcctagccaacggagggaggcgcaagaagcacccggcggcggtgagggcgtgaggcctttttttttttttttagaaatgctcgatcccctttcacttgcgagatgaagaaaaggcaagccggaggggtattttcgtctgatcaccacgtgaacagcaaaaaaaacatttcggaaatcatgaaaaggcgaaaatggcaatgcgacgagtagcgcgcgctcgagattagtattatatcgaattacgttttgaggatgacataatagcgaaatccagttttaaagatagctaaacgtttattttctcatttttcatgggacggaaggcgtaaacaataaacctctacaataatgcccaggattcggatctcattggatgtgagaagagagagacagcgagcaaagcgaagtgaactgactgtgaagtgaccgcacttcggctgcattaactgcatcgtctcggctaggctagggctaaacacgtccagagaccaaaacgagtcgactcgtcgtcgtcgtcgacactcgagaggcacctgcactactccactcagctcacacgcaaaacgtccgcttcgtctcgtctccctcctctcaaaccgcctcgtctctcgcgccctcctcctctcctctcctcctctcctctcactcgctcactcgctcgccgacgctgcccgaggcggaggcggcggcggcggcggcgaagaggccgtagcccgcttcgctcggcggatcgcgcgcgcgaaccgggcggtggaggaagggggagggggagggagagggggcgnnagcncnannnncnaccangnnagcgcannganncccccccnnngcccccngaaanaaagaccccccggcacgcacgaggcggccccccccacccaccatccccggggaggccggccggcagagggccggccgcgacgaccacgggaggggagcgccgaggggacccacccaaccccgaaataaaacggggaacccaaaggggggggggaaccaagggcccacaccacagcnaaaaacccacgggncaccctgacgagaaaagagaagacttggaatatacagtacggaaaacaaggctgacgcgcttaaccaagtccttgatcaattggctctttactattttacaatgtgaaaaagatttgtattctaatttctttaagcaattcttttatgctcaaatatttttgaaccccccctgtttaccacctttgaaatgcccccgcgaaaaacgaaggaccccttttccttattggccttttaccaaaaaatcgacctaaaattttatgcctaaaaacaataaaagggtgacccccaaatttttggggtatatttcacccgcgcttcgttttatagacgctttatattgggtctcgttgtaaataatgcacacgtggtgagtgtattgggttggcccttttagagagcaagatttggtcttttcccctcccgacatccttcacctggtgttttaaattcaaaccggggcttgtaataatcctggtggacgcggcgagaatatccttctttttacaaaaaca

SEQ ID NO: 63194 - DNA, 2911 bp, Oryza sativa
  unsure (1)..(2911): unsure at all n locations
gagcgctttgattcccctccttttccccctctatttctgaccctccggctcgcacgtgtctccccctcccacccaccatctccggtgtggccggccggcagatggtcggcggcgacgacgacggtagtgtagtgctgcgggtacctacgcttccccgaatttaaattttgtaacctaattttggtgttgattttagggttctcaccatagtttatttccaacggttttccctgaggagaaaggagaagacttggaatatacagtacgtaaaacaagctgaacgcctgaactagtacatgattaattagatattaactattttaaatttgaaaaatatattaatataatttcttaaagcaacttttctatagtaaatatttttcaaacacgcactgtttagcagctcgggaaatgcgcgcgcgaaaaacgaaggaacccttctccctatctgccactcttacaaaagaacacagcaaaacatttcattgctaagaacagatataaaagttttacccacaaattattttgagtctattcaacacgctgcattcatttcattagctgcatatatatttgtgtactattgctacaatgatcaacagaattagcagtgctatacgttttgccccctttcgaagtccaaaatttggcgctcttctgcctcccaggaacccctcctcgcttgattgcttcgacaactttaagcagtgatcattggaatataactccactgtgaatggtgcgagatggttactagttttttgtcagtaagagatgcatgattactcctgtcctgcccctgaatcagggttgcattgtaacaacggacatataaacgcaaaatgaatttcctagtaaagtgctaaaggcagggatgtgtttgccaatgaattttctttgcaaatggtctagagtttggattttaataatgcgacgagttttgtaattccaacttgaattgatctcgtttttacaaacaagactattgaaaaagttagggatatgctacttatgatttgattaatcaattaatctgggggagctatttaaataatgatgggactaatattgtccagctgctgctctcagcttcaccctactctcatgctgccttgtagatcatgagcacaatggctgacagcgtatttggagaaagggacagcagtaatctcgagattcttcaacgaagtcatatgaacagcaattagttgactaggcaaagcatctttctgagtaaatcacgtcttgttagggtacttcagttgtctttcccagatctcttgtaaaattctttccctcagtcctgcagatttgcatgctcaaggacaaggacctacacattatgtggtggttcatgcaaaaaagaaaaatcaagtttttctataatatctacacatatactcaacagtttgactgtatacattttttctattatagaataagacagcattggctgcagagggttcaaatgagaaagctggggtagatgcaaatgaagtttcattgcctctttctaatctaagcaacactcgacaacattctgatagagaaaacaacatgcctggaaaacatggcaacgatggcatgtcaaaagacatgggacgtgctactagattgaagagactgcaaacgccaatcaacttatttgaagatgaatgcgttttctgccattcatttagaacacctcctcaggtgaaccatgatctattaaccagaggttatgttttgaggtcttcttaaccatttctgacactaaaggtcctcacttttcctatttcagtttcatggtccaatggcgcattatcaaaagggaaagcttgtgtccagtgacaatggcagtccatgcccaacagatatcatttatgttcataagaaatgcctggagtggtaagttcctaaatatatttcaactcttgatgcttattcaccacaatttagatttatcatcatgcgcttccaatgcaggtttaagatacaaggatgctggacaatttttatttttatttgttgagatctggacccttgtataattttttagtttaataccttattggtttgctttataagacaaccattccatttgtttaattatgtccaaatattagtcagtatgatatataggtttagtggcatgcaagaattaccattttgattcctatttcaaagtaaattcacatgatatttttttttagccattaaacagcctattcaatgtttgagacgtgctaagtctaaccatacctaataaaaataaccagtggctggagtggtattaaagtgggtagttgaggggtgatggtgcgttctacattccccttccttcatcccccatcataattttgttgtttgcatgatatattcttctgcaaaaagttgatttgtttgcacatgtgtatgtgtagatggttgattgatctcatgtagtaatttttcaattttctagatttggagacaattcttatttttagtatatttagctttacattataaactatatttacttcttccagtgcaacagttggcactagctagttactctcaaaggactatttcttgggtaaattgtttgtctttccctacttttttcttttgcgaagggccccgcaagtattttacgaaggtgataccattgtgaacttggagttggaaataaaacgtgccgcgaaattgaagtgcaaaagatgcaagcttcctggagcagctcttgggtgttattatacaaagtgcaataggagctatcatgttccatgtgcaatgatgactttgaattgccgctgggatgttgtaagctcatgagaatattgtgtaatcgatccttttgtttgtgatattcgtcaccactctaatagtctaatgnnnnnnnnnnnnnnnnnnnnnnnnnnnnnnnnnnnngntctgcaactcacgcgcg

SEQ ID NO: 63195 - DNA, 4829 bp, Oryza sativa
  unsure (1)..(4829): unsure at all n locations
agagggagtgaggtgtagtctcttccccncacncagccccaaaaaaaatttgttggtcacaaatatatcctcacaaagattatatttgttcgcactgtgtaaggagaagaggttatattatccccaagagataatttttcacattttccaagatttgagaccaatgttcttattgtaaggattattaactcttcacatattaacaatattttacttcctcagagcgcaacatttgcacttagttattacttcaaaaggactttttctgggtaaaattgtttgtcttcccaactttttttcttttgcgaggggcccgccaagtattttagaaggttaacccattgtgatctggagttggaaattaaaccgtgcggcaatatttaggtccaagagatgcaaccttccgtgaacaacttttgggttgttattatccaaagtgcaaaggagctatcatgttcaatgtccaataatgcctttaaattgcccgctggaatgttttagcttcttgagaatattgtgtaatcgatccttttgtttgtgatattcgtcaccactctaatagtctaatgttctaagctccgagatgctaattttcattttgcaggataacggttgtgttatgtgccctgaacatgcaacgatgccactaccatgtgataagataagctcgccaagaaatgagagtggcaattcttcttccttccctcagaggtttttccatgaataagaaattgttattcaatcttattgctttcttggaaggttatacaaaggctctggtatttgattaatcattgatccttcatttgtatttttctccttgattctgtgttccagccaatcgtcaattgaacaaagcgattccgctgattgcgaatgggaatatcctataatagatcaatggaacacatcaagttctttgtctcaagggtatatgacctttattcacctgccttttgagttactttgtaatcattttatgaattagctaatacggagtaaatacctacaacattctcttttgccttttgttgttccagacaaagttcagccaaagaaggaatttctgctgttcctaaaagggaaatagatcaacttaacacttcatgttcttcctttcctgaggggtacacaatctttcctaacctttcttgttagatgtctttaaggttcctgattctttgatcaattgtagtcttgcattccataaatttgtgttgtatttaatcattgcagccaatacttggacaaagaaggaatttccactgacgaatacaggaaagaaaagcaaacagatcacctttacacagaaagagattgcccctcggatctgtgggttttgcttggttcagctttaagtgaatccgagaaggtaggataagtgagaagtagcaaacattactctttttttgtggtgaacaagtatacggacaaacaatgctgaatcctacttcatggataattcaacatagtggatgatttgctacatttatgaagttaactcttccattccagcttttgtggtaaacatgatttatgtttttcaagcaggattccttgcaagagtttgcgtcttggacagatgcaactgtggtcaacgagtggactgaaaatgtgacccatgttatcgttggaaaaagtgctggtagtgcatggagccgatcttatgaggtcctgatggctctactgtttgggaaatgggttgtcacggttggatgtcagtattgagctatcttctctacagttctctatttcttttaggaccccaatttgagtattctttcctttacgtttatattgtttgatatacctaagtatccctaaggccattcaaggtttatcataaatctgcagagtattatctattcctaagctgaagtgcttcgccttgctcttttagggattatggattgcttggtaaagtttattccaagtccagaagcttcctttgagttaagatttagccatgactcacgtgcatcaattggtggaaacaagaaaagaagaaatcaagcttctgaaggggtacatatacatcgctggctataagattagacttattttatgtagtgaaaactatcgtaggctgtcacttgtataagcttaggaatttgatttgcaaatctttcccagtaatattttcttacaggcctagctacaactgggtacaacaatgcataaaaatactttttacatatcgctgttcaaagtcaaggtgtatatatctagtgcataactccatatattccacctgctttgtgttgcaacttacgacatttcattctttagagcaaattttctgccgcaacaatctccatgatgataatgcgatgctttcaggcacaaaaagttgttctcgggactgaacttttgcctcagtgtctacataaaccctgacgacagacaacacatacagagcctgattgcagctgctggagggcagatactggagacaaacggcggctcgcatttgctgcgtgaaaacctggagaaagttgctgtgaagccatgctacttcgtctacgacgggggcgctccaaggaatttcacccaaggattgcttgatgatctccctaaggagatggaagaggcaagagagtatgctgcctgtggagctcaggtgatcagccatttgagggtgtttgatgccattgcggcttatgatgcacagattctcagccacaaggatcacttcaccccggatgtgtaatggcgcaagctgtgactgtacatggtaaagcatatatccatggctagttgttggcaatttgtaggtgcttttggagcagtgcccttcagatcaaatctttggcactgtaggacagtaatgctgttgtatatatataaaccattcgatgtttactgacacatctggttagcctgatattcacctactaagagcaggtacaatagtggattattagccggttgtaaacattttaatgagataaaagatgagagaagagcagcgggctacagatctgtagccagctgcagcgcgaactataagacgcaatgtgtgtatgacaggtgggaccatatattaatagtatagcaagcaactattgtataaattggctattagattggctataaatgaattggagttaggtcctctttatttaggcttataagccagcttataagtcgaaaagtctaagtcaaaacaaacaagtagcttttttttatttggcttttttgaagccataagccactctaacactattaagccaaaagataggttggagaagcttttttggcttttatgagatagatgtatgactccaccactaaacttaggacattaaatccactgtcttataaatcatataagccaataagctgacttaaaagtctaggccaataagcctaagcctaaacaaagagggccttagtagtgggctgtactattgtaacaccctgaaaattcgaccaataaaatcaaaactctaaaaatacggattttcaaaaactttttaaacaaattgcattatgccgattttattcacctatttcattggattttgatttcggagttcgttgatcgcgaataaagaataattaattaggaataaaccctaaaattaaactggcaaaataaataattaaaatataatttaaaataaagattaagtgaggttggtaataaataaaaatattatcgcgaccatattagtatcaattaaatttaagtgcgatggaataagaattaactttaattaaattcaagtaatttatataaaaataaaatatgtgtaatgttaatctagggcgaatcttttggttagagcaacacaaatattgagtaaacttgatttgtgcaaaagttagaatttatagggcgagatttaaatagaaaatagactaaattagggttaataaggatctagccctattcattgcctacaaggtgcttgatgtaatcctagcctagccggccccgagccccgcgccgccgacgccgtcgcgtcgccatcgccgcgcgctgtcccatcgccgcctgccgccgcgcgccgtcgccatcgccgctgccgcgccgcgcgccgttccgtcgcaccgtcgcgtcatgtaacatactgaaaatttgctattttctaaatatgcatcatgccgattcttatgttcttaataacttcctaaacctaagaaattataattagagggacctcctaaaactaacctgtataaaatccctctttggtatttaaaatctttcgtggttttattctaaaaattgatcttgttaaatcgaggtattctctttgatttgatttgtatcttaaaccttctttcgaccaaaatttcctttctttaaatttagtttaaaaatcctttttacttttatgaatcatggtccaagaaatcctccaactatacctttgaacctaaacccaagcaaattcaatttcattgaattaaatggtcaaccattccttaaaattttgatcccaaatatttttttaaatttacccgccgtttgattttcccggtttggttttctctttagccgggaatatatttatatgacaattggtctgtgctaaaaaataaactttttcctccacccaaatccaaactctttttgcccctattaaattttaaaacccgcgcaatatttggggtaaaaatttttattttttcncgggcttcggcacaccttttgctttttcccccaccctgttcgcacgattctctagtttttttccccatatttctgtgtctcggccaacccttgtaatcgcgaaactcccccgcgaccaactctgtttttttcccctccgccccccctcctttacctcaaacccccgcggcggtgttttttagggcct

SEQ ID NO: 63196 - DNA, 6150 bp, Oryza sativa
  unsure (1)..(6150): unsure at all n locations
gccctgagaacaaatcttattaggccaaaaagattttatccgacaccaattgagggagaaataatattagagataccgtacccaggacagagattcaactggcatccgacatattacagacgaatacactgaggatgcctacacctcaattacccttgttcgaagcacaagaccctgtgcaaacggaccaaaacccggagcggccaaccaacctttgggttataaagggccactaacacaccggccgccctttccgtaaccccctcaaacactcccgggccagactattggttacccattaggggaggcaccttctccgcgggcccaataaatcccctcccgcttggaattttaaacgggaacaaccaactttttatttcaccattttcccctctttactttccaacggaccgccgtttttgttacgccgaacaaccgcttgggttccnccccaccggctgaagttccgcaccgtgcgtcgcccgccttgggcggcgaccgcccttcacttggttcggtcgccgccgccccccgggtaagcagtaacccaaaaaaaaagaaaggaaaaagcgggagggagagaaaaggaaagaaagaagaaaagaaaaaaaagaattgaaaagaagaaaaaggaaaaataaatagaaaattagggagagattaaggaggtttgaaaaattaaataattggggttagttgtaggtttcttttagttgtagaatcacaaaattttatataattatagaatattttggtaatctctatacaaaatcaattcgtggtagaaatttagatttatttaagagctaaataattatgttgaattattaggaatgtacttctaaatcacaaaaaaaaagacttaggatgaatgaacttaaaattggaataaagtggttttgcaaactttgtagtcgatatagaaagatcgattcgcgttcgacttttatttaagtttatttggatttcatttgaattctaattgaattcaaatcaattcttcgcacgtacttttagacccgagggagttgcggatccgagcgaggatcaagacccgcaggactacgagcaatgcaagtcatcactattctttgaacatgttgatcccaattacgaaattattttgtttacaaataaaattgcatgcaatgatgaacatcctacttgtgattatgccatgccttgattattgtttaccccttatgccttcgtaaccatgtttacgtatgagtccctagtcaattatgacaattgcttaaaaatgctattctagaatcatgcatactcatatttatcaaatgctatattcttgggcaattatctttgggaaggtaattgagatgcggcatgtggagacatgagcgccacattgccatgatgttgatgacatgatttgtgaaaggagaaataaaataaacaactgttttcgactggngcggacggaggattttggtggtgtcccgaaaaggctagtgccgtccccggtcaattaagaaccgagccatgaagttaagcatgaaacgaccccccgtacaactgcatttctaatatgggtatagacctagcgaatagatagctaagcgaaggcgacctgcgggtgcggtgcctccccgtggcgaagctgagcgtcaccgttagctcgccgcccgacggcacggcgaccaccgtcgccaccgcggcggcttgagcagtagcggtatctgcgggcagcatcagcttcggaggaagcgggatggactcctcgtggatgacaatcccgtcgccgccgccgtcaccgtcgccggcgatggcgcggtagacggcagccacgctctggaagcagctcgcgcagaagtcgcccaggaacacctcgacggcggcctcgacgccgctcttgatgaacatgtagtccatgtccagcgagcagattgggccctcgatgcgtgacctcagcaatctgccggcgctgcaggtgatcgtcctgtcgacgaactctttgcacgcgtcgaccagcacgtcgtcggcgtcagcgtcggcgccgtcgccggcggtgttcttcagcttcaggtcgaactcgagcaacacatgctcgaacgcggagatgccgcgcagtggagatgacagctccagtgcaggagagctctgaattattccaaacaaatcaatttttttaaaaaaatcgaacgtgtttgaatttcctaaaatttgttcaaattcagccaagatagatcctgttcaaactcaaaatttaacattgtcactcaccagtgtcacttcctgggcgttgtcccgtgtccggttgaacacaaagttgggcagcccctccatgtcgtcgcgggcggcgacgatcccatagacgagcagccgccgcccatcaccgccgctgccggcgccggcggcgaggctgagcgagcagagctgcagcatgttgtcggcttcgtagtcccagcgggggtgaggggtggtgaacctggagcggggcagcgatgtcggcgccgtctcgtgcatccggtactcggagtgccacgagaggccgaagaagccgtcgcggtgggaggagccctcgaggacgaaggtcggggtgtagcgccgctcgccggccggcagctcggcgttcagcttctcggtgagctcgtagccatctgtgtaagggtatcggtttatcgtggctcctcctgcaagacaagaaatgttcatatactccatttgtcctaaaatataagtatttttggactctggtacagtcttcgagatgctactttgactaacaatatctataaaagttattttaaattaaaagagttgcacattatgatagtatgtttaataataaatctagtaacatcaattttacatgattgatctttttttattattttactattaatggtcaaagttaaaaatgcttatatgttggaaacggagggagtatgtggcaagtgttttaaatttgagggaatataatcttgtttgtttaaacatcatataaatagttggtaaatctttttataaaaaaacgacaacattaataatgtatatataaaatactctatataaaatcaagttaaaacttaaatcacccatctaggaataaaagaatcaaatcaaagtgctctggatttatctttttttaattctcaatatgtaaatcgaatttgaattatatttttttggtggtgataaaagttactataatgtacattgctaacaatttttacagctagaggcctcggttgttggtcgttctccaatgccattgtgtaagggctggcatgggttcaagggctttcttgacctgcgtgagaaggttttattctacacaggatgtacagggtctattttgtctttggtgggtcaagttttttttttaaaaaaaatacaaacattcacattgaatttgaaaaaaaagaaaaagttacacgaggagatatccttcgagggtttagaatcctgtcccaatatttgacttgcatattatgaacaagaaatttatactttggtgctgcttgcaatggaggcacttacgaatctcatattgaccaatccgatattcagctaagtgtttattcaggccttgcagctgattatcttcttcctcctcttctgctgattcttcgtggtgatcatcgtcgtcgtcgtcggatcggaatagccaggccgggatgagagccttgttggacggcttcttcttcgtcgtcacattgcagcagtcgcaggtgcagcttgagcggccggggacggtcagccatggctgcctcgtccggtccagcttcatcaccggcaccatccggtcgatctccgccatgtcgaactcggcgtcgcggttgcgccgccgtcgccgacgacccatcgatcggcgcctcggtgatcgatcggaaagcaagcagaagcgaaaggcgaataatatgggattaattcggatccggccttccaaaggcgatcgatcgcttcttccgtttgcctaaaaccgagagggactccgattctttgcaattctggttgcgaattcctaagaagccacggctcatgattagttgtagacttaaacttgtaataactacagtacacttgctagttactagtagttactacaccgcaatatttgtacattagttacttcatttatatcgtacaaaaagaaacacaaacagctcaggatcaatatacaggcattcctatacaccataggagactttgtagctcggagtgaaagtaggtgattgaatggcttgagaaacggctggcaaattggaaggcaaacttttattacttagagggcgactgacactaatcaatttagtgattatcagcctaccaatatatatgatgttcttttttgaaatacataaaggagtgatcaataaaattgattattttcaatcaaggttcttttggcaagaggatggacacaaaaggaaatcccgactagcaaggtaagacatcatcgtaaagatcaagggggttgggaattcaagatcttgaaattaagaacaagattctctttagtaagtagttgtataagctactcactatagatggtgtgtggcaataaatgctaaggaaaaaatatttggagtcacagccttctcattggaaaacaagagagtcacacttttgggctagtctaatgaaggctaagcctgattttcacatatttgactctttcaacatcaaagatggctctcaagtacggttttgagaagataaatagttagggaatgcctatttaatagaacaatacccatgtctttataatgttgttaggcataaacatgcaactatttcagaaattttccatactagtctgctaagcttttcttagcgcagggaccttactggctctaagttagtggcgtgtaatcaccttctctcacacatcgctaatattatatttctcacaaccaagatgagtttaaatggaatctaaccactgatgacagattttcggttaaatctctatatcttgtgttggtgcataccgatgttcccaatataaattaaagaatttggaagattaaagccccataaagattaaagattaagatcttcttatggtacttatatcagggagtagttttaataaaagatattctgattaaaaggaatgggagaggaacttgttctttttgtcgtaaagatgaaactattaatcatttattctttgattatcttgcgcggtttggtctttaatccaatctgcttcgaatattagtttacctaatagtataactcatatgtttgggcatttcataagaagacaactacacaatttgaggcatttggtcttatttggggcaactgccactatttgatctatttggctttgcaaaaatgatgtgggttttgaaatgaaaaacatatcttctctgttataggttatattttttttactacatataggctctactcatgggctattctccagaaggtcaatttgttgggtaccatcactgcggcttgccaataattggagttagtggccatggagttttctaccctagcacatgggtggagttctaggctacggttagagagttcctaaagtttttcggttgtcttggatgatgatattatcttttgtttctttcttgttggctgggtgcactctttgggtgcatacgccagagatgctctcggaataattttatattatttactgagataataaaacttccattataaaaaacaatatacaatggcgaatagtgacagctaccgagagccacacctctccgcggaaaccacatgggtggcttctcattggatcatcctaagatgttggaagacattagcaggcaaggcaaccgattgatgaatgatatgggagcggtgagagagtagccccgacagcagaactctcctgctgtgcatgtcaatcctgcaaacgtgatatagttgggggtcattttatgtcctgagcggcttaggctgttcactttagtgccattttcaaccttaccaaatttcggtaaagttgccaaaaaatggctacatttagtttgctgccaaattttgataactatataagaaatcctgccaaaattttggcatagttaataaaattttggcattgccaaaatgacattgccaaaattttgtaaggttttttttggcagggtaccgagctcgaattcgccataagtgagtcgtgaacatcagnnntcaatcctt

SEQ ID NO: 63197 - DNA, 15153 bp, Oryza sativa
  unsure (1)..(15153): unsure at all n locations
agagtttgnattgcatttgaacatcnnnnnnnnnnnnnnnnnnnnnnnnnnnnnnnnnnnnnnnnnnntggtgagccgcctccgtcgccggtgaagacgatggcggtgtcgcagcacatgaagccctgcgagagatccgcccagaatgtgttgccgtcgaacgaaaaaatggtgtccgtgcagaaaaatcctcttgtgtgtccactgttcgctccgccacaggcatccgcggcgtgcagcttgcaggaaaaggtgatcaccttggtccagcggcggccggcatgacatgatggtgttcatcttgatcctcagcagagcctcgtcggccgcgccgaaggcgaggccggagaggaggtcgtcgccggcgccggcgccgaggcgcgcgtagagcgtcagccatccacaaccaccagcgcctggccgatcgagctcgccgcagccgaaggcgtccatgcgcgagcactcgattcataccactagcacgcgagccaaacccaatacggcaacttttacctgaccaccaccatcggcatcggcgatgtgtcgtccttgtcagatcgttaccactagccagttgtctgttgcttaaatcatactttcttcgtccaaaaaaactcaacctaaaaaggatgtagaaggaaatggctagattcatgcccagattgagtttttttttggacggagagagtaagttcacaacatggcaaaattttacctgaccaaaaattatcaaagtaataataaaaaaaaaaacaggacaggagctgattcaagatccaaaatgtcggtgcctgataagtttaaacgacatatctggtacggtacaggtaaaaacaggtttaaacattcaaaacattcagtcatcacaagaccgaaacataattaaaacggggttcaactttgtttcaaaacttaaaaatgggtttaactgattgcagccaccgaattatgacccgcggtatttcgcagctaccacaaacgccggccatcgcaggagctccgatccccagaaccagcatgcataccctgttcagaggaaattaatgtagtttaggccaccaagtaagttaatctgaacttactatagaactaaacaagttcttgcagaatcattttgtgagagttaactgtaccttaataataccaacaattgatccaagccatgaaactctaatcttcaacacggagaacctactgcaatggctgcaaatgcaaacttacatcagaaaagggaattatggcactttttttaatcataattatgacactattttgacattgtgcacaaaaaaaacgtctattgggactcccaaatctgaccttgtttattcttacactaccattttgggtggcaggattttgggtggcaggaagaaggggaggaagggcaggtatcttctcgatatcgtcataacggagaataaagttgtcctgcaaccaactttcagatatattttcttctgctatcggaaaaagctgaaaatatctgtcagaatttctttcggacgtttaccttaggaattgcatcccaaatgttggcatcaaaaagatagcagagtccttgttcataagttgtagttttgacgagaggggtcgtattaggagctcttttaacccactgacgcagctctttgtggtaaacccacccgtatttgcatctgaagaaatggaagcaacaatctgagctatctggcataccaggccatcgttttactgaaaatgacaggcaaatgagaaaacaatatagaactgtggttttgtgcttacatttcattcgcggcatataactgagctgcatcctgtggcatactgcacaaaagacagtcaaataatgcatagcctactaacacaggaattcactgttgattgaactaagtacctgtagaagatgtagaatagtgtcatgaggtgaaacctcagaaaatgcaacgcctgcagaggaagataaatcgtaatgtcagatacaacaagattaatgctaacctaaacattccctcacaaaaagaaaaaagaaggtaactcgaaaattgagggccttacttgcaggggtggaggctgcatagaagagtagcaatccggaatttcataagaatactcttctttaactggctcacttgaccaaggagagccaaatgtcttgtaaagattatctgaagagttcatatccaaccctagtgttgtcaaatcaatccctaaagcaagagatgccggtccctcctctttcaacttcattaccctcagtagtccatgtaagccatatggatcatatggatccggtgcggtatcagttctctgagaagacttgggactctgaaccttgtgagactctggtgcggtatcggttctctgagaaggcttgggactctgaaccttgtaagactctggtgtggtatcagttctctgagaagacttgggactctgaaccttgtgagactctgggccggaagatgactgcagcctaactgacttctgagcctgtggttcatgattttgctggataacttgttcacgaggcctcggatttaaaggcaaccttggagaatttactggctttggtccaacattttcaggcccagtattttgaacctaataaacacaatcagtatggtcagtccatatttgaaaagctcagcaggcacctgctaccaattattttgtaggattcttacttactattccccataaagaaaaggtacatgaacaaaaaagagtcgtgttcaccaatggtggtgttttcaatcttgactatctggtcatgaggtaaaagaaatcataatacaggtaacttaccgaattagctgtctgcttatgttgtttacggggtggacaactgctgcccgtgttaaagccagatgatttgcccatctgtagaatcacatgtaacggaaatttaaggaaaaggaaataaaactgttgttggaattacaatttttatttttttagaaaaaaactcacaggataatgttgtgcttgcataatatttgcattcttaggaagatgatccttgcgatgcaactccataccttacattcagagcatgaggtaatgttcaaacaaagtaccaagacataataaaaacctatagcatgaggtacttggcaaggaactgtctgaataacatatagaattaaataatgaaacaaaaagtagagtaagagtaccttccaatcttggtaaagctgggaagtcctcattatggattctaaattcctggttttgctgaacagcattaataccaaatgcttgttgtcttagaggtccttcatttgttataaaggagaaaagttagttaactaatattatcattcagaatatttagtttgcatgtcagcattaccatataacccctgaatatttccagcagaattaggtcgcccaactaattgaggaaaatcattgatgtcaaatagagaattttcaccaaagttaccatcatgtcgcattcctggagaaccagacgaactgcttcctgcctgcaattggttcttagatagtgttcctccaggtgctgaactagagcttccaagcatattcatagccggcaatcctggtaaataaacaatttgaaacaaaactgcccttttatatataagaaatgagaacgttcacattcttactaaacacagtaagttctgcacacgttttagttgcttcgtttgattgataaatgtaatagaataagcacattaacaagatggatgagatgtcagtacagaataaataacagctagcagaactatggcaaattgcctcaacagaatggtgtacttctttaataatggacccaattaacacttccattccccagatcaggtaccggtcaaatatgtgcttccttattcttttttgctccagatgactagtgtacttcataggcttaatactcagtccttttttttatatggcgttggctagttcaaaattgaaccaaccaatgtcatataaaaaaatagggagtatgtgatttttaatattatttattttagatcatttcattatcaaatcagaaagaaagacaaattgagaacatatgcgcgtgcatttatacaaggggtttatatgtttagtatataccttgttgatgagtcccacccatttggtttgatcctcggatattaaaagcccaatttccaaacaaattaccagggaatgcaccagtaggcatagacatccggcagagcttatggttctcccaatgttgcccccacccgcaacgctagccacataagttattcgcgggccaaaattcccacaaactggagcagctgccaatccaagagcagaattgtggttaccatctttagtcaagtacgaggaggaagcttgtattgaaccatcaattgcactcatgttaccagtaaaaacaggacttcccccaacatgcatacctcctcggttgctgagagcaggatacccgacctacaaaaaggatgaaagaaaatgtgagctggattagaagagcttcataaacagactcgagcttaggagaggaaaaaagaacctgataaatggatgcttgaagactatttggaggaaaccaagcaccagaaatactacccctaggtggttgaaccccaagggatgaactaccagtcattgaggaaccccttggtgctagtgaacctgacatgtttctaagattgagattcccatatacaacccttccaagtttttcgtgagagttagttttagaaaaacatcactttctaacatgcacaaacggactagcaaaataaacaactgtaatgtcactaaccaggatgacgaaaacctgaaactgatccagattgaccagaaaaggtcggtgtcaacggctttcctgttgagactggaaggtttgatctggcaccactactgcttgactgaaaaagtaacaagacataagttaacctataattgtgacattttaatatgcatttgtgccaaaacaaaataataggatcaaattttaattataatatagacttaaataataaatcatagctagtattcaaagctgcttttcactactctaaagagccctaataacaacaagaaaaaagtgtccttcaacagcatgattcataacactttgttttgatttcagacatagtttaaggtccttgtgaaatagaggaactaaacaaagagaaggtaagttacaagaatacagtatccagaaggatacacaaaccaccaataaagtataaacaggctcgtgagtctgctaatctggactgcaatgatttattgaaataagatataaacacgtaaaaaaattatgatagtaaggatgagggccttctgaaaacaactaaacaaggatgagagcacacattcagcgatcctgacattttgatgatgatcaaagaacaaacaggccaagagcaagtcaacaatattctaccaattccataacaccatttatcagatctagagttcaagataagacaataccctgtataggcaatcctccaaaatgcaggctatttttcaaggaacaaaagggaaaggattgatgtattattgaacagacgatgtgcaatggatgcaatgcaggatccaaaacctgtttaaaacataatcataagaagatgtaaccactctacttgggatctcatgccgcagaggcttgttttgcttcgcctgtttacctatctcatccaactgccatgtaagcttggcctgtaatatttcctccaaggtatatatataaatctctctagggttcttccaaatcccctcaaccaaattacccacaaccgccgctgccgcggacagtgtctccatgctcaactattccaagattccattgtttgccgcctgctcaagccaccctagcgcacgacacccagccggtccctcaacgcactgcctgctagctctgcccttggttccttcctcccaggcgtcggcaggtagcagctatccatggcatcagcggacggtgcagcatgcgctgactatggaggcaaccagacaaccaagcaaggtgtgaccaaccaccaggactccatcagagcatcctttaatcctcccgatgatgattgtctctctcatattctctcgattccccttttgccttttcagattaggaccatcatgttgtcagatctagaaatctaaaatggagtattggttttcgttcatgtttaccagtaactaggcctctagttgcatgtgcttgccagtaattgttcagcttgtacatcaagcgattagcatcctcatgctaacatgtgggatttttttttggtctatttcaatggtctctttccaatccgctgaacttttgaaaccatatcgttaagctatctggcggacacataggcatgcctgcgagcacacagcgtccacaagctacagttatgggctgagttcttcacccctcatagagtaacgggcacgcctgtggacaacaaactcgcgggcgtgggcatgggtagccaatacccgtgcccgtcacacccaattgccatccctaaccctaaccctagatctatgcgttttaccgctagattagtattcaattgcttttccacggggaatcctaaatacttgtcaacgtagaccactcccgaataaatggaaaattgaggtcttacctagtatagtacatacttgcagactatctctacttaccaaacctcatgcgtaccaaccaaattacaacaacaattaccaaaatcagtcgttgaggagtttgcggaaagggaggattacttgtgtcgactttgatggagatttgcggccgcccatccttgagcgtttactttggtgagaaggttgagaggtgaaaagaccaagaattgcggctaggcataggggttcaaccccttttatggaacaaaaccgcatctatcccttgttgccataggcacataagttcaatcccatatttaccccctaatctctttgacatgtgggcccataacccacatgccattgtgagattaaggggcaaataagaggatatgcaaacttttaggggtgaataaggaatttatcgaaaggggctaagcatacaaaattgagtaaattccttatttgcccttgaaagttgatttcgtccctttttgcccttgcaaaattgccctccaatccattgaccacctttctcaacttcccttctttatttgcctattgatacatcaaaatacatttttgctctagtgaatgcccttctttctcatctttattgttccttttgccaccatggcaacacttaatcctcattttcattatcagttcaccggtgatatcttgtatcccgtcatgtcaaaaaaaatatcttgtatcccacctcttggttggttgtaccctcatcaattggcacctcctcctcacctcctcaatcctgacctaccactccactattggcaacatcttcctccattctcacgcagtcacacagtcacagtttttctgattttctcattaggaaaaatattcttcagcatattcgcagaatgaatgagactcttaaagatatagtcttagctggttacgaactttgtaaggattgtggttttagtaatccttgttgcctcttaatctctactacttagaggtggagtcgtccgtctgccctccccctcatgacgcacagcacgagtcactacctccccaagaaaaccataaaaaacaaatggtaaaaaataccagttgtatcccatgctttaggttagacccacaccccaccatcgtatggtcagttgcaatgaacggacatattactagttaaaagcgactattggctgtcacctggcagtattctcctaaaaaatgcactatctacatgtgtttttaggtatttggttgatttagatggttgtgtatacaacttataaaactgtggatagttatatgttggttttttaactatagatctttagtatatttgtttgacatatgttggaacatgtgatcacattgctcgttatattgcaaataggcactatgtcatgcatggcaaactaatgaactgttgatggaaaaattctagaaaaagtaatagagatccataatgagagtaggtgaattacaaccagtccgaaaacccaaatgagggtgagtgcaagcaagtttaaaagtggtactttagaatatgtgactaaaattcaacctaatttgacaggcgaaaattatacttagtagttgatcactagaaggcaaaacaaaagtgctaatgcttacaaaataatttgaaatgaaagaaatataaaatgaaacaaatacttcctccgtttcatattataagactttctagcattgtccacattcatatatatgttaatgaatatagacatatatgtgtgcctagattcattaacatttatataaatgtgggcaatgctagaaagtcttataacctgaaacggaggtagtaataattaccaacactgaacaaacacaggcctactataactggagactagaactcacaacccatggaagtctaggattaacattttgtgagtagctttataataagctggtgttccaactagcctcaagaggccacgtatttatggaccttccatgtataatcctgaatagtagaattagctatgtgatactaaaccaataacatgtttggatgagcttgagatgcaaactcgaaatttccaaaagtgacttccaaaattaggtggtgggtcagcaagaaacaatgaaatttcatcagaataacacatgctcttttttcactcataggtattgcaacatactgaacaaaaataaggaaaagggactggaaattaccatattaaacgtaagcattcaaacattactctggtggatcaaattttatcaccaataagccacttgtaatttgtagtctcttgtatagatatacacaaatgggtacaaagctcattctttggctatatttagaatgcacattccaaatcctataatgacttgtatcatgtgaaaatcctacaaaactcagttgtcaggcccttactatagttagcacctttatgaaggtaagccccagatataaagttttctttggttagtttgaacaaatcctaccctatattcacactacgaactgagaagaaaatttccacccaataaaaatattttaggttcttctccctcattcaactatacaatgggtctgtttggcacagctccagctccagctccacctcttctggagctggagctcagccaaacagtttcagctccaacaaaaatgggagcggagctgggtggagctctctctcacaaaatgaactagagaggtggagctgggtttaggcagctccataactccactccagacccaactcctggagctaaatttaggagttggagctctaccaaactggcccaatatcagcacatcatctcatgcacacctataatctctcccattgatttcttgatcagatgcattgaccaaatatgaaggctacttgaggaagcaaatctatggtaggtcaccattcttttgtaaccaatttctaacatcaccttggttgcttagttttggggttgatttatttaagtcaaccaagtaaagaaagattttctatgtaattgcttctcccacaggcaccaattttgagcagtaagaacaaaagcatgaccatccatgtgcagataggttttagtttagtgtagttcaaatctcattcattaacgagtacagttacatggtacaactatagggtcggtttactcagttacctaacttgcatgccaataagagtagaaaataatgcagaattcatgtgttgtttcaatcctaaaccgtatttaattggcaaaataaatatagatacgcattactcagcacaaataggaatattattataataattattttgtatattggattaaaaggaaagtccattctggctagactctaggggagttcttaaaaggtaaaaggaccttgaatccattataagacagtaacttaaggcatacaaattaaaaaaaattgtacactggtctgtttgtggtctttttctatcatgagatgatgctaatggaacattaaattagcaagaggaagaaaaagtattgaagaaagcaacctcacattgtttagttgggttagtgtcacttctaacttcccctggaaggtaagaaatatgcagttatgcaccattgtccgaactccaaagccttttctccaagaatcatatagggagcgttcggcaggaggagtttgtgagttagtttgtttcattttccgtgcgcacgcttcccgaactactaacggtgtgttttttgtaaaaattttctatatgaaagttgctttaaaaaatcatattaatctatttttgaagtttaaaatagtttatactcaattaatcatgtactaatagctcacctcgttttgcgtatcttcccaatcttctcttttcccctcctctcaaactcacccatagtctatagtgtatgaactctgaatctcaaacttgtagtacaaaataaatctgcatggttaacacgacatacaaacagataccaatgagttgttaagccactaaaacatacaaacaatgaagatgttagaagcacaattatctttcagtggatatatgtacagctccatacgagaggattcttaattctcttgaggtagctacctgcgaaaaacatcggggttttcaggatccatcagtcaatcccctgaacaagaacgatgatgtcggcttgtcgagaataacagaacaatgcatatccatgttctccgaagattgagctccccagcttggatcaaatcgcagacgctcgcgtccgcagctgagcaggagttcatgaaacctaccaatttactgcaagaaaaaaataatctcaaaccggagcctaactggaattacatacagcatcgaagactacccgatagaccaacagaataatttgagacctgtagaacattctgtggcttgagttcattcaaaatcatcagaataaagccccccaccctatcccattccatcaatccctcccccggggcaaccggaaagggagagaacattctgcagattgggttcattcagatcacccaggctggaaactccaacgccaatggcccaagcatctctctaattcgaatgcaggaaaggccgccgctaaatcaaactcccaactccccccaaaaaagaaaaaaaatccaagcacgatgcacgactggaaactattcccctgggccgggacgaacacgccgtcggctgcgaatcgagatgacacaagatccatccgccggtgagcagcggcgcggccaccgacctaatctgagttttggcgatggcgagaccgagagttagcggcgggaggcgaggatctctctgtcgcggtggagacggggacgaggggtttgtgcttgtgcccttcgtccctgtgaacgaatcttgatgcactccgtgtaaggtggtaaggctctgtttgcgaagcttcaccttatctcgtaaaatctgaagctcttccaaataatcccactttttttttaattctaagaagttagttatagaatatggaaaatgaattagagagctgtttgggaagctttcatcacataatctcccactccctaaaccgtctatattttcacccatattctaagaatctttactcgtagaatctagaaaataaactagaaatctaaaactgaatctaaaaggctggctaccaaccagtagattttcagaatcttaaactactccaaacaaaacctagaaatcggatgctgagaaatctagcttttctaagccggctacatccagctatttcttacaatcttaaactccagacagatcctaaggctaagagaggtgcaaaaaaaaacaccaacctaccgtatgaatatttttgaaatattgagctaagattaacgaagttacgagctggtagctcgctattgataagtacttcctccgttctacaatgtaagtcatcctagcatttaccacattcatattgatattaatgaatctagatagatatatatgtctagatttattaacatcaatataaatatgggaatgctaaaatgatttacaccgtgaaacggagggagtaccaaacttgaggaatgggctagtaaatcttaaattaatgaagtaccatgtgactaccaattgataggtctcactaaaagagcgggttcgactagaaaaaacttgattagttaagttacgctcacttaaaaaaaccaaacattttcttgtaatgttaaattaaacaagttctaatcatgaagtgtacgacctccatcttattcacggtattgtaaaaacagattatttaaatatgttcctagaaaaatctccaactgtttgtaaggtcacttatttttttattttaaaaaatatttctatatagttacatagataatttataacaatactccacttaatataaatatatattaaacatttttttcattttacaagaaccagcccaacttcccaaatggccctcatcaattcgacctgggccactcggacgtttccgatggactcgtcaagcccacactccccccaccgatcagacagtgggcccttcatgggcccacgccacgcccttcttcactccgtctgacctgaccatcttccacccagcgttggtctcgtctgaagcctcgccttcacctcggcgggtagatctcgcgggcgcatcgcgtcgcggggcaaattcatcaccttcgtgaggcgcaaaaccctactgcccttgacccctcccgctcccctcagatctccccagggtccaccgatccaaggtgaggcggcttcgtgctcggtcggtgtgtgcgtgacgtgaggtttcttgttcttgattttggtttcttgagttttgaccatggtggatccggcggtgtgtggtggtgtgtggttgcaaatggcgagcacgggggggaggtcgatggcgctgtcgctgctcctgttcgcggtgacgctgtcgctgctcgagatgtaccggggaaggttcgcctcgtcggagctcatgaccatcgcggccggattcgccagctccctccttttcttcttccttctcacggggcgttgaatcgtccgctcccaaccctcctcttacgatcttataccccttaataagtttttaagttttgctcgtgatgccgttgtatgtccctctttctttttagctaatttgaagtgatagaatcacatgagtggtaaaattttcgttttattattaatttagacaaaccccgtagcaaatggagttgccaagatgttgtctctcgtagcttttgtcacatttgagtgattcagtctgtaggggataaacaccatagaagaaaacatagttttgctctgtgcagaagtgggtagtaacattgtgcttctctgaattgtaatatccgactaggcgcataagcgagatttcggcttagaggacctggaactagtttattcaggttcagttttccagatatccacagaagaatagcttctgaaatatcatacaccatctaatattaagttcactctctacacaagaagtcaaggatggcttctgaaagagaatagaacatttaattttaagctcacttggtactatgtaggctaagctatctgctagtatttccatgatgctatcataattcttgcaaagggcatgttaagtatggaacctggagcttcgaacttttaaccttttgagccaagataatagaactaaagggggttttggccaaaagcatgctaagccccaagagcatccagcagaactagcagccccaatgtccatactactagtcttatctgatggtcaaagaaagtatccttgaaatggggtacttatcccagctttctgctctgtaacaagagaacagtgcaagcagacccttaggaaggcaacaaaacttagcaaaaacaagcacataagacatagtgagcaggtggtatccacatttgattttcaccttttatggttgtattaaaagatcagtgagttttgcacttttttaactgtttcctctcaacattaatattagtatatgataatttgatatacttttgcagtttattggcaactatcaggaagctaatggagttaaaactggatggggtgcaggtatgtatagtcatacgatctcattcttgctgcttccccctgatttttatttcgactttctttaactgtctctttctttgcagttgttgtcgcggaacttactgcacttattgttgccggcactgtccatcgtgtttgcatcacaacatggtatgttatctttaagacactttactatttctttctaccgacatttagaatttttctatatggtcccattaacacatccatagatctgagtgtttgctgtttgctaaataagaaaattcttggattatccagagatggtaatctcagacatactagtggagtatttgcttatgaactgttgctctgtttagatgggaggaaatgaaactaacaatttaggcaaaaacaagatactccactcctttgtttgcaaggagtttaaacttttttcatcctgttgaatgtgatatcattcaagatagtaatgtgtatttcacacaagtattttttacctatcttaaagtgtatattggtaacactaatgctattggtaaatatggatttgtcacatgttgtaaaagctgtatttatgcaacaatgtcactggaaacgctatgcattttgcagatacgctattcaaaaatattgcatatagaatgggttactagtagttttgttgaaacctgctatataaaatatcaaataaatggccttttataggctaatatgcttgccggctaagccccgccgctcctggcctttttttaagcaactgacccattgtggtaaccctataaacatgaatttggagaagtctattaccgtgagaaaattgaactcttgagagtcctttgcaggggtaaaatcatttatttaaccttggtcanttgggccaccttcgtggaagccttggaaagggtaaatcaattttatcaactttggctgcacttccggttgtctgtggattctttaaaggtggataaccctctgggatgaattctcccaaagaggagctaagcgagggggccctaggttttgtccactcaatttttggatcaaacaaaaatatagtaccacccttagtgaactttacacaatggtttttccccccgcctcggtaccattataattaaatccttg

SEQ ID NO: 63198 - DNA, 1794 bp, Oryza sativa
  unsure (1)..(1794): unsure at all n locations
accctcttaagagggggcccttttctataaaaatgggttaatggggaaagggggcgggtaactccctcccaacccaaaaagaggccccatcctttccgtgccatagggttccaaaaacataagccatataccagagtttgtttaccatctttaataaaacnacctggcgtggggtgaacatttggcggggatgactcacgcttttctatcattctcggccataatacccttagaaccctaattcacccatgttgtagaatcttaggccataccaaagccntagtcgagttttacctcgccgcacaagcgaagcnctgcggcccctgcgntgtctgttcttgccgccgcgaggttttccggccgcaatcagtcgtttaanccgatctcggtaagttcttccatttcaagcattaacatactacatagatgccatttgagcgatccctttgcactatcatgtcaccttctaagctgccaacgtgagcacggccgccgcttatgtaggcgctcgtcggcacttatgtccggcaccttgccaaaggtggcaaagctgcgaaaatccctctagataccccgtagatgctctagaacccctcccctaaccatgtctaactctcatcactccggtcaccatcacaacctaaccgtgccaccgccgccctagccgctaggccgtccacgcatcaaattaactcctctgccaccgctcgccgccgccggagatccctagctccctcccctcttcggccacaaccactttctccctctagcgccaccgcagtcgccaaccctagcgccgccggcttgaaatggggaacggctggaggtagaagaagagaagagagagagactgatagatgggacccacacacagtaccatttcacttttattcgattttcaaactttagaagcccatatcttttaaaatatagatccaatttcagtaaaacttggaccaatattcttctaaaatcatcctctatctattgggcccctttttgctatttttgcattttatttaaactcctttttgaatttgaattttatatgtctaaccctaggtcttgaggattcctctgacactctagataatatcaatcaatctcaggacatcgagcaaggcaagttaccatatacctgttgatcatttaagcctatattttacaaattatttatttatttatagccttctattcaatattctattttctatgcataaattaatcatagaaacccaaataatttagtattgcttattttgcttacaatctggttaaaataccctatacttagattgggacaatacgtaagatttggatgatttccgggtggctagtattgtctcaatcgatataagttttaccaggtacttatgtcgaacgaatgggtacgaccgcagtttctagaatggggacagacctagttattatgttaattagcaatatggcacctctgtatagtggttcttatttttaagtcctcgcgcaggaggcaactatagccgcgaagggcaactttaaccattaccatgtacaggtaaatggtttgtgatactcgggtataaactatatggtatatttctaaaccctgatcgagatgatgtggtgtcatacgatcagttccccttaaatacctcgggaacgccagaactcctcttgctgctgttaacattacgttcagagcatatgaggatataagttcatggaataagtgccataattgttattgacttannnnnnnnnnnnnnnnnnnnnnnnnnnnnnnnnnnnnnnnnttcacnnntcaaggcagcg

SEQ ID NO: 63199 - DNA, 3103 bp, Oryza sativa
  unsure (1)..(3103): unsure at all n locations
gcccccgtggtgagtgcacatcctatgggcgaattcgagctcggtaccagggggtcggggcgccccagccctcggggccgaaacgggggcgccccagccctcggggccgaaacaggagcggcccgacccctcggggagacagagggaggggtggccacgtcaccctcgggcccgaccccccccccccccccgagggggtcaggccacgtgggtgaccgcggctacccaagcctctagtcacgatacccccggccccatgtcaccgacaccacccataaagaggtctaaattattttggtcagaactatattggtcacgagaaggtggtattatataggtcatgaggaggtgttaccatatagttattattaaaggtagagaggagaggatgagatgactaagaaatcagataagtaactcttgattattttatactaacatgatcaaatgacaggtactcatgatgtgtattagttaaaggtagataagaggggtagagatgactaatgagtacgaataaatacctccttaatcaaatggttgactgttttatactaccataatcgaatggcttaggataagagacgactagtaaatatgtatatgcaactcctctatccaccgtgttaatcaaatatgtatctaattaaaggtggagagaaggggtagaaattactaaaatgtaatgtggataagttactcccttatccaatggttgatgattttatactagcatgatcaaatggcttagtatgattcatgatgtgtatttnnnnnnnnnnnnnnnnnnnnnnnnnnnnnnnnnnnnnaatcagcgttgtcattgtgtggtttacaaaataaacgtttgtctgcaagtgcaaaaggacatgcaacttgccaggcgtatctgtgggcggaggccatggtgaaaatttgtttgcgagccatgcagcatgatggacaaggagcaacatgtgtcgttgattaacattttagaaagtagtgtagatgtatcttcacatagggatcaacttacccttcgttcccattctaattcagttgatgttagtatttaccttttgctccatttggattggtcgaattcaggatttcatcaaacagtcgattgtgaaatgtgaaccaggaattgttgtgttgattgcaataatgggttcctctcacctgcttcttccatcagatatttgaacagctgttttcaagaaccctgtgctcaaggaacacaggcagttgttgagtgcagaggaccttgaaatatttcctccaaccccatatattgcactcatgatttgttattcagacaatgttacaaagttactggatctagatggaaacaagtggcaagatggaaaaaatggcaggatctacacggaagccaaattacaggaacaatgagcaaaaccaaactaatcatcaggaactagaagctatcatcaaaattcaagggtgtccaaaggaggcagaagcaatcaagacagcaacataaaagaagggaactcgcctattcagatcctctgattttgtaagcaactacactatcactggtgatgaactgttgatgatgttgatggtgaacactctacttgcaaagggaaaacgaggaagaaactaaaattccacatcaaaattcctatgtacatttctacagccacatctcggaagagctccatgtgagcgtgtgtcgtctactgatagtagcttagcttctaattctgcctgggattcgacttgctcgacggcttctgcttccccaggctcgcattgacctcgacctccacggcggcggcggagcgcgacggcggtgacctcgccgccggcgcattctgcagcagcttcctcggccggatcaggccttctccccctgacgctgaagctgcagcatcgccaagatccactgcactgatgctggcaaagcattgcaggatcatgagaatgcaaatgcagaggacacaaatggtggcagatctcatggctttggtgacctgcttgcggctcactttgctggacagtatgaatgtaggctgttgcagtgaagtgttcagcttatatgagcttaattaagctcacacggcttccatgtgagtaatgaagtggaggtgattaggagtggatgggcgtgatgatgggcatgtggtgagaggctgcgagttggattagtccatttgacagccagcctgcatgcgcttgccatgccatggctaattgcattccgttcgtcagatcagattcagagcgtgccctgagccatgcacggcacatgcgacgcgaagcagagcagcctaacccagcctagcctgctgctgctttcggctctccttcctccttgtactagcacgagtagtctataggactcatgagtcatgacgcatggatggatgcatgattccgggccaaactgtccgaatgattgcacgtgcaggaaagcacggggaaatgatgagatgcgagccccagaaacacggaattatctcgtgaaattcattcgaaattcgacacaaaccacgagatttggagctccaatgatcggaggagcttctgtctgctgcagctatttctggaatctccaacactctcaaacattctaactttccatccagattacgagaaacagactaccacgcgagagtttgtttggaggagcttctaacaactacagctattcataaagtctccagctttctcgatcaatccaacttccattctaagaaactgtagttacaaaattcagaaaataaattaaacccaaaaagctctagattcccatcagctacttctcacaatctaaaactctgctcccccagacaggcatacgatatgtgttgcatgggtgagccgtcaacttatcacccatcgttatcttagccgaaacaggggaactgatgttgatcaggccataacaaaagtctccacagtacactgatcacaaccaagtattaagtatcaaccaaccacaagaaacaggcaaagggcccaatcatgtataaccaaggagctctgagaacttaccagcgacacgtgccttggagaatttacatactgacaagtgacaaagcctnnnnnnnnnnnnnnnnnnnnnnnnnnnnnnnnntctgcactcagcgcg

SEQ ID NO: 63200 - DNA, 3150 bp, Oryza sativa
  unsure (1)..(3150): unsure at all n locations
taatttcatgcaaactccaatatctacatgggccaagaaggtctccgggggtgttcaaatctaacccccggttggggggaaatgattccatttatcattttctcccaaaggttggaattttggcaccccatattttcaaatttcttggctttgtccctcaaagcgcgaaacttttcgccaattaaactgggtcccgggaggccggattcaatttctctccacttctgaaacacgggggacaaatcttctctaaggcactccacatgatgacaggtaccagatgtcattagcttaatggcattgcggttcttgttacccaattctaagaacaaggccagcatgatcccctcggttcttaactgtaagaatactaatattgnaatgtcataaaccgtttgtcaaatatcacggggccatcatttctattatgctaatagtacagagagatgtttgtgactttgttcagcatcaagtctctgttcaaggggaaaaggcccaaagttaagggcatgggaatcaagcatcttggtgaattactatggaattgcagcacatgtataacccgtaaagctctacagatatacagagtagtttcatatgcaaaaatcttagaaaaggcatgtttggttgataaatcattaccatgattgataaataaaaggcaaccaaaaaaaggaggcccacctaagtgttcagtgatttaatgtatgcaacattgcaacatttaaaatttacactttaaaagattgcaatgatgcgcaaaattggtgatgacaatactagtgtttcacatatttaatgctgatatataggagtataatgtagcatgataagttgattaaaatcctcaagaacttcatataggtctccttagaaagtcaaaggcacttgcatatatagcaagtcaaaatcaaagcctcatttgattgtttcatagttcaaatatagtagtaactacatctggtacatttgccatttataaggagaacatagcataatccttaagtaaacagatcaaatagaaattactaacacaattacaaaagtatatagcacttatctagttatctgttaccactttggacctgttggtgtaacaactgtggcaagtggatagcgagagaaaaaaataactagctaaaataaaacaggaattgtcgactgtgcaacaacagtatttcaaagccatatcaacataataacacagggagtagtccttagtggaatatcatttgtctaaaggaatgacaaaatagaaacagtacaatggtaacagcagagaaagtaccttctgcttctttagcctctcattctcctcttctagacgaagaactttgttttcaagctcattagtgtaagcctgccagttagaatgcacacagcggtgaaataaatatacatgatccataaaagaaggggaaaatggcattccaatgctactgcaactggtatgttcttacagctttggaaagatataacatatatattgatatattagactaaatactgtatgagtaagagaaatgccaacttaatacatccagagattaaaaaaaaagaatccatgaggcctttatgtttgaaagcagtaaattataataagcaaagtaagagcatacaatatatagaaaattctaagtaggaaggattaatcatacctgcttcctcgctcttgacctggcagctgattccctgttttttatcatcctcttctgccttctttctactagcttatctgcaatctcccctgtggcacagcgtttgcgcccaggtgtctgaggatcagaaagagccccgagcattggcgaagtgatctggccatcggagtaaattggatccaaaacagcacctgtagcaacagctaatggctgaggtgccaggtgagttgccatgtaaggagcacctatgcttggatgctggggctccaaagcctgctggtgatactgctgtagccactgtgctccggcattcaaatcagacgtaccagctgcagccgcagcagcgccccctaccacatccatgtttcctggcaaatcgttcggatccgtgacaaccccagctttgaccaggaaatcctcaagcgtcatctcccccagggtcggttgtctctcccgccttcaccggccaccctcctcagcacccctcttcggcacatcctggatgcccttccacacctcatccaccgtcttcttgctcagctccggaggcatcgtgatgctcccctggcgctgcagccccagggccggctgagactggcccgcgatgccgccaccgccaccgccaccgtcaaggtccgcgccatcaggaaacacgcttttaagcagctcatcaaggttcatactaagcaacggctcccccaactggctctgaacctcattgagtgtaagcccatacagcgacccttgcctcgccaacccctgcatcggcccgcgctgcgccgagccagcatcccggccacttccaccgccgccgccgccactacctccagcatgcgaagccattgcctgaatcatgaatcggcgctctcaattacaccaaatcagcccccgaggattccaccctacccctctccaagtaacctcagcagccgcgatacccagcgaggctgacctaacctgggggcattagggttcaactgaaccccagattttcctctgcaaaaactaacatccatcagtaccagacgcatcacagaaatctagaacaaactggacggggggctaattgggaaggagaagaaaatccaacccaacccaatccaacccgcgaacagattcccctacctacgcgaccccgagccatcaatccaagcggcccgcggaggagaagagcgaagagaatacctttggattcgattcgattcgatttgacccgagacggtggccggctggcggggccgcgcgcgggaagaggcggagggggtcagcgccgccgcggcgggcttctcgccggcggtggccgcggccgcgcgaggaaggggggggggggggaggagacctaccggagtatcagtgcatatcgccaccagccaaaaaagaaggaggggggagagtgagatagagtccagaatcgttaaagaaaagaaataggaggggtgggaaaggggcatgttacttggccattggccaatttaattattttactagtccn

SEQ ID NO: 63201 - DNA, 3134 bp, Oryza sativa
cccctataaacaggccagttttttttaatgttttcaatagagcagccgccggcgttttccggcctctttccggaatttttccccgtttacaagtagtcttaagctttccccgttaatggggggtcagttcctaaaccaaaagccgtaaaagctaaatgcttctttgtaagaagaattttttttatcctccccacaaattttaatttatggggggggcctcctttattagaaagcccatctattttttggggcatccttcttttatgggatacccattcataggtaataaaataattcttggtttgggttgagagagttgcccttatattaggaaaggatgaagaccttttgaaatataaatttctatttgaatagtctctcacttattataaatgtagttcctgttagaacttcttgcaactgtttttttttctatttcccttaatgaacgaatgctacgcgtcaaaaaaaaactaaatagatatataaagaaactaaataaatgctactacctgttctcatggataaatggtttgtatgtttcaatgcatcgtaaatgaagggcaattatgttatttgaattgttttcataactacccgtagtataagttgataattgaaatccatttaatactatatataaattttatgtggtaaaatagtgcatgatcccgaatcttaccttatgtaaattattgttgggaacaaaaataccatagcttagcatgcattataaaatagagttatatactgcagttttctttcatgcctctatctcagtctcaccgagctacatgaagagccactcttttatgtccccttcgccatgtctcggtgcactaccggtaacctcatcagctgtcctcgaagcttcaccatcatcatctttatgccacgttacctagttgtcatcatcctagttatgcgtcatctctaccttatcgttgtagcacgaaaggaggaggaggctgagctgctacggtgatagaagcgggaggtggcagcaatatgggcggctctggagctcgcatagagcaacaaaattgacagtctcatcccatttgaatcccttattgaggttgccctcgaggtaatcccagaaaggcaaggaacaagagaagaggtggagctcaaaggtccatttttaaggtcaggcttagagtgcaaagaagaatggcaaactaaggtaggcacggactcaggcatgaccaaggttcgttattatccctcttttcacatttgtttgttctcactatattgttcgcctgatgtgttgatgtgctgctgttcagactttgaacctacattttatcatctgtgagtgggttttgtttggctgtattttgtgaatttgtgatgcagtagttgcaacttgtatgcttgccgaacggattttgttgctatctgtttttttttcatttttcagaaatttcgcccgcaattttcaaatttgtattcaaattttttaaaaaaaattcgtccaaaatttccacaatatttctaaaatttctgaaattttagaatttcggtgaccccatacaaatcagtaaacccacaggtcgaaccctgcactccgggagggtatatataatcgcaaaattcctagtgaccaccgacgcgtaccgcacattttcggggcccacctaccagcagggcccttcaaccttgcccttcacgccctcaccacaaacccacgtgggccccacctgccggggacccaacccctccccctcccccttctatataaccttctcccttgcgcgatttcaacgacctctctctccccatctatcttctctccctctccgcccatttctcctctccacctgcgatccatccgcgcccgcgaggaggagggagccggacgccgccgcggggagagcaggggagagaaggagaggaggagatcgccgtcgccgtcgccgtcgccgtcgccgatctcggtaaccaccgcccccgcgaaattcccccgctggtcgtgttcgatctcgctggttttgagtggaattctgcgtctgcttccgatccgatcggttcggcagcagctggtttggtttgattttgatttgatcggtagatttgggtgtgtgtgtgtgtgtgcttgttttgtgcgatttttgggggtgggtttgtatgggttggggtgatctgaaggagatttgattggttaggttttctcgctagattcgataggtttggggggggggatttgaattgattcggggggaagtttgacccggtttgaccggctccgctcgatctagcttcgttcccacgcttggtgttgggaggaatctgggtgggcgcggggaatcgcttcggttggccgcgaatccgatccgatgccgcgctttctgcgtgcccttgctcgcagatctgcgggctgcgggcttcagatctcgcggatctagctgcggttgctttgattccgctcgtttttctatcgagaccctgtggatctacgggactgactttttttgtcttcatttcgttttcagagcgggagcggagatggggctcacgttcacgaagctgttcagccgcctcttcgccaagaaggagatgaggatcctcatggtcggtctcgatgcggccggtaaaaccaccatcctctacaagctcaagctcggcgagatcgtcaccactatccccaccatcggtgcgtttccaatccacatcctatgctgtgcacgtattgttacgatgtgttcagtaattcagcttatagtggtatggtagatgcacggtctccatttgtcccatcgcattaagttaggctgtgtgcgcataattaacattccagcttgcgttgctcagcaatagatcaaaggtcagaattaggtcctttttagtcagacaataattttttgggctggcttaatgataagaactgtttagcaatgggattagttttagctgatctcaaattgattatttggctcaagtgtgtttacactccacttcacgtataatggttactcctatatgctagggggacttaaataaattactgagatgtctccttcaatgtgtttcatcttactggatttaaaacctgaatactttctttaaaagtaagccaatgttgtagggatggagaattatattgtttttaggaaagttaaacactgtga

SEQ ID NO: 63202 - DNA, 3082 bp, Oryza sativa
  unsure (1)..(3082): unsure at all n locations
tgccccctaccccccgagggggttccaaccacattattggggggcagttgggtccgtttttcagaataccgcttaaggggagggaagagccgggtccctctggccccaccaataaataaggtgggggcagaaataaactaccaagctggggtgaacaacaaaagatcaaagctaaaattaggtctttttaagccaacaatatttttgggcggcttaaataaaagcattgttaccaagggattagtttagctgtcccaaattatatttgggctcagtggtgttacacccactcacgaaaaatgttacccctatgagcaagggggcttaaataaatacttgagatgtctcctccaatgtgtttcatctactgaatttaaaaacctgaaactctcttcagagtcaagcaatgttgtagaatggtagaattatatggtttaggaaagttaanacactgaaaaaacaatctgctagcatttacattgatcaaactttgttgtctatanctgcaggttttaatgtcgaaactgttgaggtcaagaacataagcttcaccgttggggatgttggtggtcaggacaaggtaagaaattgccttcgatcagctattatttttgaattatttttttggtgcatattatatagttaaccattgtcaattacctgttattaacatgcttgcataatcagaaaccacgcatgcaaactgcagtatatattaccttacactaagctctgatggatctgttttattgaattttatgaaaaaaaaaagaatttagatttggttaacttcctttgtcaaacatatcaatttatcatttcaattgtttatagcttcattctctcatctattttgtcttggcatgttcttgtgatctgatattttctgtgtgttttattaatacagatcaggcccctgtggaggcactatttccagaacacccagggcctcatttttgttgtggacagcaatgacagagagcgtgttgttgaggccagggatgagctccaccgtatgctgaatgaggtactatcaatatcagagttcaaagtattagtctacctttagactcttgttgggaaacaattcataaattgcatgtggtttgctatattctgttgttgagaatcataattcataaatacgtgtgatttgtaagattctttgcccatgattccctctttcccttttttcctctagccatcaggaagatctgccattggtaatatacgcataagatgtggttccaaagctatttgaaatttctaaagagcccaacatggatgaaacaacttatacatgctatcatgcttatcatgtgatgttctagaagctatagttttaatgttggcatgttgtggctacaggatgagctacgtgatgctgtgctgctggtgtttgcaaacaaacaagatcttcctaatgccatgaacgctgctgagatcaccgacaagcttggtctgcactccttgcgccagcggcactggtatggtttcctttcctcttaaaagtttatggcctgctcacacagggctttttagattgatcagcaatagtgtgtatttatatgctttcagcatactatgtgctgctcgcataatggtgctcctgtattctacttaagtactaaatccttgtcctaaaccaagtaaaaccattcatgcattagcaaattgtgaaccaagtaatagcattcagtgtgcattatccaactgtgttgacaatacccaatattagtgttttaaagttaaactttctatgcaatctgaattattcgtcttatgttctcataggtacatccagagcacatgtgctacctctggtgaggggttgtatgaggggcttgactggctttccaacaacattgccaacaaggtacgacaatggcatatttgctgctatagaacatccacagtagcgctttaaccgcgcgttatcatatcttacctaaaatgtttgtaggcaactaaccacctgccttttatatcctaaaaacaggcttgaagcatcttggccgggcttaaatgaaaggaagacatggcggatatccctgagtgaacgctgcctttttacgtatcgaaactatatagtcatgacagataatgatgtggatgttttgggaagataaagctctttaggttccaccaccaaaggagctagctatcagattgtttttcgtggggtgttaaaaaatcgtgcgtgtttcagtttggtttttaatcgaaaggcttacggtgcctgacttttgtacctctgtactcgccacagatgttgtagtattgacttgtcttgggcatagcgtattgttacgtaatcctgttctgtgcagccacccccaatatccttaccagtttattccccgttgccttcctggccagcattctgctgcctttcttcttggatggcacttcattccttttcagtagctttccgtatgtttatattgaagtaagcgcgttgtaacgtcagcctgaaaatgcaaaccgatcatttcctgtgggctgtaaggtttcttggaacaataagaatttacaggaaatggttttgatcttaatgaaatccgttggtcatatcaaatttcaaggaagccgtaggctgtgaatggcaacacaaacatttggaccaatactttctcgcacatttcccaattaaaggatggttttttaaaaattaattttactttcttcgtccataataacttgcggctttgaccttttcttcaaccggtggacattccgttnatttaaaaaattgtgccatttaaaaaaccagcactccttaaaataaattggttataaaacaggccttggcccaaattaattattatttctaaaaaaatttggttagaccaagggttaattttcctccctcgccccaaaaataacgcccttttaactttatattgggaacccagnggcttaatcatacttaaaaagctatttttgaaagcgggggggcaaaaaaaacttaacccccagtttattgggtgggggggttatataaaacagttacaaacacattatcttctttttttnaaaatatgtatatatatttaaaattcttcttcccccccacctcctg

SEQ ID NO: 63203 - DNA, 2737 bp, Oryza sativa
  unsure (1)..(2737): unsure at all n locations
gcggcttgnngtaacgatcnnnnnnnnnnnnnnnnnnnnnnnnnnnnnnnnnnnnctatacgtacgttctctatcttaaataggaagaatatatacgcaaacatctccatgtagtgcgatttctcccactacatccactccactaattaaggtgtgatttctcccactacatccacccactaattataaggtggcatatatagccacatgttaaggttttagaattcaaatgtcgatgtttgaacaaggatgagatgcacgagacaatactgatttttacaaacacctgcgtgcatcacggaccgtttaaccgtaggcgaagatcgatttcgatcgcttgatctgtagtagtgttcattcatagagtatatttcttaaaccgaaccttagaattgatagattaattgagtcagctcagaccgatcagtgaagtgcacaactcttttaaatcacaataagaaaatcccttaaaagtaataaggtagagctatattacgtggcgaaatcaaaaacattaattaggttgagttctttagttgatcgaggttaggaactaacatctcacgcacgtaaaatgaagtaatttattaacttatcactaattaagtattagctgaacttttatgaaaaatgaattaatatattttttaaacaacttttgtatataatttttttaaatacgtattatttagcaatttaaaaaacatacgcatgaaaaacgagagaagtaagtgaaaaacgtgaacaaataaactcaaccagagtattaagaacacgctctttgctccgtggctcgctcttaaaatgggttgtcaatagacacgctcgctaaacgacgtgcgttttccatcgtgcgtgtactgttgctccacaaaatcgatgaggtcaaaagaacgaaacagcttccattcacacgtgcgacccgagctagagtagttttaaaagctaacacgtgcgatcaaaaaagtcgtggactggaggcgtggccgtccgatccggagtgaagctgacagcgaattttctttttttagtgagccatgccacttgtcgccgtacgttcagttggtccacgggcactgtacaggctgtttagatttaaagtttagatccaaactttaatcatttttcattaaatcaatctatcatatacacataacttttcagtcacatcatctctaattttaaccaaaatttaaactttatactcagccaaacattaaatcgatctgaaagcaggagtagccgagtagtacggcaatagccgcaatatgcagacatgcatccactaaactcgaattcaaagacaagaaattttcttactgccacaaaaaacaatcatgatcaaagcacgtagtaataattaacctttctgggtaacgtaataatgctattagcagcagcactacccctctatctaaaaaatacaatcctaatcctagctacgaacttgaataactatctctcagtctaaaaaacaatcctagttacgaacttgaacatatatgtgcccaggttcgtagctataatttatttttctgggacggagtagtacgccagtaagagattagagtcaattttccttttaaaaaaagagattagggccaatttaaatagtaggaacaagaaaacgaattaataggaaaaacccattattctaacagaaatagaagtgtaaaacaaataatttaaaatacaggaaataccatgtgattgtaccgtaggaaaaaaatcatatgagaaagataaactcaaaggaaattttctaagagttttgagctcttgctaagttttctacaaaaatctctgtagaattatctattcaataggaaatttcaaaggattggatatgattcaatcctttgattcaaagccattctttgaaatcttttctataggataaaagttatcttaaaatttctatgtttttcctccaaatcaaaagggtccagtgtataaaatacataactgtcaacaattaaaagcgttacgtcatattacaggtgaccaagagatcatacatataatagttggctatcgacacaatttccaatagattgatcatactttttttaatttaactttcacacgcagatgcttattatactacacataaccccccaatcatgtttttagagcaggtacaatagcagattataaactagctataaacacatattaaggagatgaaagaagagagataagcagcgagctataaatttatagccagctacagcatggactccaaaacgcaatatgtgtatgacatgtgagaccaaatattaataatatagtatatatttatagataactattatatgaattagctattaaattgactatatcagataattttgagtcagtagttagctatactattaaacttgcttttaaatgtgtttggaaccgacgccaaatcaatcacctgcgcacatatggctcatcactttttcttgcatgcatgcattaccgccagattaaactgtatattagagcaagtttaatagtattaatagtatagccgattatgggctccaaatcatatatagttaatttaatagtcaattcataccatagttatctttaagtatgtgctacataattaatgtctgatcccacctatcatacacacatgtatcttggagtccatgctgcagctggctacaaatctgtannnnnnnnnnnnnnnnnnnnnnnnnnnnnnnnnnnnnnnnngttgtacaacaatcaangccatgcg

SEQ ID NO: 63204 - DNA, 2511 bp, Oryza sativa
  unsure (1)..(2511): unsure at all n locations
ccggttgaattgatatatcnnnnnnnnnnnnnnnnnnnnnnnnnnnnnnnnnnnnnnnnntttctagtataatgaatttaaacaggcttttaaccagatttattgtaatagaaaacattacatctaatcctagattggtttttataggactctttcctccttcagtcccaaaataagtgcacttttacactgttcatgtccaacgtttaaccgtttatcttatttgaaatttttttatgagtattacttttattgttattagatgataaaacatgaataatactctaagcatgactatttgtttttaatttttcataattttttaaataagatagacggtcaaacgttagacacgaatacccacgactgcacttattttaacgttgtagatgacagtccgacagtgacatggttcatatgattccctcagcagactattagaagctttgattagcctttgccaatggctgctctcgcttggatttaagctcctggcactggccactatagcccactagccacatagtactatggagtatggacctgcttgaaagctgtagattccaagggcccgttcgaacgagcattttggctcagctaactggcggcacttataataaaataatctattaatgcataattaatcggttcctataaacttaaaaatagaattatttgattttagaaaagccttttgtgtagaaaacttttacatgaaacacaacgtttagtaattctggaagtgtgttcacgaagaagaacgagtaagttgccattgtaaattgctctctagaacttagcatacaaagtataaagtgagtagtagctagctggtgagaatctaaaaagggtgaaggttttaatttctgatttttagtttatttcctaaagtgtatagcttttattctcgtaatatatacttctacatgaaaaagattgactacccggtaccgagcaacttgtcatgtgattgactttatgatcaatgtcctgatgtgcagtactatctccaagattggaagatgacgagccaaatgacgcagtttttgcatcgaagcgttgaaaccggttgtcaaattaaagtattttttttcttcagattaaagtatatctgcaaattctttaagctgcattattttgacttgggagcaaccaagccaagaccacggaaacaagagtgacatgggcaacaaagtcgataatgtacctagactgagttcttttcatcaaccccaaaccgtaattttttagcatgtttctcaaacgattaaatgatatgttttgtaaaaaaaaattgtatatagaagtaactaaattaatttttcaagtttgtaataactaatacctattaatcatgcgccaatggtttatcttacgttcgtgaaaaagtgcagccgaaaatctaccactagctacttagaaaagaacgcacccttatattaaagtataagtgaattgtttgtcttttttatgagctaagtttttatagtttatattgaactggatgatacatacaactcagtataacttctctttgccccaacacccaaaaaagtttcataatctgtggcactgtctgtgggcctcatcgtttggcttttttcgtaataagccaaaacggcttattagagaataaaaatgaatttgtaggtaaaacttttatatatgtgttctcggtgacgtaaaagccaatgctgaaaaagaaactacgttgaaaatatcacaaaatcaatgttaaaattaagtttgaaaatttaaattttgcctttttctttggctgaataggccatccgatggaagccattgttgtaaaacatggtactcctagcagatattcggttgaagcaatgccaacatgtcatcaagtacaatatcttatcctctttgtaaaaaaaattataatcctaacttcgaatctagatatatacatatagaggtttgtagctagaatttgttttttttaaggcagatcttagtagcttccaaagccgtcatgcattggttaagccttaactaagcctaacgacatatgtcaatcacgatcataacttgactgagagaatgttgttgcttcaaggagtaactaacagtgcgtgaataaatcctgtaccactcgagaaaaccaatcattgattgctttaagtatatccattcgtgccagcgttaattaggacaagaaataggttgtattacaggttgtcgtcatgaagctgaggcaacaaagaatgaagaaaataagtctaaacgaagtaaaatcacatgtacatccaggttatactatataagctgggctgggatttggttattacagaatgtctacacttggagtaggtgatcaatgagtattttacctagaaacatatgtgacggtctagttttaaaattgatggtccttaatactttttttactttctttcttttaaactggttcatgtgtgtcttggttgtgtacatccggggatcctctaaagtcgncctgcnggcatacagtatagcaatacaatggcgcag

SEQ ID NO: 63205 - DNA, 1972 bp, Oryza sativa
  unsure (1)..(1972): unsure at all n locations
ctcttccctccacaaggttttggcaaaaactaagcacactttacgttaaaaatcttcaaaataggcccaaaatcttaccaaccagcggtgcaccaaaagctggctggagtacaaataatcgggcaaggagggccattctagatttaaaattgtctccaaacttgttttttccgtggggcatacctcaaggctcaaggaaatcgcgagttaaaggccgggcagtataaagacttccaaaaaaattatatttcgcgggcggcaccnttaggtcactcacttagggttttatagtgaaaaggatggaattccaattcctaatatcttccaattcacaatttcatgatgcaattccgccataccaaattttaaaaagttttgacaaattcacaatgcaattccaccagggacgtcatcatggacatccaaaggtgggagtcgtcctcttcagcgtcttcttttggaagaagcaaacgcaacacaccatcattggtgtgacgaggaaggcaaaagaccgcccacgacgaggtatgcataatttttggtcacaactatataggtcatgagttggcggtgccatataggtattttttaaaggcatagaggagaggaagaggtgactaataaatgtggataaagtaataccttgatataccagttgataattttatactaacacaatcaaatggcttaggactacccattatgtgtatctggttaaatgtgaacactactaaaaagacacatgcaggttttaaaaaaacagtattacccaaccgaggaggtggaggtgggcgacaaggcgatgctgctcctcttggaggcggaggcgagcgattccccctcccccttcccctctcggtgcaagacgacatcagtggcgtcgacagcggggtagggcagtgtcagcggctgttcccgtggcagcggacggggttgataatttgaaactaacatgatcaaatgggttaggattgttaataactgtagccaattaaaggtggagagaatgggtagagattaataacgaatgcagataagtaactccttgatctaacatttgataatttcatactaacataatcaaatggcttaggattgttcatgacatggcttcgtgcatgtgcttatattcgtcacaactatataggtcatgaggaggtgttactctacaggttttattgaaggtagagaggagaggaagggacgaataaggaatgcagataagtaactccttgatcacgattgattgttttatactgacatgataaattgacttagcataatcatgatgtatatttgttaaaggtggagaatagggatagagatgactaatgagtacgggtaagtaactcattaatcaaatgggttgatgtttcagactaacataatcaaatggcttangataagaaatgggctagtaatacagacatgcanactcattatcccatgggttgataattcatactagcataatcaaaatagttttgattcactcatgaagtaaatctaattaaatgtggagagaaggggcttgaaatactaaaaaataattgaggataaggctacttctttggccaanggnntgataaatttatactcatcaaatgacatagtttgacctactgatgggtatttatattaaggccttagaagagggggttgggttcctcatagaatgaggaataagtacctcctggtccaacaggtgagtgttttgacctaagtatatccactggcttaggttaagaaaccaacaatatagtccgaacctcttgtttcccacacattatgtgtctaacacgacacaatgttaagattacctcacctccacacactggggggggggggcagaagaccttaagagacaaaaataccccttaaaccactggtttatttgttaacaaaaaagagggcccccctcagaaagagtttctcccaagaccctctgttaaactattttttccaacacaag

SEQ ID NO: 63206 - DNA, 4344 bp, Oryza sativa
  unsure (1)..(4344): unsure at all n locations
cccgggacaaaaacatgtgtgcttcccccccgttcaaataaagtggggggttcccaaaaaggggggagcccaaataacttttcccgagaattttgtgtcaataaggcccgggataggtgccgccctttcaaccctccattggtttacgccgggccccactggccgtgggttaaaagccctcgcggtcaccttggtggttccccaacttccccaggaagggggggtttcgatgtgggggcctcaggtttgcctaacaacgggttcttggaaggccgccgtggtaaagttcaatgnggcgggtcccttcagctcattctcaatatgaaatatgtgggcccccggtggcgcccatcccggtccaatgggcacctaaaatcgcggttgtctgtaatgaacaggcggcaagcccccttgcgggggggtcaaagccggggtggtcgagaaaaggttaagcatctccgtccgggcgcccacaagaaacggaatggtcacgttcnccaaggccccggtccagaaggtttgccttggggaatggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgagaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagagtcgcatggctagggaggatgaggaaaaaactgcattcattacccccataggaacttattgttatacgacaatgcctttcgggttaaagaatgcaggtcctacttttcaacgtactactcgaatttctttgagtagccagataggacgcaatgttgaggcctatgttgatgacttggttgtgaagtcgcgcaaccaagataccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgccccaccagcaagcttagggatgtgcagtgcatcaccggctgcatggccgccctaagtcggttcatatcgaggctgggagagaaggcactacccttatttaagctcctcaaacgctccgggccgtttacctggacggaggaggctgagcgggccttcactcagttgaaggcgtacatcagttctcccccggtcctggtcgccccgaagccagatgagccgttgctactctacctggcggcaaccccgcaggtggtcagcgcggcattggtcgtggagcgcgacgaggacaaccctcactccgcgcatccccaccctgtatcggctcgacccgggagagagcagggaggagaggcccccgagccaaacggcggcccaaggcccccgacggccggagctggccctccacctgcttgtccgacggtgccaggcacccccgacccccaggatggccccagggccactgcgggaaggccgcgcctgtcgccctctgaccccgaggtcgtcggcacagaagccgagtgcgccccgcgtggcctctcagacgaagagcgccctggagatgcggcccctggcgaagaggatcggccccgccgaaaggtgcagcggcccatctacttcgttagtgaggccctccgggacgccaagacccgataccctcaggcccagaagatgctttacgctattctgatggcttcgaggaagttgcgccattatttccaggcgcatcgggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgggtgatgcagttcgacggttccctgtctcttcagggcgcctgtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccagtgctctgacccgcagatggacgcttacgtgcgccaggtacggcgtatggagcgccatttcgacgggatagagctttggcacatgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccacggcccgtcggagtccaagcctcgggacccgaggggagcgctcccagctcccctagattgattgcttggatcactgagatccaggcgtacctcgcagatgagactctacccgaggaccgcgaaaggagtgaacgcgtccggcgcatctccaagcgctacgtgctggtggaagggaccctctatcggcgcgcggctaacggagtcctcctgaagtgcattcctcgggaacaaggcgtcgagcttcttgccgatgtccatgaaggcgagtgcggagcccactccgcctcacgcactttggttggcaaggcctttcgccagggtttctattggccgacggctctcagcgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgttgctgtcgacaagttcactaagtggcccgaggcttatccggtcatcaagatcgataagcactccgcgcttaaattcatcaggggcatcactgctcggtttggggtgcctaccggtatcattacggataccggcacccagttcactagtgagcttttcggtgactactgcgaacacatgggcatcaagctttgcttcgcctcccccgcccaccccagaagcaatggccaagtggagcgcgccaacgcggaaatcctcaagggcctcaaaaccaagaccttcaacatcctcaagaagcacggcgactcgtggatcgaggaactgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagattagcttcgtcgagacgacctcgactatctggaagagcgaaggcggcgcgcggccctccgagccgcgcgctaccagcagagcctgcggcgctaccatcagcgccacgtccggacccgatcactctgcgttgacgacctcgtcctacgccgcgtccaaacgcgtgctggactagcaagctctcaccaatgtgggagggtccgtatcgagtgatcggcgtcccccggccgggctccgttcggctggccacgggcgacggcacagagctgcctaacccgtggaacatcgagcaccttcgtcgcttctacccctagtgggggtcgggtgtcatgtctcaggctcgggccaaccccgcacccccccgggcgtgcagggttggccgggggctaccacatgcatatacttaccttttttctcttccgtatttcaataaaagcatttttgatttcctgaggactgtgtttgtgccatcgtttnnnnnnnnnnnnnnnnnnnnnnnnnnnnnnnnnggtgttcatcaagcaantccaagnacatcg

SEQ ID NO: 63207 - DNA, 1406 bp, Oryza sativa
  unsure (1)..(1406): unsure at all n locations
ccgtccttgagatcggaacaccnnnnnnnnnnnnnnnnnnnnnnnnnnnnnnnnnatgcatgtctgccttatattatgaaataactttaaataaaagaacggtgtgccttgttttattgaatggagtattgaagttctacggggacatggaattaaggaagagactattcaattattggttttcataacccaaacagtttttttctctatcatgattttgaacaaagcccaaattttttttaatttcaaacaaaaacaagctggagtactagtaaaataaattaaatgggccaatgaccaaatgacatgccccattttcacccctcctattttctctttttcacgcatctcgacttcatctcactcttcccccttccttctttctcgctcgctgcgatctgcactggtactacggtaggtcttctcctccccccccccctttctcgagcggccgggggcaaccgccgtgaaaagccccgccggggggcgctgaacccctacggctttttccggggcgcgggccccgcaggccggccacggtgtcggggcaaaatgaaaccaatcgaatcccaaaggatttctctttggctttttttcttcccggggcccgtttggattgaaggctcggggtcgccgaagatagggaaatctgttcccgggttgggattgggttggggtaggaattttcttttcccttcccaattaacccccccgtccaagttgtgtctataaattttgggaagccgcttggacctgagggaaggtaagtttttggacaaagaaaaaactgtggggttaatttgaaaccctaatggcccccaggtttagggcaaacctccctctggttatcgccggttgctttaaggttaacttggaaaaggggttgggtggggaactctctccgggcttgagatttgcgtcaaattggaaaacccccatttcattgaatttatggacaatggttcttccattctttaagataatagccacgccgccccacgttggaaaaagaacccgaattcttgttttttcgccaacacgggccccatttcttagtgttgtgaaagcacaaggggcccttttatgggctctaccattcaatgaggttcaaaacaccattgggggggaccgtctcttatataaaacacctgatagacgtgtataaaaacggtgttctggaggggcgccaacctctttgaagggggggggtggggtggcgggtatatatggcactacatataacacacaccctcgtgtggttttaccccncacggagagaatatacaaacacntctcccgctccttacaataaaaaacacgggtggagagtggtgggagagctctcctctctctctccacaaaaagatgtttctgaatagtatgtcccccggtgaggacatacaaan

SEQ ID NO: 63208 - DNA, 1214 bp, Oryza sativa
  unsure (1)..(1214): unsure at all n locations
cgatgtcngtganngatcagatccgcnnnnnnnnnnnnnnnnnnnnnnnnnnnnnnnntatgacgaataagagtggcattattttgatatgccatatttgcacttttgcagtggcatggatccaattaaccaaggcccaaaccctacccggccgtctccccatctcctccccaccgcgccccgcaccggcggcggggacctgtctccgccgttcgtcctccccacgatgccgtcgtccgctctccccccgccgccacctttcgcccttcccctgccgccttcgtgcgccatcccaccgccgccgccgtcgacgacgacccttctcccctccctctccctcctgcccgtcggagctcggcgccccctcccccttgtactctctcccttgtggcggcgtctgtgcctgcggcggtgtcggagtcggcgccggttcacccctattctcactcatctcgttgcgtagttcgacccggcgctagccttccttcctcttcagatctggagcaacaccggtggtgacggcggctaagaaagaggtgttacgggccggacgagtaggacaagcggtggggagtgggacatgggacgggcagatggcccggtgcctccttacccttcatatccccctaccttgggagagagacgggcgtagtgcatcctttccctattctattccagatactagacggatggtgattcttccggtctcacatattcacaacggcggcctttccctgcgggttcctcaaactgtgcgcttcgacttactttgaaacagtttctttttctactttcaagtttacggtaacaaccgcttctcccttttcaatattgggggtgatacccctggttgtgccccattcttctatggttcgggggttaacgttatgacttaacattcttgttaccaccggaaaaattttacatttatcaacaattttttaggcggcgcctttacccttcaaaagggggtgtttggcaaactaattacgcaggggttttattgcctctaaacggggggacaaatttgtgacaccaccacagggcccgcccatttccccatgggttaaattgaccggcctggcccgctaaaaattctttattttccgggaaaccttttaaacaaggatttttttttttagggaaagtggggttcccccgcgaaaaaaaaaaaaatcccggtattagccctaagtatccaaaaaaaatacctc

SEQ ID NO: 63209 - DNA, 1248 bp, Oryza sativa
  unsure (1)..(1248): unsure at all n locations
ngtcttgggccaagtgttcaattcaaccgcgcccccccgggcagggggccgccttttagaaatatgcctcgaacgaaacccctttgtttggggggcaaaatatcggcgggcttatataaggggggtcgcgccccccaatttttttgggtgagggttttaagagaatggggaacacgcgggtttcggcccctttttcgggccttccctataaaaaaatgaaccggggggggcagcccaaaaggcctgggtgcggaggcccgcccccggggcctaggcattttgcccgttaatgacaagttggccatgtattcaagcaaggtcgggttgaagtctctgtatcgggacaaccggcagtttaacccagaagggcancccagcttggagcgcgccttggggcgtgccgccatcccggtaaagaaggcagcgacgcgcccggtctgccngtcttcccccgtcgccccgggcggggaagtcacggatcctccgacttcncgaagggcctccccccgcccaagatttcgccaaaagggggacggtggggtgcgagcccgacggcgcgggttctgctccccgtcgtcaccgctagcgttcggagagaggctgtgcgccactgcccgtccggccattgggctgagcgggagaagcttggcgcacacgaaagaggacgagggcttagaaagacacgcgcaccccctacctggcgcgccagatgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgtgtgaaggaatacagagagccggagagcgagagagagttcaggctctagaaccccttcgccagagtcccaacccctctttctcttttttctctttttttcccctcctaggcctgggcctccttttgatctggtcaggggtcaccacatgggcctctagctgtctaagaaaggaaacatgctttttacaatgagggctagtctacagccggaagtgacctctgacaagcagagcacacgcctcctgccccgcttgccagctttcccggtggacgcccattnnnnnnnnnnnnnnnnnnnnnnnnnnnnnnnnnggtggtagatcacgcaatcaaacccgc

SEQ ID NO: 63210 - DNA, 1433 bp, Oryza sativa
  unsure (1)..(1433): unsure at all n locations
gtgacgtgtttattgttattctgtactacgannggannnntcctgttccaccctccctgaggntnctcactatccatatnntattttcctccccccccccccccccgtgggttgannccnnctttgaaatctcncttncaannnccgnacccaatgaatagggctagatccttattaaccctaatttagtctattttctatttaaatctcgccctataaattctaacttttgcacaaatcaagtttactcaatatttgtgttgctctaaccaaaagattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcttcccggttcctagaaaaacgaacaggaaggctcccgccggaacctgacagtagacgcccaatcctcccccccgagggggaaaagcggagagcgaccccggggccatcacgtactaagccggcatatagaagaagtataactaccagcccgccacagcgacaccgtgtacgatattggaataccccccagtcggaataaatcgccgcgttcgagcggaatgtcggccaccataaaggcaagggcacaccacgcgaagaacgagtaatacaaacgctatcccgtaggtcaaatgggagcgacaacgtccatacgaggtctgcctcacgatacggtacccggtgattcccttgggagggtgcggcgactattgccaccgaacccggcggcaataaagaaggggtgaggcgtggccgccaccaagggggtggggcaaaaacccacgtccgaaccccccgtgggccttaatgtaacaatactgttgggtctcaccccgggaacagcaactatagcgcccggcccaggccattggtaccaggttctcaagacggggtgttggcgggctcaccaatccttgagaggggcggtaacccgggcactaagaaaacacattgggaattgcctctgtataacacctcctattaaaaaaaagagagaatttgtaatgaacacaaaacatgtggagtggcggtttttgttgcaaggctataatgcgccaaaaaaagagttcagaaatctgtgttctctggggggggcgccgggggcacaacactctggggggtgtgcgatagtataaaagagagtcgccattattctcttaagagagagttaatctcggagctgtgtggcg

SEQ ID NO: 63211 - DNA, 2030 bp, Oryza sativa
  unsure (1)..(2030): unsure at all n locations
cgtccaccgggatatatttttccgggtgccaacaatttcctaaagcacggtgtgttaaggggtttgcccaccctctttgacaccttcccacttatatcccaggtgtgcttaaaagccctcttcaaaggaaaggggcagttcgtaagcagtgtgacacaaacgcacagatttccggggaacccgggtttttaaatccgggggtttgccacttaatttgaggtaattttgtattctgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcaaccgatacaccgtctccaatggtcgccgcgaacttgtggtgcgcgtcaacccggccacgagggcactcgtcctgcaagcaatcgaagaacaagcaagaacaagtaggacaagcgctgagattgctagataaagatgaaagtttcactatcaaacacaatatggtggggttccgattacaggcagacgggcggtttagccaacacgcgcgctgcgagccggtagcaagaagctatctctatcatcaaaacctgcctgttcttggcggcgactagaggtataaaaagaggggaagaacgaccatagggtcgtgctccaaccctaggacgcgcccctaatgggcccaacatggatacacagcccattgggccaaaagaggtgacgcagcaccatggacaaaaaatagtcgggagtaaaatgacaattgcggccgctccagaacagatatggacatgtggctggatccatttgaaaatagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgaacgtgggtaataggaccatcatgctgtatatggggggacgtggatgtatcgatggtgttgatgtcctcatcagtttcggcggctgagggggttttgtttccccgatctcgaggcttggccgtccgatcaaaaccctagagatcggacggacagcgtcgaccgggccgatttcggcccgaaatgggatcgagagcgaggccacttttccggcccaagccaaggttgcggcctggggaggggaagtgcacccgcgcatgcgcaaaaggccgtgggccgaccggcaagggtctggaagaagtctattttaggtccctctagccgaagaaaaagagaagtagttcatttttagtgcttctttttttagaagcatttacaattatagttattgaatgtgtttatttcgaatcaaacctaaaagaaaggattttctttctttttccaattaaacaatttgttaaatgatgtttgtattattaaaattagcaattaagttatgaaaattccaataaaattctaaagagtgtgggggatcctctagagtcgacctgcnggcntgcgcgtatgaagtgtgcatcaacgt

SEQ ID NO: 63212 - DNA, 2591 bp, Oryza sativa
  unsure (1)..(2591): unsure at all n locations
aatttttcccggccccggattttttaaccaacctttaaaccaatttcgagattgtttaaaaaacattttttatggacctccggtgaacgcgacttttcgagtatattattatctcaaaatagaagtgttggtcaactcttcaataatcaattatatattttaggtaacatcaaacctaatcttttcttgttggcgggagtataacctgaaattaacgggccacaaataatttccgggtatccttatagcgcctacgtctcggatatgaagcgtggnaatatttttctgattatagcgcttataagaaaccttatagatagtataaaccccactcttctctcccacgttccaccgccagngacggtcngcaaggctcatttccgacgatgcagaagcgcttcgatcttgccggccgcggcgcaaggggcattctnccnccgcccgtcggcgcangggcatcgcggggcctcngacgcggccctcctgacgtccatatcgccggcacaggcgcatcggcggaccggtcgaagcccgcgctgtcgcctcctgaccgacagatcgaggtccgaccgccggcgtcngacgtctcatcggtgtgccggcacaggcgcatcgacggaacggtcggagcccgcgccgtcgcctcctgaccgacatggtaaaataacattatggccttgtttgtgatgcaagcatgacacaatttctcattgttagttgataaagggattgaattgaggcgctataaatgttaatttcaatgttcaatgatatacgacttaattaactagttttgtggtatgaataggatagatagtcccattttgtatgttttgttaatcttatttatatatttttgtttatataggtggtcttaacactccagaaaattgtgctataattcaaggtagagctaacagaaattgtgctataattcaaagtagagctaacagaagggatgatattctagacgagatggaagttgctgctttagcttctagaatcaattggacaggtatgcattttatattgatgaaattctggatgagatggaagttgctgctttatcttgtagaattaattggacaggtatgcattttatattgatgaaatctgaactaattataaatttacatttcattattttttttgtttatttagagtatcagttagcttcaattgaagctgctgcgattggtaacataattagggatggaaaggtcattgaaattgctccaaactcgaaaggaggacctctacaggatgtgctgagaagtttgcttgaaaagtaagtgtatttactaaacttgtttcatacatatttaacagaataacaaatttgtagtgctttttagctgatttttttctgcagttatatgatcactattcgttggtcacagattgcaatgttgttgatgtgttatccactaacaattgtgcttttgctcatatttatgtcctcagaaatgaattgatgataaataaactgtgtgatgaggatgctccactggaaagtaccgcttcaaggtagttatttttagatctactgcatctcatttgatttcgtgatgttttaaacatcagcatttgatgcaattctccttagatataggagatcctttactgactattttgtgatgatttaaacatctagtgtcattttgtagctcttcctttaaatttttctctcaccgctgtgcaggccgctctcaggcttctttttcaacacattatgtaaggagcctgggtatctcgcatttgacaccatacgctgcggcaagcttctttaccctgagtcacgctttgctgcattaccagagcccgtatctttccttgcatccacgcgtggccttgtctgcgtctgtggaaagacaacaggcttgtactatgtaaccaacacgaccaccttcaagtgggttcagctaccacgccacagttgtgatcatggagaaccagcagttgtcatcacattcgangaacccctgacattctgcttcgacggtgctgntgagcattatcatgtcgtcgctgcctttcaccctcagggcagcgtctggacatctgagtcatacctcttcaagactggngaggtggactatngctaaagatgccccttcttgtttggaagtgaaggccgagtctggtgttggtacacttggcttggccttcttgccgcacttcccttgggtctattcttttgtatgaccccnggaaggacctcctaaagtcattcttgcccctcagatgggaaccaagatacggatggtagcttggggcaattgaaggaggacttactgggacttgttcaaggatgttgaccggttcttaacatggcccggctaaaataaccaaccacggttgtgtaaagggtgtgtcctttggaaattggggttattttcgggggagaggtggaaaaggtattttgttcctccaaggcccccaagattttttgggaactttgggagccgtttccagggccttaggcctttatggaatttggcccacacaaagagggccccgctttttttctctcccccccggttttggggggccctccagaaacacagtgtgtttcacttttttttaaaacc

SEQ ID NO: 63213 - DNA, 895 bp, Oryza sativa
accggcgaaccgtacctgcaggtgcagaccaacctctacgtacattatattgacggcatcggcaaccgggagcaagaccggttcgaccccaccgcccaccggcgacttctgcacctctggtacggtcgtcttcctcatcggcgtctacgagaacaagaacgacactgcgcctcgatcttgatcttatcgtgcgcgcgtcgatcgagttccatacccagacacattaactaccacgccggtcggatctggcggccccgacgccttgtaactcactatacccatgcaagatcaaactcgactcaaaccgactggcaccaaaacaaaaatactctgccttgtgaacagcccccacaccaccatgaagctccacatgggggcatggcgctacccatatatacacactgcacgcgccctggcatcctcggttggtgaggacagggaatagaggcaagcgaggagagaggaatatccacgctgatttaccacgggttgaacgaaactggcaaccatattatcttgagatgaaagtagatatctctttacaagtccaaggacggtcatatattcacaaatgctactgggcgggcgagcgatcgattctccacccccccccccctctggaattcgttattagcaccgcataacttccctattgtaataaaattatgtatctaaagcttataccacctaggttgacacatctaaagtttgagaccaaaagtttataagtcaaaagtttatatatccgattcaaatttgaatttgaattcaaatatttttcatatatagtatttctatacatctaagggttatacacctaaagtttatatatccaaagtttataagtcaaaagtttacatagccgatttcaaatttgaatttgaattcaaatttg

SEQ ID NO: 63214 - DNA, 729 bp, Oryza sativa
  unsure (1)..(729): unsure at all n locations
tcaccatcaataaaaatcaatgcgtaaactagtcctttacattttggaactaggctctattgctaaatcctttcaatctaaactactgaataatcacacaaataagtatcttctattttactttgaaaaaagatgagaaatcataaactaaatttgtaatcatgtttcttgctaatgtttttttagaagtaacattgtaagtacagccatacaacaacaggaatgagaggagggggtgtggggatggttcggatagggggtngctgngcctctgccctcctcctccatcgctgctcgccgcggccaggcttgggagcagcggatatgccgccgacggcgctcccgggcctagggcggccagatcacgtggcggcggtccccaggtggctcggagatggcgtgcggctgcgtcgacggcttgcagcggcggccccggggtggctaggcgacggcgtgccacagcgtcgacggcttgcgcagcgccagccttctccgccgcggcaggcctagtacggctcggtggcagcggtgcagcgacgacggcagaggcgtcagctgcgtcattcgtgagcctgagttcttgagcaccgaggtaatggtcagcctgctcccctttgatcgggtctcatccttcgcgagcctaagatcttgagcatagaggaatgaacagcagcagtacttggtttggctggatcgagagcagatcttggaattgcatgatttgtagag

SEQ ID NO: 63215 - DNA, 1089 bp, Oryza sativa
  unsure (1)..(1089): unsure at all n locations
cataaattaaaaaaagtgtgaggatgccccccaccaaagagggggggaaaaacaaacaaaaaaaaaaaaacttataaaaggggggtttttccggcgaagtaaacaggtccagtaggaacaggttttttttcattaaagtttaaccaaaaacatttttcccttttaaaaattacggaaagtagtaaccacacgctttgtgggaagattcgccctcacaaaaggcgatgaaaataatgtgtaatccggctgttcgctatcgggagaagaccgtaaacgaattttgcaggcgagatccatgcacgccttcgggtaggcctattttaaactgtccaggggaccgcctgcaaatgggcggcgagggagggcatggaattttgcaggcggcccccttgccgccctccgctagggcgattttgtactgtgggggggggccgcctgcaaatgggcggcgagggggcatggaattttgcaggcggcccccttgccgccctaggggagggcgattttatactgtgctctatatttttgtataaatatcaatagttatcaaatctttttatattgaaaactatacaagattaaaatctccaagactggtaaaatataattttattattttttagggcatatttggattgttaccgtacaaatattttgttagcgccaaaatataagcaagttttggcactaccaaatatttggtaagggaaaattgcatttgatcatatttggcttgctgccaaaatgtaaaattgtagtgaagaatgttctacataatctcaaatctagattacgtattaccaatgaataggcttccattttcgagtgtggagtgctactgggaaagaagatataaagaggttgcctttagattgtaaattatatagcggtcgttttcactggcatatatgtgaacttaatgagatacattattcattaaatgtgacaagacgaacacgcgggggcgggaattactttattgtaacaaggcggcgccccaaaggttggaattagggtgggagaatccccaaacctttttttttcaaaagacccttttgttccccccccgccccctttttttttttttan

SEQ ID NO: 63216 - DNA, 3866 bp, Oryza sativa
  unsure (1)..(3866): unsure at all n locations
cctcggagctcctcaagctgagagaacctagtactcggtgtggtgtccccgtgcaagttgtgtcgtanactggctagtagaccagtctaccggcgtgagacgaaaaggcccagttacgaagttcccgactgcaaatcatgctggacaaggcccatcagtttcgtacgagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgcttgaaggcaaacgaggtcctgcgaggatggaacatcaagttacgacggggtgatgttttcgtagaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtatgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtacgagccaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaaaagaggtaaattatatggctcgatgaagtaatccgcctaaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcccaaggacgaaagtcctagcggtgctctcgcagcgatggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcagcatagggcagccagcgatgatcgctcccgcgtcagtcttcgtgcacgcctcacaaagggcacggtacgtggctgctagcacggcagaaccccagctccactgcggcacgtcctgtggctgagcatccgcgatggaccgtgcgtagtggaccagccgaaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcaatgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcataccaaggaacgtgacgggggtcgacacgcaaccactcgcgccacgtgcgtggacggaaggtgccgagctgtgcaccctcgactgctgacaggaacgagcggtggttcctgtcaatcccacggttcaacagcgccggtgtgtcgtacgccatacttgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacaacattttatttcctaaatcgaaagcattgtgacactatggaatcgcctgctgcgcgacgacgacttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatatataacacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacggaccaattttcttgtatcgatccctaaagtacgcttgcgtgccgggaaggatgaattcaacaatagcaaccaatggaagtacccccgaaactttccccttccgggcccaatttttttttaacccccccccccccaaaa

SEQ ID NO: 63217 - DNA, 2519 bp, Oryza sativa
  unsure (1)..(2519): unsure at all n locations
tgtccaacgaagtaagtcactcagttaccgggaaaagatcaccattaagcgacctgcccttttcccgggggggtggcggattttattaaccaaggtggttggcaggtctttccgattgccaaatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggagtggggaagggtggttagggataagattgggtgaaagttaactgaggagtaattggtgtggaaagtagtactctaaaagtccttatattttgggacaaactttgaaccccaaaagtccttatattttgaggcacaaggactgagggagtaactagtactagcataagtaaattttgggcacaaatgctaaaacctcggcacctgatgccccatctctggtttttttagatgattgtcgtaacagaggtttttttaatataaaagttcatacagtaacactccgtattaataaatactataatcatcagatgtcctgacatctgatctcttctttcacccgcagaaagatgcatcaagtttcttatagggttaaagttaaactaatacctacttttctattcaccttttacagagtttatctctaacgccgtatacctttttccctctatcttaatgaaatgatatggagatctcctgcatgttctaaaaaaaactaatacccacctttctatccatcagtttttccttctttttttttctataacatgttctattttagcctcaaacatttctatgtatttgactattgcaacattgttcttcaactgttgcaaaaatggctgttttgcagattgaagatggaagttctacagaagtgtaacggtgttcctttcattgcggccagcttaggccatagattacaccagaaggataaaagtaagtgggttgctattctgcaagaggaaatttgtgatgccaatcccaattatttcattcgggcccgtcaactgagctatgcacagttacactcccatctcaagccttgttttgcttactgctcaattattccacgggaattccagtttgaggagtggcttatcaagcattggatggctcagggcttcattcagtctaagcctgatgctgtagccactgggagttcttactttagaactttatttgaacagtcgtttttccagagagaactggttcaccatagtggggaacgacaccgttatagcatgtcccgaatgatgcatgagctcgctttgcacgtctcaactgatgaatgctatatcttggggagtcctggcgaagttccagagaaggtccggcatttaacagtattactcgacgagtttgccagccaaaacatgttcgagacaatttcccaatgtaagcatttacatacacttctagtcactggtggcaacgcaggttatgaactgagtatccccaaaaatttactcaatagtacattaaaaaagcttcgacttctagaattggataacattgagatcaccaagctacctaaatcaattggaaatttgatacacctccgctgtctcatgctccaaggatccaagataagaaagctgcctgaatcaatatgcagcctgtacaatcttcaaactctgtgcctaaggaactgctatgatcttgagaagttgccacgcagaataaagtatcttcacaagctaaggcatatcgatctgcatctggatgatccttcccctgatatccatggattgaaggatatgcctgtggatataggattgttgactgatcttcagacactgtcaaggtttgtcacaagcaagaggaacattcttgacaaccacagcaatattaaggagctagataaattggacaatctctgcggggaactactcatttcaaatctgcatgttgttaaggatgcgcaagaagctgcacaggcacatttggcttccaaacaatttctccaaaagatggagctctcatggaaaggcaacaacaaacaagctgaacaaattttggagcaactgaaaccaccctccggaataaaagagcttaccatttcaggttataccggcatatcgtgtcctatctggcttggttctgaaagctacacgaatctagtcactttgtcactctatcatttcaagagctgcaccgttgttccttccctttggctattacctcttttggaaaatctccacatcaagggatgggatgcattggttaaattttgtggtagcagttctgccaatttccaagctctgaagaagctacatttcgagaggatggacagtttaaagnnnnnnnnnnnnnnnnnnnnnnnnnnnnnnnnnnnnnnnnnnnnnnnnnnnnnnnnnnnnnnnnnnnnnnnnnngtcattcaagggcgccg

SEQ ID NO: 63218 - DNA, 2938 bp, Oryza sativa
  unsure (1)..(2938): unsure at all n locations
cgtgtggnattttgaacgcagttgtannnnnnnnnnnnnnnnnnnnnnnnnnnnnnnnnnnnnnnnnnnnnnnnnnnnnnnnnnnnttttgacttataacaaacgttttggaacttataaaatgaaactgaagtagggttagagcttatttggtaggacgtcaacttctaaatttaactttttaggagcggagtttggagtagagctgtggagcagtcagaaccccactctatcccagtagcctgtaggttatttatgtcagatcattccagcccactccactttattttcgatggagctgaaaccgttaggtgatactccaaccctaggagaggtttctcggggaacatatcagtccattttcatcctgctgtgacagatatgtacaactaatcaacttgcccctatcaacttttgtgaaccaatggcctcatgttgtgaagcgaaatatttctgaacgttaattgtgggctagtggtgacacatctttcatttcggcaacaacacggttgatttgtgcttctgaattgcaaatggtgacatgctgcagttgagaatttaaaagatggttcatttaaacagggcgaagagtggtactgatgtgacgtatgcgatgatatacagggggtgtttgaatccagggactaaactttagtctctgttatattggatgaatttggagtattaaacatagactacttataaaactaattatataaatgagagctaattcgcgtgacaaatttttcaagcctaattaatccataattagcgcatgtttactgtagcatcacataggctaattatggattaattaggctcaatagattcgtctcgtgaattagtccagggatatagaatgggttttattaatagtctatgtttaatatttataattagtgtccaaacatctgatgtgatagggactaaaactttttagtcccatccaaacaaggtcataagggggtgtttagttttggcgtgtcacatcaggtattatatagggtgtcgcatgggatattcgggcactaataaaaaaactaattacataatccgtcaataaaccgagagacgaatttattaagcttaattaatctgtcattagcaaatgtttactgtagaatcacattgttaaatcatggagcaattaagcttaaaagatccgtctgtaaattagtcgcaatctgtgcaattagttattttttagcctatatttaatacttcatgcaggtgtttaaacgttcaatgtgacagggtgaaaaattttggggtgggatctaaacagggcctaaatattcttggataggatgaatgccagagtaagcgtaaagaaactacttcctcttctgtgctaaaatgtaagtacttttaagattggcacagatattaagaaagtaggtaggaatgattagaggaagtgtgtgattggttgagaagagaaaatagatgaaaggaaatagttatgattggttgagagaatgaggtagataaagaaatagctttattttaggacaaaatactgtgttagaaataggtgttgacccaactggggaacaacacaattatatcttgtctcaaatgatgcatgatcttgctttacaagtctcgggtgaagattgtaagggcatgtttagatctatttggaatggtaaatggtaaatgacaaaagttttggtggcaaaagttttagcattgcaaaagtattagtcggtgtttagatgcatcataaacttttgccattctagcactttttggtggagagagagagagtggtcccaaagtactttttggcacaatttgctactatggactagcaaatggcaaatggcaaattgtcaacttttgctattagtgtttagatcccaaatggcaaaacttttgctattttggaggatctaaacatgacctagatgttatatcatggggaagggagtacctttcaatcatgaacagaagatccggcatttaacagtcgatctcaacaagcaagccaatcataacatgtttgatgtgattcgggaaggcaaatatttgcgcacatttatagttgtgggcagctctgaaaattgtgtgccaagaatccttaatgactttggagataaatttccaagattactcactttagatttgagtaattctggtatatctgagctgcctagattgataggaaaactgaaacatcttcggtgcctccagttgcaaaacaccaagatcagacaatttcctaaatcaatctgtaatctctaccttctacaaacaccgggccttagaaactgctatgatcttgaagagttgccacgtaaaataaaaaatcttcgcaagctaaggcatattgatttggtgatgacctgtaatccctgccgcaatgactgcagcttgaagtgtatacccaaggacataggacttttgttttgactgatcttcaaactctttcaagctagatttgccataagcaagaggagcgctcttagcatccacacttgcaaaaaaggtattggggagttggctaacttgaacaatctcaatggtgaacttcttatttcaggtctggaacatgttaatgatatggaagaagctgtgcatgcgcatttggcttcaaagaagttcctcgaaaaggtagggttttcatggaacggcagcaatgaacaagctgaacaaattatggagcacctaaaaccaccaaccacaatcaggtggcttggttctccagactacaagaagctaatcactttggacgagggtttgaaatttcggttcaaaatttctaaaatttctgaaatttcagtaatttcgctccccaccggcatgctcaaatctcatccgaaattttcggttttttgcatttttttgtgaatttggccaaattttattaaattcattcaaattcagtcaaaatttaaaataattttcgcccgaaatttccggaattacctaaatt

SEQ ID NO: 63219 - DNA, 4656 bp, Oryza sativa
  unsure (1)..(4656): unsure at all n locations
tttccggggtttttcgggggggtttaaaagcggggggaattccaagggtttttgggcagccgccgcgtacggcggcagggagacgtgctcgccggtgcacaggttgcagacgtaatactccgacgagctggcctggaacagcagcgtgagcccgttgcacggcttggtggtgagcacgacaaggtcgtcctcggcgggaaggttgcccacggtgacgagctcgcgcgccgccgatgagcccgatccgtccgacgctagcttgcaggtgtaaaagacggcggtggcgaagcccccggccgccgccggcgcgaagaagacgatctccgggcggccgtcgtcggtggccgtcctgagagcgcggcgcacgcggacgaagtggtcgaaggtgagcgcggcgcgccacgcccggcagaccgcgcggaggcgaacgacggcggccgccgggacgcgcgcgaggatgtggccgacgaccaggtcgtccggcaacaccggatgatcagcgtgccgaggcctcttgcacggcggccgaggcggcgtcgaagcttcttcggattctgccatgatcgatcgtgtgtcagatgagatgaatatgattttgatcgtgctaggaaaaaggaggcacaggccctttttatcgatacaaattaaggtgaagtgcaacatcgtgtaccagtccgactcggattggtagttctaataagaaataagttcaccggagatcactcgacttaatagagagatttttgaggtcccttgatcgcaaaatcagaaatatgtatctcttaactcaaacaaaccgtgtactcaaggtcgtatggcagtacatatgggtggttttgttaacatagtattctagtcagaaaaaaaattaaaaaaaatacatgaggctcacatatcagctgcacattttttttcttatcttttcttctcctgctcttctcttttctccacgacgggccggcataagaaccaggtcaatgccgatgacgtcgtgtcgtgcccgacgaggaggaagttggtgaccacgtcacggaggctctcgttgctgtgctcgccgctcgcagcgaagcgcaacaggaagtcgtcactgcgcgccaacccggccaccactctctccctgcgctccccgacgatccgctcggcgaagccgtggatcgtggcgagcacctcctgcaaccgcctcttgggctccatgttgaacagcctcttgaagcaccaccgcgacttgaccggcgacatgaaccggtccatcacggcgttctgcgcgtcgttgaacgcgcgcatgaactccgcgctctggggcgaggccatgctttcctcgcgcgaggcatgccgggtcctcgtcgaaggcgacatggcagatgttgtcgaacgcaaagcactccagcacgtcctgcacgtccagcatccggccgtcgcgctccgcccgctccagcagcggcagcagcctctcgacgacctcgaacctgacggtgtcgaccacaaagttcctcaacgagcgcttgttgaacttgtagctggcggccttctgctgccacagccactgctcgccgtcggagttgaagatgccatggccgaggaagtccacgagcatggacacggcgagctcgcccttggggtagttaccgaagttagtctttagcgtatactcgacattggccgggttggcggtgatgacgccgccggtgaggccgagcgccttgaacgacatggtgtgcgtggggctccgcttcatgacttttggtgtacgagaactggtggtgcgccatcgatcgccacggcagagtgtggggacgagtcttcggagttggcccatggtggcgacgacagcggtggtccaaccgttgggcgcagcggcataaagcatgcacaagagtggctcatattggttcaacagcggtcgggcggcatcgtctccctcctctcccgcgggacagtctaggctggcggcagcgagctgagaagctcattggcgatggcctcctcgagccagccctcggcagcgccaagccagctagtcgcccgaaaatggcgctcccccttcttctacaccaccggttccccctctcccaccagcgcgacgcgtggagaggacgggagagggagagttggtcgacgggagatggccagatgggggaggggaaaggcggccggctgctgccgtgctcaccctccgccgctctgcccgccactcgtcgaccgctgccgcgctcgcttgccgccagcctnccgcatccgtgctcgccatcgtcgctccgctctccgccggagagaagagaagagaaagagaagaaaagaaaagaaaacaaaaatgtgcagctgatatgtaggttccacgtatttttttcaaattttttttctgactaggatgcaacgtcagtgaaatcacccatatatactacgataggactttgagtgcacggtttatgagagtttaggggtagatatttctgattttatggttaagggaccttaaaaaatctcgctgttaagttgaggaacctattgtgaacttactcttccaaataaaaggtcacagatcgatttaattaggcctgcacgtataatgcgggccaaacttggttcatgctcatgcgggccaaatcttgcagaaaaatgatattggcccagcctgcattgggcatgcccgctaataatacgtattcttcacatgattacgtatttttatctttacgcctttgatcttagttcacggaaacgttatcctcgcggacggcgtccctccctccttggccgcccaccgacgacaaggagtaccccgcggatccggcagacctgtcccccgccgccaacgactcagacggtggccacatcaacctcttctctgcccgcggcggctccggcggtgttgccgacttcgcggcgctcgcctccgccgacggtgggaggggcaccgccagggagtgggagcctcccgcgaaccctaaactgatattatgataaggtttggttaaatttagtaacaagcccaaaccttctatacaaggctaaaccgactttgtaaataaggttggccaaaccgaccttcagcataatgacgagccaatcttagctatagagtagaccgactaacaaactctagagttcgagttcagtttagatatttaccatattttcttggttgaaaccaggatttctagtgtcctattggattttaagaccaactgaacgtggagaagaccttgtaaacacaataccaccccttctataaacagactggggcaaggccaatcgtaaaaaccactaatcaaacgttaaaatcaatcaactacccctacccttgtattctacatctcccttcttctactagctacctgtatctcacgtcatttcatcctcaaccccctaattgctcgttgtctctctcactgctggagaaagggtctttaaccccggttcataatcccctgtagtgcaggttatgcaaacggaagcacgaatccgagactaaagatacaacatactggcacatgcgagtatataacatactggcacacgttcaccttgacgggtctctcacatgtgtttgtttgacaatatctacctcccatgcggcaatgtttgtttgacaatatctacctcccatgcggcagtgtgtctccgagtgctgttgtgggttacacacaacatgcttaaggtgtggtggcgtgttttgatgccaacagtaagactaatttaaaattcgaaataaaaacatttccctagccattaatctcaccgtcattctcttctcctagcgaagtcgagtgatcaggagaggcgacggggctaccggcgccatggccggagaacatagaatttttttcattttaatatttacagaaatattataccagcgaaaatatttacagaaatagatctgccgccaaagtgtatggcagcaaggtgacgtggcacatggcgccccgtgcgcattttgcgctgaggtcccttgctagttgctaccctctgcaagggcggcaagggggtgaaatgcaattttcgccacatgcaaaatttgcatgcccactcagcagcctccagcacttggtcacacacgtcactctaccaccctcggggagggctgcagagcctatttctgtaaatattttcgccggtataatatttatgtaaatactaaaacaaaaaaaaattacaaaatgaaaaaaattcggaaaacgtacgtgccgctaatgggccggagagtgcgggaactagcagcgaattagggcccaattagatgtcttgtgttgggttaggcccacttgaacgaacagtcaggctgaatcctagccgcacgtctccatccaacggcagtcatggacgagaaacgagtgggggtcagagatttcttttccgaccgagctgtactgggcattcctctgggaacctcatgagaagggcctatcttggtactctccgggcccacctgtcggtgtcacacctcgacgttggcgcgcagataaaattggaaaactagagggggttagcgcgaaaaacaccttcgctttccccaatctctctcccggtcggcgaaccctctcgacggcggcggcggaggaggagccatgggaggccacggcgggctgaacatcctgccgcagaagcggggaacgtctacaactttgacaaccgcgagaaggtcgccccgaccag

SEQ ID NO: 63220 - DNA, 3227 bp, Oryza sativa
cgcccccggaaccggaaggggaaaaaaaaggtccgggttgggtatggcctcgcgggaagggcgtgcggccccgtggtaatgtccaaacgtcggcttcatctccatgaaaagaaggatcgcaggcggaagaaggaatgtgtgaaaaaaaatgttggaaaaaaagcattaagagcttaggtagaagaggaggaagagggaggccaaggagaaggagcgagagcgagcgctgctcggcgttccatcgaggaaggagaagtattcggaacggggacgatcgtcgaggttgtagcttcgctacacaagattcattagtgtgaattctacttgtgttcttggaccttttgatttttttgtgctaattgatgtcatctttgtggctttgatgcagatgggcacggtgatgtggggatgcacttaatatatttgtgcaggctcttcgaaagatgttgatttgaagaacaatgtgaggattcacttagacccttgttagttttgggcgtacaaattgtgaattaatttgttgcagtgcagtgtaataaaaaattacaatgaaattataatgctggttgttgatgactctcaagttttgttgtatcgagaaataagttgaatggattaatgatatgcaattaaattttgtttgatcatttggggttgttcaaagttcaaacagaagcattttattagatttaagttgtgtattacagctcttaacatccctaatcatgtttgttgatgttccagaggaagttttttgccctgttaccctgtatagttctatgttctatccctccttttgataacactcttatttacctgctgggtgcctgtgtctcttatattagaatattagatagaaaatatcatgtttgcacaatatggcatagataattattatgtaagcacttgttgtgttgggtgcgaaactgtatctcactaaagaaaatgggggaaaaggcatatggggctccaaagtttctgtctgttcttgcttgtaatgtggtgctcctggttaaaatgcttgtttatttataatccacaaagttgggggccacaaatcgtgccgaacatacttggtacagtgttgactgatttttgttgaaaacctaaattttgttgggaccaaatttaaaatattattctgaaaatgtagcaatttatgctggcaactgtttggtggtagttaaagcgagaagcctaaaacttcattgacttttcctgacaagggtttttctttaattaattggctggtgaacgagaaacatcaaactattcaatcatgttacctacatagttgtgctattgaaaatctggcttatttttgcaacagatatttatattccgcagaaacaattggagatgacttgatgaaggagatttcagaggttttatattgcaagaagagccaaggtgctaagctgttcaggcgccattgccgccgaggacatcccagtattagcaatttgcatcagagttatcttttgtaaaaccaaccctggctaatgtaaactaatgtaatgcaatggagctttcaactctggtagaaatttcattgtttgcttgtaaagtttatcaaaaaattgcatggtggacagactcaactctcaagcacctctagattgatcaaggttggagaaaacttattttctggagcatgtcgatgatcaaagttgaaagagcttacaacatgagatgaactctcaaatatcccatttgcttgttggggagatggtcacgatgaattataggaagatcaatatatacgattttatttgggaaagatacaaaccattcctttgtgacatgatcacatcgatactacaatcacgttttatagataaaattaagaaaatctaatactgaaaaccacacacgtaacaatcaataggagtaactttccaatgattagtttaaaaatacatcatggatcaagctagattaccactacgacgccacacaaacaccacccttttttgtccatcggacacttgtaaacagtaaacctcaccaaacttggtacatttgtttttctgcatcctttggcagctgaccaacaaaactaagcatccccacgacgtcacctttttatttactgtagaattatctgactagactggaatatgagatttctcatttctttacaagacaacccagaataatgctaagtagcccaatcaccagtacgaatgccagcgagaagcctccttgatgttgactggcttgacgccttgcaagctcctgcatatttatgcccaccaacatggggttgacaaagatgatcactaacatattattttcagtgagttcaacaaaataagaaggcatttcttccacagtggaccttaactaaagttttaacatgctaatgtaatatatttgctcctattattcagacaagatcgatggaaaaaatagaaaaataatcagctccatcgtaagcaaagtgcataacgattcagcaataataataataataataataataataataataataataataataataataataataataataataataataataataataataataataataataataataataataataataataataataataataataataataataataataataataataataataataataataataataataataataataataataataataataataataataataatattgttatccattgtcgtctatggataacctagaaaaatttggtgttgagaacaagtagcatctaaaggcgcataatcgatgaattttatattgagaagaagtagcatctaaggacgcataatcgttgaattttatattgagaaaaaaaagcatctaaagacaaataatcaattgatgtatgcagcttgaaatatctagattgaaggccccttcagataaattccctggaatatatggcttatgtgtattttctacatgaacaagtacttaaggaggtgatgcttatttttgtaataatatttgaattgaaaaaggggaattcttttacaactaagtaaatgactcaaatcattaccttcaaatggaagcatgtagaatgcatgacttaaccaaatactcccagctcctttcgaagttcctattttgctaatgcagacttcttttcttcgtcaattttgcaccaacgcggacagttgaatgagagagaaggggtattaatgcacgttaagtaatgacagacaagatgcaaagtaattaaaattaatag

SEQ ID NO: 63221 - DNA, 2229 bp, Oryza sativa
  unsure (1)..(2229): unsure at all n locations
agctcanatgaatgctgttccatatgnccnnnnnnnnnnnnnnnnnnnnnnnnnnnnnnnnnnnnnnnnnnnnnnnnnnnnncaaatgtgccatacctcatcttattgatcttttgtttggctctccaggcctgggcgtagcttatggtgtacttgaatttgttctcgatgtgcctaataattgattttggttcaaagccaatgttaccaacaacactgctgtacatattacttgccacaaaagctgaagtgatgtttcggtgatacttctccaccccttgtaagtagcacttgtgctcggtcacaatgctaactttccaataatcattccatttacccttatatgcatggacacgccacggacaatctttcttcatgcacctcacttcatacacataatttgttgacttgaccaccctaaactttctctgcaaggaaactgcccaatgcttcaccgcctccttcatctaatccttatgagcataccttgcaccctcaaatacctcgttctcgttatactcccaagggtacatgatcaccctctgatataacaagtcaagaaaagtcctcatttgcccaatcagtggccattacatcaccttcctcatcggatgatgcgtcgtcgtccgcttcctcattatccaatccttccctctccatttcatcaacaattataccgactctctccccctcatccgccatgcccatagcctgcttctcccttggttgattttcctcattttgcatcgatggtccaacaacatcccctgcattgataggaccctctacattttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctgaacaaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctgaattcatactattatattctatgctatggatctacacatatgtgctgtgtgctacagatgtgctaaaatatatggaactaaaactaagacgcaacatatatactcaaacataacatattagtacaaatgcaaaagatgtatgggagcatacctgtgatgaattgagcgaaccagcagggcttcgccgctccccttctgctgccctcccctctctctctctttcgttttttttggatttttagtgaatataatgaaatttcacagaggagggactgggctttataagggggaggcaaaaatcgccctcccccagggcggtaagggggcccnctccaaaaccccatgcnccctcgccacccatttgcaggccgtccccccgcacttcaacatgcgcaatacccgacggaccccacagcattctttctcttgaattcgctcgacagtcactcctatgcttaacagccagtcaatagctagacctttttttacacctcacctcggacctgcggggaatatcggcccctatttatccgggccggcctcagccctatcccctattagcacatacaacaatttacgcgctgcttccttatctttcgccaaactagacagacatatagctgcatagaacctatttccctatcttgcacgttccacactccccaaatatctcttggccacggatcgggttagattccttcttccccaaacacgtgtacactaacgggtttctggggctcctccgtatcgtacgttcacccccctcacctactccctaggaaggttcccacccccgtggtgttcccccgctcgtccccccctcccgttgggggaaaaaatctctattatacaacccccctcttgtcgtctaacaccacccccatctgtccacataattctctttgtacaccatcg

SEQ ID NO: 63222 - DNA, 1130 bp, Oryza sativa
  unsure (1)..(1130): unsure at all n locations
cgcganataggatnnnnnnnnnnnnnnnnnnnnnnnnnnnnnnnnnnnnnnnnnnnnnnnnnnnnnnnnnnnnnnnnnnnnnnnntgtcagtcactgagtcacactcacagtgccactgatccgccatgagctgggtcaagctgagctgcaggaggagtgcagataagagaatccgccttgctttcctcgccgcgcgcattctcgtcgtttcccaaggaagcttcctttcttttcttcttctccggtcagtcgcaatgtggcgggctctcgcggcggcggcggcggcggtggcggtggcggtggtcgtggcggcgcggccggcggcggcgactgacccctacgcgttcttcgactgggacgtcggctacgtcaccgcggcgccgctcggcgtcaagcagcaggcaaaactcgcctcaattattctcctcggtgttcttggctagctcttcgttctcgttgcaagtaaatgtgtaatgtgcactgactatggtttggttggtcgccggcaggtgataggcatcaacggcaagttcccgggaccaaccgtgaacatcagcaccaactggaacgtcgtcgtcaacgtgctcaacgacctcgacgagcccctcctcatcacctggtacgtacgtttatataatcccgtcttgcagcaagtgaataatgtgtctgtatatggacgaacgtatgcaggaatgggatccagcaccggaagaactgctggcaggacggggtgctgggcacaaactgccccatcccgtcgggctggaactggacgtacgagttccaggtgaaggaccagatcggcagcttcttctacttcccttccaccggcctccagcgcgccgccggcggctacggcggcgtcgtcgtcaacaaccgagacgtcatcgccgtccccttcggccgccccgacggcgacatcaccatcttcatcggcgactggtacaacaagaaccacacggtaatcaaatcaacacgaaatcaaccgcaatatgaaacattttggacaggtttttgattttgagaaggtgaaattttggatnnnnnnnnnnnnnnnnnnnnnnnnnnnnnnnnnnnnnnnnnnnnnnnnnnnnnnnnnnnnnnnnnnnnnnnatcagngttcatcccg

SEQ ID NO: 63223 - DNA, 801 bp, Oryza sativa
  unsure (1)..(801): unsure at all n locations
gttccattgatgccgtcactatnacnnnnnnnnnnnnnnnnnnnnnnnnnnnnnnnnnnnnnnnnnnnnnnnnnnnnnnnnnaaaaaagatcaaacttttgacagtataatccaatgcacgagatttcttatatctttcgtttgtttcccggctctttcttgtgtatatactgctccatccgttttatattataactagttaatcattttcttcaagttttattaagtttataaaaaatataacagcatttataacacaaaacacatgcattatcaaaatatatttaatgttacatctaatgaagctaatttgatgttgtagatgttgttaaatttttctgtaaattttaccaaatataaaatagtttgattaaagaaaaaaaattaaaatgacatataatatgaggtagtatcaaatttctcatgtgttggttggtttgtttcaggcagcagacccctcaccacaagatggggacgtcggcggcgggggtcgccgtcgtggggagccgggtggcggcggcaccaatgctgctcctcgacggagcagtcatgatctggccgtagagtggcgacgtgttttttctgcaaggaggtgactccgtcgtgtaggattgtttaggatcagggttcaggatcgtagcctgttttctctgttgatatgagtttgtcagtgtgccgcttgattgtgctgaaaaaattggtttcttttcatttttctttttacctcnttttgggttcttttagggtgggtagagagtgttcttttgngggttcgagcgattgtattacaanatacatgcg

SEQ ID NO: 63224 - DNA, 728 bp, Oryza sativa
  unsure (1)..(728): unsure at all n locations
cgcccgtggtntagtaagcgctcggatcgaacnnncacaaccgngagaaggtccgccgcgacgaggccgaggcggcccgggaagagcagctccagcgcgaggccgtccgccgccgggactccgacctccgcctcgccgggttcgccgcaaccgcggcctccagtccgccgacgcggcgcccctccctccccgggcgcccacctacgccgcggagcagtgccccgcggatccggccgacccgtcccccgccgccgacgactcagacggcggccacatcaacctcttctccgcccgcggcggcggcggtggtgcaaccgacttcgccgtgctcgcctccgccgacggtgggaggggcgccgccagggagcgggagcctcccgcgaaccctaaccctaagaagcgtaagaggaaggaggaggaggtgagggcggtggggcccgacgaggagaagtacaggctcgggtatggcctcgccgggaagggcgtggcggtgccgtggtacatgtccaagccgtcggcttcatcctccatggagaggaaggatcgccaggcgggagaagggagtgtggggaagaagaatggtgggagaagagccttgcggagctttgggaggaaaggacgaacagtgcggtccaccgaaaaggaccgtaatctctcccctgcttgtcccccatcaatgaaggcaaattctgcgctccggctccatgacctcgggtgcaactctcgct

SEQ ID NO: 63225 - DNA, 1309 bp, Oryza sativa
  unsure (1)..(1309): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtatttcttcgatgagatggtcaagaaagggtgtcaaccagatgttgtttgctacacagttatgatcacaggttatgtggcagctggggaattcgatgaagcccagaagttcttcgatgatatgttgctgagagggcagcttccgaatgtgtacacatacaattccatgatatgcggactttgcatagtaggagaatttgataaagcatgctctctgctgaaggacatggagtcgcgaggatgcactccaaactttacagtgtatagtactctagtgagtaggttgcgaaatgctgggaaggattctgaagctaacaatatcattcagtacatgacaaataagggtcattatcttcatttattgtcaaggttcaggagatatagaagatgctgatatgtgaggccccatagtcagttacattgtaattttgttgtattgtttccaacttggaaagatggatcataagggagtactttgtgaggtaaccattcgcactctaactgttactctagcacatagggttccttatctatttattcagtacagaaatgcaacactgtatacttaaactgttttacgcactaatggaatgggataggatggggtggcctggcgtgtcctaaatcctaaccgactcatgatggaggagttcaaccctgatttactagtcctaaataggaaacccaaccttagttctgttgcaatgtagtacacaatatttgatttacttccacttctggtctcctgaaccagattacatccaatcttttgttttcaatatactttttacagtgccaagaacttatgctcaacaaaatatggggcatatcattttgctaaattacaacagaacttaggcttttgattcggttggatgcaaagcacaccgtatttctctcaattctcatttctgtcaaccctagcataggtttagcttagtggattatatgtcatagatcagataagatccatataaacattgtgcattatcttgcagcactaagagatgaaaagcctatgcaatcttgtcccttaatgatgctctttaggtcattagcatctctcgtcacagattgcttttatcattatgcatttatgtaatgtatgattaaaaattctcagtgtcttaaaaagatagcaacaaattaacacaccgttaagactgcctccagtcacaaataagtgacatttttg

SEQ ID NO: 63226 - DNA, 11332 bp, Oryza sativa
  unsure (1)..(11332): unsure at all n locations
cgcgcccttccattgnnnnnnnnnnnnnnnnnnnnnnnnnnnnnnnnnnnnnnnnnnnnnnnnnnnnnnnnnnnnnnnnnnnnnnnnnnnnnnnncatctaccctggcctgaatcaccactatcttttactggaggggatattaaatattgtttaagtcagtttcaaccttggtatctctgactctggtcatccattattttttgttggaaaaaaatatttgaattaatcaatacgataggtacaggcctgcaaagattcatcaaattagcaatgttctctaagttcttttagttgccaaattgactttggcatcataaacataaagcattaaagttgatgatattgtcatatgtgaagacaaattgctgagttacagcgtgttgatgttaatagagcaattgacaggttgtaattttttttttgtaactgtaagcaatattacttacgtgtaccaatatgttctttacagtattatggtacagagtaatttcacataaaacatcgatcaaaagtccaaggtattggctgtttcacttgcagatgggagagacactatgcaatggtgttatatatttcataattttatcatttcttctcttctttcttttcctctttcttctcctccttcttctcttccttcttctcttctttcttctcctctttcttttcttccttcttctcttcttttgcaggtccaacagacacaatgtcaatcttcccaatcttctttaacttctttgcaattgccactgtgtccatttcaccgatgatggtcatcttattgtccttcaaatctgcagctatggaatcgatacctgtacatgaaatcacgtctgtaatgcattagattttcttgttaaaacagtaatagtttatcttacaaaatacttctttgaagatccaatcttgcatcattacatgttcagctgataatacatgatgtggagcatccagttcttttgtctaacctttagaaactaatgtacagttgttcaccgcaaacagcacatattaataatcccatacataggggggaaatcattccgtatgcctaactatatcatcgatcgtcatcttcattgtgttatgtgatgtaacaaacaatttccaccttacatgatatctcttatcaaacctctgcctaaaaccatgctaatgcttccaaatgtgatttgcagatgttttttgaatcagagatcaaaacatatttttcaagtttcagcagccaaagaagaaaggggatggtacagaatgttaccgtagatgtctgcaacggcttcaatggctttctgcttaatcttgtcgtcggtcatggttggaaccctcagcaccaccttctgctgagaattatcatccgacgacacgaaggcgtgaaccgccgaaggaatcagggaattgaaccataaacaagagttgcacttgcttacctgagccatctggaagctgtgaatggagtggaggaggggaaaggcttaatgttctgctgaggtatgaacaatgagaagaaaccaaggctggtgatggcaccggccgggcacctttatatgcaaagggtgcaagtgtgctgtcactattctggaagaaaccatatcaccaattccattcagcactggtatttatttctctttctccacccaattggtgtttggcgatgagtcagtagccaagccaggccagtttctgtttgctgcaagtgaccagtttattcatccgtccgtctcgtcgatatctgatgcgttggagatgaggtacgcaaaaatactttcaactctttcggccgctgccagtttcaattggttcactcatccctggcttttctttctgatcaaaattgttgtgatgtccctttccatccattcctgaacatgcctttgctacgtaggattgcagggtcggtcagtgtcctggtgcgaccgtgggacgggtcagtgccaaccgccacgccggcacccggcgcgcactgacgcgagacgacgggattctgtccatggagagaagtggtggtggactggcgtgagagtgcgggggcggcagctagtgaccggacggcggcggcgtggtggcgacgacgtccagacatctctagtaaagcggcaaaagcgggtgaggatcatctaccataatgtcgctatcattataatcactgaatacaaaaggacgagaaggttgcagcggcttggaggttggaagaaaaatggcagggctgttcgcctctcaagtctcaacgttggttggtagtggggcagtgaggctcaggagcatcgagcagacatgcgaccgtgtgagtgacatgatccagaggaatttcttcgcttcttttactggaggatctagaagaatttggtttgtttggttttggtgtttggcagtattggcacagcgcatgattgaaactaaaagtgttttgtgaaaaggatggaagctcacaactgatccctttcaggcttgagtacacgagaacgtgcacaattgggccgggcgtgtttttgttggtgggcctgttcttgaacctgatgggctttgctggctgggctgggctaccacgagttcatgagtggggtgatatacagggtcagtcagtcattgtctcctcgttgcattcgttttatcttgtgaaactatagtgccaaagaaagattcaacggtacgaattccatggcgacatgtatgtatatgtggtttgacaaatacacctcttcatggacgggtgcaaatttctgctccagcattacggatctgaaagtgagactagcagttttggaaatacagatttttgaccaactcgaaatgcaggcaaaacttggctatcaagtttgcccccccagccaacttggctcccaagttttaccggaccgaagacacgcaatttgcaaataaggcggtggttcgttgggccttttctgccgcataatcagttttctgtttgcaccttttaacgcataacctcaaattatttgtttccactaggatacttaaaaaaaatctctctaacaaagttctcaactctttgatttacgagatggtgggggttatagggaatacaggccacatcagcgttgagttttgttttttaaaaaaatgcacctataataagtctataaccacaaaaaaaaagccacattttcgtaacttccacaatgtccacctataaagttgcaaaaatatggtaaggtctcactcaaatcatacgtagtatgtctttgtatttttatttatttatttataaaataataactcgttataaaatttggtaatacctaagtagattacttttcgggaaaaccaaacataccattatatttactgatcggatttccctcaaaaaaaaaaatactgatcggatatatcaatcccagccaaagcctacctcgcagccgcagccgcagccgcgcggccttggtctccgcgagtcgcgaggagcgccgccgccgtcgtcgccgtcgccggtggcaacgcccccgtgtctttttctccacacacacccctttcccgatcgattccgccgcctactccgatcaagcaaggtaattaattagtgtgatcatgcctgcatccatcacaaaaccgtcaataccactttgtcatccgattccaattgatacttccgtttccgactcttggaagcaagaacgccctattaatttgggagaaggccactccggccggcgacgcgcggggctgcttccatctcgctccggaggcaatgactatcaccggcgccatggagaaggtgagtgctcgtataatatactccctccttccctaaatgtttaacgctgctgacttttttaaacatgtttgaccatttgtcttatttaaaaaattatataaaatatgtaaaactatatgtatacataaaagtatatttaacaataaattaaatgatagaaaaagaattaataattacttaaatttttcaaataagacgaacggtcaaacatttttaaaaaagtcaatggtgtcaaacattttgggatggagggagtattagattagaaatttcttgtgggagtgctcgtatgtttgtctggtacgcaagcagtaagattgaatggcttaattaataatacctacagtacacacaatagattaaaaacaaacaatgtagcttgtatttctgcgttagcattgcgctgctttggttaattcctcgcaaaaacagctctttgttttggtctgatgcatttgatatgatgttgtgtgttggtggcttggtgcagccactcgatgagaaggagctggaaaggaagctgaagaaagatcagaaggtactcactctagtaggattgctgttatgtacttctgttaacaattcaaaggaatcgtgtccagttcaccagttgtttggtgtatgaataagtgtgttatgtatgtaataggcaagagagaaggaggagaagaggctcaaggcgaagcaaaaggaggcgattaggctacaggtgttaaaaataatccctgctcagataaatgtgttttactgtcaattctttgtattgatgtggttgtctgcaggcgcaagcagcatctgatgaagcaaagaagagcggcgagaaacaaaagaagaaaggcacaccggatgagaatcctgaggatttcgtcgacccggatactcctgctgggcagaagaagctgcttgcttctcaaatggccaaacaatataatccagctgctgttgagaaatcgtaccgcctctcttgctttattcctcgatttaatttattttcaatgaggatatatctttcatatcgttagaaccttaggaattcataacatgaaatttctcacttatctgtccttttttccggtatgttgttttcatgtagatggtattcttggtgggaatcatctcaatattttgtagcagatgcgacgagttctaaaccaccatttgtaatagtaagtccactataatgcaaagagtgcatgattatatatttgtattcaggataaatactttatcatgattactgtgtgagtagtatgtcctatatgaaatacacaattgaagctttatttctacttctcattttgcatttgcaatgtttatttttccagatcttgccacctcctaatgtaactggggtccttcatataggccatgcgattacagtagcaattgaggtatttattgattgattctcctgtttattcattggccatataagcatcagtattgatgtctttttggttgttgcatcgtgaacaattcaggatgctatgattcgctggcggaggatgtcgggctataacgctttgtgggttcctggaatggaccatgctggcatagctacacaggtctgtcatgcatataacatatatatggtatctgtttctaacatataacctctacaggaattattgttaacttgaatacaaattgacttttgctgaaacatcacattgattgttaaccaactttctgttttagtttttaagggtagcaggctttatgtaacaaaatttctcttcatatcaggtggttgtggaaaaaaggcttatgcgtgacagaaacctgtcaagacatgatctggggcgtgataaatttctattggaggtaatcatttttttcttacctattgcatattgtattaacttcacagttagtttcatttttatttatttttttcattcttcaatcttcttggcaggtcctccaatggaaagatcagcatggtggtaccatattgaaacaattacgtacacttggagcctcacttgattggtcacgcgaggtataatttgttttgatttcccctaaggttgtagacagccagaggagagcaccatttatatctaagcaatatattttgttgaataaatatgacaaaactccagacattatggttcagattgcacaaaaccacatgttttttggcatgttgcacataaccaaaggcattatggtcctataattggttaatggtgtggtttagtgaaatcttaataccataatatttgtggttatgtgcgatgtgccaaaactctgagttttgtgcaacttgaaccatacctggggtatataaaatgtattcatatattgttttgctttgttgttaaatagtattgattttcttgcaacttgtttcagtgttttacaatggatgagaagagatcaaaagctgtaacagaagcttttatcagactgcacaaagaaggcctaatatataggtcagtgtcaaaatatcgttgaatgtgtagtttaactttctatatttgttctgcttcagtaattttctattcgaattgtgtgtttcttagtttatgttttcttactgcagcacatcttactttgtaaattctgtatgatttacttgcagggataatcgcattgtaaactgggattgctcacttcgtactgcaatttcagatattaaggtatacgatacttctaatatgattaacattttgatttgttgatgaggaggattgtatttttatgttttgctcgctacttttcaggttgactattgtgaacttacagaagagactttgttagaggtccctggatgtagcactcttgtccagttcggtgttataataaattttgcttatcctctaaaggaagggttgggtgaaattatcgttgcaacaacaagaatagaaacaatgcttggtgatactgcaatagctgttcatcctcaggatgaaagatacaagcgtttgcatggaaaacatgctctccatccctttaatggccggaaactcaaaataatttgtgactccaagttagtggatcccagttttggtacaggagctgtcaaggtaagtgtactcactgaaggagtgtctcgtatatcttaattttattttccatacctggattgattatattcatcaatcagcaagctcttatttcttttttctattttgctgttgtttccatacagatcacgccagctcatgatcttgatgacttcaacactggcaaacgacataaacttgagttcattaatattttcacagatgatgggaacataaatgaaaacggaggtccacaatttgaaggaatgccacgtttcactgctcgggctgctattattgatgcactaaaggcaaaggtattattagattatttagttttccatttccttttctaattaattcctcgatggtattgtagtctctcacaatttcagatggtttattatcatgctttttatggaatttattttacatttatcttctctctctctctctctctctttctctctctctcaatggtgcattgatgtattggcactttgtcactttattagtttctcacaatgaaatactattgttctctatgaaaaacattatgatattgggatactgttgagtgttgctattatgttctgaaagcatctagagtatggttaagctatgaatataccattcagctttgttcttgagttggcatactgattaatcttttagttttatttggaaatttcatcttgttgcctgcttaactatctttcatgtgccaccagtactttcctgtattctattgtcttagaagaaatgccaaattacaatcatttacaccttttcaattaagggtctatacagaggcacagaaaataataagatgcgcttgggccgttgttcaagaactaaagatattgtggagccaatgatgaagccccaatggtttgtcgattgtagtactatggcaaaggcagctcttgatgctgtgaaaactaaaaggatcgagatcattccaatacaatacgagcaagactggtataggtatatcctattttcttttctttaggaaaacataattggtaaatcgcaacattggatagtagaataacccattcacttctactgttctgtggtaacagatggcttgaaaacatacgtgattggtgtatttcaagacagctttggtggggacaccgtataccagcttggtatgtaacgctagaagatgatgaggagaaagacataggttcttacattgatcactggataattgcaagaaatgaaagtgatgcaatcctggaggcaaagcagaggtatccagggaaaaattataagttagaccaagatcctgatgtgctggatacatggctttcatctggtcttttcccattgtctgtgcttggttggccagacagcacagctgatcttagttcattctaccctacttctgtacttgaaactggactggatatcctcttcttttgggtagcacggatggtgatgatgggaatgctacttggtggtgatgtgccatttcagaaggtaatatttaggttatttcattcttaaatagttcttggtcaaatctgttagattctagtgatagtgatagttcagtatgattgccttctaaaattatttgatatcattttaagtttggtaacttagcttttggtccttgtcgaatcatgttaacttttctatgctaaaaatgaatcaatcattaacacgcggttagaaacttcacaagtactagtaatttttaaaccgtgactcatgactgcttatctgtctcaggtttacttgcatccaattatccgcgatccacatggccgcaaaatggcgaagtgcctaggaaatgtcattgatcccattgatgtaataaatggtatatcacttgaagatctcgggaaaaagttggaacatggcaatcttgatccaagtgagttagaaaaggcgaaagaaggtcagaagaaggatttccctaatggcattccagagtgtggtactgatgcccttcgttttgccctgatctcctacacttctcaggtaaattttcccaccagcttttgttgttccttttactgttagtaaaaatttcttgtagtaacatttcttgtcttgttcagtctgacaaaataaatctggatatcaagagagtgcacggatacagacaatggtgcaataaactgtggaatgccgtccgttttgccatgaacaagcttggagatcaatacactccaccagcggctattgcgttgtgttctatgccacctctctgcaaatggatactctcagcacttaacaaggctgttggcaagactgtttcatcgatggaagcatgtaaattctccgaggccacatcgtctatgtactcttggtggcagtaccaactttgcgatgtatttatagaagccgtaaaaccttacttcaatcaatctcaagagttggaatctgaaagaggtgcttgtcgtgatacattatggatatgtctggataccggtttgcggttgctccacccgttcatgccttacataacggaggagctttggcagcgccttcctcagcctaaagaggcttgtaggaaagattccataatgatatctgagtacccctcagttgttcaggtaaatacatacttcgtactgactttggaaaaaaaaatgaattcttctagcttgtaacttttcagagatcagtatggtagagtcctattgcataacgattaaaagcaaaccactgtaaattctagcactataatcaatatatgtaaaaatgatgaagaaatgattaatgcattgtctgcctcagttggagagaccatagatttaagaaattctgcaatcctatgaaaaaaaaaattctgcaatgcctattttgactagaggttttcttttgacggatgacaggaatggacaaatgatcaagttgaaaatgaaatggagactgtgttggattctgtgaacaagctaagatctcttcggccacatacagatatacatgaaaggtatgcttatgttcaccagatgtatattcttttggtgtgcttcaagactgtcacttcctttttatagttttattcttattttgattcataagaatttgttcattttgaagctaataccttctgccctattttcatctggacagacggcctgcttttatgctctgccgtggggtagacattgctgccattattcagtgctaccaggcgcagatttcaactcttgcttctgtttcatctcttaaggtttgctcggtcttatacctctctggctctctcaactcggccactcacctcaagtcactgtttatgaatgccttgttcttgatggataatggcataatttctatttctatttcaattcaattcactcgagttttgtctacagatgtgcttatatttttgctaatatattttatgtctaaaatgcctaaaaagccaaaaaaaaaggagggaaaaaactgattcaaagggaacttttgcagatactgacagaggatgatccaactccacccaactgtgccacaaatattgtcaacaaagatctatccgtatacctccagctacgaggagctctaaacactgaagctgagcgtgagaagctaaggaaaaagcgagatgagattcaaaagtaagtgccctgttaaaccatctgaacataaatttgaacgaaccaatttgaacataaatgaaatttgtagttttgttagtggtaagacgttctatttcccactgtaattgcaggcaacacgacaccttgtcgcagaaaatgaatgcctcaggctatcgcgagaaggctcctcagagcaagcaagatgaggacatgaaaaagattgctgcattactggaggaacttgagatcattagagaagccgaaagtgaactagaatcaaacaactgaaagggttttgatgtatagctttttaatgacctactgtgacttgtacgaacgcaggtgattggcatattttatgaactcaagcaagctcgctttcagcttgtagggatcaagaaacacttccactttgtaaatccattcgttctttatattttaaaggaatgaaaggaaaattttctgttgatgtccatcataatttggccttctcttgaccttttgtttaaactaggtataggtcacgcgcttcctcttctccccctccccatccggccgtttcaggccttgttaggttacatggccaggattcgttccgggccggaaataatagaaataatagatataacaaaaaatttataataggtagaacaaaagaaatttatagtaggtataacaagagaccaggatttattcatggtcggaaactaatatactcatattaagtacaacaaaacatccagattagttccatactgacatctaggccgtgtttagtttcaattttttttttcaaactttcaacttttctatcacatcaaaactatcttacccacataaactttcaacttttccgtcacatcattccaatttcaaccaaacttctaattttagcgtgaactaaacatagccctagattagttctatacgcgtgaactaaacacagccctagattagnnnnnnnnnnnnnnnnnnnnnnnnnnnnnnnnnnnnnnnnntacacncgaaaggtccacgccgcgg

SEQ ID NO: 63227 - DNA, 2313 bp, Oryza sativa
  unsure (1)..(2313): unsure at all n locations
cctccggtgtgccgcggcatgaaaccacctatattccgggggcgcgaacgtgttcaccttcaggctccaccccttggccgtcttgaaattttccgaccgcatccgcaggttccagtaccaggcgacggcgcgggcgcgcgtcagttcaagctcctcctcctcctagtcttccgggacgacggcgccggaggatcctcctcctcctcctattcgaatgtctgggtgcgtgatcggggttcggcgtggtggtacggtggatgtctccgacatcttggacatcttgatcttgcacggccccgaccccgcaaccttcgaccgcgccttactggagaaggatcaggagatctgtaactaaagctgctagctacccccaagtcctcccgtcatttttaggatccatcgattataatttgtgggtggttaatttgatttgtgtttcttgcggttcagacaagaaggccttccccgacttgtccgttctcgggtggtactccattgggaccaatgtgcacgccaccgacatgggaatccaccatggggactacgccgacatgcaaatccaccagacagtgagttttttttataaccatttaaatcaactctatttgttggagtgctaaatatatcacactctcatttggcttgtgctttagtgtttggtcttattatgaacaaaatgtggggtattcgggtgtaattcgctgttagtatacttaccactagttgatggtagttgagatgttcagtggacaacaattctgatttaatgagtggagtgtctgctggaaatcctgttgcgagaacacccttgccccgaaacgccacgtgtccgagtttccctttccgagtaagggcccctttaaatcacaggattaagaaaatctagaaatagaaaaaacgtaggattttgataggaatgtaagtgtaaaacagatgattgcaaaacacaggaaaaacacaggaatgaccgtttgattgaaatacaggaaaaacgcaggaattggatgagagagatagactcaaaggaaagttaccaggaggttgaaactcttgctaaattttctccaaaatctctataggatttccattccataagaattttaaaggattggatatgattcaatcctttgtttcaaagggcttcataggaaattttcctataggattaaaatcctccaaaattcctatgtttttcctccaaatcaaaggggtcctaagctttgttagacacgtgcttatctacacgtagagaaagcagctattctgttgtctagcatgaccatgcatagctttagcacagctttagatgagttttcatgcatttttttctaccttatgaatatgtagtctgatagaaagtaattgtgtaaaagttcttgatatgaatgttccgattgctgaatacaattcatattggaagtcttttaaggcatcacccaaagctaactggctacctgctgaaagtttcttttcatcctgttggaaatcgcctaatagaaagtttccccgttgaatgtctcctagtagaaagttttaccattggaagtctcctaatagaaagtttcactgttgaaagtctcctaacagaaaattttcttctccatataaaatgcattttttaactttgatggaaatctgcttctactcttttcagaaccctaagtgaaattgattgattacacactaagaaaaagcaaaataaattattttccatgcaagccaagcagtgaatttgtgtattaaaaaaaatcccagtggctactggtttgaatgcaaacaaaaaaaaaaggcgtatcatgaacttagcttgcaacaagaggaaaatgataagagttccttgctcatgcaaacactcacatccacgtaccatatttttattcaatccattatatttcgcatatttatacttacaacataagttgataaagtcttttagtgcttgtggaaggttggggactccctcattatagtatgcgtaaagtgcatagccggtccctaaacttgtacgactgagtcatttgagtccccaaactctcaaaatgcatatatccaaatcccaaaacttgttaaattgtgtcaatccgatcacaaactgccatgacacctccaggatcctacatggcatgccacacggacgatgatgtggcagcatcacaaattctacaccaactgacaaatgggccccaataaaaaactttttttaatatccttttctgttcattcccatcttgtcctnnnnnnnnnnnnnnnnnnnnnnnnnnnnnnnnnnnnnnnnnnnnnnnnnnnnnnnnnnnnnnnnnnnnnnnntccatc

SEQ ID NO: 63228 - DNA, 2731 bp, Oryza sativa
  unsure (1)..(2731): unsure at all n locations
tggccttagaaatgcaatgcactnggcacccgcattgaccgtagccatggcctctggtcgagctgcctcttcgatgacatgaacagtggtgcgtccatgggcaagaaggcaccggcgcgacagccgtgtcgacggaggcgctgcatcgtgtgggcagcggtgccagcgcggtgatggacgcggttgtgtcctgggcatcgaggagactccggccgggagcggcgcgactgcgtgtggctcggcacgtttaccagcgaggccgaggcggggcacgcctacgatgttgcggcacggcagttccgcggccatgacacagtcaccaacttccgcccctcgtcaagtctgacccgaaggctgccgtcgagctctgtttcttcgcctcccggtcaaaggccgaggtcatcgacatgctccgcaagcacagctacctcaaggagctcgttgttgagctcgcgacgacgtggcggcggcggcagcagggcgagctcgtggcaggagcgcccgtcgcggtggcgacggcggtgcgaggcccacggcggtggcggcgtcagccgtcggcaggagctcctggaggtggtgctgtcggcggcggtggctgccgacggcggccgcggtatccggagcgtccacagcggctcacggccggtctgggtgtggccgagtgttggtcggctagcaacgtctgttggcgacagcggcggcggtgtggtcgtggcagttggcggcggcggttgctagctgcttggtggtggagggcgacggcgcagcggcggtttgcggaggcggtggctcgcgtcggtggcagcggcgacggcggccatgactgtggaggcagtggcgatgtcggcggcggggatggtgacggcgaggtggctgagcgttcggcagcagcggctgcggtggtggtgaccgtgtctgcggtcatcagaggcatggcggcctcggatggcttgccgagggcgtgggagacggctgcaactggccggcgcggcatcgtttggtggaggggtcggagaccggcttggcgcagagaagcgcagccgatggcagcggaggccggctcggcacgagaggcgcgggcggcggagatggaggccggcttggcgcgagaggcgcggccgatggagggaggccggattggcgcgagagacgcgtccggcagaggaggctggcctggcgcagataggtacggccggcggtggaggaggcgacctaggtgtgaggaggagctgccggtgggtgtggagcagtctttggcgcacgaaggctggccgccggggggtgctggtgcaggggtcccacatgtcggcagagctagtgttgtggtggagcattggtgcgtcagtcgtggattcgcaggtggtgagcggtgggtgaaaacctagtccggccttggccggaccgacaacgatggttcattccccctcctgagggcgttgtcgtgctgtctcacccctcaagggtgtttgccgggtgaaagcccagtcttggctccttggagtcctgatggacggctgtggcggtcttccgtcgcttctcttcttgaagacgtcgttttggcatccccttgggggcaatctcatctgtgtccctttgttggtctagtggcggtcggtcccgcttagcggcggccgttccggtgctagccttctcctaggcttgtgtgttggtgatgtcggtgtgtgggtggtggtataattttttctttttcctggctacgaccctccagggtcgtaatcttgtattttttttccctgctctatcaatagaacttcacaccgtctcgtgcgagtcgttcaaaaaaaaaacaagtgcgccttcacctccatctcccatcacctgttcgacaagatggtgatcccgaagcaaccagaccccgaagaggccacgtcgccgcctgccaccgccgtcggtactggtgttgcgcatggtacacggcctgctcaagaacggcggcagtggcgttgtcgtcgccgcgagggtggcgaggttggtttgccgttgcgcttgccgtcggcggagccgttctggccgaagcttagggttattgccgctggctttgacttcggaattcgtcgccatcgtcgatccttatccgaaattgaggtctctctcatcttctccatgccaaactccctccttcccctctcctccccgtgccgtcctgctgttggagctcaccggcaaggtacccgtgtgccgcggtgccgcctacctgttcggccgccattgtgtcagcacgatgcgccgccgctaggcgtccccgcccaagccgagaacacctccaggctccagctccaagttgacgccctgatgctcctaggcagccagccgtgcccagtcggaagctcgccggagcgccgctacttcgcatgcccccgccgcttgtacaacaaaaaaaagagagagaaatagagaagagaaaggaaaaaaaagtgaaaggagaaagagaaaaaggaggaaaagagagtttttaagtgggtcctatttgtcagtcaatgtataggtattgatgaggccacatcagcgtccgtgtggcatgccacgttagcgccatgtaggatgccggaatggtggtggctatgttggaccaaaatgacatactttagcaagttttgggacttgaatctgtattttttgagttnnnnnnnnnnnnnnnnnnnnnnnnnnnnnnnnnnnnnnnnnnnnnnnnnnnnnnngncgtaagtgacgacgagtcatcaacaccagc

SEQ ID NO: 63229 - DNA, 6549 bp, Oryza sativa
  unsure (1)..(6549): unsure at all n locations
cgatgacgcctgtanctattatccattnnnnnnnnnnnnnnnnnnnnnnnnnnnnnnnnnnnnnnnnnnnnnncatgcgattcttaccacgtatcaggtgattacttccgaggtatcagatgatacctatcaggtatcatgcgattcgtaccacgcagagggtgatacttgcaaggtatcaggtcctgatacggtatccggtatcgggtgatacctaccaggtatcgggcgattctaccacgtatcaggtatcagacgattcttatcacgtatcaggcgatactcgcaaggtatcatgtgatacttatcaggtatcgcgcgatttctacgacgtatcggggtgatacttgcgaggtatcatatgatacctactagatattaggagctgggcatcgaggcgtcgttgccggcggccgcgtcctcccctgtccacgctccacaccgaacccgaacctcgtcgccggcagccgcatcctcccccgtccacggtccacatcggagctcatcgccggcgaccgcatcctccgtcgggagctcgtcaccggcggccgcgtccgtcgtccacgccttagccggcggccgcgtcctccacgccgaagctcgtcgccggtgccggtgccatcaccacacaggatcctccaccgttcacgccccacgttagagctcgtcggcggcgccatctttatcaccaacaggatccttttgcggtcatgcgaccatgccccacgccggagcttgccgcggccgtgtccgcgccgacggtgtcagcctcgtctgcgctactcccacggaggcccgcgctctcgcgtctgagggaggtggagagggagcgatcccgttgggacagtatcccaacgggattccggtatatagcagccccctgaatctaaattactaaatttataaaatcgcaacaaaacaggctaatttactaaattactttggtcttgtacttgcagaaaaaatgcatttaggacgatgctgtttgaaaccccttcgggatttgtaatgttccgtgtttcagatgttttgtttagatatcctgaggtatgtataacttttcattcaccctagtgtgatgcataattcatttttcttctgttacatttaggccctacaccttatctgattttcctttccttttgtaggacatatggtcgagttttactgatccacgtaccgcacaccaggtacattttaactcctaaatttcctttcatgctttttgtttgtttatatctatttatcgatttattgttttttgcacctttactatctatgtacatcctaaccattactgttttatttttttttgcacctttactgtaaaagtacatcctaagccaactaattattgctttattattttttgcatcttaactgtacatgtaaatcctaagcctttaaatgtgtttcatacaattctatttgtatgtcatttgttctcttggttttattaagatcctaagcctttaaatgcatctatttgtaggctgttcgtaccattggttttattgaggttggtaacaaatctcttgtatgggataaggatattggtcctggcgaggatttagaacaatttatcctaaaattcccaattacaaaatcattggttgttccaaacgcacagcttaaattcgttattgagaaaaaacttggaagtttacatctaccctaatgtattttaatgttgatgtttatttaatttttttgttagtgtggaattattaatgtttccctgttatatatttcttttttcagaacattggctgttggtttaatgggcgtattgttcctgagttgatttggggactaaattatgccctggatgaatttgtgcctcaagagaagggcaacctatcaaatgaatgccattttccactgagcaagcaattgcatgagcagttaaaagcatatggatttagtatctcaccacaattagtatgttttctcctttgctaatattgttattattctctgctgaccatccttttattgttttcttccttggtctgttgtgttaccttatttatttatttattgttttgtgttaccttatccttttattgtttaatcccttaaaatatttgctactgtactatctgttgggttaccttacccattattgtttaatcccttgcatatttcttgctattgttgtgttgccttattattttatccttttcattttagattaacagagagtttataaccagtttcggttacttaaattatctggaacgtacttcgaagaacatttccggggatttacaccagaaatttgatcgtttcttttgtggacttgagatgtctgagggagtgtttgtaaaagttgttgcggaccgtctctgttccatggaggtcagtagatttgctaaaagcaaatagtactaataattaagtggtggctactgatgaacaatttattttctttgttttctgtaggaagtggcatcaacaccaggcagacgagaggcattgagcaacgctgaatttcttttgacggttcctaagaagaagtataacacattatctcgtcttaagcgtatggaggcagaagttaggggttcagggccttgggttttcgtagctgtttttgcagtggccttcggggttatggaaggattgcgcattgcaatgaagcgagcaaattagaactgggtaataggaccaatgaggctaaattaggatccgtatatatggtgacaacttttgtgatctaaagtgaccagtaaacaagtactgttttaccaccagttcatatattcattttttttttgcataaataccaacacgcgtcatttactctgagaaggcgaaacgtggtgcacatgcagtgggagaccaggaggaccggtggggaaaccggacaaaaaaaaaggaacggttccattgctcacccaatcgaggagtttctgcacctgcatagtacatggcacacctaccgaggagccgaaaaaaaattcaaaaaacagagccctaccaggctttactatcttattattactctagtaccatcctcttttgacactgcaaatgctaatgaaatttcagaaatcatgtaggtttcagaaaatcccagaagaaaattcataaaacacaggggcaagactgtaatgtagtagatgggtttaactaatatgctctattttttctagatttctgtaacgtaatgggtctaactaatctgatctctttttctagatttgtctactaattgctgatacaacagcatgtactgatacacatactgtaagatggtcaacatgaatcaatagaccgttcactgacagttcttctgagcacatcaacgtagggcaaaatcctctctacatcaggcccataatacagcgagaatatcgcatctgcccgggcgaatgcagcagccgcgcttgcgccatctcccatggaaagctcgatggagacgagcttgatcaactcgtgcgcgatgatgatgtgcctggggtggtaaagcttctcaagaatctgcatcatcacaggagagggtaactcagaagtcagaacaatgaataacagatgtttctatagtccctagaagggcgagtgagtgactccgagtgatgatttgaggaaaaggagaagattattaccttgatggatgcttcacagtgttttcttgcttgttcttgatctcctaccttagcaaaggcctcagcaattgtgtcgtgtgactacagatttcaatatggtagtaaaaatgaaagaacttagatcattcttttttacatcaagtgcaagaaaactcataattaaactagtacaagcaccaaacctgagcaagagtcttgctatatgggtgccttaacttcttaatgcgttctaaggattgtagtgcttctgcaatgaggactttagggacattgtctagagatggaagctccttcaatctgtcagcataattgtcaatttgtatgtgtaaagagcacagacaatggaatcaaatccagcaattcatgtgcaatttcacaggaatataggatatacctggttatctttgatgttgctctatctgacatagcaacagcagaagacaagtcaagttgggatctgcaactcatacagaatccaggatctatgttgaacatggtatcactcttgaaaaatagttttccaaccttcactatatcctcatcaaacttagatacatcctgatgcaaaaagaactgttataccaccaaattactaacaagaaacttttgagaaaagaatatgtgaggagaataatcttacaggtaatgataatgtacagacatgagattctcctatggaaacatgcacaaaattctctttgtgtctatgatgaattaattctgatacagcaccaaggcaattactttgcggacagcaaaatgaattcatgacaaggtctgatagacttagtactgaacaacttgaacacccacaactgaagtagtaattctcccgaagtgacttttgtctctctggaagatccatctcaccaacctgaaaacgagaaacatagacaatgcagaaaatatatgtgctacacgtgatgtcagtatatcacagagggagggaggaaagatacctgtgggccgtatgacagctcgattgggctacctgcttttatatattctgtagaccttagaatgagagtgcgcgaatgaaaatatgcatgtatgttgggccggcacgagtggttgaaaaagctaccagacatgtaaatagcttgagcaaccctgacctaacaatgcaaaactaaacacaggttatagatggtcaagataataaatgagctgcggtgcgataactcaactaaagcaaagtaagagtaatacaatactgtgcctgatattgctatttattgcaatttaagattagctacatgttgtcatgtgtttgctgaatttactacaaagaatttttcaatttccaaattgctatttacctgaacatgattcagaaacatactatcctaaataatgtactcctatagaaacaccatggttggcaacaaatatcaaacagcttttatagggtgatgttactagagaagataagaagaggagacaaacctgttccacactacacataacatcaccactaaatccagaaaacccctttgtcagcgccttgactccatccatggatttcatatgaacaattgcaattgagttgactttaatttgacatatcaaaagaaccaactgcagatatagttacaagaattagcttcttcttcagtaattataaataaatatgaaaatagtgttccatcagttctctacaatctacatcctagggggcagaagtatatggcagaattctgaaagtttaagaaatactccctccattccaaattgatctacatatagtatttttgaggttattcctaaatgatctacatatttgtgttcattcattaagcctattcgttatttgtgcattggagtaaatggacattgatgcatgcatccatgcacacaagtataacccacatgcaatatcttgatttgctattggctaaaaaatagtggggatagggcatgcatcaagtttgatgctagagtaaatatagtatgagagagttattaacttttcttggtcttagtgtacctatgaaatatgtagatcaatttggaatggagggagtactgagctaatataaacaataatgtcaaatctgatatccagaacaatccaaaaaatctgactaaagcagccatcaagctcaagccacagttgtaatgaaacaagcaattgaaaatgtaaacatacaaagggaactcttgaggacaaatgccacatatacctgtgataaagaatcctctgcccacgagacacctgatttataatagctctggaggcataagaacaggacagttgcatatatatgtgactcaaatttgctagcagaagaatcttgatcatagtggtgaacgagatcctgcaacagtttagttcattagttcctgatgtaacagtacttatgctataacatttgagtgcttgcagacatgaattctcttataccagatttggaccagagatggtagatctctttccgaccagcaattgtttctctatgtactgtgccattatccgcccagctaaaactatatcagctggcaaaacagctgcccaacaggcacctccacattcatgcctatgttcagcaatttgtttagagtctggagtcttgctctttgtagaagttacactcaattttgcaatatccaccacattattgttagattctagatgagtattttgattacaagacatttgtcctatagccttctcctggcacctgtttgaacagtaaatgggtattgtacatgaagggcagactacgacatctgctggagcttcactaaagcaatagtggcagtgagtatcccggcaagatttcatgataatctgcatacaactgtacaagtaagaggcatatagaacttcagttcaagattacaatagttgactgattatttaacaatgctcatagagataagctactgccctggcntngtngggtnccgaggagttgctctaggnntcaatggcact

SEQ ID NO: 63230 - DNA, 6130 bp, Oryza sativa
  unsure (1)..(6130): unsure at all n locations
tatgttattctttccaaaagagggttatttccatgctcaaaacaaacttccaaatcatgtatggaaaatgaatagttcctaaaagatgcatttccatccccccttctgtaccatgcctgaaacccataaacagaaacaggtgaaatcatcagagtaacttagtttccattctttaaagtgaattcctgcaaatagagacagaacaaacaacccaagcatataagatgcattcaacaaagttcccaaaccgtattgctaccttagcataattaggtgaaacagaaatggccctgtcgcaatctcgcagacactcttccaaaaggcccaatttctgtaaacttcagaaacatgatcagaacgcatgcactatccagtaatgaggtcagatggcaggaaaaaaatccttagatacataaaagggaataagctgaatataacctattcacaatgcactgtttaccatgaaacaccaccaagaactagaacattacatcaatatgtccagaatgcaaacaggtaaatgaaagactcacatgcatggtagaggcacggttgacatataatgtggctatcaagcttgcatccgttccatcaggactaatcgggaagtaccgtaacgcctgtaacaacagagaaaaacaattagctatcatcaagactgatagattgaatatcaataaaatgggcattgtcccgtgccgatttgttccaaaaaaaaaaagacagatagattgcagtccacacacataaatgctagtactgaaaaggagtgaggatcattttcttttgcaatatcaacgcatcactctttaaaaaacagaacaggtgaacaacaacaaacttcgaacagtaaagttacttctgacttctgaacttgcactcatttttaccaatcgaatcagaacccatcacttcatcacctacacaatccaagcaatcaagaggaagaagaagaaaaataaacgagtaacacaacaaatcaacctgcgagtagaatccaagcgcttgctcgaactctctcttggagaagcacgcattccccttccccttcagctcggccgccctccccttgtccttgcggcacagcgcgagctccgggtcggtcagctcaccaatcacctgccctcacaccaacacgccacgcgaacgataccatcaaatctagccgcacccccccatgcctgggggaagaggaggagcagcggagcaccgagcgacgggaggtggttacctggcggaagagagggagagcttcgaggaaggcgagcaagcgggaggtggtggaggggaggtcggccgccgtgccctcgccgacggctcgccggagctccgccggcaccgccgacttgagccgctccatgggcgagggagagtgtgtgggcttggggcaacaacacgcggcgctcgggctttgagcccaactggatgtattgagcctacgtgggctgagatgtgggcacagtatagttgggcctttgggcaaaggctattcgtcccactacgacggcccaatgaggtgtgcagcgtagtttggacttttcatttgggcccctgaattgacaagtattctccatttgggccactgttgcattttcctactttgctaccttgcttggatgatggatataaatatacagaaaacctacaccacgggctttcgggacaactactatcactaaatatctagcatccttatcctcttctttgtctctttcccttccttctcccttctctctctctctctgactaccagcacgaagatgacgatggtggctagctgtgcggggtggcgcgttgggcgtggagaacgctcgtcggagccagtgcccgccgttgtccccgtcgccgtcgccccaccgccgcggggtcgaggcgacgacgaggagctcggcgataggtgcggtgaataagagggagagtgggagcggaacgtggaggccgctgctggccccgggaacggcgttgccgggcgggagcttctcctgtcggctcaagacctcggccgccgaggaggacgacgacggcgcggccccggcaagggtcgccctcaagctcgcctcccttaccgcgttgctctggctccccgccctagttggtcttctcatcggctgccccaccttgacgaccatcggattcgccgctgcctcctcttccacactccgcttggcggaccacaagattcgccgccgcctcctcctcgtgatccaccacgtggctgccttctcctctctctctctctctctttctcctcctccaagttaccaggtaccaggtatcacggataccaggtacaaggtattaggtatcatggtaccagataccaggtaccagccggtaccagatttcaggtatcaaaggtatcagtcggtaccaaaggtaccaagcaccaggtaccaactgatacccaaggtactaggtatcaagatggagtgcacgtggaagcggagaggagtcacttaaattatcccgttacaacgggatcccgttttgtagccgctctcataaatatattataattataaccagtctcttatagttggattacccaccatggattagtctcttgtagttggattattcccccaccatggattagggtgattaaaccggacctcttgttgtgcaggcagtaaaaggtggttgtgtgcttgttgtgacacaacatttacccccaaatttagctctcatttgagctcgtcagctaattaaatatgtgaagatcaagttgctgcagttgatgattttgaattatggatcattcaatcatgggaaagagacaaagaatggtacactggtaatgatcggactttgagccgatttatatatgaggatcatttaaacatgggaaagagccaaagaatggtaagctggtactaatcggattttgtgagtcaatttatatatgaaaatttctgcagtggacaaaacacttggtactgctgtcataggagttctagaggccttcaagagcatggtttctggtcagcacggtagatttcatagagttgtggtgcagaacattctgaaaaacctatgtgcctatgccaaaccagacagtgactgccaatactccatgcagaaattttctgtagacaacatctcgatggtaagaacacagttttgtacctaataatttagctaaacagattaagatttgatagttgtgttgtttgatgcatacaagggactaatgtttatgctggttaatttgtaggcacttagaactatgtatcagacagacaatcttataggggaggacatggaggcctttcttggccttggtttgcagttcagcaaacttctctgtgagaccgatttcatcgaggctgtcaacggaaatggaatcggcttaaggaattttgtacagaagctgaaattaatcctgaagcaagcaaattcacatagaactgaagcaagcgtacaccctggaatcagaagatccgcaattgagcaggtcatatggatggcgcaactgaagcctgaacctcactgcatcgaccatttcatcgactgctaaatgcgggacgatctggtgatggcgcagcagacagccagaagggcatggcaagagaatttcaagctttcatctggaggcgtctctgtcctggagtacgaagagtcccttcgctctgttgcctcgagggcactgaagctgatcctcggtgtagggatgaaaacggtcggaaacggtcggaaaaaccctctaccatttccattttcattttattttctcgaaaatggaatcggaatggcatactcggaaacggtaacgatatcggtaatgtcggtatatcggaaacggaaccgttggaacgggaatctaccgatgtcggccagaagtcgaaaattcatgtcggaaacagcgaaccgtggtatcatcccacatttaactatatatgaagatggccttataatttcacctttgcatgatcacgctgccacaccccacaacaccgttatatgatgattaataagttgacaataaggtcgacaaacaatataaacaaagttcaacgatacttcaacatcaatgtggctaaagcatacaatgtgggttacatgataggattacagcataactaatattgtccgactttttttagatatagatttgagtcttcgagaacacggcttccttcttcggaattttgtcggaaatttgacggaaattaccgataaaaaacggttaccgacaaaacggtcggaaaaaagcccatatcatttccgctaacatttccggaagagattaccgttttcatttccgacaccgacaatttccgataccgactgaaacggtcggtgcaaaccggaaacggtagccggaattcttggatatttccatacccgtttcacccctacctcggtgagcacaatgcgccggtaattcggccgagctttctgccatgtaccagtagcgaccactcgtgagttcaggggaaatttcaatgcaagccttgttctgtttttctttgaagaatgtgttgaagtttaacacgaccggggcactctggttatatttgtgtttggagtaaacattgtaagccatatgtgctaaggttgttcaatttacatcgtatcgtcgtgtttcacttgaaaaaaaaaagagagagcgagaggaaaaaatagatctaacttctgattgctcatatatgaaaactcagcaagtgcacttctaggtcgctatcacgaaccaacacaatcacaccaaatttctcacacaagtgccaccgatatgttgcaaatccactcaagaatacaagtgctcaggaatacaatcaagagagtagaatcagggattgggaagagtaatatagggaaggcagaagcatgagattggaattagagaaatagaatcagaggaggtagagttggaggaggaagagagccatggcaaagccacaagttgaatatctgttcatcaatacccccaagaactgcagtgtggcttggttttatactcctccttgctgtttggttgggcctagagccagcccagcccatgtacatgacagtcgcttcctgaatacctgcatagtgttcatcaatctgggcagatcggtgagcccaacatctcacagtgaaccaagcctgaatctatttggttctcgttgcattgcatcaaacaactgctcgcaggatcgccggccacaggatcgagattagagagggaggccattggggaatgagagcaaccgggaggtggttgaaaggaagtagcggagccatcataagcgaaacggtatatttgtgaacgaaatgtaatttataagtaaaacttttatatccgtgttcttagcaatctaaaagtaaaagctaaaaaataaacttcggatgaaaagacctcaaaatcagcttcaaatttaaggttaaaaatttaaattttactccctccgtttcacaatataagtcattctaggatttcccacattcatattaatgttaatgaatcaaatatatatttaaattttactccctcgatttcatatatatggtaacattaatacgaatgtgagaaatgttagaatgatttaaattgtgaaagggaagtcgaggcagtctctcgccgtgccctggtcgagcttgaggaagatggggctgggtggctttacgtgcggcaggaaaatcggcccagtggtgttagatttcttgggctggatgtttctggttttttaatgcctgtttgattcgttgccgaaatcgacctcgccaaatttcgttaaatgcaaaaattagttaacatggtgaaaatgttgtttagtttgagaccatactgaaatttgatatggattggcgagtggaaggttcaggaataaccaaattttgatacgaatttataaggttatgagttatgacattaagagtttgtttgggttactgttataccaaaagtaattgtaacacctcaaaccagatacctaaattcaaggaaccctcacatttggctctttgcttttgggttggtacgaatggaaggcaacttcctccgtttcaaggtataatactttctatattgtttatattcatatatatatatttagattcattaacatatatactgaaatgtgcantcttccgaaggatctttgaccgccaccgacgtagaccacctcaaaaaggtcccccctaccaa

SEQ ID NO: 63231 - DNA, 3270 bp, Oryza sativa
  unsure (1)..(3270): unsure at all n locations
tttttttttttttaaaagggggtttttttaaaaaaaaaagtgggccatacaaagatttagtttaacatgtgccaaatgttgtgtagttcgagaccaccctgaaatttgatatgcattgtcgagtgcaannnnnnnnnnnnnnnnnnnnctgatatgatttgataaggttatgagtcataacattaacagtttgtttggttttctgatattcccaaagagtttgtaacacctcaaacaaaatctatgaattagtggcacccacacgtatggctcctagcctatgggttgccacgaatgacaggtacctaccattgtccacatatataactctctagcgttgtgtgcattcacatatatgttaatctagattcattaacatatatataaatatggacaatgctaaaaagtattataacctgaaacggaggtagtactatttgtttgggtggtcgttaccaacaattaattaatatcgatcatgtatttttcatttgggcccttgtttggtagtagcgatcatgaatgtttcatatggcctctagatttcaaccagtatttttcatttgggctaccagttgaatcgctatcagtggtaacgatgaagtgtttttcatgtggaccctggtttggatctagtataggtcgttaccttgttgttttttttttgtttttttttactccctgtaaattttgggggcttggatggatgtattacatgtgcaagaagccaagaactgtgggggttttggtggcctaaccgatcgtctcacacgggcaccgtgttgttaccggtcgataccaaaatatgggaccgatgtgggatgtcaggtcgcacagatgacggacacactcatgtaggtgaagagaggttgtggagaagcatcaagactcgggcattgttcggttggaagaggaaacttggtactgttctgggaggatatctggataaatgggtcatcgatttgttagttggcgccttccatctatgatgcggttcctgcgagatttcgcaatcacaggacagttgcagaagcacttctcaacaaaagatggattcaagacataactggtgccctgggaatgcaggctattctcgagtatcttagcctctggccagtgatgaagtctatacagctctcggaccaggaggattcgctgcactggagatgggagacgtcaggtgaatactcctctcggtcggcctatcaagcacaattcctgggtcgcattcgcttccagtccagcccaatctagaaatctttagcttcaccaaaatatcggtacttcatctggcttgttgcccttaccagatactagacagcagatagacttcgaaagcgaggacttccacatcctgccaagtgtgtcctttgtgatcaatgcgaggagagcattgatcacctgctgatcgtatgtccagaatcttgccagctttggtggatggccctcaatgcgattggacatgcaggatgcttgccactttcagattcgtctttccatctttggctatgtgacagcacgatgaagcaatgcaaggaacatagacggggatttgacaccattgtggctctggttgcttggaccatctggaaagagcgaaacaatagagtcttcaatcagcagcaaagatcctacatgtggccagtgcaatggcggcagaagctgaactttagcgacttgcaagattggcagtgccggagctgcgtttgtcggacggagacatttggtcgcaccatcagttgcgagattagctcctagtctttttattttcatgtaccttgtccccttcattgttttcttaatttccatgtaaataacttttattccttccaaagatgcactccttgcatattcccaaaagacttgggcattgtgcgaacgcttgaggaaatttttggatagctaatggaagtgttgtcaaatttttaaaagtagtggaggtgggtaatgttatggcactaaggtgctgtttggttcggtaaaattcagcccgcacccgattccagcgcaaacagatccggttcccgttgtttgtttgagatgctccgtaattggataccttggaacccattacgggcccagttcagaggcgataccgctcgatcaggagcgataagcgttaacgatacggagaggcaacacgagaaagaatcaagcgtcgcctccgccgctcccctcgacccacgtgtgagaaccaaacaaaatctaagtttgccgtaatctgattactatcacagtgctatctgatgtccttaccgtttacgtttgcaatctccaaccaaacagcacctaaagtttatttggtttgtttcccgtaccaaaacactttaaattaaatttaaggatcacgcatctcgtttggggtgttgtcaatggtagccaactatatatttagttgtctagagtcgctaccaataatattcatgatgtactagtcatttagggcctttgtttgggtcgttgttaatggtagcaatcacgaacatttcatcttgcctcagatttggactggtatttttattttggcccactagttaaatcactatcattggaagtgtcgtagcaatttcatgtggatccccctggtttcaatctagcatgggcaacgacccagtatttttacattttaaaactattggttttgggtggacttctaagcggtcatgtcacatggtacaaagttaaaacctattccgaaatggaaaaagtacgaattacccccccccccgaactattgcggtcgtccgaattacccccctcccgaatcacaaaaccgggcatttttcaccccccccaaccatgcaaaccgaacgaattacccccctcgacccaatccgcggtggttttagtccatgtggcgtacgcgtagcagtccagtcagtactctatttattaaaaaaatgtgggacccacctgtcatctcctcatcctctgttcctctctgttctctctttcactcttcctctctctctctcaaactggtcggtggaggcgtgggggagagacgcagcggcggggtgcgggcggtggcagagcgccggggacggattcctccgaccactggtgttgtcgttgccgaagtttaggatctcgttggtctccggcatgaagaaaggcggtgccgtggcaccgccgcccacgngaaatcagagaagttgagctcccggcggaaggggccctgctgagnnnnnnnnnnnnnnnnnnnnnnnnnnnnnnnnnnnnnnnnnnnnnnnnnnnnnnnnnnnnngagaggagatgtcaatgngccag

SEQ ID NO: 63232 - DNA, 6627 bp, Oryza sativa
  unsure (1)..(6627): unsure at all n locations
cgatgtttcatgaatgacactcgtttcatagnngcgggtgaagaatacccggttttgtggttgggggtaattcggacgaccgcgatagttcaggggggtaattcgtactttttccttccgaaatataggactaatatgagatatgcttaaactggagaagatcggttatggagaagcatcttgtggcattatgcggaccatggatgaaaaatatggatgacgaagggaagcattatcaatttttctcatagtaaagatgggcaagaaaaaaacaaatgctttgaattcaccaacatgaactagcaagtaccaagagtagagaaaaagagaaatctgcatcagatcagccaacggtgtagcatccacccgtcgcctccaccttctcctgcatcacatcagctgagcgctgcatccatccgacgacaccatcgccttcatcagatttgcctccttgcaagcctctacctcagccaccacatcccagctgccgcatcgggtgcaaaaaatagccggcagaggagagtgacgggtggagcacgagggagtgggagaggggtggagcaagaagagaggtgctaggagaggtggagtaggcaggggaggagttagagcgaaatggagaggggtgtcacatgcttgctttactctgttttagaccaaatttaagctgatgtaggtgcttaagtttgcactgagggggtgtacatatggtgaaaaaagatgtaactatagctaaaaaattttcttgaccggagcactccctttggacatgtagctccgcccctaggagcaggagggagtgggagaggggtggagcaagaagagaggtgctaggagaggtggagcagggatggagatagagatcggtggagcgctgctaccctgcgtcgataatgagagagggaggaggcagagggtgaacgagatagagagatgcgagaaggatgagagactgggaggagataagattcaaccatgtgaacgtgaggaaacagagatgacttggtccttctagttcacctaaatatagctgacattcaatgcttctagtgttttgagcacaagtcatttttttttttacaaccgttccgtcccaatcagtttatcctaggacggaggaagtactagtaaactttctgtcactattaacaatggtaccaatcacgatttgtcttatttatgttggctcttacatctagaaatttagaccgccactggttgaatttgaatcgcgtatagcgatcaaatgtttttttcgttgtattgacagtttggctggcagcgacacctgtatcgtttttccattttagtccctacattagattagatcgctatattggttgcgatccaaaaaaattttcattctagtccttggtaatgaactaatggtggcagtgtggcactcgctccgctgctctattcccccctcgcgtccgccgccgacggcgatggccacctcgccgccgcgaccacttcatcgtctcccttcagatggcggcgcaagatctcgtactggtgagcaccggcaggggggcagtagcctcaagacccccccctccctcccccccaccgcgcaacgaaaggcgcgcgccacaggtgttctcattgctctctctctctctccttcctaatatgagtatctctctgccctggagcctctagccctctactcgttttttgtgggggaatgacatagaagggttattggcacattgttcctcagaagaagggggaaaaaagaaagaaagaaggtttttgacatagtttctagactcgtttttagcacgcaaactaattcctgtctgtgaaattttcagtaaccaggttgctgcagttgataattttgaaagagttgatcatttaaaccgtgcaacgagcggtacactggtagtagtctgactttgtgagctcaattgtccaattgatatattagaaattctacagtaggataaaacaataaaatcaggtagtagtgaaaaaaaagagtgatattctaatatgcttctctgtcagttgattttttacgacgaatattgaaatcagggattcaattatttttaccagtgagatgctttcttgacttccataagatcatcatatatcagttaaccataagggatggcttttacaccatcttagtatttatttgggtgttgaaattaattcctatggtgcatctgtttgaattgtgcaagcacacctggaatatgaagcattattggaccacgaaaccatagaattacttcgtactataaaacgatgtattggcttgtctgtttatttctaacatgaatcaaaccagataaggggtcctatcattcccattggcaataagttcgctgactattggcaagctaagtaacactatgacagcaatatactaaatcatgacattaaaacagagtattttattgttccaacagacaagcatgttggcttgtcaatggttttaaatcatgacattaaaacagagtattttattgttccaacagacaagcatgttggcttgtcaatggttttgttcttgatttttttttcttttaaaaaaggatcacaactcagcaatttttttaccaagaaaaacttgagtagacttttcctatttctaaaccagtatcacgtagctcctggtaggaatcactcgtcagaatagataaataggagacaaggatttaacgtggaaaaccattacaggggaaaaaccacagacacacaaaatgatcactgtgttgagaatgtttacattggaactcttttgccccctttgtttggtgtttcttgccctaggcctgcagggccatatttgtgtgttacatgtagaaatagactacgagtatgaccccataaaaaccaaaattaattcagttcattttttaacaacctaactgctttgctgcaataattttggaagcaaaaaagtggagtattatctgatattctgatatgcaggatttttatttatccttgtggattccaaatgctgctacagagatgttggtggtgcattactccggtcttaatgacttaatctcttgctgactctgataagacaacaactttgcagttttcaagtttcaacttgtaaccaatgctgtgttgctagagaatgattctctgtaacaaacgtaaataagatgttgatgcgaaatacaatgtagaaacctctcgctctagcctctaggattggaattctttggtggacgttagatgccaagttaattagcccttcaatgatctccagtagattttgttctaataaagttcaatgttcagcttcattttaaacatcaaaataaggtatctaatcctccttttctatttgatgagatttgggtggggagttcctacctttcaaatttataccaaggttgacagttatgtaaagactccttggcacattgatgtgattgagcattattcgttcataatttccaaatagttggtatactttgcctaaacactaacattcatttccatatgagagtatgacttgattatgtttgagtgctatccaacaactttcagttgaccttgacatgttcttctacttgactacttatactgctatgttttccaactacaatggttcctgcatcctgaccttcacttttcttgtgtttgtgagagccaaacttgtaagcagccagtgctccttcaacggggaggttgcattatcatcttttatgtgtatattaagtgtgtattccttattttaaactttgctacgtgtttcccataaacataaaatatattcttttgtaacaatgaggatttgacactctttaaaatagcatcattaagataagaacaattgtttttcttcttaaagtttgtagctactggaccattgactgcatcacaattgattggtcaccgtttctgataacgaaatggtttggcacctagctcacaagtcacaacttgctccacttgctagaaattgtgatgctttcagctttgtcctagtttttgacgactgctgcttttgcaggaatctacggatcattcagttttgaccagaacccatattgcaatgggtgttctacacacccctctctgagattctcacgggaggtgattgattccaaatcctctgtagtagcagataagtcaccaaactttagggtggagaatgctccttttgcttatcaggaaccatggcgctgcttgaagatcggtcagccattcctatatccttaggtgcatacctcaagctgcagtgagggaacatatgacattgtagtcttgtccggatagagatcaatataccttagcttgcaactgttctcaatgagtagtcaacggatggcgggagagggaagggggaggtgacgtacgagcacacgagggaggcggtgagatcgctggatcaggagaaaggattggtgcgaaagcacaattttaccctcccaccaacagaacacaatcggtacctcctttcgcggggacgcggtaccaccaggtatcgagcaattccagccgttagattgcgccagatcgagtgccaggatatggtacagcctcccctcaaggattgtaaaaagtctcctagtattatttatcagatgtttagtatatgggttatcactctgttaattgcagtttgaccttgacaagttccaagtctcctactgatattttctttttttctaacattttcacagttctactatttaacagacccctttgcatttgaagccatccgttattactgattgagcattacaccttagtattgccataccttgcctttacctatacctcaaggcactcaatcctttcaatggctgatgctgttctcccagcttttctgcaagtgctttttcagaatgccatggagctgttgaagaagaaactggagtttgcttgtgatattgataatgaggggcaaaaactcatgtccaatatggaaatgattcaagctgttcttagaggaggcgagaagatgaagtttaatgatgagcagagactctggttttctgatctgaaagatgctggctatgatgccatggatgtattggatgaatacctctatgaagttcagcgacgtaaggtgatccatcttccccatctgcgtaaccatacattaagttctgctttgaatccttcacgtcttaaatttatgagtaatatggaaaggaagattaagtgtatagctggtaaaattgatgatttgaaaaataagcgcttaaccttccaagtagaggtccatgattaaacagatcaacaacatgaaggaagtatgtgtaacgggagtacctctcttcctccaatttcaccctgtggtagagagaatgatcagacaggattgtaaattatctttttcaactagatttgaagcccaacattgcagtattgcctatactgggtgaggcttatattgggaagacaactgttgctcagctaatcatcaatgacaagcgtgtatcaaggcactttgatgtcagaatatgggctcatgtatcacctgatttcaatataaaaaggatatctgcatctatcctagagtctatatatgacaaatctcattatgacaacctggacaccctccaaaaacacatacaaaagcggctacgagggaaaaggttcctgcttgtcctagatgactattggacagagaactggcatgactgggaggaggtcaagcgtccattgctcaaggcttctgctggaagcaaggttatagtgacaacacggagtggggcagtcgcaaaattgcttggtatggatctaacgtatcaattgaaactatcaattgaaacctctatcaagtgaggactgctggtcattgttccgccgatgcgcccttggtgtggaagtcaaagaatataattctggagatttcctcgataggtaccctcttcaatcttaatctctccgttccaaaatataagaacttttagctttttcttagagagattaaggttggatgaaaaagattatgatgcccctcattaagtgagggatattttttggagtggggaaaggtggttagggataagattgggtgaaagttaactgaggagtaattggtgtggaaagtagtactctaaaagtccttatattttgggacaaactttgaaccccaaaagtccttatattttgaggcacaaggactgagggagtaactagtactagcataagtaaattttgggcacaaatgctaaaacctcggcacctgatgccccatctctggtttttttagatgattgtcgtaacagaggtttttttaatataaaagtttatacagtaacactccggattaataaatactataatcatcagatgttctgacatctgatctctttttttaccccgcagaaagatgcatcaagttttttatagggttaaaagttaaactaatacctacttttctatttaccttttacagagtttatctctaacgccgnataccttttttccctctatcttaatgaaaatgaatatggagatcttctgcatgttctaaaaaaaactaatacccaactttctatacatcagtttttccttctttttttttctataacatgttctatattaggctcaacatttctatgtatttgactattgccacattgtttttcacctgttgcaaaaattgctgtttttcacatatgacgattgaag

SEQ ID NO: 63233 - DNA, 2331 bp, Oryza sativa
  unsure (1)..(2331): unsure at all n locations
tactgttaattttattgtacttagtangatgttagcgtacaaatattatcttattacganttatatttagttctttaggcatttttttatatttcnanacannccnnnnncnatgtgncntttagancnctggtcggacccctgcaataggacngntgactgatcttcagacactgtcaaggtttgtcacaagcaagaggaacattcttgacaaccacagcaatattaaggagctagataaattggacaatctctgcggggaactactcatttcaaatctgcatgttgttaaggatgcgcaagaagctgcacaggcacatttggcttccaaacaatttctccaaaagatggagctcttatggaaaggcaacaacaaacaagctgaacaaattttggagcaactgaaaccaccctccggaataaaagagcttaccatttcaggttataccggcatatcgtgtcctatctggcttggttctgaaagctacacgaatctagtcactttgtcactctatcatttcaagagctgcaccgttgttccttccctttggctattacctcttttggaaaatctccacatcaagggatgggatgcattggttaaattttgtggtagcagttctgccaatttccaagctctgaagaagctacatttcgagaggatggacagtttaaagcaatgggatggggatgagagaagtgcattccctgcccttactgagctggttgtcgacaattgccccatgctggagcaaccgtctcacaagcttcgatcactgacaaagataacagtggaaggatcaccaaaatttcctggtcttcagaacttcccatcgctgacgagtgcgaatataatcgcgagcggtgagtttatttggggatcatggcgctccctttcttgtcttacgtccatcacccttcgcaaactgccgatggagcacatcccacctgggttaggacggctccgttttctgcgacaccttgagatcattcgttgtgagcaactggtgtccatgcctgaggattggccaccttgcaatctgactcgcttctccgtgaagcattgccctcagcttcttcagctacccaacggtctccaacgcctgcgagaattggaagacatggaggttgtaggatgtggaaagcttacctgcctcccggagatgagaaaacttacttcactagaaagactggagatttcagaatgtggctcgattcagtccctgccaagtaaaggtttgcccaagaaactgcagttcttgagcgtaaacaaatgcccatggcttagttcgcgttgcatggttctgggaagtactatctcttcactatggattgacggtgaacttattaggtactagtatgaattggatttagatttagaataaggggatgacaactctgcagtacagagtaagttaagcctcttttgtttgattccgtaacagtttcagaatgtaagttaagcctagtgtgcctcaaatgtcctacatgatcttgtttgtggagaaatcatctttcttctgtaatgtaaagtactgtttcatatgtattaacttggataaacgtgccagcaaaagcacaatgccagaatgggaaccaaaatgacccagtatgacatggtatctttctgtaagacatccttaaaccttgtgttttgttgaactttatcatttgcaccgaaccttttacaagcatgtctaatcacatgtgatgctagagattcgtgccgcaatttcaaagtccatcaaaggttttctggcaaagcaaattacacgaactatctttccattctcgctgtttcattataaaatgttttaagtttcctttcaaaaaaaatgttttaagtttgttttagtcaaacttgttcgagtttgattaaatttatagaaaaacataataatatttataaaacagaattagcttctttatatccacattgagtatattttcattgtaaattcattgtgttgaaaacgttagtacactttttataaattttgacttataacaaacgtaaaggaacttataaaatgaaactgaagtagtattagagcttatttggtaggacgtcaacttctaaatttaactttttaggagcggagtttggagtagagctgtggagcagtcagaaccccactctatcccagtagcctgtaggttatttatgtcagatcattccagcccactccactttattttcgatggagctgaaaccgttaggtgatactccaggttnnnnnnnnnnnnnnnnnnnnnnnnnnnnnnnnnnnnnnnnnnnnnnnnnnnnnnnnnnnnnnnnnnnnnnnnnntccatgccaattcaggnccgcg

SEQ ID NO: 63234 - DNA, 6191 bp, Oryza sativa
  unsure (1)..(6191): unsure at all n locations
gtgtgtncattaggatcannnnnnnnnnnnnnnnnnnnnnnnnnnnnnnnnnnnnnnnnnnnnnnnnnnnnnnnnnnnnnnnnnnnnnncttaagttttgtttctgtttttctacgaaaacatcaccccgtcgtaacttgatgttccatcctcgcaggacctcgtttgccttcaagcgcccctagcttcggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacacttaggagcagccagaggtcacacctgtacaggcaggacgggttggccgtgccgtacccccggaccgactcacgtactctcaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaataacttatgctcacgacaacacactttcggcgcttcacggtagtgtcagatccagtagcgcgcacagtccacaacagcacacatgaaaagcggcagctcgagtgatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctctttatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattatattttaccagtcttggagattttaatcttgtatagttttcaatataaaaagatttgataactattgatatttatacaaaaatatagagcacagtataaaatcgccctaccctagggcggcaagggggccgcctgcaaaattccatgccccccctcgccgcccatttgcaggcggccccccgcacagtataaaatcgccctagcggagggcggcaagggggccgcctgcaaatttcgttgacggccgtcgcccgagagcgaacagccggctgccacgtcattttcgccgccctctgggagggcgatttttcccagagagcggtaggcgactacttccgtcaatttttaaaatggaaaattatttttgtaaaacttttaataaaaaaaattctagtcctactgtactagttacccgtggaagcccgatagttttgcacccgggcctcgtcgtctcgtcgtggtcctttcctctcagaagtttgggccaagccgaggcctaaatcgttcttgtttggaagcccggtagcccggtattgataggcccaaccatgtacagaacaagagtacaagactaacaagagacttgggcccgtttgattgtttgtctggcgttaattttcgcgaactgctaaacaatgtttcatacaaaactttgtatgcataatttatttaaaagattaataaaaattctatctgttagcttctaatatctattttcgcgaactgctaaacaatgtttcatgcaaaactttgtatgcataatttgtttaaaagatttaataaaaattctatctgttagcttctaatattttctttttataaagttaatactcattaaacacctaaaatttaatatacaagcataatatttattagtaatcctaaaatttacatacaagcatgctacatcaattcattataagcacacaaacctttccatacaagcatacattaattatatctacaatttatttcattctaaaactaaacatacacatgctaaatcattattttaataatattttaatccaaatcatttttctattatctaacatatatcccgcagtaaaacacgggacaacttaataattaatcatgcactaatcgtttcacgatcagctcgctaacacaatcgaacatttcgcagctctttactttccttcggcccaattgacagataaaaaaaattggcccagtgcggtctgaatgattacacaagtgcgcccagaaggcaaattctacacatgactacgtcgctctacgtgtacgcctttgctcttagtacacggaacgtgagccttgcggcggaagtagaagaagaacatcattaagaccaaatcaggatgagcagtgaacaaaaaatatgttcaaaaaaaatccacataaaccctcgcttccgaaaaaacccgcatcgccgcgcggagcaaagcagagagggggaggaagccgccgccgccgccgccgccgccgtcgcacggggggatggagtcgacgccgaagccggaggacgggagggagctctacgcgctgctccacctctcgccggacgccttcggggaggaaattcggcgggcttaccgccagtacgcgcaaatctaccaccccgacaagtaccaggacccccaggtacagggcgctgctccgcttcctccccccatggccccatctccgcgtcgcaactttcaattcgatcggctcgaagtgctggctggcttagggttgcgcgccacgcttagctccgtgatagattttactgatgaaacgccgatcgattgactcgtcaggtagttgcgagctgtattgggattcggttggagtagttagttttcaccggtttgatcgggtagtgcccggctaggattggtagttgattggtctcgacactgaccttgctgcgcttgtttccagtgaatttttcacaagtttgcattgagagacggagtagagatcaaggggaagatctgggcaatgtatgataactaagggtccacttagtgctcatgggagatcattaggagaatcagtaaacatataagatgataatgggaaatgctgataatttctaattactgcttgtgccaaattgcacacatatctggtctgtttgaactggctatatatcatttgcaccagtattatggtctgcaaagagattaacgtttggtagtaggcattgctctagtgccatgggaatcggagagataccaatatgctaaattcgtctgcatttcttgcttagagaagctgcatatctgaatagcggcaaacatgttcatttacttcatttacaaccatgttcgatggaacaatccctgatgcttttttttggttcagaatgaaagttagggagggatgtgacactaaagtaccagccttatttaaaagagagcgttatacttttgtgaaccgatttatgaagattattaagattaatctagtgagtaatcttgacgttaagtccaatcttcagcttcttcatgcttcacagatgcattcagatgtttatagtgcaccatttgattctccaggctccccattttaaacagtaatttgtcctaagatagattcctgcttctggtataatctatattttgttgaactaggaataaccctttgttttacattgatgagttttttttctgaactgactagtatcctccattttcatatgtgtttgtctagatgaaggatgtggcaactgaaaacttccaacgaatacgtgatgcatatgagatactatcagatgagaacaagaggcagatatatgacatctatggtatggaaggtttaaattctggcctggaacttggccccaagctaaacaaaccagaggaaatcaaagaacagttggaacggctgaagcggcgcaaggaagaagagaaatttttagcccatgctcgacccactggctcaataattgctaatttttccgtgccacagtatttagatggctatggaatcatgagagggtacataatgctttccattatattttgtgtcttctttttttctgcagccacgtgcaatattgaagctgttcacatagagtgaagcaatcacctagtttgatatctctcgaactaattagtaattctgtactcactgagctcatttattaatttgtatgcttatcggtattgtatgtaccgctccacattcttcagcatgttttggtgatggcaacagttattcagcaaatggaaatgtttttttagtgaaaatattagtagtgcttccttagaaatttgcacttgttgtttcctttccggctttaccagttcccacccttttatcttatgtcaatcctgagtgcttagaaacacctaggttggagttactacctccagcttgcaagtacaatttacagactatcatgttggccaaatttcgttgatcgcggcaattgcctgcttgtgaaaaagctccccaaagctctggctttagttctgaaaggattataagctgattttgatgtatgcatttttttttaagaattctcagtaaggctaaatcagtatattgtactgttcccatgaactaggatggcagtttaccaatttatttataacctgtagacatatttatcaagtacccttttgtatttcaattcagcttgatacttcccatattcttctgtagctccattatttaattatttgatttgaaaatgggcagcatgggaatgtccagtgaagttcagttgccagtgtccaagaaaaatactgttgttgttggtggaaatttggttgtcaatggcacagatggaactggtgcagcaagcgctgtgctgcgtcaccagttgtcttctgtggcatcagtagagtttatggctacagctggactacgttcccttattagcgtacaaacatttcggtaagaacatgccattttgttttacttctattgctacttgcttgcatattgcaaattataattccttgatcgttatgcactccagtcaaatttcaccacattcgacagcaacatctggacttgctctttctttgagagatggatctatcaatctatcaaatgcctggactcgccaactatctgacaatattgttgggaatgtatgtccctttattcttgatgctcttttcagttttctgatacactgcttatttcctatacacaactaagtaactaataggctagcaacttagcaattcaaaaacatggtaacatggatagattaacatataaaaagagcacggataatatgtgtacaatctgtgatgtcaaacgccgttgctgaaaaaattactcgagttctattcccaccctacatggaaccatgaaactgatacctgtttattttcaatatttgcagagcctcctaggctccctgctaattaaggctgcatagtttttaggaaaatagcacatcttttagtgccccccacccccatctttccaaacatgacttttggctccatgtttaattcatgtatagaacaacttgtcaactgttcattttacatttgatgcatattatagacactatacatctctttctggataagttacaagaatttttcaaatggcataaatccaaaatgagttttatgtttgctctcactgatttatgctctactaaggctgtgttcgcatgcaccttttcccatcccctctccctcgttttccgcgcgcacgcttttcaaactgctaaacgatgtgtttttttgcaaaaagtttctatacgaaagttgcttgagtngcagtgcaattcaatggccac

SEQ ID NO: 63235 - DNA, 2981 bp, Oryza sativa
gtatttttatgtaatgtacatgtcaattttgccacattgttgttcgcaacataggttaaatacaaaacctacttattttgtgttggtaagctgatggtattttcttttcctgtgtccgttactcgattttgcccccaaactccagatacagcttgcccttggtacagactcaagtatttctgttggatggcaaaagaaggatgaaaaaaattctgcagcaggggatgtgaaggtaattctgaaacaactctgttatcagctaagagttgacatatctgtttggaatttgaagtacttgccattttatgccctcgcacaatttacattgcctggttggattcatttttagtagcacgtagcttcatgttgtttcgttctgtagaattcacggttttattttctttcaaaacagtgccctgtgtacttttatccatgacacttccgaggaggtgtagttacagcatctattataagttcgccgctgtgttcttacttctgaagctagcacagtagttagtataggagtgtttctaagcaatcagcagctaaagtaaccagctccccatggttgccatatggttcattagtacttacagatatctggaaggtcattcaattttccaagcaatctcatcactaaattaacagcacctattctgtgtaggactgtagggccttgaaaattgagaaagttacatctctgataaattgtgaaaaacaggcttcacagtgattataatatatataccttgactgtaatgccttcaagaactaattgttttatagattgtttcactttcttacatcaggcaactatccgatgcttgctttttgaggacttgtattaacaacctagcctttttctttccagcttggtactaattattttggtgcatctgctcattacacccgttatttctccaccaagtctcatggtcgcgttgctggtcgagttggaaggtgtatactatttgatttcacttatgtatggccgtattgcattttttgaaagccattacatgagtttgtaacccctattcctctctcttgaactgttttcttgcagcacggcccttgattttgaaattggaggaggaaggcggatatctgagttcagtactgtaaggatgatctataatataggaatccaggtgaagtgcttgtttcttaggtctcatgtgtttggtgggattttgctctaatctcttgcaatatctgagaaaattctcttggtattttgctaccatatcaccatatcgattctgttgaaataccttgtgttaatgctactccctccatcccagaatataagtattttagagttggacacggttattaacaaagttggtatgattaaatgggagagtattgtgattggaggagaagtggaggtaggtgggaaaattgaatggtggagggttgtgattggttgagaagagaatgtcgatagataagttgttatattttgggacaaattcaaaggctagaagttatattttgggatggagggagtattttttttaagacaatttgattttggataaacagtgttgtataggctgtgttcgggaggaggggttggaaacccctcttctccgggacgcaaaacgatgtatacattaacgcatgattaattaagtattagttttttttttgaaaaatggattaatatgattttttaaggcaactttcatatataatttttttttgcaaaaaacacaccgtttagcattttgaaaagcgtcgtgcggaaaacgagagagatgagttgggaaagtgaacaaaagaacccaacttcctattctatttaggtccgctcctgcttttgtcctttccgaaggtatccctcggggggttaaaacatgactaaacattggttccttattgatgatcacaataaatataggctaattctcctcgcaaaaaaaaggctaattcactttatctcctgagtcaaagcaaattaataaacttaattgctgcatttatgcctatgatatttattcatggataacagtgcaagtaactcatgcacacttctatttatccacaatggaaataaacattttaatctattgctattactctgcgatgagtttgaaacatgtatatggaattattgataatgtattgttgtgaataaataattaatgaatctttattgttcttattcatacacatgcttctagtatgaatgattgtgagaaagacagaaagcatcctctgcagtgtttataatagctctgtaatgcactttggagtatataacctcttaggctctgttcttatctccaagttcccaacccatcttcctcgttttccgcgcgcacgcttttcaaactgttaaacggtgtgttttttgcaaaaaaattctatatgaaagttgcttaaaaaaatcaaattaatccatttttgaaaaaaaaaagctaatacttaattaattatgtaataacgcgtgcttcgttttgcgtgccggggaggagccccttctctctttttcctaagctccacaatccttcttatcacttgttttcccctttttgtcctctactgttctcactctactctgctcttctccatccccctccccagttttcctttccgatcttttttaacctctacaccggtttcctcttagcctaaatatcttttgtctctccgccctcccccaactcagattgccccatctctcgtaacgattaggctacttctgtcctcatcctttcccccaaaggcccgctatccctctctattgctctcccgcttcctcctccccttctctccgctacgtgcccttcttacattctggcattattctatccttcttctccgtcatcttcgccctcccttgtcttctctcttctctgatgcgggtctaacctaattcttcttctttgcacaatgacttatagctcttctccttaggttcgcccacatatctattcttctatttttgccgctcctcctctctgctctctccg

SEQ ID NO: 63236 - DNA, 7730 bp, Oryza sativa
  unsure (1)..(7730): unsure at all n locations
ntggccaggtcattggtaagaaaagtccagttgcacttgttgatcccccgagatattcatcaaattttgttttgccgctgatcccggaccaattttgaacccccatagctctcttcctcaagattttttcttcttatgataagacctttcttgttatccgctgtttttccctcccatggtccattatgttgtatacatgcgagaatttgttccacttaaattgtagataccggggtcaggtccgaccaatcaatcagtttcatcctttcaaaagtttgaggctttaagttccatcttcagtgaaacgatcatcctttcatttgggccttttttgaacataaaagagnccccctcctcccgaacgcagccttagggatgttttcatcatccaaactaatggtatggtcttcaacagtagtttatggcttatgatctgctatccactacatataaggatccaacatcaaagatggcttgttctagcattgatgggttttatgtattaatcttggaatctcatgtatttgttgcttgatacgttttggcaacttttatcttcctgtccattttgtactctgaaattcctccatgtatctaatgtagggggtctcttggagattcgagttgcatcgtgctggtcaaaaattagttatcccagtaagtatctgttctactcctgagtcctatctggttctaatattttttgtttatcaaatattataatgcaggtacaggataaaagcatcaccgtgatacaaatctattttatttttcactgttgttgataattttaccccttcaataacatatgattccatgtataatttctttttttaggtttcactgacttattaaataattgtgcaggttttgctttcaactgatttcaatgcattacttgctaccagcgtttttgctattccttcaacactatattttctacttcaggttatcaattagtcctatcctatgttcattcttacccctgatttttttttttttgttgggaggattttcctgactggaatgtgatatttgcaactcctagcattatctcacatttgttacctttgctgcatcatcagttcactaaatgcaaattgtgcctttttattgattcacagacgtattttgtaaagccatactgtcttaagcgggaaaagcagaaggaacttgaaaaaatggaaagtttgtcttcacaggtaaaccaaggttgtttgtgtcatttgtattcttacttgtattagacagcttatgtacaccagtgcaaagggcggactggaagtttactagctggaaccttcacatagttttattttggaattagtcacccaactttggttatcacatgccagttcagttaaatctatacagatagatactccttccatctcaaaatatatctactatatttgaaaatgtagttttgcggcggagattaaggaagtaagtggaattgaataggggatggttgtgattgattgagatgagtggtagttggagaagtagctatattttgagacaaaaattgaatgccgaaggtagctatgttttgacggagggaatacatgtattagaccttccattttttccatgatggaacatctatcttttttttttttttgaaagaagaggacaaactatcttgtggcttctctttatcatagctcctctgcaatctgcaactgcaatgtgtctcttaactgcatgcccatgttattttctttgttaaattttatttaaacaaattctatacataaataaggttatcaagtgcttagggttccttcttgtatagctaactgaagccagacgcgcagcgaaaaaagcacaaaagttactagaacctgtctcaaatcgtaagaagaatagacagctggaggatgatggcttggtgattacaaaagctctgtatgggaatcgcaaaaaagttaaagagagcagcgaatcaaatgagttgaatgatgatgtggcttcgcaagtattagacgtgaccatcccactgaacttcctcgtctctgaggcaggccagctaaaggtatgtgccaatcacatataagtttatctgttaatacaaagctgatggtaaacaaatgctataatatgtagtttattttttgcatcctatctatccttccttttctggctagtaattccactggaaaatcaacaatataatatggtacctgcgggctttaacttgcaaatagacagggattacctgttatatattcccaatactaggctatgtttaactctattttacctttgtagattgtttgttcattgtagtagctcaatacattcctccaaagttaattaggtttatacgtttgatcgaaatatggttgcctgacaacaaatttccaccacttgcagcttcatgaggggatcaagaagtctggaataatgggcttctacgatccttgccctggtgatccaaagctgttacttgtagaatacacatttcatggtcagaaatacaaggtagagaataatctgacatccctttgacataccatgtcgcaacgctaggtatgcggatttgtgcattcctacataaagtccttgactctctttctgttggcaggtcatggtagatgattacgctgcactgttgataccacaagatattcatcaaatttgatctgccgctgatcccgaacaattttgagccccatagctctcttctcatagtttttcttcttctgatgaggcttttctgtttttcgctgtttttccctcacatggtccattttgttgtatacatgcgtggatttgttccacctagattgtagatacgcggggtgagatcccgacagtcaataagtttcagtcaatcaaaagttcgcgacattagttcaatcttcactggacgaaacatgcactgaactgataatttctttatctacgaagatgcagctgtcgcctttccacttagatcacagccaaccctctaacacatgcatctgtttttccttgtctgcgagcgtgcgacaatgtgatactctgtttttgtcatattccagttttgatccgtcagctggtgttcaggttctttagccaccgccagcagtgattttcaagaattccctttcttcaccattctcacctgttactaatataaactcatcataatgtcggtgttttccttgttttcctatgttgtgttctactttgaaattgcactcctgtgttcaaatgcaatcacttcaatacagggtaaagcgttttcttgtgaatcatttattcatttggcccttcatttgtcaggtaataataataatttttagagtaaattgcactcattatacataaacttatgatgtgggtacaaataggtacaacaacttgtaaattactcgttttagtacaataacttgactaggttatgcgaacatgggtcaaaataatccacacagataacctttgcgcgctagtaattgttttgttttgaaaaataaaatccgtactctagtagtgcaaacagcctacaagagattgtaatatagtaattactgttgttgattgatatgttcaaaattaagctagtgtgcttgcgtctgcacaactacaaacaactgatagcgtgcatatgtctcacactggttatctggtactacacattagatcaattttgcatgtgtgtgttgttttgtactaggttcgcacaaactagacaagttattgtaccaaaacgagcaatttacaagttgttatacctatttgcacctaccaagcaaattcatgtaccgcgagcgcaatttactctaatttttatcatgtcgatcaccaaccacatgcttcatccgagattagaatagatgcagactggggagaaccaacaaaatgttcagcgtgtgcactcctcgatcaccaaccccactgctctctgaattgacacatgacaccacagtaccacacatgcaaatgcaagcgccttctgttgcgttgcagctgcctcagctgcctctgcctccgggcaccgaagcaattaacctgcaaacaaaaacatggtttaggtgaggccaacacatccatcttgctggatctgtctctgctcctgcttggttttcttttcacagggagtccatcaggattcaggaacacaacatcctctcctgttgcgagaccggtgaacacatcctgcattcctgctgttgcgtgctcgtgcaacagattagatgctgtcggcgacagccgaagttccatgggcttactttgatttgctagttgctactctactgaactccaatgaagtaaagttttttttttatgaggcagtaaattaaacactcaatcaaaaatactactccccccgtttcacaatgtaaatcattctatcattttctatattcatattgatgttaatgaatctagtcatatatatatctatctagatttattaacatcaatatgaatgtgaaaaatactataatgacttacattgtgaaatggaggaagtacagagccaaaattctaggacacacatctattgtttcgacttaggccgtatttagtttcaaagtttttcatcaaactttcaacttttccatcacatcaaaactttcctacacacacaaacttccaactttttcatcacatcgttctaatttcaaccaaacttctaattttggcgtgaactaaacaaagccttacctaatgcaattttagcatcaaatcaaacctgtccattttatagtgcttgagttgaagctaccatctttttttttcccgattcatgaaaaacagaggcatacatcacttcgcatgcacaacaggttcacacttttaaagtaaagatttttttgataagatagtaaactgaacacatcattaaaattattagtaccacagtgccaaaattctggtacagccatatgtttcaccttaccaaatgcaattttagcattaaaccaaacatatccattttatctcatctttatcaaaattttatagtgcttgagttgaacctaccaaaaaaatttattcatgaaaaacagagtcatacataccactacatacgtaaaacagatataatacgtctcttaacatacttccagagcgaacattaaaattttgaatagtcatacttatatacccacgactccaccaccctactaatgatttcttcaattctagtagggcaacaaacccaatatctaatctcgcgaaatatagattttttttatttctacggaaatatgctgcgtccgcccagctaatacattcctagattgttcagaccagatgaagacttgaggtctaagcaagttacgatatttaagtagactcccgatgcaggctacatcaaaagctactggatttagtacagtcagtagtagcagcgtgagtgacatatctttgttaattgatcatcttaatgtaaagtatcttcaaaaggcatcctttaaaccatagcttttgtttttctatttgccactccctactgtttccggatcattggagatacttgtatgttcttagtggggttcactccaactgattcggtactttgttcctgttcttgttaatagcatactcctgtcatagaacaaaaaatattttttactgtacctccaataccgatcgagtgctcacttgaaataccattaccactgcttgggtaaaaattatacagtttttacatgtcttaaataggctagaaactcaaggctagacttgtatggtaacggggaaaatcgtattttcagttatatgccacaatgtatatagactaagtagttcaatatagattgaatccacgtaagtgggttgttgttgttcgaaataggatactggattaagttaaaacccacaccttaaaataaatcgcattcaactgccaatgttccctcacgagagaggtgaaatataatgcatttttaattcatgtgggtggaccatatagctagagatggctatcacatttccttttctacttccagcttttacattgatataaattgctcgtctagagctataagggttatctttttttttcacattatggatgccctaatatgatctcttgttctcaaaattacttaaccatgactttgtttcttagtgaggctagagatttaatgttagtctctattcctctaaacacacactctatgcgcacgtgtctaccatataatcataaaagtgagagagagaaaaaaaacggaccacctcttttaaatacagctaaaacttttctagccatatacaaatacacccaaaccaaacaggaggccgctccccttcatcgcatgtgtgcagatctagtacgcacaatcaagccggaagcaaagcaaatgaagaggagagagacgcattgccacccaaaccaagggatctcgcagtcgcagcagcatacggaatgtccattgcgccgcaccaaacgcgcattctccagtgcagccagccatggagctatcgatggatggatggatggatggatccagctaagctaacctcccctcctctgctctgcctgtcgtcctctcctccagcagacacgcggccgctcgccttcatttctgctttgacaatggtcaaatgctggggtagcccgttgctgtcacacgcttgcagcgttcagtattccggaatgttgctatctaaaatatgatttagtttgtcttaagacaatagatctaggcaacgattctatccagactagttatctttcgttcagattcattgttttaggatgaaccaaattttatcttagatagtactatctctgtttcaagttataagactttctaacattaaccatatttatataggtattaatgaatctagacacatatatatctagatttattaacatatatatgaatattagtaatgctagaaaatcttataatatgaaacggaggaagtaatattttaggacagggagtagtgacaatcacaacctgtatgaatgtgtgtgattagattaactatggtttttacccatagtttagtggtaatggtcctgcatattaagtatatcacactatgtgctcttaaccttttatgataatactgaagtactagtagtttagtacaaccaaccactccaggtgaagaacatgagtcaaagaaggttgagaagcatccagccatgcacactcatgctaagctcagctcagctgtaaccagtgcagcatgcgtccgtcccactccaagccttccccgagcctctctccccccgatcccgacctcccctgatcgatctcctccctcctctactgtaaacagcacatcaattcagagcaggtctcactcttggaaatttcagttgctactactccacatcactgctcaaattcagaatcccaagttcccaaccaatctactatattctcgtctcaaaatagtttcatttttcacccatccagcacataaaaaaaactaaaatatccctactttatcaaattctaatggctaatgcaattattcctctatttcatttattctctatcgttataaattccgatacaatgactattaaaaaataagcttattttagaacaaatgaaacagataaaaaataaacgtattttagaacggagggagtacttcatcaatcccaaaataagcaaatttaggccaaaatataatattatctagtacaataaatttgaatagaaatctgtacagattcgtagtactaggtaatatcttatctaatnnnnnnnnnnnnnnnnnnnnnnnnnnnnnnnnnnngatactcaacnctcaaggccgcg

SEQ ID NO: 63237 - DNA, 6752 bp, Oryza sativa
  unsure (1)..(6752): unsure at all n locations
ccggcccttgnnnnnnnnnnnnnnnnnnnnnnnnnnnnnnnnnnnnnnnnnnnnnnnnnnnnnnnnnnnnnnnnnnnnnnnnnnnnnnnnnnnnttgttctcggtcacacctgaactctatctgaagatcttgtcgaatcatgttgatggccaatgcaactgagttaaaatctacattctgattttggtctgcatcagtgtccatgttcaaccgagctagtatcttcttggtcacactcacacctgaactcttatctgaatatctcatcgcatcgcatcaacggacaatgcaagtgaatttctgctgcatcaatgttcatgcttaacttctgctgctgcagatttgtcatctgtgaactgtgaacagctggttcatcagatgcagttatatcctgagctgtgccaatacagactagtagtagtaactgtgaatgagacaagtaactgtatgattttccttttcctgcactctgacctgttccaaaattaatcttttgatgtgctttaactgatgaactcttctcccctcggtgtcctttccaatgaaagaaacaaaaccgatgaagatggcatccatatttttgttgaaagaaacgaccttcctcagcaacagcaacactgcaaaacaccatccagtgtgagctgaaaagtgggtaaaagagagtgaaacatataatctgatctctaaacaatcagaattacagaacatcagcttgcttcaccactgaccaagaaacctaattttggagtcgatttttgaggttttttcatcacaattttattttccagcatttacattcaaatttctaagaacacacatataaaagttttataataagcaaaactatgacacaactgcattgtgattgaaacaagaaaccagccttttattttgccttttctcccttcccctgtataagtcggtctggctgattgcgttgtgtaactataactttttctaatatattgacaagtaattcttttgtgcgtttgtgaaaaaaagattgaaacaggaaacagtcctcccattgccaaacatttctgtgtatcatcatcaaagcaggattgctggaagcctggaactgtactaggctactggctatggtaatcagtcgctgcagcatggtacagtacaagttacaccgcgtgtgccagttcatcttgcacagtgacaattcatctgccactcatcactgtgctctctgcacttgttctgtgtaggccatgtccacaacaaccctacatcctcaggacacggagccgctggttgcagggagagagacctcttcttgttcagtgcatcaagatctgtgtatccctgtctctttgatccggtacactcccctctaaatgcacacatttaataccaggaccagcacaacatctcgttacactacagcatctgcttattattatcttatcagccgtagccaaaattaaaattttgaaacagttatagagcttataagccactgttatctttttgccatacagcttataaaccggcaagccgttggcatcttttacactacagataaggctcccatttttgtcctacaacttataatccgctgtcaaaatttggatttttaaactaagttgatattgatggtttttcattgaactttatttttcagtattggcttttaaatcgttcagcgttaggtcatctgatggtagtataactttagtttattttgcataattggttttagaaccgttagtaaaatagatataaaagttttacgtataaattatttttagttgtttttacggctcatcaataatggacgaaggctggagtagcagtaaagcagatgaaaaggatcattgcatcagtatccaagcagaactggatgatctgatcctccctctctcacccaagtcattgtcattgtcatatactaattgccagtgttaaacccaaaacaaaaattatcgggaatcctatgcatgtcataacacatatataatactctaatttttaactaataacataattattataagctaaaacagctaaagaatggaattctatctcctgtgacccagactacaatactgtaggagcgccgctgttaattgccaaggcctgtcttttttttttttttgaagataatagaagctttatttagactcagttaattacatcaagatgatacaatcaaactgagtcaccgccggcctctgcataaaatgcacatagccaaaaaagaagaaagaaacaactagaacatctcccaagcacaaaagtttaacagaaacatatatcttagtggctatcaatctgtagactagaccgccacccatgctcctgggtaaaaaacttctgtgccacctggtctaattgtcgagataccgccgtatatcttagtggctatcaatccgtagactagaccgccacccatgctcctgggtaaaaaactcctgtgccacctggtccaaacgtcgagataccaccataatagtatcccgcagtcccagttgatggaggatagcccaggtacgtagcgaaggcctgtctagattagcaacatggttttccaagcccagccttttaggcccatgagcattcttggatactctaacaaaattatgaattcccaaccatgaacagattcctctgaaaaaaaacgtgaacagattcctctataaaaacatgaacagattgacattacaaacttacatccacagtatcagagcaagagacagcacagcggcaactctgcagttctgcaccgaaagtttcagtcttgtcatttgaactgcatttcatgtctcacgtgtgaatggctgtgatcacttttactccataattacaccaaaacctccatggttaagtccccctctatacacgctaaacggcccatcagagtttgcctttacaataagttgagaatgatatggaatttcggcatattcctcttcattttttttaaaacatagtacaaatacaggcgcttataacgcgcgtaaagttacccctatgaacacacacgtgcatttcttcatccaacttcactggatcattactgtacattatctgctctacgtctctaaactatgttctttttttttaaaaaaaaagatcgattgtattgcttggatcacttgctctataagtttactttttataatatttaatttatatctataatcgaatgggtcgttattaggtttcaaattttagatttaacgttagtgtccatcaatcatttttctttttttttgatgaaatgtccatcaattttggaatgtacactgcccacacgagtgcgtgtttagtgcatgatgtatgagtccaaaaagtacatgtactcagaaagaaagttgagattagatgccaccatccattggcagagcaagcaattagcattcagtaaagcttctttgtcatcttacctggcgattgctatggacacttcaatcagcccttgtttatcttcataactttttcttcaaacttccaacttctccatcacatcaaaatttttctacacataaactttcaacttttccatcacatcattccagtttcaaccaaactttcaattttaacgtaaactaaacacaccctcagcttggccttccaaattcaatgtatagtatacgtaaaccgtggtacagatttgctattaggggccttggtttttctaagtggctcgtaattgatgatactatatgtatgtgtgccactgccagggtttcgaaataccgatcctcgctcattagcggttttgttgataaccgtgattactactcgtcctcattgacaatttcagtgaaattcagaaagggactacctactccctctgtcccaaaataacttaacctgtgatctatccgaggagaacgaatcttgacaagcctttgtccagattcgtcattttaggatgggccacattccattattttgggactgagggagtacgtccccatatcacaaggtctgttaattttaaagaaaatttagaattttatttttattttattccaagcgaaaaaatggaatatttagcacatgagaatacacgttcatatcgtcattgtaaactgtattttatatggttgccataattattatcaaacttatctaaaaaaacaaatacgatataaccgaatcaatagattaagaagagggaaatttttgaaaataaatgattgatatcgaaaacatattgaaacacaatggcttatattgaaatatttaggacccctgtgtgatcgaacaattggcacatggccatggatggccttggagaccggacatgaatttgatacaaatttggtgatcgatttcatctctaaatgtttgtcgcctgccatttatcttttgaaagaaagcttaattttttttaaacttggttaggttaaccgagcggtatgtcaatatgaactaccttgacaataccaatacccgtgattatcgtgcggttagcatcatattttcaaaccctggtttatgcctttaaaattgttgacgtgaatattagtggttcgtcgatgatgtgaaataaattgacaagaccaatacccgtggttattgtgcggttagcctcatattttcgattttgtgcatgtaaaactgttgacactgacacataattccgttgaagtgactgacaagctagaaaacatgagaatgaactcagggtgtgtttagtgcacgctaaaattaaaagtttggttgaaattggaaggatgtgacggaaaataggaagtttgtgtgtgtaggaaagttttgatgtgatagaaaagttggaagtttgaagaaatagtttgaaactaaggtggtgtttggatacatggactaaactttagtccctatcatatcggatgaatttggagtaataagcatagactacttataaaactaattacataaatgagagctaattcatgtgacaaatttttaaagcttaattaatccataattagcacatgtttactgtagcatcacataggctaattatggattaattaggctcaatagattcgtctcgcgaattagtcgagggttatagaatggattttattaatagtctacgtttaatattaataattagtatccaaatatccgatatgatagggactaaaaggttttagtcccatctaaacaagatattacactcggcctcagaaacgaagggagccggaaaaaaagaaagaaagaagaagtgatgggaaaagagtcatggggaggcttgaaatgggaattgggaagcatggcactcttgaaagtgttctcttgacctatccttggacaacaccatttgcacctagatccatcagtgtattataacgtatgaacacgacccggttttctctgtctcttgagatgatgtatgaacatcttctatttattggccgatgtgatgccaacttggatgaaaatgacctggtaaccaaaactaaaagagaaaaaaaaataaagaaagaaagaagagggtgtcattaattttgctgaacattataatttggtagtgtgcttattttcaggacaattaaacacagtgatgctatatgccatttgcatgagtatatatttatatagagactcaatcttaatttgattcatgtgtggcaattggttaccactgctacagtaatatcacatgacaaaaacgtgaggtatcaggtgttttgtccctttttttcttgtcgtttttgttcattgaatttgggttggttgtgagcttaatttcaacttgttactagtggcggagcctgagcgaaaattgggctgaatacaattgaattggaaaaaaaaattattacgcaaaaaaataaaatgggtctaaagaaagagcatatgtttaaaaaataatcccgtaaatggacgaaaaatagctatcctccatttagttgagaattaaacggccaccaactacagaagacgtatagtagtacaaagagaaaaattgggcagaagtatcttaaataggttaggaatgtggaccagttaatggtgaaatgctgaagaatctttaggatcacaccattaaaattgagtatacacaaagatatttagtaattatgtacaacaagtcagagaattatttcagaaaaaaagaaatagaataaaacaaaacagcccaatttcttctgcaagtcaaactgaaacttgaagagtacgagtgtcaaggtagaacaagaaaatgtacaactattttgtcaaagcaataccttttgtacggttaacatctctagatacgtctactaagaatcatcaaaagtgtaaacctttttcaaaataacttttatccatgactatgcaaaaccatctatctctctttaaacatgactatatccacacattagctgatcggtgaaggtcgtacgccttttcaacatttacattggtagaatagtatttcgcggtagtttacctctgaatatttcaaaagaagtttacccataaatacatcgataaaaatatgtactccttccgtccctatgaataactcactttagatttttttttccaacatgatcgtctgtcttatttaatttttttataaaaaaatcagtcatcatatataaagtactatttatgttttatcataataataataatataataataatataataataataataataataatttttaaaataagatgatgagtcaaacgttgtatttaaaactgaaaaatgtattttttttatgggtggagggagtagtgtaagagtatagtataataacacacaaacaaaaggttttatttccataaaaaaatatttttccg

SEQ ID NO: 63238 - DNA, 2799 bp, Oryza sativa
gaagtagaccctccttcctgtgggccacaaccccaccccacccaagcaatggcgcctcttgcgacctcgtcaacgtcgatccccccgagctccagttcccttgtaagccgaagctcccggaccctccttggctcccccgtgctagctagcttcatctcgttccagaatttcgccgggtgttcttgtttttttgtctgaatctttttttcttggtaccttgcaatttcttggcgtgcccagtcgagctcgacaagcagatctcctgccccctcaggatcgccaacaagaccgagaggacggtcgcgtttaaggtggtttgcggcccgtttgattgcggtgtaaaaccctagaaatatttttcttgcttgcttgcttggtgtttgaggaattgtctcgctcatggttttgcggtgtcctttttgtgtgaatgcgtgtgggtagtaggttaagacgacgagccccaagaagtactgcgtgcgccccaataatggcgtcgtgcggccgcgatccgcctccgtcgttgtaggtaatgtgtttagtgtttaactgaactaggccagagttcaagaaaccgctcaattttggggattattttgtggctgtcggaatgtggggaattttgatgcgttgtgtgcttcagtcacgatgcaagcccagattgtggcgcctccggactttcagtgcaaggacaagttcttggtgcagagcgtggtcgtcgacgatggcttgtcagctaaggacatcacctctcaaatggtagtactaaattgttgtttgcatgttgtttatggttaaagatttcgttctgaattcatggattggtgtgttgtttagttcctgagagatgagaacaacatggttgaggaggtgaagcttaaggtttcttatgtgatgccacctgaaccagcgatggagattgcagaggagtctgatattccaaagagaattttggtgcctatgcagcggattttggataatgggaggagtggttcggagctgtcaagtggtaatgtctcattgagatcagctgagatggggacagtaagtgcactgaatttttctcatatgatatttctgctcctatgagcctattaaggaaataaatggatgatttgcttaatgtgttttcaggagttgggatcacctcttggacgatttgtgagaaatgaggatatgctgaagactgcaagtcctgttgttgtacgtgctacatatacaatcaaatctttttaattgcttctatatatctctctacatatatgcgccccttaattggtctacaatttcataatctgtacaaaatttaagatgttgcttgtttctgtctttgtgatgtaaaatgttctaggaaacaagagtacatgcaggacctgatgaacaatacctcgaggtgagttcatttagcatctgaagctctctgattttttccctctgtttctcagtcatcctctgtgtggaattctattcattgttctttgtaactaattaaaaatgggggttggaatggtaggtcttctaaacaaatatataaaggaatcattcagttaatttctgtttgaatagtacagtatctagctgcagacttctattgtgcatgcatggctagttaccaacttaccaacacttattttatattccaaacaagagtttttctctgtttttccatcttcataaatttgatttatatacaattgacaggtagcagggtgttctttatatgtgtgttttactaatgattgttccaagcatgaaaattatttttctatttaagtcttaatttacttttgcattctgttctggtcattgacttatacctgcattgaataaccacttctcttctcatttcagctgtccgctttggttgcaaaattgaccgaagaaaagaagtctgcacttgagcaaaataggaaacttcgagaggagctggtgagtatttggttaaagtcatgcactcttacatgcttccatttgaaagctaatgatttgagtcatttacttagttgtaaaagaattcccccttttcaattcaaatattattacaaaaataagcatcacctccttaagtacttgttcatgtagaaaatacacataagccatatattccaggggatttatctgaagggccttcaatctagatatttcaagctgcatacatcaattgattatttgtctttagatgcttttttttctcaatataaaattcaacgattatgcgtccttagatgctacttcttctcaatataaaattcatcgattatgcgcctttagatgctacttgttctcaacacaaaattctctaggttatccatagacgacaatggataacaatattattattattattattattattattattattattattattattattattattattattattattattattattattgctgaatcgttatgcactttgcttacgatggagctgattatttttctattttttccatcgatcttgtctgaataataggagcaaatatattacattagcatgttaaaactctaatttaaggtccattgggaagaaatgccttcttatttttgttgacctactggaaattatatggtagtgaacatctttggccaccccattgtggcgggcattaatattccagaacctgccagggcttaaagcactccacattaaaggagcttcttgctggaattcgactggtgatggggtaactaagcatattttgggtggcttggaaagaatgaaaaactatatttccaccttggcagataatttccccgcaataaaaagggcacccccggggatcttta

SEQ ID NO: 63239 - DNA, 6226 bp, Oryza sativa
  unsure (1)..(6226): unsure at all n locations
cggcgcttgagattcgactactattggcgaattcgagctcggtacccaaccaatagcactaatgcacggctgcgccaaacttattcttcttcttaaagagagctgtggccctgtttagatgggactaaaacttttaagtccctatcacatcggatgtttgaaaattaattataaatattaaacgtagattattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccaccttattcttcttcttaatgagtattttattaagaacataggaagttttgcctctcaaggaaacgttccctcattttttatgtcacctaaaagtcatcatttttctaaaacaaaacttgacaagttagatcaatatatatgtgatatattaattactcgcaaacatatgcaagttccaattcaacttatacaaattgaaacaaaaataataaataattatcaataatgcacagtattcagagttatatttgggtttttttttaacttttgttgttgaatttgaacttatggagtgataggtttaagtgttactccctccgtcccaaaatataagcattttagcatagtgacaaatcaaatatttttaactttaaaattttaatagaaaaaataaaaaaataatcatgtaaaattgatgttactacatttatcaataagcaaactatcataatatgcaattctttttgtttaaaacatcttacttttatagatattgttgatcaaagtagcatcttgtagatcgtgtcagggtataaaaatgcttatattttagatggagggagtaattattttatcattttcctttcttaaatttaaacttatggaatggcgggcataaaacggggaaaaacacatcctaattaattaattttcacaatctagccaaaagcattcttgtgagtgtgaattaatgaaggagggtaattatgttactaatcaaatgtcaaccttgtttatttgtcctataggatcatcagagaaaggatgggctactaaaggaagggctttatgcagcggcagctgctgctgcggcggcggccaacatgggtgttgcaccgtactaagcccagctagaataattagtgagaagttagttactatctaccaagtctagctagctcatcaattaactagtgtgttcttcctatcaagctatctagggcttcctgatcatctctcttgttattaatgaagtgtactgtctctgtgcgttggtttcacctaggtataatctgatcatctagctagctaattgagcttcttctgctactagtcattttgctctatctgatatctgtgctgttttttttctctagcagttgatctgatcaaatcttcatcaattcctttcatttctaccctctttccaccctcatgccaaaacagtgaatattgtttgattgtagtcagggtttacaaaaccgcgtggttaattactatgcggttatcgcagttaccatgcatggtaactttaaatttttgaaaccacgatatttcgcgcggttaccacggggtccggtaaccgcgccaaaaacagtaagagtgtatcgtacaaaaaaaaattaaaaaccactagcgaaaaccggaccatggcgatttttctggttttagcaaaattaagccattgcctatgctagtgaaatctgacctttttcttcaaaaatttaaaatccaattaattattttaatttaactagaaaacctacgattttgtgttacaaagccagcccgggatacaacgatggagctaggatttagatatggaagggggccaaaagtattgaaggggagtactattatttaacttgttgattataattgattagattattctacgtaaaaaaatgttggagggagcctggcctctagtcgtccctctatctctccatctctattttatcataaaaaccgaccaattttaccagttttgtaaacaccggtcataacataagttttcagttactttagttttcttgatcgggcactattctttttttttcactttttctttatttggtgttcaagtacgtaggtactttggtgcagtgccctctccctgtcgagtaaagggaggccggccacggccggttgaattgtctggaatcaatgaaccacccctttgttttgcctgcttgctgccctgctccgtgcttctggaattcaaaccaattagccagtctctggagatcagctgttacagctcttgtgcttgtctccttaatatctgtgtccggatgatcagttgctaatacacgcatctctctttacccatatgcacatcccatgtcatgcgcggtactataaatagctagagtcattttttaagcattggctggtaaaccgtgaaaacatgaacgaagcaaaaaaaaaatcattatagataaaacttttatagttttaaagcctatgtaaaaaaaattgtgatgaaaaagctctaaagttaagttttagaattcaaattttggtttgtgactaataagtttgcaagtagacgataaaggacaaggatatcacaaatgtttttaaataataaggatcattcgcaggtagaggtggatagcgagctagctcagctcggctaggtcactagaaatccagctcggcttgactcgtatgaaagcacgagctagcttgtttggcttgcgagccaaaccatccaaacaattgtccctaggccatctcttgcaacctgaggcactagttcgttatctctaacgagcttaaaagccagctcggctcgttaggaaaatgaaacgagtcgagccaagcttgtcacgactcacgagccaagtgagttaacgagtcacgagctttctgtccacccctattcgcacgtaaattaaacgaggacggaaatcaatctacttcaagagcgacaagtgctactgtttgcttccaatagtgggtgttgtgtgtagtaggcacttggccttttttttttctgattataacattcggggggctaatttcttgtaatttttatctgctatatcaatatgaaacctcaccattatcttgtgcggttcgtgtttttttttttagaaaaaaaaaagagcaacaagtaaaactgagcgttttccccctaaaagcacgattcaaacagtcggcctggtttgtcctgtgggccgagcggagaccagtgccttctctagagcccggttacctggtccgtcgtgtcagtgcgtccagtagagcccatttcacccccaaatgggcctagtgtcagtggtcactgggcccgcatgctgcatatgcacacatatgggcctttctcctccacgatccgggctatgatgccactcaaggtgtagcatataaggtacgctgctttcaattttatccacgctttttatatcttatataaaagagttgactctgaggatactatggttcaaatactaaaacttataagctgaccctcgtccatctaaacttcaagatagtttttttagtaaaacacaccagcggtccttaaacttgtcaggagatttcacttaggtccacgaacttgcaaagcgcaaatcgagatccctaaacttggtttattgtatcctggtccgaagccacgtttgaccgtgatcttacctacatggcacgccatgtggaccgatgacatggaattgttttatttatttttttctcccttcttccttcttttttctctttcttccttgtcaaaaagacgaaaatgcctcgtacacgtcatcatccatgtcatcgtcttttcataaaagagaaaaaagatggaagaagggagaaaaaaaataaatttcatgtcatcgtctacgtggcgacaagaccactgttaaaagtggcttttgacctggatgatacaataaaccaagtttagagacctcgatgtgcgctttgcaagtttgtgaacctaaatgaaaccttctgacaagtttaagtaccgctggtgcattttactcttttttttcaggttaaaattttttaggggggaactacaatgggcggggagtaagaggactactccgcttttaagttttaaagtttgaaatttgaaagtggcttatctatactccattaatacgtaagacattagtgtttgagatgagcgatggatttgtcaccaccctatggccccaccaccaaggtttctcaaaccgtcgggaccggagttaccgcaccctcatggtaaccatggcaaactgtacgagaccgtataaaatttattaaaattacaacttatttttaaaatttatttgaatttaaggaggttatcgcggttttccttttaccgcacctcgcgttaagtgcgataactatgataaccgcgcggttaccggcggttggggaaaccctgcccaccactccttatattttttttattaaaaaatgtatgtcaaagagtacacatataagctaaaatgtacttcattcgtccaaaaaaaaagcattcctaacattccaaggcaaatttagtgaggagtaaaaatgaccaaaatgcccccctcatttttgggaaaaaaatatggtgataggtaggtaaaaatggtattaaagggataaaattttctgttttatgtgctggggtaggtaagatgatggaagttggttttctgtgagcaaaatttaaactcttctttttttacggaggaagtatatgtagagactaagagatatgatacatataaataattaaaaaatgattcaaaaagctactgttgcaatgcgggcattatactagctagtacttcctaccccaagaagattcaacttaggtgttaatgacactacatgggataataaatctggatagatgtcctcctaacttgtccaaattcactgtactacctagtggcccatccaattcgaatttatacagttttgttgtagctaggtagtgtttcatttcacttttactctctttgttaaaaaaactcaatctagtacttgatgttgacgtatcatagtattacgagtctgaatatgtatatacccaaattcttaatatagaatgtgtcaatatccggtactagattgattttatatgagacggatggagtgtgacggatggagtactttgattttttcagggagactaaaaagcaaacgtccgacatggtgtatcactaggtctacaggatgggacacaagcacacgccgatgtacagtgcagacaggagtaatttgctggaacgatcccaaggacaacataaaatttgaaggcggcagatcaaaacaaatctgcgtgcaggtccttcgagaaataacgtaagcggatcgcagcagcaggacggttttttttacgttctccagtctaaatgatgcttgtacgttctttcgtgttcttcataaaattctctgaactcgcgatctagactcccatcggatggtctattcagctaaagaaaaagctaaattttgaattttcaaacttaattttaatattgattttgagatattttcaacgtaatttcttttttagcattagcttttaaatcaccgagaacacatatatatatatatatatatatatatatatataagttttatctataaatttatttttattctctaataaaccgttttggcttattaaaagaaaagccaaacaatgggcccctaaaccgtatgcatcccacttcccaagctatcatggcaacatagcaaacgtgatgctgtatgtgctatgatcgactatgacattatacggtactagtcacaggtattttattttctcccatatttttttctctcggttcattttttataccgttattggtttttagccctctttttatacgtgggattggctttttttgttttcggttgatcagtttccttacacgtggttatctttttatttagctgttttctggtttatatgattaagagggaaggagaccgatggtgcttttaagttcatagagaagctcacgaaannnnnnnnnnnnnnnnnnnnnnnnnnnnnnnnnnnnnnnnnnnnnnnnnnnnnnnnnnnnnnnnnnnnnnnnnntccatngnaantccatgggcgccg

SEQ ID NO: 63240 - DNA, 783 bp, Oryza sativa
  unsure (1)..(783): unsure at all n locations
cctggncttgnnntttgcagtatannnnnnnnnnnnnnnnnnnnnnnnnnnnnnnnnnnnnnnnnccaaagccggaagctttccagatgatgaagaggatgatcggcctcgcacagattttgtttcataattagtaaccttaacccaaaaactgagacatgactatatgggacactaaggtatgaagtacataaacttttttttcatcttgattttttttttagcaagggccatggcccccatttctattaccagaaatggacacaggactacaaagttcttaaaaaaacagctgactccggtgacgaggcaggctggacccacaacatcggcttcccgcgttggtgtttgcagacggcgggcgctctgtcgacggcgacgaagggcattacggcacgcatgcaaaggcgcgactagcggtggaggaggccggcgtgatgtgaagcggcccggcttgctcgtggtcccggcacaaggaggctaagggaaggttggctgcccgctgcggatgccggcacgagcgcaacgctatgagttgttgcccgcgcaccaagatgagcggtcngtggaacaggccaggtgcaacccggtgccgcatgttgaggcacgaccggtggcgatacgcggagactgcgcggnggggggggggggtggttttttaactttgtatctnatttcncagacaaacccccgaacttggagaaatgctgaaattttttgcccgcccccctgtaacttgtaagtgcggcgcctggataattctggtcactttcccaaccgccg

SEQ ID NO: 63241 - DNA, 797 bp, Oryza sativa
  unsure (1)..(797): unsure at all n locations
cggattgaccctgatannnnnnnnnnnnnnnnnnnnnnnnnnnnnnnnnnnnnnnnnnnnnnnnnnnnnnnnnnnnnnnnnnnnnnnatcttgtggtgaggggtctgctgcctgaaacaaaccaaccaacacatgagaaatttgatactacctcatattatatgtcattttaattttttttctttaatcaaactattttatatttggtaaaatttacagaaaaatttaacaacatctacaacatcaaattagcttcattagatgtaacattaaatatattttgataatgcatgtgttttgtgttataaatgctgttatattttttataaacttaataaaacttgaagaaaatgattaactagttataatataaaacggatggagcagtatatacacaagaaagagccgggaaacaaaaaaaagagataagaaatctcgtgcattggattatactgacaaaagtttgatcttttttctttgaaaagaaggaaatttgggtttgggaaaattccatacttctggtacttgtgaagctggccgcagaagagggcgttgtcggggatggccatctcggtcttgttgccggtgtcctcagggttgacgaccctgacgtagacctcctggcccaggtaccatgagttcaggttctccgacctcacgtttcagacgcccaccgttgtccaggacaccaagaccgtcgtccacgcttcccggtacacctgccaaatcatatgccaacacccgccatcggaatgcaccacatgaagatacagtncagtccaaatcaaataaaatca

SEQ ID NO: 63242 - DNA, 787 bp, Oryza sativa
  unsure (1)..(787): unsure at all n locations
actgcgttgannnctgatnatcacttgacctttccnnnnnnnnnnnnnnnnnnnnnnnnnnnnnnnnnnnnnnnnnnnnnnnnnnnnnnnnnnntattgatgcactaaaggcaaaggtattattagattatttagttttccatttccttttctaattaattcctcgatggtattgtagtctctcacaatttcagatggtttattatcatgctttttatggaatttattttacatttatcttctctctctctctctctctctttctctctctctcaatggtgcattgatgtattgtcactttgtcactttattagtttctcacaatgaaatactattgttctctatgaaaaacattatgatattgggatactgttgagtgttgctattatgttctgaaagcatctagagtatggttaagctatgaatataccattcagctttgttcttgagttggcatactgattaatcttttagttttatttggaaatttcatcttgttgcctgcttaactatctttcatgtgccaccagtactttcctgtattctattgtcttagaagaaatgccaaattacaatcatttacaccttttcaattaagggtctatacagaggcacagaaaataataagatgcgcttgggccgttgttcaagaactaaagatattgtggagccaatgatgaagccccaatggtttgtcgattgtagtactatggcaaaggcagctcttgatgctgtgaaaactaaaaggatcgagatcatttcaatacaatacgagcaagactgtttn

SEQ ID NO: 63243 - DNA, 4010 bp, Oryza sativa
  unsure (1)..(4010): unsure at all n locations
cgtttaaggctcccatcggatggtctattcagcaaaaaaaaaaagtaaaattttgaattttccaacttaattttaatattgattataacatatttccaacgtaatttcttttttagcattagcttttaaatcaccgagaacccatatatatatatatatatatatatatatatataagttttatctataaatttatttttattctctaataaaccgttttggcttattaaaagaaaagccaaacaatgggcccctaaaccgtatgcatcccacttcccaagctatcatggcaacatagcaaacgtgatgctgtatgtgctatgatcgactatgacattatacggtactagtcacaggtattttattttctcccatatttttttctctcggttcattttttataccgttattggtttttagccctctttttatacgtgggattggctttttttgttttcggttgatcagtttccttacacgtggttatctttttatttagctgttttctggtttatatgattaagagggaaggagaacgatggtgcttttaagttcatagagaagctcacgaaaataggtaaaaacagtcttagttgttactcccttcattcaaaaatataaaacatatttcttttatcaccaagataaagaagtaattaactcacccgttatgtggcaaaactaataaccaataactactaataaaatgaagggagtactaattaatacttcctccgcctctaaatatttgacaccgttaacttttttaaacatatttgatcattcgtcttattcaaaaacttttgtgaaatatgtaaaactatatgtatatataaaagtatatttaacaatgaattaaatgataggaaaagaattaataattacttatattttttgaataagacgaacggtcaaacatgtttaaaaaaatcaatgacgtcaaatatttagggacggaggaagtattgtggggcctgtttagatcccatggcaaattttttcaccctgtcacatcgaatatttagacacatgtatgaagtattaaatataaacgaaaaaaataactaattacacaaattgcatgtacattacgagacgaatcttttaagcctagttactccacgatttgacaatatggtgctacagtaaacatttgctaatggtagattaattaggtttaataaattcatctcgcagtttacaagcggattatataatttgttttattattagactacgtttaatatttcaaatgtgtatccctatgtccgatcgacacaacgaaaattttcgatccaaacacagccactntagttatgacttgtttactggcactgttatctcgttgatgattctttcaggcacagcttccgaggcacattaggccactgcaacggtacagaagaccacacgatacaggcagtggcggcaggcgattggcagacgacccccaagtatgctcgccttgaacaccaagtactagctagcacgggagtaaagccaactcaaggtataagtaaggagcacgcacgcgactgggcctcgaggtgaacacgataggtatccggaggccatttcttattgcgaggtcaaaactgaggtttaccaccgtctctttaaacgtgtgttaagtgacatattctgtctatttagacatattctgtctatttgagcatgtgttaaggaacgtgttttgtaacagtgtgtgtgcgtgtgggtttattgtgtaattaaaaaaaagagtgttatcaaaccgccgtggactaggttatcgcaccccaccgataaacacggttaacatcatagtaacacaccacgataaattatggaagcagataaaattttattgaaaaagttaaaactatttttaaaatctgttttgaactgggggagttaatcgtgcaccgtatcgcggcggtattatctaactttggtcaaaacacacacaagtgaagccacaagcaaatcgtcagagcatgcgtgtgcagctgctgctggactgaagccgaagcaaggaacatgcccaaccccactggtaaagtggcaggcacgcattcttaatgccgcagctgctactatgtcagcttgttcttcagctaaaacagtggcagttaactactgtcacaagatggaggcaatgatttggttaggcttaatctctgaggtgcaagattgacagcaaaatgctggcctttgagcaagttatgaccagatcacccattgaatatatggggtctttttttctggtaagagcattgtgagtgtgctaggagtctcctactagtttgctggcagtacaggtgacaagctgtagttagtttggaattggtaagaaccgggatgtggaatttattagccacgaggcccttcataattgatgggggaacatggaccaactatgaagaattgcaaaggcagcagcagtcattaggaattaattccaggtagtttcattagttttactagagtattatggagtacaaagctttttacagtgcaaaagagttcagtagtagctctgaactttgacgacaaactgtgttgacgggctacaggagagaacgaaaaagatgcagcaaaggacacagaaatgatactgtcccatagacagaaagtcacctgactgacatgaaacctggatgctgccacacaacacacaagtttttggaggcgttgggcattttcctcaagacagaaagtgtgtgtgccacctgactgaattcggaatcgaatactgaatcccaatcatttcagaattcagacaaacattaagcatgtcctcagaataagaaacatcgatcagtgaaaggaaacttgaactgttgttctgaaccattctacttgaacaaacagggaacaaccctagttacaaatgaacaaacagggtacaatggcaagtttgcatttccacaacagatgacaaagtgcagcatctgatcttatactgaaggaagcaaaggattcacaggggcacacaatcataaatataccttttttttatagaactacagagaaataaattacaaataattagataaatagctctttgacaatgttagaacacagctctcagaatctgatggcctttgtacaacactacaaatcacgaataacccgcttttacccaaaccaaaactaaaatgaaagataagtagctatttctgtactactcatcgagcagcaactgtgactctccgaaggttattttggcactgttcttgatcgcctttacacaaacctccttttgttttccaaatgtacagtttcttttttgactatattatttcattcacctataattccttccctcttgccacaatctaggtacaccctacactggatcaccgtcccaccgagccgaaatcccggcaccaccgtgaaaccgaccttcggtcgcatcatctttccgagctccttgcttcctgaaaatccttttgaacgcacaatgttctccatgtaaaccaccgagtactccgctccctggccaatctggaatatgccgactgccggatcatacgcccaagccaatctatgaagtgtccatattgagcttgccattgcaacgaacagctcgtagagtggtccggccacgcccaacactggcaatttgccacaatcagaattcccaaacagtgaggactcaatgccaggatgaatgagctgcttgtactttcggtcacagaattgggcgaattcgcagtctgggcttgaattgataagctccattgggtctgcatctgagtgctcgatgaattgctgcattgactcattccttcggattgcgagatcgattcctttccgtgtggtggcatcagttgaaccaccaaattggtatgaatcgaagccatcaaacatggataggcaaacccgggagaggagcgcgtgccggcagtgaccaagcctggagtagctacaccggggagaaccgccgcggcggggcaacaagaacccaccctgcgcatcgaagaaattcgccagccaaccggtgaaacggtgggccactccgaccg

SEQ ID NO: 63244 - DNA, 10485 bp, Oryza sativa
  unsure (1)..(10485): unsure at all n locations
aannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggtgtctgttactaaaagatgcttctaatctcgtgattgttttgattttgttactagtctacctgtaaatttgtgtaggagtatttaatttgaagagaggatgacagttatagtctatgttaagcttttttttttcttttcgacaaacagtactaatcgacgaaatcaccacaggcgtctcgttatcgaggggtacgtcgtctaccactgaaagaataattagccgtaaatgcgagcactcatatcaaatctaggatttgaacccaggtgagctagttacagtttaagaaccaaactagttagcctacgctcacttcgcagtcttttgttaagccttggtgcatgaaaaaataaatgaagtgtaaaagatttgcacaacttttgcaccaagacaaggctgtgttctatcgttgaagatagaggtttagttttcgtggcacgtgaaacgagataggtcgtttagcttacggttaatcgagtattattaattattataaacatttatttgatttttgtaagaaatatttctatgtatattatctattattttattaaaggaatagaaaaaggagcctccacgttcgctctcatggtctaaaaattcccacattaatcggagaaaaagaaaaggcagagtccatataggaatacaatttagaaatagctgaaattcggaattaaaaaagaaggaatattagaagacgagactagagtccatatagaaatacaatttagaaatagatgaaattcggaattaaaaaataaggaatattagaagaggagactagagtccatatagaaatacaattaagaaatagatgaaattcggaattaaaaataaggaatattagaagtagagtatagagtccatatagaaatacaattaagaaaaaaaatagaaattcggaattaaaaaataaagaatattagaagtagagtatagagtccatatagaaataaaattaagaaaaaaaatagaaattcggaatttaaaaataaagaatattagaagtagagtttagagtctatataggaatttaaaactaactaaaatttgaaataaacataataaaattaaaagtagagtttagagtccgtataaatatacaatttataaataaataaaatttgaaaataagaaaaacatgggaagaaagtttaaagtcaatataggaatacaatttagaagtaactgaaattcgaaattaaaaattaaagaatattgaaagatgagtttagagtccacatatagaaatacaattagaaataataaaaattcagaaataaacataaataatattggaagaagagcatagagtctataaagaaatacaatttacagaaaattcggaattaaaaaaagaaatattaaaagacgagtctagagtccatataggaatatatgatattaaaaataattaataactaaatacatatataaaatgcaatatgaatatgacacattagtagtgttgtaaagttatttcaaaatttaaaattatgtttaaatataaaattttaatatatttgaataatataatgagaaaacatatatgctattatatgagagaaaatataatgatgttagctgcgcaatctgcgcgggctaccatgctagtttttgtaaatgacacaaatttgaagctgaatgttaaaacgggtcctaatgcacgaaacacatcaaaattccccgtttgatgtggaaattctcgtcaacattggatgtgtaaaaactgtttcttaatttctagacatgattcaccactgtttttttgagggtttattcggtttggaggaatttaaatccataggaataagaaaagtgaaggaataggaatgtttgcacacattaatccatatgaatttttcctatgagatttgagcgaatggaaaaattattatgtttcctctatacaacttgtaggaaaagaaattttcctttggttttcatgtacttcaatcctataaccagaatgacactcatagcaattagtccttaggactccaaatcctttgtttttcctccaaaacgaacatgcacttagaaacataggacaaatgcgagcaagctcatctctataacgcacacacagacaccttatgtctatgagtataaacaaaaggctaggttggcatatcttgaaattgatgaaagtcaccatagacatctcgttatcgataagtacgtcgtctatcattgaaagtcagcctcgttatcactatcattgaaagaatacaacatgtattggtattgacgaagtcaatcgatgggtacgttatctatcactaaaaacaattagccgtaaatttgagcccatgtcaagtcttaacttgaactcgagtaagcacacgttcctttacaaataatttaaccagttgaattatactcaattcgcgagctttgtgatttgattttgagcaattctacggtccttgaggaggtaccatgaggtaccaaaaatttaatgtaaaatttggtacctcatagtacctaggtactaagaggtaccaaatttacaatagaaaaaattgtacctcatggtacctccttaaagaccgtaaaattgttttttgattttccttctatttaatgtacaatgtttccctttggaaggagggttatgatttctatattatgttctcggtacaaaaggagtcctagagaaccttcagcgagtctcaactctcaaaagagagatcaatggagtaatccagcagctgttcgtggctaagctttgggatgttttaagtttgcaagtttaactttcaataccctttttgagactaaatgtttaactggccaactatttgtttcaaaacattttcaaaatgcatagacaactttttttttcttgacaagtttagtggtagttcctactcattttcatgagagagacagatccaaaaccgtagttaattctcacatttaactctataaaccatgcgatttgtggcacgtgtgtttgccgcgttggagtgagctgtagaagcagcagcagtgcctgtgaccagggcccactacgcagctcccccaaaaggtagctagctagccttgccaaagctaagctggccccacatgtcatcctctaccagaccacagttttgtcaacaccttaccaccggcaagcttgccattattaatcaatttccgtttgattttgcttgattgcttggttagaaggggatggctttgtttccttgtgtgctgtcccgtgtaaattcaactgtcacgggcaatgggagagttcttggccttttaggttgttagccgatgagagcgacatattatggttgttgagactagaaaatgtgaccactctagtctgaagtgacaatcacactagctttgttttcatctcgagtgtctacttgtattcagatgtgaagttgctgaaatgctattcataatttcaccaaaaaaaacttgaccacggtttgtttcattacatttccattgaagaagttttccttacggacggttttgcccggtaagtgggcggtcactgaggaaaaacgaattttactatttttttttaacatggtcgatatattgggcctttccattatcgcactgacagtaagcctggttaccgtggtaactgataaacaccggtcctaacatgtaaaagaaatttcttttaatagagcataaagatttttatttcaagggaataaaagttagttatttaggtaagtagcaggtcatctctgaaacgtctattgtcattttgtctcatgcctatacattatctccaatcctggtcactgcacaccgaaaaaaaaaacattgtagcatggcttaacaaggagaaaaagacatctatctgattctattctcttccttttccatcaagggggatgctagagattttgatgtgtggaagatgacagtagaatagggtgttgcatctttctcaagcagcagtgaagattctcttggcatggcctgcacaaatggggagtagaatagagtgataatccacatctgtctctccctttccagatccctgcagcccagttgctccaatgtactgctgtcccatttgcagaagttgagagagcaccaaagggcattatgcaagggggtagtggttggcatcacactacttcacacctgtgaaatcaatcattgttagttagtaatatatataatagtacatcagatattcagatgtgcactgataatattttactccctctgtctcacacagacttcatttctagcgtttaaaacttgtctcacaaaaaacttcatttctagatgttacaaccaatcaggctaagacatacacatttaaatacagtcaagaatattaatgagatgtatcatagtagtaatttctccatactaatttgtctgagaattgctagaaatgaagtttatatgtgatagagggagttgtacttttttttttggtgtgtgtctgggtgtaactgtgtgcatcagtgcatgagactttcaagtacttggtggattactttatcagattgtttagtttagtaatcttagtgacagccataattaaagatgcagagacaagctattgtaatgggagactggatagaacctaaccctttgacttgggacatcttctttaaaggcaggcctgcagaaacagcagagtgtgttttcttgtaaaaaaatcggtgcgcatgaagaaagaaaatggaaacggagaatttgccgttagctcaacagagtgtctagattcagaggccggcagatgacccagagttgaattgacgcattagattaatgaacaatcacatctttcttatcctatgattagtttaagttaacttggagattgatccagagttgaattgacgtatgaatatggagattttacgaaatgaaaatgtatcaataggcatcagaagttctcaaaattatgcccttcttttaacgaagcatatgccagttttcaaagttctgaaaaactggcatatgatacataacagtttggaagatggaaaatgacgctgtgttctgcagaacttcctctgaatttcatgaattccaaaggtaagaatcctgcagtttctgcaattttcagttagatctctggccaatgggcctggttgatcggcctgattgtgagtttgttatgctacttgatctcatgcttgctccctctactagttcagtccatgaggtgccaggcctaaattgggcacttccttactgctacatgttaggagtatttgggctttttctttctttctttttttgaaaccgagacagcaaatacggctgaagggaagtgtatttgggttttatcatccccaaagtataatgggctgatgaactactgaacgtatcagaaattcagtagactgcatggactcgattgagcgattcagaagtctgaattccaaaaagttcatcagtccatgcgactacttatatatggagagagtatatccagcaaaaagcccaaaatgtcgtcaaaggacaatggaattgcgaattctgctagctcacctttaataagtctttaactgaactgaatgattgctgcctgttcacatgagctgctgctgaactgcagcacagctagttaattggctgatgaggtaataaggtttcagctctcaggtcgtcagccttccatctcatccaagattcagcaaactttgctactctgaatgcatttacacatatcatctacagcaaactttgctaatgtaacgattgtgccatgaaaaccgagtgaactgacagttgatctgaatgttcagacgagcataaaaaaaattttgccatgagattgttatttagattccaaaaaaatttggccaaaaaggtcacatcaaatgtttggacacatgcatagaacattaaatgtagacgaaaaaaatcaattgcacagtttgcatgtaaaattgcgagatgaatcttttgagcctaattatatcatgatttaacaatatgatgctacagtaaacatttgctaatgacggattaattaggcttaataaattcatctcgcagtttatagacggaatctgtaatttgttttgttattagtctacgtttaatactttaaatatatgttcgtatactttaaaatttttacacgtaaacaataaaacacggcctacgttctgcgtttcgttcttgcagagcttgtcgttgttctcactacggctaataacccgtgcaacaatgaagaagcgaccaaaaataatttacgagtaaaacttctatatctatattatcagcgatttaaaagcaaattctgaaaaataaattacaataaagaaccccttaaaatcaactctaaaaataagttttgaaattcaaattttggtaaaccaacaagaaaatgaaattcctacaaaattcccgcactccaaacgctcttccatcatccgtaacctcaagggtgtgtttggataatggaaaatggaggttgggattgggattgggaaatgaatgaagggttaggattaaatgaaagaggaagaatgaatggttaggatttaaagatgtcttttgatgggtggaaaatgatttccccatcccattagccaaacgctgcccaaagttatcaaccagagaatggaaaaaacccaaaacatctcacgtagtaatgcaccatagtccatactgcatagtatgctgcagaatttcatatgagggcgttcactgaaggcagccagcctgtgccacggttgctctgtcggctagccgtcagccctggtccagcatcctcctcctcctgctgctgcctcctgcacgcttgctggggctatctatctaccgtcaaaatcatgccctgctccagtcaaattgctgcgtcggcagcatgccagcatccatgtgatgctgtgcacaaggatggataaaaaggtgccaccatggcgcactcaagagtacagagaaaagcgacgcggtaaatatgaaaagatgaacaacactgaatctgcttgcaggttacaatttcaggtcttggatcgaattggacccccacagatttcttcagggcctgcatgtgctgcaattatatctctgtgccagggacaaatgagtgcagatgtagtgataaatgtgtgtggtttgcaaaagtgttaatgggtgattatgatgttgcgaggtcttgcctttgtttggagtgtttaactgaacctgcaggttcgttcttgtttgactgcctgtcgttctccactgaacaaagctgatgctgtcttttttttttaacagtttttcagacgatcaaacagagttacactaccaaaaagaattggagtaaccagagttgatcctggtgaacaaatgcaaatgcacgaacgaatcgaatcaagaagcaatctctacccaccctaaaagaacccaaaatgaggtaaaaagaaaaatgaaaagaaagcgacaatggcaggcacaatcaagcggcacactgacaaattcatatcaacagagaaaacaggttacgatcctgaaccctgatcctaaacaatcccacacgacggagtcacctccttgcagaagaaaaacgtcgccactctacggcgagatcatgactgctccggcgaggagcagcattgctgctgccgccacccggctcccaaagacggcggccgccgccgccgacgtccccatcttgtggtgaggggtatgctgcctgaaacaaaccaaccaacacatgagaaatttgatactacctcatataatatgtcattttaattttttttctttaatcaaactattttatatttggtaaaatttacagaaaaatttaacaacatctacaacatcaaattagcttcattagatgtaacattaaatatatgttgataatgcatgtgttttgtgttataaatgctgttatattttttataaacttaataaaacttgaagaaaatgattaactagttataatataaaacggatggagcagtatatacacaagaaagagccgggaaacaaaaaaaagagataagaaatctcgtgcattggattatactgacaaaagtttgatcttttttctttgaaaagaaggaaatttgggtttgggaaaattccatacttctggtacttgtgaagctggccgcagaagagggcgttgtcggggatggccatctcggtcttgttgccggtgtcctcagggttgacgaccctgacgtagacctcctggcccaggtaccatgagtccaggttctccgacctcacgttccagacgcccacgttgtccagggacaccagcaccgccgcccacgctcccgggtacacctgccaaatcatatgccacacccgcaatcgcaatgcaccacatgaagatacagtccagtccaatccaatcaaatctaaactccattgtggttaatctccagtactatgaacactgaccagtgtgcagagatagtgcgattgctatttgcaatcagatggtgatcaacttgataagttattagaaaacgtgattatttttacactctgttttcagctatttcattggattgttacagtgaattatttacttcacatatctaagaaaaatacgatttcgaaaaaaaattgcctattgtattgcttaaactacttgttgtaatagtatttattaagttcattcataaaatatatttaatttttctctacaatcaagtagataatcggctcttcaggtcaatgaaccgtaggataaaccatgttctatgcttttagaatggaatgaagtcctagttttcaaaaacaaaattagtagataattcgctataataacctgttgaataatctattctagtgtcaattttaaggtattattgacaacttttacgatgatctctaccaattttgctcacctgcacagtgctgcgggcgacgccgtcacccttgttgtaagtacccctactatcctccgtccattcgccgtagtccatcctgcatcgaaattcaagctcacccaccttaacaaagatctccaagaacagccatggcggatgtacatagctttcaagctaatttgtgccattgctagctactacttccttcgtccagaaaaataaacatagaattggacgcgatatatcctaatataacgaatctggtcaagagtcagtctaaattcatttcatatgtcacattatttaattctaggttcgttttttatttcatatgtcacattatttaattctaggtttgttttttatgggacgaaaggggtatgtatttacccgacgacgaagaaggcatagccgtccatgtggtagctctgcatcctggtgtcgttgttctggaagatgagctccatgaagccgcggtaggtgccgttgatgatggagcggcccatccggggggcgccgcgcagcggccgctccgggaagtcgagcgagtagacgcccctgacgccgtacgcgtcggcgagccgcagcggcgtctctggcggtgtgaaggacagcccgttcagcgtcgcgcggcgccgcccgttgatcgtcaccggcgccgtgctccgcagcaggtacgcctgcgtcacgttgatcgacgagtacctgaacgatccctgtgggttcggcctcgccgctccggcactcaggttccacctgcccaatgcaaaaaaccaaaacccaaaagcttaatgcgaataatacatcattccacgtatttaaaaaaataatttataggtaaaatttttataatgtattttagcgacgtaaatgtcaatgctgagaaataaacgataatactttaaatgaagttctaaaatttaaattttggcatcggttgatgttggataaagaaaacgatggaggctagtaatttttcttcttttttaagtatctagattgtcatatattgaatttttcagtttttcatccctttgaggacaatccaactattattttccttttcttatgtaaaaggttgaacaacatattcaaacataaaaaaataaaattaaatgaaataaatttacaattcataaaatttacagaatttatgttaagaaaatattcaaacttagataataataaagcaacaaaatcgtactaaaaagaagtataattgtacattgtatactactactcctacaattttagacttagaatttttaatttcctgaaatctagtaatgccatttttttctttctagttgaaccagacagtaagtttaactcgaaacttataagctaatgagcgaagtcgggcaattcactcgtacctgacggagcgagcttggttcatggagaaggacttgtcgaactggtcctggggagggtcggggaaccgacccttttcggtctctaccggctctatacatttccaccggatgctatttgtctcgggttcattctcatttggggtcttttccctcttcgaggctaatccgcttgcgatgctatctgatatagatgctcaattacg

SEQ ID NO: 63245 - DNA, 1951 bp, Oryza sativa
  unsure (1)..(1951): unsure at all n locations
gaaaaatatatagtttgaggaaattaaggaccaaaagtagtttatgaaacaaattaaccagttctcagaatatccgcgtcaaggtacagccacacatcccacccaacaatgttttcaattgaattgaaggaaagcgagtggcatcttttcagtacaaaaagggcttaatctatgctcctcatcttatgaggatcctccgaggacttgaagtagcggaggacggcgacgccggcgacgcggcgccacacggtgtcgttcaccatgcgcgcgctggcgacgacgtagtagtcggagctcgcgttctggtcggtggtgacgaggaaggagtaggactggccgacgtggacgtccaggttggtgtagttctgctgcgtcgtgtaggagccctccgtctccaccagcaccatgttgtgcccctggatcctgaagttgaggctcgtcgacgtccccacgttgtgcactcggatcctgtacgtcttgcctgtgtccccacaccgacgtcgccgacacacgcgcaaaagataatagactcattgtaagtaggtagtaaccttctccgtttcatattataaatcgtttgattatatttttgttagttaaacttctttaagttttttttctataaacttaattaaatctaaagaattttaataaaaaaaatcaaacgacttataatataaaatggatggagtagttgcatcaatttgtggatgaagcaaacaagattatatccttttcatgagggtgaaagtattcagtgaacaattcgtcagtttcaagtttcatgaaatcggacagggtctctgaaagtctgtatttttggtactgttggattgactactctggcttctgttgtcacatcttttgtatcctagtttcggtaaaaaaaattttggcatttttactcctatcgttgatctgtttaactgaaaccattgcatgatatactactagcagacaaaactggtgaaaattcacgagaatgaactttttgtcagttaagcattagcggacagcttcagtaagcagagcaggctgccttaaggcttaaagcactatcttccacaacactttgtcctacaatcaaattccaaatttactatcacaaaaagcgaaggaactaactaaaccttactcctactagtactactgctatgactatgaaacaagattccaatccaaagaaaacacagtgctcgatcagcatgataaaagcaacgaaacctgctcatccagctgccaaaatgccaccccactgactctacgtacgtactacgtattgacgctgtaaaaaactagccgtagtacagagaagaggacccaaagtttcgtcaaaaattttattttacccggatccacattgatggtctcgtactcgatgccggccgggacaaggctgtcgttgtacctgtacgggcccttgccgttaatcagcacgccgtccggcatcccgaggtccttgccactgtccagcatcttcctcagatcctgcaacgaattccatccaaaatttcaccttctcaaaatcaaaaacctgtccaaaatgtttcatattgcggttgatttcgtgttgatttgattaccgtgtggttcttgttgtaccagtcgccgatgaagatggtgatgtcgccgtcgggcggccgaaggggacggcgatgacgtcgcggttgttgacgacgacgccgccgtagccgccggcggcgcgctgaaggccggtggaagggaagtagaagaagctgccgatctggtccttcacctggaactcgtacgtccagttccagcccgacgggatggggcagtttgtgcccagcaccccgtcctgccagcagttcttccggtgctggatcccattcctgcatacgttcgtccatatacagacccattattcacttgttccaagacgggatgggtaccgagttcgaattcgcccatagtcaacnggttctcactn

SEQ ID NO: 63246 - DNA, 1307 bp, Oryza sativa
ttaggtttccccgggctggttccgtctcccccatcttgcggagccgcttcttcttgcgctccccctcgggctgtgacgtcggcgcagccccctccgggcgccgaccgctggtacgcactgccccgccccctcggggaggagatgggggaggtgttcctcccagcttcctcttccccggggcgtcggcagggcggctgctccccgagcccccgacgcggggcccagaagcacgaccccctcctggggcagattttttccccgggcggctctcgcccgcgccgtcgtggcccttaggggctctctcctctgaggccccgacccccagcataatggttagaatggagacgcggtcgggatcgatgcagagggggaggatctcctgaggaaggcgagacgcctccgcggagctaagattcagcaccctttggactacgatcttgaagtcctcaggagcccaatcccatctggctccctggtgggtccgcatgtagtcttcaggcccagtgtactcccaggcgctccgggcgcgccgttggagcggcgcaatccgccgacggaggtaatcgccgtacaccatggccccggtgagcccctgggatcgcaggcccgccaggcggtcgaggacggcgtcgtactccttccccagatctaccggcgcccgccagctggagacctgcgccgggggctggctcggaagtcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgatggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggtagagaaaggggatcctctagagtcgacc

SEQ ID NO: 63247 - DNA, 5049 bp, Oryza sativa
caagaggaacaaaggcgaaaggaagggagcaaatccttttctcgatgcttttatacccttgccatcgctgggcctggctcctcgtttctcgcgcccactacctcgctccctcgtatctcgctatcttgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtgatgtggcagtcttgaatagaccgcccattatggacaaccaaagttaccaataccaatgtgcatggactgggaccgttggggattttgcccaactatgcagaccggtcccacctgtcaccaggctttaggagtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcatgcagtgcagcacggcgcgtccctttatccggtctgtgaccagtcacagaccggtcagatcacgggttaggtggcgactggcggtctgacacacgccatgccccatcccgtcaagacgaaagcctctagtcactcgtctcaagccggcgttaagcgtgttatctcttagagatgacacgttagacccggtcgatatatgccaggcttcatcttaaccattacaggcaagatgttgtgtgaagaagggcaaacatgcacgttgccaagattacacgcggtggacaagaacgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagaggggggttgattctttcccagattatgagcttagaacgggggagaagtcagctgaaacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcaactttacacatagatggttctttctccataatacttctttgaacactaagatattgttctattatgaatagtgcagattccatgtgcaataccagtatttatcaatcatgattacgataagaccatcacactctaatcatatgttatacaagtataagaataatggagcaaagtgcatgctaattgctgctggagagcttttttttttctattccctctattttatattactgagtttatcctaagttaaacaaatttgtagaaaaatgtactaatatgcacaacatcaaattagtttcattaaatttgtcatcaagtatgtttttttattttatgttaaaaatgttattaattttttatataaacttaatcaaacatgagtaggattgacgcaaagttaaagtgactttgccctcagtcaaacttttttttagaaaaatgtactattccacaacacccaatttgtttcattaaatttattatcattgaatatgtttttatagtatctttattttatgttaaaaatattgcaatgtttttctataaatttaatcttggacaagattaaagtgagttatagggcctgtttggcacagctccagctccagctccaccgggagtggagctggagctcagctaaacagtttcagcttcaccaaaactagaagtggagctgggtggagttctctcacaaaatgaactagaggtgtggagctgggcttagacagctccacaactccactccagacctaactcctagagctaaacttaggagttgagctgtaccaaacatgcccataatataacaaagtgggcacttcaactctactctatttcctcgataaaatcatatcttactgttgaccgttgattactccgagtgcagagtgtttttatggggaaaaaacgagcggggcatgtaacctccataaataagtccatatgggtgggtcacaattatctcgtgtatgggttacacattttgaaatttactcccgaaatttgtgatatattcctgatcattcaaacttcctggaaagatttatacatctttgaccttttttaccccttttagtttccgttgttttctacacatcagatgcactctttctataaccccatgagctcacaagttatgattatgacagtccattaaaaagagcaaacgagataatagcaatttagagaaacagacaacattttctcattaactaccactgtgcaacaacaaagcatgcagttacaagtttgattatatgcagaactgcactagggtgatgaatcaccatgtgggcgagcaacatgcagatgtatcaatgagaaggatttttcccttcccaataaatagttgtcaaaatcattgcaacatctgatactgcctctacaagtaagaggtcagacaaaaaaccgggtaaacagatttcttacccttttttcccatgtacagcgccaccaattgtacaccagctgcaaagagatgaggaactgatgaaaatatgttagcaccaggaaagccaatccatgactccattctcatctttcaatcgtgttccctcaagcagcatcagcagcaaatccaggagagaagcatggctgtctttctttcatcagataaataaaccttagaatttcctgccacatcaaaaggagagctcggagctccgagggccaactggatcatggagaaacagctcttccacttgttaatctctcaccagctgaacagagatatatgtgacagcaaaagcctttgcttcatccttctggcattgagggtctatgattggtttcctggccgaccgggacttgaagaaaaggattccagcggtcaaagatgatgcgacctccccgtccaattctagcttgccaccggaatggtggagcagtagtaccactatcaataggtggatctagtggtggcctgataccagccatcttcagcttatcagggtcaattggtcttgtaaatagcattactggctcctcaggatcccgcatttcaggaacctgttaaatcatgatccaaatataaacatgacaaataaaaaattagatgagttgccatgtgaacctaaattttagtttcactatccaacaactatctagagcaacagaaattgtgcctagcaagcccatcaatttctggctgttctttcagacaaatttgggaattaggggtgaaagaagtcaaaatagataggaaaatgctcaaaaggttttctgaaccatatttttatgagaattgaaaatggtaacaaatgaatatttgaactatcagagtattagaggcggaatcattagagcagaaacatgctggctgctcgaactggtaatttagaccagaaacaccaagtcataatttgctatttcatgcggttgaccgagcaactaataagataaattcatatacacactatatataactcatagccacggatattatggaataaattcatacaaccacatgtatcattttataattatgacttaaggtgcatttagttgtaaggatgttacttggattcccagtaatcatggggtaatcctagttgattcccatgtttagttgaatcacctggaatgttaattaagaatataggattctaatacaactaagattctggtaatatgtggtattaggatcccttttgaaacaggtagcttggattactccccatcccctagcagaatcttatcattttctttctcacatgtgcatgctataatgttacattcccagtatctaattctcacactaaggattacaggggatgttaagtttcccattaatcttgctttcctgtaactaaaccgcacccttattatgtttgctatactaaacaaatactcaaaaggtagcagacatataatatgtctaaaagaaaatgtccataactacaagcagatagcctgttggtttgccccatgcatgggctggcagtagatagtgggttccaaccctagtccgataggtatttctgtggaatttaccaagcaaagccgtgcaaattccaagaaggttgtgccggttgctgggtttaacagggcatggcctagtcgctgtgtacaggcttttcactgttaggccagtgtaattattggcaatgttctccatatgaatttggtaaatcaaggaaatggtcaccaaagagcaaaatcatttccaccaccaattacgattagcctcactgtttctggttccagttctaacgaatttttattccgatcgattcagttggtagaataaggaaacagtagttggtggatcaggaatttctgctaccattttcatccctattgggaagagttgactaggaatgtattggttagttatctttgtgccttcaatagctccaaaagaagtgactgtatactcatcagtagaagtgctggttacacttagtatatgttgtgtggggtgttgggggggggggg

SEQ ID NO: 63248 - DNA, 3928 bp, Oryza sativa
catcagtagaagtgctggttacacttagtatatgttgtgtggggtgttggggggggggggtggcaatcgtacacacccatattgcaaaacagtggtaaattctacgtcctctcattgcaaaaatccgattggagttgtgcaagaacaaagaatattgccatattggtattaatgattttttgcccatcatttagacctaaattggtaaggtagctcatttattcatgggagggcagtactacttcaaagaagattttatgttaaaaaagaattaccaaaaaaaagcatacccttttgaacaaccagccattctggtggggtcttctttttagctcacgctcgcgcttcaaacgcaatggcggaacagctgatagcttattatcagggaatctaggatgaaaagcaaccgatcgtacatatggttgctcgttggccgtatcatctgaatctgcataatcatcttcacttgatccagcttgctggaggcctgatagagcaatcccatcatcaataagctgtgcctcatgctgaacaaggaataaaattgttaatcataggagataattttgcctcttaaattttatctgttttacagaaagaagtaaagcatttggggaaaaaatcctatgagactcagctacaaaactatatgcttttagccagtaattatggcccgtgtcacactttgagaagattctaaatatttggtagtgccaaaatcttggtaagtattacacatgtttggattgttaccaatgtgaagccaaaatttgatgatacagataagaaagttctagagaataatgccaaattgttcaaaggccttaccaacaatttggatttagtacaaacattcactagtactattcaaactaccaataaattgttatggcacatgttggcatcaatccaaaatggcccctagtcttataggaatttttttcccaagcatataggccgtaccaaaaaggtttacaaatactccctagaaataataaactttaagatgtgcaacaaatcccgggccatacagatcacatcaaagaataaacttatttagctagaacacataatctgatgggagctttcaggatttgccactacattgtaattcaagtatgtcactctgtgtcagtgatgtggattttggtgtgacatgtttgtgaggaagtggcaagttcctctttgtgctttccaacaagacagaatctggagatttgcatgtgatgaaaaacaagaataaaatcaacatcgtgtagccacaatgaattatccatctactacttgaacacataagggcattatgcactatcatactcacaagcaatcatcttcattttgttcgtttcttaaatatgtacactaatctactgcagaaaaaacgagggaacctacatattaagagtaatgaaaattaaacacttgcaaaattgcacttctacacttagatgccgaagccatgtatcactctttttagactaagcagggagttatgctcggaaatgtatgagatcatgtgatgaaaacgtaagtcataaattagcatttttctttccaaaatcaaccaatacttactagcaacatcctgttacacacctaccagaactttcattttgtttgttattcttcaacatgtaaattcaaattaattgctagtgcattaaatggtagaaaggaccaaaggacagaaggcatttcatatagtttaataaagcattatctaccttgtatctcatctggatacgtcgaaggtgaacctcacactccatagtctcacgttttctctcttccctctgcgaagaggatgagtgcacggtttagtatttctcatgccaaaattggcattatttaatgcatttgcataccttaatcaatgcgcccattagtgccttagcctgctctagattgcgccggacctgtattggggttttaaaacataaaaataagcaaatttaaatatcagtgtacatagacaacaagtgcatatttcagatacacaccatgttgcaagcactacagaacataaaatatgatggttatgattaagatcgtgcactacacaagaacacaaaggcaccatgacaagcaaaaaaacagagaggcaaacatactgcactattcatatcaagacattaagagttatcaataattggtccttctctgctttcttgacagtcaagaagtttgctattcaagaggacagcaaaacattcgatatttaaggataagcttgattgcttgaatgtatttgcagtctaagctagtgatagtcaaccaaatatggatcttctctagaaatacaattaagaaatatagaaatatgatgttaagataatatgatcaacccctggcacatttaggttttgatctgaggctatcctggtctgcgggacccaacacaagtattcatcctttccaatgaaaaatagagaacaacaaatacagctaagacaatgtcaaaatacttgtgtaataattagaaccatagtttcaatcaagcctgtgtatatttgtgtccaaaaaggaaaatatctaaagagttcaaaaaactacatatgttttgacaaaactattgaaaacaacgtatttaagcccaccatatcacaagaatacatatttaaacaatactataacataacagcagatttaacaatgaatttatcacaaaactatagatttgtgaatttacgtttctggcactattgtactgatggaacatttaaaattatagtttgcaataactaaagccatagtgacaaattaatgttagtatgtagttctgcaacattgtgttttaaatttatatttttctgacaactgtcaaatagctgtaatgttgtaaaatttactctatctagaaagatgcacaagtcagagacttcaacaagaaaaggataacaacatgccataaaatccttggataaagaagaaatgcctatacatacgcaattccaaaaaccaaacatatgcatatttccataattatagcggctgctccttgaaaacccaactattgctgttacacttaccacacggagtttgtcgaatgattggacactattttctcgtctttgcatctgaaaaaataaatgaacataagtacacaaagaaatataggcacacgaagatattatcactcctgtgctttcttgatgactcaaaattgtccaggagtagctattgtcaaactagtttcctgtgactcaccctccttgtgtgaagacgataagccttctcccttggtctgaacacattgtatggatttgtgtcattaactggcggaggcggcttcaccaaaagaagaaaaaaacagttactctaaacagttgtgtgatcaagaaagcaaacatataaacagcggtagttttgtggtaattttctacctgaccacagttaatgaaagaaaaagtccattttactcccccaaactagtttctagtttctagtttggggtgggggttcaaatgagccaaaacctagtttaggggcttaggtgataaaatgcaatagttcgggggagtaaaatggacttttttttttctttaatgaaatatgaaacagaataataactcaagaatgtgagccaactcataaatagcgaatttaacttgcttttgaacttttccgcaactaacgaaattcttgaaactaagacctgtcattgggcagagaagcacttgagtaataataaacaaacaccacatgtttatccaattactttctttcatttttgtagacctttgtccccagtttgttcatttgaaaatgcaaacatattataagcataagccatgatgctaggagcaccttgcaggccctactatcatttttggggcaattggtcatttgaccctgttttgaagtctaactaccaatctgaccctactttttctagtttgcttatttgaccccgtttttcaaaatcgaa

SEQ ID NO: 63249 - DNA, 1463 bp, Oryza sativa
actctagaggatccccaaataaatcttccaaggtataacttcaactaagccaacttctccctcataagcaatatctatatgatggtccactataaaatcacatacaatttggcctttcatagatttcaatggttcataagccaaatcatatcctctcaaaagctaacctcaaatcggctatgtatccctccataccatccgatttgacaacaatatcatcaatgtagatctctaagataatgcctagcaaatcatggaagatcaaattcattgccctttgatacgttgcaccggcgttcttcaacccaaaagtcatgacaacccactcaaacaaaccaacaaatcccggacacctaaaagccgtcttgtacatatcctcttccgccataaagattttattgtagccggcattaccatctagaaagctaatcaccttatgacccgaggcatcattaatcatcatgtcggctataggcataggatactcatctttgggagtggctttatttaaatctcaaaaatctatgcaaactctaatcttaccactccccttcttctccaccgggactatgctagaaacccactccgcataacgacatggcctaataaaccccaccttcaacaaccgatcaatctcctctttgactcggtcatatagcaaaggattaaaacgacgaggtggttgcttataaggcctaaaacccggtttaattggaagccgatgctcaacaagctcacggctaagacccggcatctcatggtactcccatgcaaagcaatcaacatactctttaagtagctcgataccttaaccttataataggctctcatgtttttgtttacaaaagtcggccttggtttagttccatcacctatatctacttcttcccaaggatcggccgatgtaaacccttttccaaacttctctacttcatcaaaatcttcaatggtttcaccaatatcgttctttgtagaccgatattcttgcaccctcttttgtaaccactctaaattagcctctttactcattatacaaatttatatggcttagccgtgctacactagccggctttacagagataggtacaaatttgccatcggagatactaataaaatcatagctagaaagatccctccccgacaagcattggatattcccatgacgccactcaaaagtagcatcggccattgcaacctcggtcgatgtatccgcttgcacaatttcaacatcattgccgtcccattgaattaaacattgatgcaaggtagaaggcacacaacaattggcatgaatccaacaacgactcaaaataacattgtagttaccttgcacatcgacgatgaagaaagcggttggtagcgtcttgtttcccacggtgagctccgccgaaaagataccctttgcctccgttggttcaccattgaagccattgagaatcatgttggtcttcttcaactcatca

SEQ ID NO: 63250 - DNA, 7190 bp, Oryza sativa
  unsure (1)..(7190): unsure at all n locations
cgagctcggtacccagatactccaattccatctccagaaggtattggcacatcatgagaccccactttgatggtaattacttctgaagtccttgcctccaccttgatgcgctttccttccctcctttcttcattggcccggttcctgccataaaaccggccattatttggtgaagacaaacgctcatgaattggccttcttgatcctccccacccttggttgaattgcattggaggcatatgattgaacattggcggcgttgccccccatggcatgtaataaggataaggataacccggcggctgcattggataagaaccccatgacatgtcttgtggatgatgatatggaggtgaatgcgaccgtcttggtgaatgaccaaattgttccctaggaggtgatcttggtctttttcctttgttgtgaaccctctcaccaccttgcttctcatacttctccaaaagcatatcaaaagtcattttggtcttcctaggggctttagaagttgaagctccactcttattctccttccaaatgccaacctccggcttctttggcactatcgtcttaggccttggttcgccaatgaccactccttttcccttagtagattcggcttactccggccgaatcaacaccttcttatcattgaaattaattgtgttcaccagaaaaggatcatgatcaagcttcatcttggagccatcggtgaacttcaatcgtccttcatctatggccgattgaacctgtcgtcgaaacacattgcaatcattagtagaatgagaatgagaatcatgccatttacaatatgctcgacgtttcaactcttcttgagatggtatgacatggcctttaggtaatataatttgtttttcttgtaaaagataatcaaagattttgtcacacttggccacatcaaaactatatttaacctcactttgccgatctttgcgaggagtcggcattaggttagagcaaacaaaaggcttgtttttattagtccatgaccattcggcaacatatatatcatgatcaccttcctcctcactatcactagcctcagggtaatcaatcacattaacattaggctttttgtcatatgatctaacaagttttttattatccttaacccggctttcttgagccagagccctttgcataagttgactaacatcaagaaattgttggtgtcacgcccggaatttctatccaaaattccaaacgcttacatgtgtgtgaaccctcgtccaggaatcagccgaggcacataataacaaattgataatagagtacaattattactctaattaataagcgtataaaatgtcattacagaggtagataggtcctctcaaacaataaagatctaagcagcggaaaataagataaacggcgcagacggctccactccacaggcagcttgaccaaagctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttagtaaaacagttaagtaattaaaccatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcccgaccatcaaaaccatgtgctcacaacccaccattatcaggttttagttggcacattaattaattaaccaatcacgattgaccatcgtgaactatcattaagccatcattaagtaatagtgaatcttaagttatcccaatagtgagctaatgtttctaagcagggctaagcaattatatctaatatctagttgaaccaatataaataaagctcaactagtcaaattataataacccaaggtatcaaggaataaagtaatcaagaacaaaaagggctataacaaagaataggttaaacccacccaatgacatttgaaaataaatgcaatatttgaatagaaacagtagctttaaacgggatcaacatgctcaaagggttgtttgggatctgtgtgacttgccttgctggccttggaactcttcaaactcttctccggcgaaaacggactctccggaaacgacggaatctaaacagaaaagagcaaaaacaccaaaacaacacataaacaagcttgaacagtacatgtggatatttttaacatgtagatctcaattttagaaaaatttagagacttgaaccaactaaatcggagctaagatgaattagttatgaatttttgaagattaaatcggattaaaacacttatatagattttaattgaattatgacgcaataatgaatattttttgaaagggaaaggggggtttttgcctaagggggctagggttttggtgacccggcccccggggggggttcaccgaccggacggcccaaatcgacttgatccaaaacggacggccgagatcgaacggtccacgaccggctcacgggagagggcgacgatgacgtcgacgatgacgtcaccaccggcggcggcggctcggcggctcagacggctcggacggcgcacgctcgctggcgaacggcggcgcttcggcacgaacggagggcaccaacgggtagagcgcgacgcggcgaactcaccggtgaccaaaagagcagcggaagaccaacggacggcgacggcgacgaggttgaaacggcggcggtcttcggtttgacgacggcgacgatgctccggcggtctccgactgtggcgaagcagcggacgaggacggcgacgacttggcgaccacgacggcggttttcccgagcgacggcgacgtctggaccggcggcggcgcacggctggagcgacggcggcgacggcggctcgaagctacacggcgctagggcgcaacgcacgagggcaggcgaaggcgagggtggcggcgggtagaggagacaccggggaagcttataaaggggctaggaggcggcggcgaaggcccacggcggccggcgacgagatggaaagctcgagctcggagagagaaaagccgatccgattcgaactcgaatccaacgatttccaaaccgatttagccgatgtttccaaaggagaaaaggtagaggagatctcggggatcatttcccctcttttgattcggccggagaaggaaaggagcggccggatttggaagggaacggcggcggcggcgcgctagggttcggccgggcgacggcggctcggggaagacgaacccccacctgtcagcgagcgagggcgcgcgcgcgcggcggcggactgggccggactgggccgaggagagagagaagggttttgggcccaaaagaagactttttaaaacctttttcaatttaaattatttcttaaatgtaattccatttattaaaaatacttccttagctcaaataaatcccagaaaaatctaggaattatagaattaagcaaagtatttaatgaaattttatctgggcccattttatattggaatttattaattaaaattagatcttctcttcaagacttttaaaaaataaattctaaaaattccatttaaacaacaatttatatattttgaattttcagggtgtgacagttggccatctagtctttctctaagaggagcaattaaaccattaaaagcaagaccagccaaatctctatcagttatattcaagctataacatcggtttctaacatccctaaatctcttaatataatcaatgacaggctcattatacttttgcttaaccgatgttaaatcacataacctaagctcagtttctccagtatagaaataatcatgaaatttttcttctaattgagcccaagtatgaatagaatttgccggtaaagaagtaaaccatgtaaaagcattaccggacaaagataaagtaaacaagcgcaatttaaaaggatcactattagcctcaccacattgcgccaaaaattaacctacatgctcccatgtggtcttactatcctcaccactaaacttggtgaattcgggaactctataattacggggaaacggcacattatcataataatcaggatacggctttttgtaaaccctagcacgattcctagtttcaattcctaataatctcactaattatatcctccatattattaggcccttgttgatttggcggtggatttggtggcctaataggttgtgtttgtggcgcaatatgattatattggctttgtctagtatcaggaggataccccctagtaacgtcattataagcattaggaacatgtgggggaacttggggattatttgcagtagtagatataggaggatcaaatgttctaagatgatacaaataactagcattagtcattggatctattccctgtatcggaataattgcgtcggtctgaccggcccagggcccggtctgaccggcatccagaggcgtggtcggaccagcctgagtcccggtctgaccgtcggggtagtacccgttctgaccggctgtctggccggtcggaccgacggctatgttgcggtctgaccgcccgtgtgcgtcgctccattggttctactacccgtttgatctataggaggttggttagcagtggtagaggccttatcctttgacatgtaatcggccataagagggccgaatttaacccttaaaaactcatcaaatttaccctcaaaagttgcatctaacttatctttaaaagcaatcatagatgaatctattgtagatgctacttgttgttggatagattgtgatacctcatcattgcttaccaaatcaggagcgagcttaggacgtggcccgggcttgatgatcacgccttgacgagtcctagtgcttgccctcatcaacgcctcccgtgtgagctcgttgatgtactcctccatagctttgcggtcttctccttcgaagtcatccaatgtgaccggtatcatattgatggctccacctccgtcttggatggcggcttcgtcatgacgaagtcgaaattgagttgacgatgaacggatctcctccccagcggagttgccaaaaatcgtgttggcaacttttttgacaagttgacaagcacgatcgcagcaccttaagccttgcggtgatcctagagtcgccaaccacctcgatctagcaaagagctaaacctagatgggttttgataactaaaccggctagcggagccgatttctaaataactacctgtctcgtgggcaaaacggaaggttttcaggacaaacctacaaagagatgtcgcactctcgcagcagcggcggacggtttatggcgcaaaccgacaaagatggacaaactaagagaaaactaaaagcaatatgaaaaaatgattcgattgattgattgtagattggttttttacaatgaaccggccatgtcccttatataggggttggtcttgccctctacaggccctcctccacgtccaactcggggtagaaaccaaaggaaacccgaaacattccttcccgagcaaggaaacctcgagacccgacgaaacacaatcggattcggacctgccggtcaaaccggccacacaccgncggtctgactggccctcaaccggcggtctgaccgctcaacacacggcggtcagaccggcccactcggaggaaaccggtagacttacaaattttggcaatctttcctattttaatcctaggtgccaaatttgggtgtaaacaatcattattcttctgtgcatccttataaacaagattaaatctcctgcgatttagcctaggacccaaagaatgcaacagaataccccaaagatcatgaaggaaaagaatcgtctcatctcatcttgtggcctgtaaacacaattcaatcaccatgacccctatcttgggacagaactggactgaggcactatgtgaatcaaccctaccggaactaatggatccaagcttgcttctccatgcaatcaagataccaccagttgcccccaccgaaggaactttaacaaaattgttatcaaaatcagacccaagcatagccaagatagtgaaatgaaggaagattgtcatgtttatagagttgggatgatctaggtgacaattaattgtttgttttttaaaaaacaatagaaattttgatagagatggaaatatttgagttgcaaatatgcgtgtcatatcaggtattatatagggtgtcgcatggagtgttcagacactaataaaaaaaactaattacaaaatccgtcagtaaaccgcgaaacgaatttattaagcctaattaatccgtcattagtaaatgtttactgtagcaccacattgtcaaattatggagcaattaggcttaaaagattcgtctcgcaaattagtcgcaatctgtgcaattaattatttttggcctatatttaatacttcatacaggtgttcaaacattcgatgtgacatgatgtaaaatttttatgtgggaactacacagggccttaatcatctaacatgtactatattggtcatatctcaaatttgctagttctttggtcacctgatcagagtgatagccatctaagttaagcattttttgcattataatgtagtagcacgtcagattagttaatgtgtgattttgtgacattctaagccactaatatagaaccgggtgacagag

SEQ ID NO: 63251 - DNA, 5557 bp, Oryza sativa
ggtcgactctagaggatccccagttttcaaatctgaacttgaaaattttcaatatcaagttgaaagttttcaaatctcaacttgaaaattttcaaatatggacttgaaaattttcaatctcaagttgaaagtttttaaatctcgagtgaaagttttaaaatctaagttgaaagttttcaaattttgtcttacaaatttaaatttagagttgaaaattttcaaaatttgaattcaaagtttaaatcttaagtcaaaagttttcaatctgttagtaaaaaaatcttccaaaaaaagaaaaattttatcttaattaccgtcattatctaaaactaatttagttagttagagtctaaaatagttagttaggcactcccggaacgcgcgcgcccaatagcttttccgcctagccacacccatcatcgatgactacttatctttgatgggctgtatttgtggtctggcataggacatctgtgacgagccacaaccaaactcgtcaccaatgaggggtcatcagtgacatgtgcgagctttacacctgtgaaagatgactatagttatctttgataggctcctgttcattgcccgtcataggtagcagtgactatgtacaccctaaacctttgtaaaatggttatcccaacctagtgtactgtcaaattttgctctagcaccacaatatctagcgtaacataacacgtgtgattttgtgcaacttgaacagtatcagccaagctttcgtgaaatttacttaagaaaatgtgaaggtataaagttccaaggtgctctccagattacaataatcatccgtattttcttgtcctcctctatctcttcctcttcatgtcatcatcctcattatccctgaaagaaatataaacacgccgtgctacagatatgatgttcacaggtggcgtcctgcttccctttgaccctattcctcgagccattatttagtgacctttgtcctaactcttaactaaaaagtctttagttttccctgtatttttcctctccagtttgtattctcgaaagatataatggtatccagtttaattgatctccatatcatgaaaggccagtcgagcgaccaacttccatgcctctatcagcataggtgcattaggtaacaagagaacaagcacgtaccttctcaccattaagaacatttttttacaacatcctaagaaatattatcagtttgtcggaatatgtagggtttctaccagcgcaggtgtcgagggggtagtccctcagacagcggggagtggagacccctccccgagagtaaagatccaaccagggggtttgcggtgagaggcacggactatctgcaatcaggaagggttcacggggcccgactaccctgcacagagagggagacaggagtttatacaggttcaggccacccagaggtgtaataccctactctatgttggtgttcgttgtcttctctagatcagctaagtacaatggagaccttttcaggctacaaagcaagagtactgatctaaaagaatccaaccctttcatctgtatatggtccccttccttttatagtccaaggaggggctcacattattaccaatctactattagtcttgtcttatcagctgtcttattgtcgccggctggttccctaacacagtcttcaagaaaccctttgagtcttgcgattcatattaccccgggctccatctgagacagttaggatctcaccagtgtgctcgccacgtggtgcgtggtgggcctgacgagacccgacttgcccgaaacagtgccaccgttgcttctccacttgcttggataaatcaagtggtgcgaggcatgtgtgacgcgtgtccaaggcgtcactagtcctaggtgactcagcgctggtgtcttgtccacgtcctttcaacttcagactagttggggatcccccatgatcctgtttcaattatggcggggcatactgcctcacagctggctatggagcacgcccaacttcccggcaagtttggcaatcctcggatgagtttctcgaagatgtcgttggtgaaggaatattccaagatttgtacgtctcgatgctcctctaggcagagggagtgagccctataaggaccaaggtgagctcggggcccgaaacaaggccgggcctgaggcaaacctcagtttacacctttatgctttgtatgtcttggcactcatcatcctcgagtagtgcgtgactcatgcgaactaaggtgagcccggggcccaagagtaggccgggcccgaagcataccttagcttgttctcttaagatataaatcttgcagatttctacgccccttttgccgaggaccgtagaacctacaaggactaaggtgagactgggacctaggacagggccaggtccgaggcagaccataggctatattcttaagacgcatttggggtatgcttgggacccaagccaggtcccaagctacttttatgctcagagatttgagtcatacacgcagtattcctcctcagctagggagaatcccatatatgaaaacttaggtgggcccgggacccaccagagtgggcccctagctacgtcactctagggttacctttttatttttaaagatattctgagcatgctatttatttgataatgatccttttgccagataaatgggtaccctggtttccatttcaccgacagcaggtgagtcacaagcatgaagaatgaaaacataaggaatgtatgtaaaatcatggccgattagactatagagagaaattctcatctatgttgtaggagttgtttatggatcaactagtaaataaatatcgtcaattgctcggttatacaggattttcatttaatttacagtgtggttcactatgcgagcatcttttttatgggttaccagagtatctcattgctttcaatacattcttgccaagttgcattatcaaaatttggtgaatgataagaatttggtcagaacatctttgttcgctcaagggtctggcttgctagcgacaaatttatatgcaataggcttttgcactgatttgtgtatcaaccactgtgttgatttgtgtatcaaccattgttatcaaactgcctgaaaaacactggatatttagtcattcagtaatgctggatttgtgtttgcagtattcatttggagtaccaaagtcctaacaatatatgatagtgatattatttttattcaatctacatgttccatggttgcatctgatcatagttgcctaatatgtgttagatttaattgggtaattgatccaattaaatcaaataaattccaaggctcactatgctagaaatttatgtgtattcattctcttatgggatatcaatgggatgaaaagttttgagaattaatccatttgattaatgaattggtaaccaatatcaattactcctaattgatggttggttgatggttgtgtagtggaggatagttgatgacaattagttactctattcatcttcctattccatgactcttttactcttcatctttcatttctcctataaaatgagaatgggagaagagacacacacgtttcatccacttccaatgttgttgctgctacggtaatcccatcctgacgagtgtgtgcacacgtattaggagagtaagccttcgaaaccacacactgctatgacgtttgcacggacaggtacgacgtttgcacggacaggtgggcgatcaggtttttggggagtgcaaggcgcgactactcactattcatcaatgtctacttcatcttcatcaacatgttgactgggggaggcgtcaacggtggacatgtcggcagcggtactggaggaggcgagaacaacaacaccaacgtaggcaacagcaacaacaatgtctcatcctcaggagcgttctctgggtatattactctaatcaccttagtgttaaacatgttactagatgatgctactattgttactagtattttcatgtttagcactatcactggatcatttcggtttccacatgtcatgtttattatcttttttctggattaaaatatgctgaattatgaccatatttctaacagtatgtttgttcaaacataggagacatcattgttggctatgtttctaccacaccatagacctaagttactttatagttctctcctcctgactgtgttatctggtttataaattgtaatagtcttcaattgattatagttgcacaccctaatttgttgtccttcacggtacaacttattaaaagcttgagattcagtagatccatggaaaataaatagaaccattttgttgagttgtatgctgcacatagactacgcactctattgaacaatgttgcatcaatataatgaaaagtcgccatttaacattataactccaataaacgcctctattgatagtagaggatcatcactttagcaaatagcgtgcgcgcgcgtgtgtgtaacttccagctgcttcaaaccagttaatgtcaaacaacatatatagtaactagagaactacatcatgtgtccaagttttccctatatggctgataaacacatgcatcacccatttggtgttggtttgactggattttcacaagggtggagttaatattgagctgattgaacattttctgtatatgacgcaatacacatggagcatggaaattttatcctaggcagcctgccctgtatgcactggaattttgctcgttacttaagtaatgtttcgggttgataatgggacctacaaggctatatcgttgttaatggaacctacaatgctatatcgttgttacagacggttatagactatgggtgatgatttccacgtgaatcaccattgagatctaactctttgtaatgcataatgtgcatgattagtaccaaactcccaactagcatattgtcataaaaactaacttggggctagattgttacaaataacaatccatggctccggcaatgattaccaaatgaaaataataagttattgtggttcactaatagaacatagagccatatataacacatgtactaaatgcaatatccataggaggaaggattcactacttgatatagattagaggtctataataaaccatatatcgaaacgacaaaaaaggttgtaaacaattacatatatgattttttttacccagctcatatccttcaaaatttgaagcatgctgctaaatatgaagtacttgttgtgggctatgactctaattgattatctatccatacccctttgggagaaattgcgattatgtagattacggggtatagactattcgagattttgtagttgtctaaagaatatgttggttggaaatcttggttgtttgggaaccccatttttttaatgccatttgtctaaactaagtgtgtaaagactagaatacctctaaaaaactttatttttctatgaaagctcagatcctactattcaaagcaacacattaattcataaactaagaaaatgtaggatacactctttcccttcaccaaccttaacaaataatgggtgggtgcagctagtaggtcttcattgagtagggtaccgagctcg

SEQ ID NO: 63252 - DNA, 5567 bp, Oryza sativa
taattacatgacatccacatgccattagggcatataactttttgtctcgactttttgccaaaaaaaaaaaaaactaaaagcctatgggagcaatgggatgaagcaatgtacctgcggggagtgttaggcgcagccgtagatggtctgccggcctgaccaacccctgcttcgacgtggtggatttgagatccagaggcgtttgtggcgggaagctgacaatggcactggcgacgccctgcagtagcaaagattcatgtgtgctgatgtattgggatatatattattgattagtgagaattagttaggatttctgagaatcataacgaagcaattatcatacaagtaattatcatagccatattatgatgagaatttatatagattgcataacaaaaacaaagtgtaagattcgtgtcgaagatctggcattaacaaataggggtcatcgctgacttaagtataaaataatttatctacaaccaattaaggaaatcaggatttcttatatttttatccaaactcatggtgttctccacaaatctaaagaggtaaaacttagatgtagcatattcagagaggctcaatgttttcatatgtgtttccgttggtgacctagtttagttttagactgtctaaaaatgaagatctaatcctggtcactgtcagggtatacacagatgtctgaaagcacaggttccatgatatgtaatctcctacaacaaagaaaatgatttactctgtaatataagaaaccaactttcagatactggttataatgggttgcatgcctgttcttccaagattacaagtttaaatttcagccaacaatgtgcggagatgatgtaaactcaatggcactacagcacttcattagcacctactgtttgttaattttgttaatactacaacaattcaaactcttagaaacggttatactgctttctgagcctatcttttttactgtctgaaatatggtgctggcctcatgagcaatgaaataggaaacatgcagtgcatatttatgttgaatccggaaatgttggcctcatgattaaagaagtaaaatagcagggctacgccacacacagacacactgtgaccatctaccttagaaacacaatcatgcatgatattccatccagacaatcttaattatatttgttgaatcttcaacccaattgagatcttatgaattatactgaatatatgttagaattgattggaaatttcaatataattaccacgcctcgacgaccgatctatattagccactatatgttcagaatttcacactttcaaactttcaaaccaaagtgagggatgtggtcatgggtgaaggtggcacaaacctgacagtactatgttgccctcgaagacctcactcatgttgctcccctcaaactcctcaacctcactgaatcctgcacataagaatgaacattgaacaaattatagagagggccatatagactgccagaacagtgatggaggacatcacttcaacatgtcagacgagtaacatgccagagcaggattaattatttcctttgatttctaattgatttctagcaggattaattgatctctaggtttggtaatgtgcaatcatatatatgagcacttgcataaattttcacatggactaaactcttattatcttttctgttaattagggaactctagtttgctctccacatgccatgtacgaggtaatactccatctaagtctacgtcaaaaggaagctatcgagggttcaggtcttggcaacttgctaaagattgacaacatacatattgaccgaaacttgtgcaatgagattgcaagaagctatgacaaggagaagaaagcattcaatattaatggtactttcgtaacgatgacactcgatgatgttgattgtttgcttggactgccatcaaaaagagatgacatatttgaggcaccaaaaatcaataaaccagaattgttcaacctgtaaaaaaggaaggccaaacaacaattactttacaagcattacgggaagcaataatcaactccttgagctacgatgaccacttcattcaaagatttattcttttctcaattggatccttcatatgtcctacaactcaaagatatgtgcgctcagaatatctcaatctcgtcgacgacgttgacaacatgagggaactaaactggtctagtctaacactaaatcagttactgaaaggcatattaaaatttagagagaagacaacaaacattgaggggaacgtatgcctcttacaggttcgtttcaaaattgagtttctttacaaaattgtcatgaacatattttcatagcaatactaattatcttatgtacaaatgctttgcagatttggtattgggaaaaagtgcgaatagataaattggctgcgacaatatatcattctggtcgtcaaaggccactaattcagtactgggacaaaaaaaaaaaagaatttcttacctttttggacaagggaaggtaactatctcatttttaatactatgtactaactatatcaactgtctgtaaaatctctaatacacctttttcactaaaaataggttgtcgacgacattacgggaactatacattgcaatgaaatccccgatgaaaaagcgcaggacaatgactcagaaacacgtagcaatgaagattttcaaggcacttctgaagaggtatatattatggggttttaatacgaactctatttaacaaaatatgtttgacatccttttctcacttgtgctattcaggtacactctataacatccactgaacaatcagccgacatcactttacaagaaaggttacaagaaagcatccaaactttacaagataatttcaacgatttcacaaaggatttttggccacgtatgcgatcattgatactagattgcatggaaaatgattcaaaatgcccagagcgaaaagatagtacgcatgtgtttgaggtaaagatcatatgctagactgttaatcattattacttacgtaacaccgctaaaaaaaaggttgacgctattgcaggatgttgaacaagaacaaattgatcccagggagcatgtatcaaatcataacgaagagtcctatataaatcaaaatgtaaacatgacttgtgaaacgaaggtaaactgaattttatttctctcactaacgttactacaacttatcataatactaacgtgcactttattacctaacaggacaatagtaactagagcaatcaaagcaggaagatgcttacaggtcctacaggaagaacatacaaaccaactaatcggactgacttcatctacgaaacaagaggtaaaaagaaggacataatcaaaacccaagcacagacaaagaaaacaataggtactatgctatttcatagttgcatatgctcatgtcaatggtactaactttactccttttcaagcgcaaacgaataaagaagcttacatgccagacacaggcgaattacggggtgaaaagaagaggaaacaagacaacccaaacactgaatgaaatatccgaatgtatgaactctctacatcatccataattttttacttatattctatgtttgtgtgttactgatttgacttacccttttctagtgtacatagagaaggaatatcttacgcaaaaaaacatagacaacggaccaccaaagaacgccttacgaggtcaaaagaagaaaaaaaaacgaatggccaaacaatgttaaaaaattcagaaggtaatgactaaccatttaacatttctatagatctattactaatttgtccaaccttcgtagagttgactaaaaaagaagacccgttcattacctacattaataacacggaggataacaaagtgatggtgcatattgaagaagtggaggttaaacggataagaatgaaagtactaacacaaccagaattcttgaatgatgatgtaagttcgcctatttaacaagcctactattcttttataactatatttgttatataactgaactaacctcaaattcaggtcatggatgcatacatcctatgcctccgctataaagagaaaggaatcaggggagatggcaaggccttcctagagatggccatgaaaacaggtctactaaatgtagagggagcgcatgtcgaagcaagcaaacctcgagataaacgatggattagagatatggcacgcgactatctagcatttgacatggtaatacttattcaagctatctatgtaatggctaattcaatttatgactctatctatgtaatggctaattcaatttatgactctatcttagtgttgaacaatgaacatatgcagattttcctcccaattaatattaaagatacacactggtacctagccgttcttaacgccaagcgatgtgaggtgcaaatactagattcgctcgcaaagccaatcagtaaagatcgacctgatctaaggcgtgtggtaagcaatacacttccacttgtataattcaaattggttttgctatgttttaaccgtaccaacgttgcacaaaactttccagctgctagctattgagaggggattacacgggacagagaatcagcacccacagttaaaacacgattggcctgatttcaatattaccgaatgggagtacaacaaagtccaaaactttccaaagcaaggagacgggtgggtgactcaaactcttccacatgatattcacattattcaattacgcaaacatgttagcctaacgactaaattcttgtagcttctcgtgtggcctgtacacccttaagttcatggagcattggagcggatcttatctcccagaaattcaactacaggcaactacaacaacctctattcatattttgcaccagtgcttcccaatacaaaaaaccatttaaaatgcactccctttgcattatgcagaaggaagtgaaaacatttcgacaggacttagccggaattttgatcaactccgaactgaacaacattaaagatcgtccactgctaccaaccacgacataaatggattatctgtcaaacatttaccacaattaccttactatgctctcttacccttattaaataatttagatactacttgggtatttgatggatcccaaacattgatgcctttttgagataatattcataattcatatttcaatccatttgagaaggagcggtatatgaaaccttacgcttcgggatgactcagcgcagtcagctatcgacgtcaccgacgtgcgtatgctacaatgtcgcacctgaacaccgataaccccttcgccggcatacggatccccttcgcgcatgccaccgtcttgcaaactgaccctgctcccaaccattcaatcaaataatcaatatacaatacaatggattcaagaacaaacaacctttatctgcaaaatcataacagtagtggttggtatattaagatgctgcttaggtgagcactataatgaaggctgaagcaacagagtaaatgagtaatctcgcattagaagatgatactctttaccaacttctcttcgttgtctttctgataccgtataactgaatattggtaagaaaagtatggta

SEQ ID NO: 63253 - DNA, 1559 bp, Oryza sativa
cagatctagcggaaacttttgagaatctccgctccgcccgcataaaactgaaccccgataagtgtgtgtttggtgtacctgcgggtaagcttctcgggttcttggtctctgcccgaggcattgaggccaaccccgagaagattcgagctatcgagcggatgcgcccccccagcaaacttaaggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatcttagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggccccaggcccccgacgaccggagtcggccctccacccgcttgtcaaacggcgctgggtgcccccgaccctcaggaaggccccgaggccactgagggaaggctgcacttaaagccctttggccccgaggctaaccctgtgctgactcgacccgggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagtgcgccccgaggggccacttggacgaagaacgccccgggggtacggcccctaacgaggaggatcggccccgccgaaaggtgcagcggcctgtctactttgttagtgaggccctccgggacgccaagacccgatacccacaggcccagaagatgctttacgctattctgatggcctcaaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggcaagcgcgaacccttcacagttgcctcacgccgcccattgggtgatgcaattcgacggttttctgtcttttcagggcgccggtgcaggggtcacgttgacctctccgaacggagacgtcctcagatatttggtccgtctcgactttcgagcgactaccaatatggcagagtacgagggactccttgccggactcagagtggcggctggactggggatccgccgcctcttggtattaggcgactcccagctagtcgttaaccagggggatcctctagag

SEQ ID NO: 63254 - DNA, 3232 bp, Oryza sativa
  unsure (1)..(3232): unsure at all n locations
nnnnnnnnnnnnnnnnnnnnnnnnnnnnnnnnncataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcgcgaacccctcacagctgcctcacgccgcccactgggtgatgcaattcgacggttctctgtctcttcagggcgccggtgcaggggtcacgttgacctctccgaacggagacgtcctcagatatttggtccgtctcgactttcgagcgactaacaatatggcagagtacgagggactccttgccggactcagagtggcggctggactggggatccgccgcctcttggtattaggcgactcccagctagtcgttaaccaggtctgtaaggagtaccggtgctctgacccacagatggacgcctacgtacgccaagtgcggcgtatggagcgccattttgacgggatagagcttcggcatgtgcccagacgggataatatgattgccgatgaactctcaaggctcgcgtcctcgcgagcccagaccccaccaggcgcctttgaagaaaggcttacccagccgtcggcgcgacccgaccccttaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaatggaatcctcctgaagtgcattcctcaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtccgacgccgcgtccaaacgcgtgctggattgagcaaactctcaccaatgtgggagggtccgtatcgagtgatcggtgtcccccggccgggctcggtacggctggccacgggcgacggcacggagctgccaaacccatggaacatcgaacaccttcgtcgcttctacccctgaaggggggggtcgggtgtcaggttttggctcgggctaaccccgcaccccccctcgggtgtgcggggttagccgggggctaccacacatgcatatatattcctttcagcatttcaatagaagcagtttcaatttcctaaaggttgtgtctgtgccgttttttccttttgaagaatcttgacttgaaataatgtcactcgtgctcaaccttgccctcgggggctcggttcggtcggctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgcgagcccttattccaagctaagtcgcaaaaggaccatggcacagatcatcctcaactcatatatatagcaaaataaaactaacacaaaaatttttcatcatttctcattgcagattaagttaaaattgtacaaaaaagaggcatgaaggccttagaagaaagaacaagaaaaaagataagagtggcgggggcctgggggctcattcatatgcgcccgggtcgccggcctcgtcgccaccgccgtcctcgctgctggtgtcgccttcctcgtcggagctgggggcgaacgcaagccgaggggccgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggagcgaggccttccagattggtggggggcaccgtcgtctggcctccccagaggcctgcttgccgaccggcgcgcttcatgcgggagaccgcgtcccaaagcatgccgggcccaatctcgcccgccaagcgaagggcctcggcctccccggtggaggagtccagcgcgcgctgcatgtcagcgacggtgtgttcggcagccgcgaggcgagcggctaagtcgctttcgcccgcagccgccccaccgatgc

SEQ ID NO: 63255 - DNA, 1454 bp, Oryza sativa
  unsure (1)..(1454): unsure at all n locations
nnnnnnnnnnnnnnnnnnnnnnnnnnnnnnnnnatttgcatctatgacatagtccccatggttcacgcactattacctgctctccatggtcttcaactatcttccagatctccacttaccccaattatcttgtcgaagcataatgcttcaaaactgcaaaaggttcaaacatttgttatcacttaagcaggagcagaacaggtcaacaacaattatcaaataagataataactaactaaactagactttaaaaaataaaatatactaaaaactacaatgatttgtcctactaggtcctcatcctatcccaccaagttctacaaacctaagagtccacatgaaacgatacaacatactacattaatactactaacaacactacaattatggctgtcaaaaaagctcgaggcttgtgcgctactcgagcttggctcgtttcggactggattcgagctcaaatcgagctcttaatgagccgagcccaagcccatgcgcaagttcacgagctttgtcggcccgagctcaagcttcttatgagcctagatgtatgtgtaatttttatcttttatatgacaaactagtatgctaaggataacttagtatacattcatttgaaaatttagtatgtgatggtatcatatattaatcttaaattctcgtaaacttcttttttcatattattaatttagaattattgtttttataaaatattatcatcaaaatatggaacatattttaggtttacttaatttcattcatcttacacctcacagccgattcggtcagatcgcatcggctaggttcacacgatatgtcatcgacttactggctgatcggctatcgtattctaatttgattgattttcttgtttattcttgttggtgatcggatcaaactaactggcacgccctaaacctaaaagcgttttggacctgtactggaactaagccgaactcccaggccgccgcgtttctcgtcatcagactcctaatgggctttgaaggcccaattaaacgtcttacatattcaggagcaaggggcatgggaccgtctgacacaacatgtgagaaacctagtcgttaccaagatgaagagcatcaaggacacgagatctccttgctgaagcccatgccggtgagaaattgacacgttgtgagtacatttaagagtacctgagtagaaaacctagccaacaacctacttaaaacatcccgctaaacttggctaaatcctatgcaagacttcaagtaaaaatggccgaaaagcagagtgaaaggctttacacgtgtaaaatttgagagcaattcttggctccttttgagattgcaagaactttgccgtttgttgcacaagcatgacgttatcttggataaatcaaccttttataaaagtactttggttaggagataccaaatgttgtagatggctagcagcanagggcgatgatcctaatc

SEQ ID NO: 63256 - DNA, 2568 bp, Oryza sativa
cttttttgacaagttgacaagcacgatcgcagcaccttaagccttgcggtgatcctagagtcgccaaccacctcgatctagcaaagagctaaacctagatgggttttgataacaaaatcggctagcggagccgatttctagataactacccatctcgtgggcaaaacgaaaggttttcaggacaaacctacaaagagatgtcgcactctcgcagcgtcggcagacggtttacggcgcaaaccgacaaagatggacaaactaagagaaaactaaaagcaatacgaaaaaacgattcgattgattgattgtagattggttttttacaatgaaccggtcatgtcccttatataggggttggtcttgccctctacaggccctcctccacgtccaacttgaggtagaaaccaaacgaaacccgaaacatgccttcccgagcaaggaaacctcgagacccgacaaaacacaatcggactcggacctgccggtcagactggccacacaccgccggtctgaccggccctcaaccggcggtctgaccgcccaacacacggcggtcagaccggcccactcggaggaaaccggtagacttccaaattttggcaatctttcctattttaatcctaggtgccaaatttgggtttaaacacatgcccccctgcctttttgatgaacaacgtgaatctaaaagcatagaacatgttttggtcttaggacgataatccaattaccggccatagtacctcctaagcgtcttgccaaacgctcgggaagtatttcttcaaatatttcccgttgattgctcgctgaaaatgctccccttgaagtgtctccaaaaaatatgcgttccctcgaacaatgccgcacactcgataaggaccctcccaactaggagaccacttaccgaactccttggaccgagtacccaaaggcaaaattgtcttccaaaccaagtctccaacttgaaacaactttgctttcaccctcttgttgtacgccttggccaccctcttcttctctttctctatctcttccaatgccttcaagcgcttgtcgatgacttcatcaagattatctcccatcaacgtcttgtaatcttcacttgacaaatcattttgcttgatataacgaagagaaccaagatttacctccaccggtaaaatggcttcttgaccataaaccaactcaaaaggagtgactttagtagcaccatgtttagatatcctatgcgcccacaatgcttcagaaagcacctcatgccacctctttgggtgttcctcaatcttctttttcactaacttcaacaatgtcttattactcgactcggcttgtccattagcctgagcgtagtaagtagaagaactcaacaatttaataccataagattcggtaaaactcttcacttccttagacataaaagaagcaccttggtccgtagttattgtttgcggaataccgaatctatgaataatatacttcaaaataaagtcaattacctccgtatgagtcatattcttcaaaggcacggcttcggcccacttggtgaagtggcttccgctcacttggtgaagtaatccgtagcaactagcacgaacctatgcccctttgatgacgaaggataaatttgaccaatgaaaatcaaagcttatcatcggaatggccatggtttgattatggggttaaacacggcggcaggcgccaattgaacattgtcgaaccgttgacaagcttaacatcctttataatatttggagcaatcatcaatcatcttcggccaatagaactccgttctcttaagcaatcaattcatcttgtgggccgattgatgagtcccacaaaatccttcatgtacctctcccatagccactttagattgatcttcatctaagcacttcaacaagacaccatctatatttcggcggtataaatcctcatcaagcaatgtgtatttgaacgcttgccgcagaattttccgatcaaccttaagtgtgggatttttcaaatatcgaatcaaaagaattctccaatctccttctgcttcctgggcacaaatgtccgaattcacagttaattcggccactatattgattgaaacgtgccccccagcgctctgcccagaaccggtcagactggccacacagggccgttcagaccgctcagagtcgccggtcagaccggcggcatgcggccggtcagactgcccctggtcaccggtcagactggccgagcaatgccggtcagaccgcccctggtctccagttttgccaatttcgcacaaagatttaaaatcaagcaccggctcttctaatatcagaaataatccctttttcacattatagccagatgcttgttgtgccaaattatttgctctagaattatcatgcctagcaatatgtctaatagcaaaattatcaaaattggcaataatatctaaacatgaatcaaggtacctatttagtgatctgtccaagcatttgtagactccggcgacttgttgcaccatcaattccgaatcaccaaaagcctccacgtatttagctccaaccatctccataacttgtaagccgaaca

SEQ ID NO: 63257 - DNA, 3039 bp, Oryza sativa
ggtcgactctagaggatccccacttggtgggataggatgaggacctagtaggacaaatcattgtagtttttagtatattttattttttaaagtctagtttagttagttattatcttatttgataattgttgttgacctgttctgctcctgcttaagtgataacaaatgtttgaaccttttgcagttttgaagcattatgcttcgacaagataattggggtaagtggagatctggaagatagttgaagaccatggagagcaggtaatagtgcgtgaaccatggggactatgtcatagatgcaaatcgatcaaaacaagcaccaaattccatatatatagtttagaaacacgctattgttctttgtttggtatatttgctttgacactcgattattgcagcccaatgagagtgttgattgagaatctttagcttttccttttttacttcgaaacaccatcatatttcaaatttaccttattagataaggtgcaatggtagcagcaaaaaaaaaaaagctcatgtcatcacatttgcacacctcatgtatctatgatgtcagtctaatggcgaatccttaattgccacttgtaagagtggcaaatagttaaaatatatgtactattttttacacaacctagcatcttcaacactttcgatgcaacattggtcaagtgatggcaatctgtctacagcatttaacagaacaacatggtctgccaattttccatggttctatttcattacaacatagttcatccggaatagtagtattgctatggacaacacattatggtgccaaagcaacaagaatcgattcaagaccattagaaagtcaaaaaaacagttaggagagaaaaaaatcaagtaattaagtacgactagtgtggtacaaacatgatcaatggtgatagctcctacattgaacaaacaaaccatgcgagcgttaaatgcaacgtgagacaaatattagtaagagagcaaggacaagtttgggagcttgctgtagctatagctactcccgaaatctcgagctccctaaatagttcagacttagtgtttatagaatcgagaaaataaaatagtagcagaggctggataacataggcagcactcaaataggttgtctatctgagctactctacggcatggaaaacacgatagataactagaacatgattaattaagtaccaactattgtaaacatgacaaattgttttatttttttaaaataaacttctatacagaaaatgtttggaaaaaaatcatcgtagtagtttagttagtgtgttcacgataaccgaggaagtagccaattagagaatctcatcaaatgatgccttagcttctctagatttttcaccaaatggatactcactagctacttagaatctctatctccaccaaatagatggcatagataaaataagaataacagcactccaaaatatagtcggcacttaggtacttagacaagtacgataagaacaaatgtagcattgctaaattattcaattaaaatagatgagtaaaccaactcataaagttatcaaagatttattatagctagtgagcttgagccttaaacgaggaaacatatttagacaaaattcttcatcatattgcatttatgcctcttggcaagaacttgttgaatgcaaggagtagatcaggatacccatcaaaaaggatcttcacacgttcaataacagtatgagtgttaatcctgcataaccaaagtttcaataaaacttgttatccacatacaactagtaacacatgagaatttcttgctccaatctatccagtcatgattttgtaagcaaccaccctatgttaatgcctattactcacctgcccctggagaaatcaatcatggtgtgtatgaatgcatggaacttctcagggtgacgcaaaaatttattcttgatggtaagaatgtaattcattgcatcttctgtcgtcaacttatgcaccttcaccgatgtacgcatggaagtttgtggcttaatggaccttcaatgataagaagataaatcaaatatagtaccattaatactcgagaatacaaattgataaagaaaaaaacaggaaaaataactagagccttttactaagaacaaaggtcaccgggaagctgagttgaagaatgatgttaatggatgtggaacctaccggtcaatatatttagtacaaaataaatcctacataacatgcatttgaaagaaatttaaaaggtatagtgccaacacaacaccatgcatatttagttatgattttctcagttcaatcctaccagcgattatttcttctctctttgatttgggagggacgagatggttacaggtagggacggacctaggttttgcggagatctgggccggcacatggcatgtttgggccaagaccaccattgggtctgttcggttcagctgggctgtggctgcacagccacagcgctgcagctctcctagcataatcttgcttcctgagtcctgtagctacagcgcttccgaactcacccattatatggtgaaagtttgctggacctaatgggctttgtttcctaggcttcgggcaatggcatgtgtgtcttgaggcttggtctgcccttaacacaggtggagcaggagcccaaaccaagcccaaaaactagattcgccactagacctgggacatgaacctcaacaaatctagtcgacgacttggattgatacccaattaataacaatttgtaatgtaaattttatattataaccatatgacacgtgaaagagtgaaaaggtactagccagcccacactattccaacccaatagccttgagcccataaagtccaactactaccaactctcctaggccctaatttgtctctcacagtcagcctactcccccatcccacaccgcgccgcctccccctcacgccgcctccattcctccccaacctcatctcctccatcctccccctcatgccatccgctttcctcccaaacctcaacttcaccataatgtgctcccatggggatcctctagagtcgacctg

SEQ ID NO: 63258 - DNA, 5727 bp, Oryza sativa
  unsure (1)..(5727): unsure at all n locations
nnnnnnnnnnnnnnnnnnnnnnnnnnnnnnnttcctcccaaacctcaacttcaccataatgtgctcccattcccctcaaattcaaaatgtatctcaaacaacaaaggcgtacaagagatagtcgtagagcaaatgaaggctagaaagtaatggtgaccatggtggagactagagaacaagatgaccattctaagaagaaggatttacatcatgcaaattaaaacccaaaagattttcaaacactaaatcagcaattcttcactcaatttcacaactaagacgaacaaagagtaaaacaagaagaggataacaagggatcgtagggattgatcggtctgactactcaccgtttgaaccccatggttgtgcctgccctttgatatggtctctctctccaatgatggtaatactcaatgaagacctactagactagctcaccctttatttgttaaggttgggcaagggaaggaatgtatatatccattggtaggatgtgtgctgacataggaaattgaagattttgaggggttttctagtctttacacacttagcttagataaatggcattaccaaaaaccggggtagccaaacaaccaagatttgccaaccaacatattttttaaacaactacacaaagttttctataacccgtaatctacacaatcgcaatatgtcccaaaggggtatggatagataagcaatcagagtcatagcccagaactagcacttccaacatagttggaatatttagtagcatgcttcaaattttaaaggatatgagatgggtgaaaactatcatcatgatagttgtttacaacctcttttgtcattttgatacatggttatcatagacctctaactctaatccatatcaagttgtaagggataattgttccgcctatggatattacatttagtatatgtgttgtatatggccatatgttcttttagtgaaccatattaactttttattctcatttggtagtcattgctggagccatgaattgttgttcgtaacaatctagcctctagttagttcttttatggcaattcactagttgggaaagtttggaattgatcatgctcgttatgtgctacaaatacttagatctcaacgatgattcatggagaaatgatcacccaaagtccataaccatatgtaatatcgatatagcattgtaggttgaaagaaccttgatgtcacctaagagtggtgaataggcgtttaaagctttacgtaaatgaagaagctagactttttggatattccaaactattttaggatatttccatattatttttggatattctgaaaaacttagatttacgagcaagctagttaagcaagcaaaaaagtgtggtggttcaagttaggaaatgattgcacaaacaacaagtaaactactagcagcatcatcaattagctaagatagatgagtgcgcgagatatatcaccaggattcttgtaagacgatatgctcccgaagttcaaatacttgaggggattctactctccgttgaggagctcataatgagccaggtcttttccaaccctatccttgtgaggttgcacaaatgtactcctccttccactaaaggtatctcttcccattcggaggtgagatcgtaccttcacaaactccctcggcacaccacaaacaaattggtgtctcgaggttgactcctagtcgtctaggtgtcctcaactaccaagagtaacaaatgcaacaaagatttcttggagatgaattgagtgctcaaaagatcttcacgaagtcaacaccaagcactaaaataaactcaaatcaaccactctcacaaacacatgaaatccaagcttatagatcggtggagaggaagaagtgagaaagcaagactcaaagtgaatctcaaatcaacacaagataagcaatggagccaactagcttgaggttggagggtagggacggcaattttacccacgggtctgggtatccacgggtatctgtggatacatggcccgatgggcacgggcatgggtgtaatattttgcccgtggccacgcccactcgagacctgagaacgtagcagacagttgtcgagtattattttttacccgtaggtaactcatgcccgacccggtacctatgtattagctaatttttgcctacctagccatctcttaattctcacaccctttctcttggctcatttggctcgttaactagggacacatatatactcaactaataaaccctaacctaattccccattcccctctcctacccccatacccacagcggaggccggcagtggcactgatgcgggaaggcggaattggcatagtcatcatcctcgtcctcgtcacatgcagccgctgtggtgctctgcgatgccatgaccagcgacggatgtggaggaggagcggtggagggacgggaacaagctaccattgaggaggagcccgtgttgctgccgcccgtatacgaggctccccgcgtggaggcagtgcatggatgcggtgctcgccggagggatctggaccgcgacgcggagatggcgaggcgaggaggaagtgggatggaggttggaggagagtacgctcgtgagtcgcagcggtgggcatgaggcaacggctcacgggcacagtgggtactcgttgggcatgcctgtggttgacaggcatgggcacggtcacggggttttgcccgatagactttacgggtgtgggtcgtgcatgggcacatgggtctcgggctgggtatggatttgctctgcccgtgcctgacctgactcgttgccatccctagggatggggcctatttttggccacaccctcatatctgcccgaaaatcaccagagagcaaaattaactttcagaaatttctaccgtgattttcagaagttgctatagtgttttcgcaagtttccaaaaagtgtaaaaaattcagcatgagcatagtagaaaactgggcaaattagcatgttggaaattctgaaaatattttcgaaaagaaatccaaaaatcaccagataaataaactttcggaaatttctactgtgattttctaaaaattccgaaatcaccagagagcaaatttgttggtcatatcaattttggaaattcagaaaggaacttttggaaatttccaaaaattcagcgaggacgagggcgaggctgaggccgcaagggcgtgaccagcggtgaggcagtgaccacgccgaggcaagtgccgctgccgagctagcagctgccggctggggcctgcctggatcatctattcatctctgcatcatcaagtaatttgacgaactagactgtcatctcatctctgttattagtctgtaaaagtattttgattcttgaatgattgattggttggattgattattgaatcaaatacatatgtgatatgtcttttcttttgtttataaaaggaagtttttgtttcctcaattgcttcaattcctcatcatgtcttccagcaatagaaaatatgattcactgactagatgaagcagaatctcaaaagggtgcttttgatagctttgttgtaagagaaactcaggatgctactgttgctgacggtcatggtggtgatgtagaagaggtcgaggttaatgttgcccaaggtgatgcagtagaggcaaatattgatgaaggtgatgtcgataatattgccgatgaaggtcatgctgctaacattgccgaagaaggtcatgaaactcatgatggtaatattgccgatgaaggtaatgatgctaatattgccgatgccatcaattgttcttttcatgatggatgctaatattaaagttatatagttgactaaaagtatgccatgtttatatgatattagatatatgaaatttccaaaatttacggccccaattatcattttatttaggggccccagatttctggagatggccctgagaatttctctctctaatctaatcagtcatgatattatatgcggtcatcatgcattcattctttatgcttatgggtcatatgactcacgtgcggctattagaaacccctcatgatttggacgaaccaagaagtctcaggatgttatttgtaaatattgtaaccttctttttatatatatttaatatagcgcagtaggagcctctcctgctgtttcccgtcaaaaaaaagtctcaggatgttctcttcgtacccaatgcagcagaggcgaagccaggggatctggaggaacccaggcctccccaggccaataacaaccctcccccacccccaccccctcttctctttttcacataataatcatctttttatcacctagtggccatgttcagctggtggttcgcggctgtggcgcaaccggcaccaacagtgccgcacgcacgcggcgcagttgccgtagcaggcttgctaaacaggcccagaatgtcaagtgtaaaatttgatatggctatggtatactgttcaaccatgaactaaaccttccatgctgtaatgtacctctacataatttctaaatgagtaaaatacacggccaatccttaaagttggagcgaggtgtcacttaggtccatgatcttgaaaaatcaaaattaggatctgtgatcttgtttaagtgactcattgaggtccaaaggtcatctgaccgggttgactggcttacatggcggaccagagtggtaacatatttgcatttcggtccctcctccccgcatccaatccaacgggagcaccggcgggcctgggaggccggcggcagacgagcacggtaccgtcggcgggcagtgggtggagcggcggtgggcaagcatggcggtgggctgcggggggagcggacggcgggagagcgcagtagcgggcctgggacgccggcggcgggtgagcgcagcatcggtaggcgggcgacggatggaacaatggtgggcgagggcggcgatgggcgaacacgacagcagttggcgggcaacggagggagtcagagaagagcttgcgaagcaccgtcgccatgaccattgtgggcgagcgagcatcaggcagcgggtggtggtggtagtcttgtaggcatcctactcctgctacaactccatccaccgtctctccaatttgccgccgccgccacggacagcgtctttgcagctagtgtgccggtggcgccgcgcctcaccgatggccagatttgccggtctcccttcctgcgggtcgtcggcggcagattcgcggggcgatgcctcgccgccggagtgatggatgccgagctccgcctagtcgctggcgctagatccagccgcagctgggacgacatccaccggtgtgcgcgccgccgcctggcacggtgacgtccacggccttagtgtggccgttgatggcttgctgccttgccggagtgcgccgagtcgacggccgatgtcccaccggagaaggtagagctcctcaagatggcgttcgatggcctcgctgcgccattcgccgtcttcctcgccgacggcctcgctgcgccgtttgccgctgcctaccagcttaacgcctcagcggtgccacctcatcgtctactgcagctgccccgatgtcgagggcacccagctctgcagcctccttaacgagctctaccacaagcccgtcgtgcccgctggcatcttgctgccgcccgacactggcgacgaccgcgaccgctcggacatgatgcggtggctcgacaagaagctagcgaggtcggtcgtctacgtcgcgctcgggacagaggcgccgattacatggg

SEQ ID NO: 63259 - DNA, 3679 bp, Oryza sativa
  unsure (1)..(3679): unsure at all n locations
gatatgtctccctagaacccgtattgctgaaagtgaacagtaaatctaaaaaaataggtccttgagaaggtacctatttttttatagtaaaattttgctacctcgagttacctagtacttacttgtagataataagttttacactagaaaatgtgatacctcctactaccttctgaaggatgataaattatcattcttatgataatgtttttttatgttgatatacgatatattacctttgggaagccttaaaatttgatattttttactatattttctaattgttatgatcacttgtcaagttgctcccctcatgcttagatgctggcttccccagtgaatgcaccactgatgatagaggcatggaggttgatggcttgactggcctttcatgatatggagatcaattaaactggataccattatatcattaaagaatacaaaatggagaggaaaagtacaagggaaactaaagccgttttactaaggacaaaggtcactagatactaggtcgtggaatagggtcaagggaagcatggaccttacctgtgaaaatcatatctgtaacacattgtgtttgtatttcttttggggaaaatgaggatgataacatgaagtggaagaggtagcagaggacaaaaatgtggatgattattgtaatctgatgagcgccttggaaacttatacctgacatttttgaagtaaattttaggaaagcttgactggtacggttgaagttgcacaaatcacacgtgttatgttacaccagatattgtggtagaggcttacagcctagagtatcacgaaatcatacattaaccaatctaacgtgctaatactacataataaaaataaatacttaacttaggagtactccctccgtcccaaaataaggcaacctgtgaccactcctaatacaacgaatctagacaacccttcgtccagattcattgtagattagatgaccaaagaagatgcgaccataagttctcaactcatcttcttcattttccacatgcacgctttttaaattactaaacggtatatgttttgcaaaaggtttatatagaaaagttactttaaaaaatcatattaatctaatttttattttttatagttaatacttaattaatcatgtgtttatctattggtccattttgcatgccgaggggaggggttcccgaccggaccagatcgtctgacatatagcgatctacgccagagggacatacaacgcacgcccgccgttcatttgctatctaaaagtgccaagcgagcagagagtacatagtgaagccagacagcctcactttcggcccactccaataaaatcagcctgctaaaccggaggaatcggcgacgccgctaatgcttctgcatctcacagccgcagccccaccgcctgttagttgattagttgagtctgcttctatctccatgcatgtgataatgatcagtttagttgtgataagataggattagatattatctcttcctttatatttgctatcacatgctggattctctcccgagttggcgcggatgatgccgatctcgtggacttctttaatcgccacggtgagggctattctcaccatatattaacgcgtaagcaacgcactgatcgaaacatgcgattgtttcctgccaaaatcctcacatggtatcagagcctgatccaatctaatctagcgatgttactcgatggcgtcctccttctacaccaccagtagcgccaatctcttcaaggaagcttggtgagtgagaagctttaaaaaaccaacattccctttggaaggtgcaggtttttgcttaaattacgggcggccttacaggggaacttatctggcccggaagaaactaaccccccaaatcgccgccccatttttggccagaccggaaaaaaggcgaacccgcatttgaaattgggaagccggggataacaagtcctaagctttctcctcacatttntttcaagagatgtgctcatgcaagtcgcaaggtgcacaacggcggctgaagcatggacaacaattgattagatgtactccacccacaccagagcgcgagcgatcaacacgtactatgcgctcaccaacaccaagaagggaaatatgatggcgcttggtgacgagatggcggcaagcaccgggcgacctgttgaagaagaagagatgatcatgcacatcattgccggccttggcgagggctacagcgaggtcatctcagcaatgagtgcgcgccccgaaccaatgaccatgggagaattatactctcagattgttaacttcgagggtcgcatggcactctaccgaggaacccaggagaacgtcgtcaactttgcaagccgtggaggtggcggcaatggaggaggttgcggtggcggcaacttcagccgcggcagcagcggaggtgctcccctaggcggttgcgggcgcggcaacaatgccggaggtcgcgggcgtggacgagcaccaggagctgcagatcgccgaccaacatgccaagtctgcttcaagcgaggccacactgccacagattgctggtataggtatgatgaagactatgttcctgataacaaacatgttgcagcagctgcggcggcgagctcctcccatggcatcgacaccaactggtacatcgacaccggcgctacagatcacatcaccggtgagttggaaaaactcacggtgaaagacaagtacaatgggaatgagcagattcacaccgccagcggagcaggtatggatataagccatgttggcaatactgttgttcatacccctaatagtcacaacattcatcttaaaaatgtgctatatgttcctcaagctcagaaaaatcttatatctattcatcgtctagttgaggataactctgcatttcttgaactacatcgtgattattttttgtcttaaggatctagccaccaagaaaacgctccttaaaggaagatcacattgcaggctctatccccttcccaagccatccttgaagtatgcttgcaatgccaccaagatctccttccatcgatggcacagtcgtctaggtcatccctcctcgtcagtggttagacaggtggtcaataaaaataatctcccatgtttagatgtgtcaaatgagtcagtttgtaatgcttgtcagcaagcaaagagtcatcagttaccatttcctgtttcatctagtgtctcccaacaccccctagagcttgtcttctctaatgtatggggtcctgctccagagtctctagggagaaagaagtactatgttagtttcattgatgattttagtaaatttacttggatctatatgctacagcataagtctcaagtctttgaaaagtttcaggagtttcaggttatggtagaacggctgtttgacaagaaaattctagccatgcaaactgactggggacgggagtaccaaaccctaaattctttttttttcgaaaattggcatagttcatcatgtgtcatgtcctcacacacaccaacaaaatgggtctgctgaaagaaaacatagacacatagttgaggtaggtctctccttactatctcatgcctctatgccattgaaattttgggatgaagcctttcaggcagccacctatctaattaatcgagtacctagcagagttaatactacccccttggaaaaattatttcatcaaaaaccagat

SEQ ID NO: 63260 - DNA, 4711 bp, Oryza sativa
  unsure (1)..(4711): unsure at all n locations
tttcaacagttggagattcaggaaccacaataggtccatcccagaacaaggctacaaagtggcatttgcaaggaaaaggtatataccgatggcacaattaaatattcctgctttactagttcaggtgaacctagtgatcatctagaggctctaaaggataaaaactggagattagccatggatgcagaatatgaagcattagttaagaataacacttggcacctagttccacctcagagaggaacaatgtcatcggggtgcaaatgggtgtataaaattaaaagaaaggctgacggttcactagatagatacaaagctcgtctagtagctaagggattcaaacaaaggtatggtatacattatgaggatacctttagtccggtagtaaaatgtaacgccccgattttcgttcgggattaaaaatcattaaataatgcattttctagaaattaaataaaagttaaatcaatttaatcaagtgaaataatgggagaattaaaattttcccttaaaaatcattggccgggaatattttgcaatattctttgtgccctaatgtactctccggaattttccgtgaattttcggagctcgagaaatagttttaatagcacaaagatcattgcatcaattaaaataaaaagaaaacaaataaaattttcccctctttgtcttgggccgctttcggcccaagatcttctccctctccatcctctcgggcccagccgccctccttttcccctcctcccttctctttgggccgtcggcccggcttgccccctcctcgcgcaagtccgcttcgcctccctcatcctcctcctcttcccgagccgccgacaggtgggccccacctgtcggggtcacccccaacctccagctcgggccagcaaccgccatggccgcccgagccgtccaacgtcgccgccgtttccggccaccttcttcaccccccgcgcgcgcgcttgtccgtgggacctcgccggccacgttcgcgccgtttccccccactctccccgcaaaatccggccacgtcgccgccttccgcgtctctctctcccccacgacgccgccccacttcccctcgaaatccgccgttccccggccctctcctcgcccccttgagctataaaatcaatccccgtggactcctcttcctttttccccgttttcccgagtaccccacgccctctaccgagctctccacgccgatccccttcgccgccgctcgccggcgatctccagccgcccgccaccgccgctcccgtcgctgccgcgctgcgccgccgccacctatagcatcacagtgcctcgccgcaccccggcatccactccatctccctcctccaccgccggaaccaccttcccatcgcgaggccgaggcactaccgacacacaccgacttcagccggacgctgccgccgcgttagccgtcgccgcacctcgccgcttgcaccaccggcttcgccgtgccttgccgcacctcggcccccgctccgttttcccatttcatcgccggaaccacctncccaccgcgctccctctttccaccactcaccgacgagctccagccgccgccaagccgcgccctgccaccgtcggcttcgctgcatcgcgtggtaccccggccgctcttccaccttcgttggagaccgccgaatcaccgccgtcgtcttcgccccgtgggatgctgccgcctccctctgctcgagccccatcagccgccttcttagacgacatgcccctcggtgagctccgccgcctcccttttcgcctcctccgctcgttttcgccgctccccggtcgccccctcgctcgtcgggccgacgccgccatcaccattgtcgtcgtcgtccttcccgcgtcggtgagcatctccctcctcctcccctccctttctttttctctctttgcccgccggccgccgcatgcgtgtcgccgtcgcgccgcgccgcgtcgccgcctgtgtcgccgccggtggtcatccggccgcgcgccgccgtctggtcgggttggtcggcgagccaaccctcccctccgccttgcacctctaccgtggactcggtccacggtgggctagatccttttgcccgctgacgcgtggggcccgctcttttggtggacccggtccaagcccgcacctccttgacccgctgacgtgttgggcccgcctgtcggcgccggcgccccttgctgacgtcagcgaataacatttcctttgagaaaatatttaataattgcgcaataaatcgagtttaattatagaaatccatttaaatggctcaaaacttctaaaattcatatctaattcattcgaactccgaattgagccattcaaattgcaaaattcatctaaaattaagctctacatgtttgtttactttttatgtactgtttccttggtttttattagagtttttcctcgttttgcgtgccagcgtgtagtttccgtcgtttcggaagtccacggtcgcaaggaaaagagttcggaagatcaaagtgaagaagcaaggcaagtcacacattctccttgagcatgttgatcccaatttataaatgttttaccgtttacaaataaatatgcatgttttgctaattacatgggatcagggttttcctatctgctcgcttgtgccatgtttacttgatatctatcctttgtcaaacttgggtgataaattgactagctcgtgttacttatgtgacctagctagaactatatgcttagccatgcttaattaccactagctcagtcgatgggataattgcagtattagacattctagtatcttgttgagccgcgtgctcgagacatctggccatgttacatggtcataattatccaactaaaatgcgactgaatggtgggctgtgggtgcatggttttgtgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgagtcttgtgggtacagttgtgcacctctggccagagtaaaactattcgaatagccgtgcccgcggttatgggcgatccaccagattcaccgtgattagtctcacacttaataaatcgacccaatgcactgtagtacaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatccccttgcacgtacgcatcgttggtgtggcttgctgattacggaggttgtactcaaccttgctattattcccccttttcaaaagtgtagtgcttctgagctgaagatggagttagaggaccaaggctcagaccccagttgagttttgcctgtggagttgagctgaagccccgctaggatcgcctttttccgctgctgctgcttttgtttcggtgtgaggactaagtgccacatctgtaagtattttatgctttatttacgtttggagctgtttattacttgtcgttttgtgtaccctggctggtcctggacagggatttaatacacaaaatagtctggaaatttgggctaaatttctgggcgtgacataaaagcagccacaattaggataatatgccgtgtctagaggatggagtcttagacaactggatgttcagaatgcgtttcttcatgggtatttagaagaggaggtgtatatgcaacaacctccagggtttgaggatgtcaccaaaccacactatatatgcaaacttgataaatctttgtatggactaaaacaagccccaagagcctggtttgctagactgagtcagaaattgattgaacttgggttcagtgaaccaaaggcagacacttccttgttcttcctgaataaatgggagttcactatctttgttcttgtttatattgatgatataattgtagccagttcatcagagagggcaactgcagctttacttcaggatctaaagacatattttgccttgaaagatcctggagaactacactacttttcttggtattgaggtaagcaagatacataatggtattattttgacacaagataagtatgctactgatttactaaagaaagtaggcatgataaattgcaaaccagcagctactcctttgtcagtaagtgaaaaaatgtctgttcatgaagggtctcctttgggtccaaataatgctacacaatatagaagtatagttggtgctttgcaatatttaactcactagacctgatatagccttctctgttaacaaaacctgtcagttccttcatacccccacaacagtacattgggcagctgttaaaagaatcctgagatatataaaacaatgtactaagatgggcttgaatatacataagtcagggtctacattggtcagtggattttctg

SEQ ID NO: 63261 - DNA, 719 bp, Oryza sativa
aagccaatcttaacctaaccgagaagtttaaagccaatcttaacctagcaaggttatgattgagagagggtgttagttgagtctatttctatctccatgcatgcgataatgatcggtttagttgtaataagatatgattagattttatctcttcctttacatttgttatcgcatactggtttctctcccgagttggcgcggttgttgccgatctcgtggacttctgtaatcgccacagtgagggctattctcaccatatattagcgcgtaagcaacgcactgaaacgtacgattgtttcctgccaaaatcctcacaccgccatccgaggacgcggcggtggcttaatttcgtcggcggcggcacccacgtccggcgctgactacgtggcccgagcagtttcacgctatgtttactattctcattagtgaagcagtgagccggcgcctgccacacttagaagttagaacaccatccaactcaaataagctcgtcgcatgcatgctgctgcatgcatctctgggaaacagatcgaaagacacaagtcatggcagagctgtattaagttactgaaccagtgaagaaattttggactgcatcactgcatttgttcaataggaaattaaagcacattgttgggtcaggatagtaatcactgcagaaacttgactacttcaatttcccttgagaagaatatcagacttgacataatgatgcaatg

SEQ ID NO: 63262 - DNA, 1196 bp, Oryza sativa
ttatgccctatatcatatctacctgattttggtaatttgatttaggatattaattttcagtaattcattattctctgccatttcataatcttttctaccctatggtgtttgattatgaaaattaagatttatttgtatgtgattaattaagccaatggaaattaattgcattactaatgtttaattaataattaatttttcagcattaggacaacttaaggctattcagcttcgtgatggatcaaattacgttgaatgttgaatggagaaataatgtgcttattaacttagccatgttggattatgacttagccataagagaggatcctccctaggaacctcaactggccgaagaactcaatataattgaggaagaatatgataatctcatgtgggcctacaataagaagttagccaactgggagaagtccaacagaatgtccttaatttatgtcaagggtgccatctctccagaagttattggaggaatcattgactataatgacattaagatgtatctggcaaacattgaagaaagttttgaatttgcacctgacactcatgccaatatgcttgtaaatgagatgatcactagtcattacaatggcaaaagtggtataaggaagcacatccttgagatgactcatatggcaaatcaactcagatccatggatatgaaaatatctgatggatttttagtgcacatcatcatgagatctcttggtcctaactatgatccattcaaaacaaaatataatactcagaaagaggagtggaccatacaagaattgatcttacactccgtggaagaggaagagcgccagaaagctgaaaagcagaagattaaagaccggctcaacctcactaatgcctttgataaaggcaaaaaggtctatcaaggggaatcctctaataagaatagtgagccagagggtgagcagaagcaagaagggatcaaggcctccacttcagctgttcctttaagtacaagtccctactgccacttctgtgcgtcagatggacattggcagagaaattgcacacgcttcacagcgtggttagtcaagaaaggtataaatgaaattaaataaatcccttgtgatgagttttcctttaaaaattagtgagtttgactcaatgccgatgtgcatgtttctaactcattacaggaaaggggatcctctagagtcgactgc

SEQ ID NO: 63263 - DNA, 4001 bp, Oryza sativa
agttcaattttttaaattcaactaaaaacggatcatgtccgttatttaaccaaatagaacatgatacattaagtgtgataataaagtgattggtcttgtccttgtgcacgacagtcatattggtctttgggatgatcatgtgactattataataattgcctgtaatgacaaaagatgagacatcattgaaattgtgacattgtaattgatgtcacatttctaggggaggttagaacgtctcataagttggagatattctttcccttgaattgattttagtgaagttgtgcactaattaaacacagttttctattctagtagcaacatattgtgtgttttctgcctaacacattgatatggttgtgaaagacatgtcccaggatcgaattattaagctaagcatttgctaatggatccatactctaaaggctcataaaattaagattaattaagattatgttctggccagtatatatgtaaattagagccttactgagatcctggatgagggggactaaatttttcaatcaacacccactaagttaagcttgagtttatttgagtactatagtgagctataggtcttgttgtctcagtgacgcataatgttgttgaagacacattgccttggggagctattttatttaataaactcgtaagtaagtctcaaaatcaaggggagaatgttggttgattttgtcgacttgtgtcgataagggttaggagaggatctaaaccatcggtttccttatcctgacaagaaacaaactaagagataaatttgttttttatgtgatcggtacagaaaacagaatcctaaactaattgagataacccccgagccccaccagtgtcgcctatataaagaaagagaaggaaagaggcagacgaccaaactctctctctctctctaatctcaaaccctaattaatcgcccaatcgatctaggcactggaaggggttcgtgaggcatctctggaagaagaagaaagaagaacggtaatggcttctaactcaggtcagtagatcaattatttttccgcataagcaaaaggtgattgtttatagactaaagcttaagatcatgtaattagaactccaacaatgtactcatgtccttaatttgttttagaatccaaaatggtgcatattcatgaatatgaatttgtataaatttcttttccagcagttaacgtgaaaagcagtgtgcgaataaaaatgggggcaacaaggtcatgacaaataaagcgcattacatcgcatattaatcactgcttgccagttgtatgggttgatgaataacacgtagcaataacaagtggtcatttaagaaatattgctgccaacagacatgacgatagattgttgcgcccgcacaggcaatgcagaagttcatgacagaagaagcaaaacggaaatcattctttagatttatcatttatgaaagagtaaattttagaaaactgcaacgtagtgacaaaactatcagtttgctgcaacattagtgacctatttcagtttgctgcaataacagagtgtctctatagttgcaattttctgaaatttacaatacagctaacctgagcctctatcccccccaggggagcttcttgttgcttagttccctttatagaacctgaaaggaacataatgccaacggagtattctaatgcagccatataatagatacccagttttatatgtacaccaatacgggcaaatattcaagattacgttgcaccagttccacggggaattttgcaggagttagtttgagatatgatgcaagagcttcacatttggcttgtgccttacatgtcctttcagaatatctttcaatctatcatcactttctgatgatatatatatatcaactcataaatgtaagtagcggaaataatttgaccgaacagtgcagataccaaatattaatgcagtaacaccagaagggaagcaaaggcaaaggatgctcacaaaaagaaaagaagaagaagaagaagctattgttccttagtttacaaaatagtttttatgaggatatagtagatactacaattagtataacacaatattgcaataagataataaataccacaatggttatagccttgcaaacaaaattaggatatatggattttaggacccacaccagcatcaagctaaatggaaaagaaagttgcccatgcatgtaaaacttatggtcatggatttaactttttttattgggagtctaattctcaaagtattggagtaaaagcccagaacatggatttcactctgaatgcaatgatacatgaaatttttgtatattctccccaaaaggacgaaacagaagggctttcccagtacactgagatggcattctcccttgccatcccacgtcggcaaagatggaggacacataccgcctttgcttccggacccaccaaaatgaggttcttgtgtccaaataaggccaccggttcttgggcgaaaaagagggcgcgtgaggctaggcacagcgttgcttccgcgctgtggagcgagtggcgtcgccctccttcccgtgcccgcagtcgccctcaagcgcgcgccgcctagcccaccgtcgacgtcgcctcttgccgacgagccgcctagcctgccgtcgccgtctgcaaccgacgagccgccaagccctctgtcgtcgtcgtcgtcgcctcccagatccgttgtggagagaggataggagaggcgtcggcagtcgagggggacaaggagggcggcaccatcgagctgttgtcaccgccgtgccgcccagagctcgccggccgctccgaggtcatcctgtaccgccagatccgcgttgccggcctgggaggagagccgccggtcgtcggagcaaagaaggggtggtccccgtcgtgggagagtgacgaagatcagggtggtggtggggttgccgctcggactgcccaccggcgccgcctccgtccgccccaccgcccagcgccgtcgccgcccgggccctgccgcactccggtcgccgcctcgcttcctccgccgcatcgacttccagtgcctcgctttgttcggttcgactggtggagaagggatagaggagtgagagaggagagaaaaagtgagagtataaaaaaagactagtaggatccactcaaagggatatgcaccatggagcatgtagctaacaatgttcctggtgttcttgagctgagttatcacacgaggaacggtatatttttgcgacgcactcctaatgccctaaaagaggccgttcattagtacggcagtcatgtcgaataagctagagctccaacaaaacactaccatactcaattctttgaccccaattattcaaaagaaacatgaagcttcttccagatgcctactatgtggtgattatactaaccttcttttcaatcgcgaagaaaaatataatgaggtgagaagcacgaagaattcagctggacaaaacattatcacataagcaaataagttgagtcgtagcacttctctttcaaggttggtagcaagaacgcctcaagaactcatcaaaatttcaaggtggaaattatgagagccttctcctccacgggagcccagagcccacaagatttcaaaaccttttcagaaagactagagagaacggtcgtatacagtgggtgaacggtataggtacccttcttcgatagggtgccctcaaccaaaaccacagggctaatgtaggtaaaaaatccacacaattcaatacaagatgctaacaaacaaaaatgacttctcaggatggaagaacatacgtatgtgaatatgtgatgctcatgcggtgcagagatcaaaactcagcagtatggaagcacaggcaatataactcacgagttcagggctcaaaatattaattttattatctcagggccgtggaggcgaggtctttagcatacacatactaattacctagcaataacaccaaaagagtactgctaccccggtgttatgtcttcttaaaagaaatcatttggttttcc

SEQ ID NO: 63264 - DNA, 5030 bp, Oryza sativa
caaacaaaggagcagttctctatcactaattcaggttactgcaaatcagtcacataaataggttagccaagtaaaagggccaactatatggattagtggactacttgcaagcttccttgatctggtggtgttagaacactgtttgcatgtaattaaatatccgtaagtagacttgtcttatgattaattgatttttttgcagcagtatcaattatttatatgtaagttttctatcgtacaaaccacaattttcatattctatccaaaattcaaatcaatgcatgatgcatcgtttgaaatgattggatgcaaccatacactgcatattttagttgaacctactatgataaacactatgcatgtgtgctctgcagctaaacaagattttatttagcaacgtgcaaaataaaaatgaaatgaaaaaattctgccaaatttctcaaaagaatgcatactatcagcagatatgatgattagaattcaaatgttttaatcagagaagcagacagatggaacataacagaacagtcagacaattgaagaagtccatacccttagaaggaagcccctttttactgaaatgtcaatttataaaattccagtgataagaatgccctcaactgatgcatttgatgattttctagattgctggatacaattatatatgtgtaccgtcaaggcaaaatttgaaatggttgttttgtaatctttactgatgaatcaggatggccaatttttaaataatgtgtacccaaaacatgaaatagaataatgttcattaaaagatagtgtattctaatggaacacaagttagctatagattaagccatcttacttttgatcaatatgtgcaataatctctcctcctgggaaagccgcttttgttgcttcatatgaaactttaatggaatgcttccacataccgccaacgtcagccacatttttaccattcatctgcttcggttcctccattggcaaagaatacccagagagcaagtggcccacccatacaccatctttcctgaaacattttcaagatataacattgacgaaaatgctttcaaaaattgaagaaatatactcccttaaatcaatgctcttagatcctgctaagaaagttgtgtcataatcaatgaaagaaaatggcgcttacgttacaatatccatatgacgaggagcataatgaccacctcctatgcctagaaggactttttcaccattcctgcattacatgaaaatatagcagacttaatgcagctcaaattcatagcaaaaaccatcattataatagataaacagttcacttaaaaaaacatatacaagcaagatagtcaagagtacccatgctgggagcatgcttgggcgagtgattttatgtatagttctcaacagagagctgattttgattctaacagaaacaatctcaaagcgttcggtgtgtgcattatactatcaaaaaagtgccaaaaattagttcttttagcattaaacggtgatacattggtctcctaccttccagggaataatatcagttgtggtggattatcaaatatgctaattattggaaaatataacgagagttcttcgcatgtactaaaattatgcttactttccattggactagtatggaaatcgacattggactagatgtctatatctgagatcaatggcatgaaaagaatgaaagaaaaagaacaattgcttgtcttccatagcaaataagagctaagtgctcgagagacacacctattggtacaaacacggtctatttgccactcaagacaacagtttctaaagatgtttgatgtatgggggggttgtactgggtaaactccacctgatagttttcatagtaaagcacacgaaaatagagagggagagcaagagaggggatgcaaacatacccatgccaatttccaacagattcttcttctccaagaccaagtcctttccatagcagctgcaagtattataagactgagttccattgtgtttttcaccataaatacaatgtgttcacgaactcaaaatcacagaggacactaaggatcagaaatgcatgtcctttccttagcatcacaaagatgcaaaatgaacaataatatcaccataaagttggaaccaattccagatatctaaggaaaaagaacatgaaaatcatggtagaccatacaaacatctacattgtccacgcccagatgctgaaatggaacacaaacgggaaaactaaccagagcgactgcgtcagcagcatcctgtctaccccagtattcttcagtgcttcctacaacacacaagttaaagaaataaatttgttaaacgtatttggtgatcaatgtcacgtgggcatgcaaggaaaatatattgtttaacaatagaaaaagtgataactcaatggttcatgatataatgagttaagtatcaaatcgttgatgtttatgtactattgctatatgtgcaatatcacctgaaatttattgtcatctgaattgtattttcacatttctttcgcaagttgcccagatatatccttttatgtgacctatcattcaaactgttcatttacaggacaacattacttcttttgagagagaggacataattacttgtacttcaaactatctgtgtgcctgaagaatcaatttgaagattattttctctttctactattataaatatcatacttatttatattatttttattcaggggactgctggatagcatttcaaatatagtagattcaggaagagaaccattgaactagttcatactttggggtgtcagaacaaagaggacctttcggccgtcagtataaaatccaagatctcaccctataattttaggattcaatacaacgttcatcaatgacggggtgcaggcattaattcctagcctatgcaacttacagataaactgtcctgtccaaaaatgaatcaggggaacagaaaaaacaaagaataaacttaatgaacttaagttgatcaactaagatgaagttacaaaacattatccagaaatcactatgaataatctaatttgtgagatatgtctggctgtcgagcaataattaagtaaacacagtggattaaaccccagaaagaaaaggtgtggagaatttcgtaccaatctcaacaaacagcgtcggcgtgttggtcactggcccatggtgagtgccctccagcgtaatctgcagaaacgagaaccaatcaatcaatcaaccaatgcaaacaaccgcgatccccaattccacaaaggaaattaaaaaagcaaaattaaaaaaaaaacacaagtaaagtaatcacctcaaactccggcacgaggccgcggtcggcggcgatccggcggagcaggcggagccagggcccgatccgcgggttgggcggcgcggcccacccggggcgcccgccctgcggcggcacgtccacgccgtccctgaggtgcgggacgccgatggggtggacggtgagcgcgggtcggttggagacggcggtgtggcggctgaggaggaccacctcggagacgcgctcccccgtggcggcctcccaccgcaggtccaggtcgtcctcctccacgatcccgcgcgcgtgccgcagcagccgcacccccgcgccgttcgcgaagctctccacgccgtcctgcgccggccgcgcgaagagttaggcagggaagaaggcggtggcgagggcgagggcgaggcattcgtaccgggatggaggggccgggggtccagccgggcatggcgaggaacgcggcggccggagtggccgacgcggcgtcggacgtcgtggcgaccaccagcaccaccatcttgacgtcgccgccttccttccttcgtgttccttccttctttctctgcaagaagacactgctgctgctgcaactgctgctccttcgttacggcgtcgttgttgtgttgctttatttatggggtggttgtggggcccacaggtcagcggcagtcaaattgggttcgtcttggtcgccagacgcgaaagcttggtgttggtggggtggctgggactgggtgcccgcccgtgggaaagttggggaggtcacgaaccaatgggcgtgcgtacgtacagggtgtttgcgcgtcggcgccggcgatctggccatgcgggctggcttgcaggggaggcgaaatcgaacaacaagtctgactgcgccgtgggcccttcgttgtctggttggaatggaataagtccacattctctccctcaactcatggccgtgtatgaatagcatccctcaaccgcaaaaccgggtataacccatcccccaactctgaaaaccattgcaaatcaactctccgggcggttttggaggcggttttgtcctacatggcatctttgactctgttgactggctgagtcagcaggtgggacccacctgtcagtgactgataaaagaaaaacggtgggcccactgtcaaccacacttcttcttctacccttttctcgctcctccggccgatcctgacggctaggagctcgccgccatcacagtgcctagccaccgcgacgatgttgctgggggaggcttgccggggacagctgtggatgggcagaagcgtggcgagaccgaggccggcatggcggtcgttccgagaccccgcggcgagcagcgagagtgcgctgagtgccacgaggaggagcagcgccgcccgtaccaccgtcatgtacgacaacttctccccgccgctctttcccctcctcctcctgcacctatgtctgcacatcagtgcacatggattgccggcggcggcccgcggcatagcgtgattcgtgcggccggcctcgggggagacttggctggggcagcacgtgagacggcagtggcaagaccaattgctgcaaaattccatctccagttacatctacaaacggctccaggaagcaagcagtcggatataaaacaatgcaagatcaatggttatccatcaacaaagctgcagatagccaggtaccccaacaatagtatcaatcagaaaattgccgggtggcataccatgctgaccaaatttactaag

SEQ ID NO: 63265 - DNA, 1058 bp, Oryza sativa
  unsure (1)..(1058): unsure at all n locations
gcgaattcgagctcggtacccatctacagttacatgtacaaacggctgcaggaagcaagcagtcggatataaaacaattctagatcaatggttatccatcaacaaagctgcagatagccaggtaccccaacaatagtatcaatcagaaaattgccgggtggcataccatgctgaccaaatttactaagctatcgatcagcaatttggtcgactgtatcatgatttttcaagcgtgtatgatactatgatgcttatgatcagcactaaatcactctgccaaagcacgcaaaacaccgtcaccagagaatccccaatcgatttgcaaatatttgcaaacccatatggcacgcactagtgtaggcggcgaagcctaggggggaggccgtcatgcacatggacgcagcggcgaagacgggctgcgctggtccacctgcagtgagaagccactccacgtccaagggttgccggccagctccctcatctcgttcgccctcctccgctctggatctgaggagggggatggcggcagcggtggaggcgatagggtgggatgggggtgggcagaagtagccgaatcggagcgtggcgctaaagggcggccgagcaagagcggggcgcagcctcgacgactggcgacggggtggggtggcacatcaccgccgggatcggccggaggagcgagagaagggcgtagagaagaagataagtgtggttgacagtgggccccacctttttcttttatccttgtcactgacatatggccccctgctgactcagtaagtcaatagggtcaaaggtgccacgtaggacaaaaccacctccaaaaccgcccggggagttgatttgcaatggttttcagagttgggggatgggttatacccgattttgcggttgagggatgctattcatacacggccatgagttgagggaggaaaaatagacttatcccggttggaattgaatggtcttgtgggccgtagttgcggtgatctaaagcgtatactagctgcatacaaannnnnnnnnnnnnnnnnnnnnnnnnnnnnnnnnnnnnnnnn

SEQ ID NO: 63266 - DNA, 2055 bp, Oryza sativa
tcgaagggattgctggcaggtcaagcgggaatcatgtttgaagaggccattgggtgcaatcatagcagcaatgccatgggcccccgatgattgtatccactactgttgtatcagatagtatgagagtttgcttccaccattcaatctctttaccttctttcagaaatatggtccttaatgtttgctgttgttaattttttgcatggtgatgttttagggaatgttcttcgcttccaatgtacactgcttaatatacaataaaattttatgagttaaaaagaagagttattagatcaaataaggtagttcaagagtcaatggtctagataattgccaaaagaaagcccaaaaatacatcccaaaattatattcttgaatccgtaatcagatttttaggtgtgaatagattcatccctgtaagaagataaataaatgttaactcccagtaataaaaaaataggtccatcccataccaagagaatcattggttcactgtcctcctcgcgtatggtgtgatcggtggcctctttccgtgcgttgcgagtccctgatcccctcctgcacatgtctaacacccttagatcgacggattgggagtgagaaaccacatccagcttgtgaagagcgagaaatatggagttgcaaattaaatttttgcatatctgtagaggggaactgttggagccgatttttcaaaaaaaaaaaggaaatccaaaatgttgggattggtttcattttgggggtatgctcatataaaactctagggtgtaagctcatggggttatttggatttcttcctgtcaatatccaagtttcagcttgtatggcaacgatcaggaagggcatgaaaaataactatggaagttgacaaagagaattaatatcagaatttaatttttagtcccatggtttgtttgccaagagaatgaaaggggattggaagttttagaggagtgagttatgggagtttcatttttttattcccagtcttttatttggtagtagagatgagaatcatgggtagtatggatgataattgaattttaagtgatgatgtaaagctcagatttatctcgtcatacttagaaaagaaattccctagaaattacatgcccttacccaattgggagtttgctctttaaactccttctcaaatccctcacaagcttccacatccaccaaccaaacagtaggttgtacctctcaaagttccatccctgttaacaattccccctaaccaaacatgctgtcaattccttatttagttgctagagagaaataataggggatgtttaaaagggaatttatgttatttgttcggttgtgggttttgagataagaaattattatcataatttatgatgaacggttgggatggaatcgatgggagttcgatcaatttcccatttcaatctctctcaaattcccatgttcttcaaagattaaaatgctctaatctcctatgcttccattagcattctcaaactcccccaaaccaaatgtaaccaaaataacacgcgaaaaggattttcaccacctgtctggaaaggggaacatatcttcccgtgcacaccaattagaaagtatcacgaaaaattctacaaaatatatattttttacacatatttcatattcaaattcattatattttagccgtatcaacaaaattctaatagttttaagggtaaaattctatcagaattttgtcgtttttgctacggctaaaatataataaatttgaagataagatttcacatgtaggtgtaatactattgaaagtatgcgtccaatttattttagaattttatttgatagttcgcatacatgggaagcctatgtgtccataggatatggaccgttgagacggatacgtaaccacacgagggaaacgtactcgtggaatacgccgtcaaccgaaccaagcctctctgtccttccccttcccctcgactctttctctctcgctgcttcatcccccgcttcttccctccatctccccgtttcaaaccctagggcacgtccttcacccccgaaaccctaaccctagctccccaa

SEQ ID NO: 63267 - DNA, 1744 bp, Oryza sativa
tgcttgctaattcatttttgtgcgcagaaatggaataattgggggtgctggttaataaatttgatcagcctgctaatcatggacgatttgaaagttgtttgttaaaatcagctgataatgttatgcaaagtgaaaacttttttttttgtgtgtttgagctatcttttcttataaaatgtggtcttttttttttggtggggggggggggttggggggttgtagttattaaatagttcagcttgctaatcattgacaatttgaaagttgtttgttaaaactgctgataatgctatgcaaagtgcaaaccttttctttttgtttcggacacatgcaaagcacaaacagtataagccccaaaatccagaggttgctgttttgtttgacctaatattaaatttgtatcattagttttaagattcaagacatgtttagcatccataagctgcaagccagccattatgtttatatcttgaccttatgtgagctgagccactatttctgccatgatatttttttggtgaatctaattttaaattcctagcagagtttattaattataatgagaaattttataatagatgctgcactaaaaaaataagatcagaataaactagttggttggccatagttcagtttgcttgatgacaggcatgatcataatatgatatccttattttacagtttggcagatataaacacttcttttctttgcaggcacatccaacatccagcaagaagaatgtgcaagaaatacctacaccacagtatgatgatgttgatacatacgaaagggactatactcgtacctttgcacagccaacatcctacatacgtgccagaggaggtttatttcttgttaccgcaataattgaaatggaaataaaaattgaatatatcttcagtggttgcatttcttagagaaattactgcttgcagccagggctgagattggtgagtttgttgaatatgatttggacaatgaagatgaagattggcttgaagactataacaatgagcggaaaaatctgaaccctgaaaagtaaggaataaattgctcatcaaaataagttatgagagtggcaatcttatacttaaatacagtgtacaccatcttttctaccatccactaatcgtcctacaaatgggagtggtgagggagagaatgttgggtggaaagaaaatgtcaagtgatgacaaagtttttttttttttgtaaccaaaagttgcatgtcatttctataccatgccacacatgccaatcattctctctagtatatagtaaaataatcttgacatgaaaataattgccttatatcatttgtagtaactgaatagaaggtattatttgctacattactaataagaatacacattacaggttggaggtcctcctattcaaactggaaacattggaccacaaagctcgagaaagagcaggcatcataacccccacctttttaggaccaataccagttattctgcagcttgattctgccatggaggtaatatttcatagagaaatttcatggtcacttgtagtttgcagttcttggttgagttggcgagtttcttgtttatcagtttgatttgagtcacatgacttccaaaaacatttgaactcttcaccaattaccatcaaggcacaaaaagggataaaaaggtatatgtgctgtgtcattgaaaagtaaaaggaacaattgatagcactcagaatggagcaacacaagagtgagtagcatataaa

SEQ ID NO: 63268 - DNA, 1078 bp, Oryza sativa
caatatgttttttttgatatatatgaatattattcattgtatgtactgattcgtttttcctttatcagagagagcggtggcaaaagcctattttgcgacgtttgcaggttagcttaggtccttgtattgtcctttctatctttatgtttcacacacttcttattgatgtacagatttagatctgagcttatcgttgtgcacaatatttggtctgtgtttgttattgcagttactttttaaatataatatgaactttttttgtcaactactgtagtatgtttgtagatattatctaagctctttttaaagcagtaggcgcaaaatacaatcaattttactgaattgacagattttgtgactacaagttttgaaaagatcaaagtggttctctagagtaaaatcccttttgctgttgttgatgggttccttcaaagtttgaagagcaacctaccagcccaatctggaccaaatcataataactaggctgctaactaggtcgggctgtgttagtgctgctgcacatggtcgaaacagcaggctgcgtgaggtgcacggttgacctaactaaaccatcaggcttgtcaaagttccatttcccagtctcccatcttgctaaccagatctctttcatacaaggataagtcacgggacatttgctactctaccaaggaagcctctagtggatgattccagtagggatagtgacttttatggtgactggaaagctttctagcatgaagcttggacggcagatggcggttttgtcgacagtaattatcttcaacttggaaggcttccccttcttcatcttaacaggtcctttccaacagattcctcatggctttcaccaatcatggagattcaagatcttctgtgaccactgggttcagtttctgtttttctcctcgccaggagaaatggaaagcttttgggacgatggactacttttaaaatttttttcctttagtattgtgaaaaatatgataaactgtaccataaaaaaaagaagggccaattgcttatttaaccccttttcagagcctactaccaatgtaaccctacctttctagttagttca

SEQ ID NO: 63269 - DNA, 3450 bp, Oryza sativa
  unsure (1)..(3450): unsure at all n locations
tgcctgcaggtcgactctagaggatcccctgcggaaaaaagtacaccgaaggtccccgaacttgtcatcgagttaaaaaacatcctcaaatcgtaaaaccagatatccgacatccctcaactaattaaaatcggtcacaataggtccttttgtggttttgattatggttttatccgacgtggcggctgagtcaacgtgggccccacatgtcaggatgccacgtcatctctcccccctcttctctcccctcccctctctctctctctgacttttcccggctcgccgtcgctgggatctagctcctcccctcgcggcggacgcggacgtggactttcctggctcgccgtcgcttggatcccctccccccgcggctgacgcggacgcggacttccctggctcgccgtcgccgggatcccctcccctcgcggtggacgcggacgcggacttccccagatcgccgttgccgggatcccctcccctcgcggcggacgcggacgcggacacggactctggcacggtcgcaatctgctcacgcgtggcccgccgtcgtgccgcctcaccccatcctcgcgcggccggccggcgaggggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgcaacgtcagttccccagccgccatcgcaggatccatgaagaagaaggaggcggccgcttgcgagatcgcgcgccttccgaagaagctcctcgtggcggtgctctccctcacctcgccgtggtctgccgtgacttccgcgccgccgccgactccgacgccgtcaggtcccgcttccttccccgcgacctcccgtgcttcgcgacgggtagcttctcctgcccactgtccatgaaggagctcttcctccgcctattcgctgcgcacattctcctcccacatgaactcacggtgagatcccttcaagtgacggcgccgtagccgcttcctcttcctagccagttgggctactagccccgaccccgacagcgtcggtccgcccgccatacttgagaaaagaagtgagacagaggagtaatagaggggtgatgatgtggcatctgacatgtggggcccacactgattcaatcgtcacggtggataaaaccggattcaaaaccaccgagagacttaaaagtaaatggttttgtaagttaagggatgtcatatatctgtttttgcggtcgagggacgattttgtaacttgataacaagttgatggatcttgggtgtactttttccaactgctgctgcagcgttctcagctatttctcgcttacctgttagtggaccgattctattacagtggaccgaaagcgaggctaggttctctccgctctctcggcaccattcgatagaaaatgaacggcgcgcgcgcgttggacgtccctttgacgtagatcgatctggttccgttcccaacccctccaaaagatacttattactcctctggtttgagaatacaagacgttttaacttttatcaaagttaaactgttttaagtttaactaagtttatagataaatatagtaatatttataatactaaattagtttcatcaaatcaaataatgaaataaattttaataataaattattttgggttgaaaaagttactattttttttacaaacttggtcaaacttaaagcagtttaactttgaccaaagtcaaaatgtcttgtaacctgaaacggatggaattgatgattagacctaaattattctcctgtcgttatgtgcttgataagaaacttggatccatatcaattctagcgaatataatgctgctattgtttctgttgcactggcaactggcaagaatgatcaattttgtgctgaaatgcgcttggtttgtcacgattttgttgccctcattttgatcttggacattgcttttcatgtttgcggttggaataggaatttgtacaaattcataaatgtgtgcttatgcacaattttggttctaaaacaaagatgaagaatatctggaggtgctctttttctcctgaacataaagataaaaatgaagattaagtgtttgacgcaaaacgaggtggtattaacgtatgattaattcagttttaatcattacaaacttaaaaaatagattaatctgatatttcagagcaacatttatatagaaagttttcgtacaaaacgcaccgtttagcaatttaaaaagcgtgccacaaatatccaaaattttattaacctttttagtggaaacgaacggattaatgctagtgaacatgagcacgtcccttgcacttctctaaaggaaagacctatggtgaaaaaaaaaactgaaggcgcacacgaaagcttaattagaaattttgtgatgtctagaaatttatccctcgcctcagcagaattgtagcaaacctatttttggtgattctgaaaagacattcatactagactatgtaacacaaatttttatggttcagtatcaaccaatcattaaaaagaaggaattaaacttttcaaaccaaatcttgaatcttcattctaagggcctctttagatcccctagcaaaagttttcaacctgccacatcgaatgtttggacacatgcatggagtattaaatataaacgaaaaaataactaattacacagattgcgtgtaaattgcgagatgaatcttttaagcctaattgctccatgatttgacaatgtggtgctacagtaaacatttgctaatgacagattaattaggcttaataaattcgtctcgcggtttacaggcgtaatctataatttgttttgttattagtctacgtttaatacttcaaatgtgtccgtatatccgatgtgacacgccaaaacttttcattcacccctatatctatacacagcctaagcttctactccctccatccaaaaaaaagacaaaccctagtttccgtgccaaacgtttgactgtccgtcttatttgaaaaaattataaaaaaaattaaaaagacaagtcacgcataaaatattaatcatgttttatcatctaacagcaatgaaaatacgaattataaaaaaaatcatataagacggacagtcaaagttggacacagaaacccatggtttgccttttttttggaacagagggagtagtcctctattcaaatataagcaataaaaaaatcaggccttaaaatccaattgcaacgtcagatcaatcgtttctcgaatgaaaatcgtgttcccaaattcacactccaaatttgccattcaaatccctccacctctacaaaaatttctactgttcattcgaaaacacaaacaattgtttattggatcatcccaactccatacatatatactatatgatgcccgcggatcatatatcctaactccatacatatatactagatgatcctcgtgcttttctg

SEQ ID NO: 63270 - DNA, 1430 bp, Oryza sativa
ccatcttctctgcggtcgccgcgtcggccgccgcgagccgccggaacccctcgctgttcttgacggcctcgatgccgcgcgcgccggtggcggcgacgtcccggacgacggccgccttgagcagccggaggccgagcctgtcggccagcgcgtacgtgtcggccgccgtggccggcgtgacgcaccgggccagcctgtcctggcacgcctggctcagcgcgtccatcctgtacaggtccgccgcggcgagcaggtgctgcgccatgtgcacgccggtggcgtccctctcgctgttcccgggcagctccggcagggtatcgtcgtaggcgaagcgcagcatggcggcgaacgcgtcgggctccatgtcatcgatggtgatggtggtggtggcatcgtcggtgtcctgtgtctcccccatggcgcgcgccgccggcccgtggagctccgccagcaacacgggcgaacgcgcggcgagcacgcagcggtgcgcgcggaaccgctccccgcggacgacgaacgtgacgtcggcgcccgtgccgtcctccagcatgcggcggaggccgcgccgcagctcgtcgtcgagcgggcgcgggccccgccgcagcacctcgtcggcgtcggcggcgaggagcacggcgcactcgaccacgaggcggtcgccgcggagcaacacccccgacgcggcgaggtcgtgctgcaggatgaactccgggaagccgaagcagccgcggcctacggtggctggacccgggccgaacacatggtacccgcagcgcgtgtacgagccgtcgtcctcgccgccgccggtcatcccgccgcggcggtagacgagggtgaagtcgacgagcacgcggacctgctccctgtggtcgctggagacgagccgaagaaacacggcggcgtagggcctgccactgtagtagccgccggggaagaaaagaatgtcccagaggtggccgccgaggctgaagagaccgaaaatgacgggcttgccgaagctgaggccgaaaaagaaggagtacggcgtgatggtaaggcgctgcgtcgacgccgtctcccgggtgggcgcccgatcgccggacgacggcgaaggtgcggccatgtcgagttagattggaattcgattttgcttaggtttgtcgtaataattagtaggaaaattttttgaagaggaagccgtgcttcattgatctttttgatcatggcgaattattacagtgtcctctagatatactccaagattatatcaggaaacataatatcactgtattttttttcattactactccaaattatacccgtacgttgcaacgggtaaactaaaatacccgtgcgttacaacgggtaaactaaaattataccaaatataaaaatattagatgattgagtcccactccggtgctttctactcggagtagaaagtaatttgg

SEQ ID NO: 63271 - DNA, 3633 bp, Oryza sativa
ggtgttggttaattaaaataaatcacatggtgatccgtgggtgcatggttttgctggtcgcacccatggcagttaaggaccggttcgcgggatgccctggaagaacttatcgtacttaccacaagccagcgtgggcaacggctgggcttgtaacgtagctttcctctagccgacgcatccaggcaagggtgggcgtgatggagtttggatgggccctgcgacggcctatgcggcttccggattcacctaggcacgagaggggactgcccgttgccttgcgaggagtgggggtgaaacctgaggtgtggtgtgcttggttagagggggttatgcgaatggtcctgtcacagcctctttccggtatgtcgtggtggcatgtcggcgcacggaaacgtgttgtggggctgtgtcttgtgggtacagttgtaattaattattacaactgtttaaatctttcaacttctgttcttaaatgctcgctttatgcaaatgaaccactttagctcttctttgatgattccctgcatcatgctctgttcttaaatgctcgctttatgcaaatgaaccactttagctcttctttgatgattccctgcatcatgcctctattccggcatgacttgctgagtacagtgggtagtactcagtcttgctctacttttcccaacccccagagtgcgagtatatgtcggatgaaggtttctccgaggagtaggcttcgtccgtgccgtcgaggatgcctgtggagtggtgttcccgctgcagttctagtcaaggcttagctcctgttgtctttctttctttcccgctgcagttctagtcaaggcttagctcctgttggctttctttctttccgctgcatttatgtaaagacttttatgatgtttgtaagacttggaattctattcgggaatttctgggcgtgacaaggtgtcccgccttcccccaggccgggaccgcttacatctgatagctttcataggtcatagactgccctcacagggcaacacatatcttttctgcacactttgtcctcactcgtgtgcacccggaaagaatttcccggtcggtcacccatcccaaattgctccaggccaagcacgcttaaccctggagttcttcggagattggcttccggaaaaagcttccggaaaagaagttgcaacttgttgatatgagtattctattaatcctattaagccctaggccgggatgttacatccggcgaggcggcgcggaggcgacggtgaacgtcgacgcggccggagctcgtcggcggggaggggagggggcggagtccgaaggcagccgccaagccggcgcttcccgtccctggcgagggacggtggagggacactccaagacggcgcgcgcacgggaagaccgacgcggccgcaaggaggtgaagtggcggcgatgctgcttccggtttagggggcttcaaaatccggtatgtcaccaaacccgagcctaattttcttccatttggatttaattcggactttgtgacttagggttcttccccaaagaattagggttcttcatttggggattttaggccgattggatccggcttatggggatttcgggaaatttcaatcttgtttattcccatatgattaaccgtggggagtttcaatcttgtttatcccctaattcttgtttggttgagactaagccgaacccttagtttcggtctagaaattttgagtcggggaattgggatttcccctttgttaaatttagggggattttcaatttggtttttccccccttttaaacttgggttaagggtttgagggggaggaaatttgggagtttcaaaagttttttcccaaaaccttttttttttttaaatctccactgatggataatcaaaatcgaaaacttgaattaaacagcttcttcaataatttgcttctcctactgatggccgaaaccaccagtataaaagggcttaatacttaaagaaattaatccaatctaattcaaaattgctcatgccgaatcaatcttgtatttttataaggatggcttctaatcacagggatgatgtgattatgagggattgagtggactaaaaattaggctctgataccacaatgttggagttctaattacatgatcttaagctttagtctataaacaatcacctcttgcttatgcggaaaaataattgatctacttacctgagttagaagccattgccgttcttctttcttcttcttgcagagatgcctcacgaaccccttccagtgcctagatcgatcgggcgattaattagggtttgagattagagagagagagagtttggtcgtctgtctccttccttctctttctttatataggcgacattggtgaggctcgggggttatctcaattagtttaggattctgttttctgtaccgatcacacaaaaaacgaatttatctcttagtttgtttcttgttaggataaggaaaccggtggtttagatcctctcctaacccttatcgacacaagtcgacaaaatcaaccaacatacataggcataataaagatacatatatactgcacacaatacaggagtcataaattgtcaaaaacaggcttctcactgagagtgtgatgaagactgattttatagaagatttctctcgttttctgacgtgcacgcttcccgaactactaaacggtatgttttttgtaaaaaaatttctatagaaaagttgctttaaaaaaatcatattaatctatttttgaaatttaaaataattaatacttaattaatcatatactaatagctcatatcgttcgttttgcgtatcttcccgatcatctctttcaccttctcattaaactcagccttagccatacgaaaaatggggtactctgctgttttacctagcagcacaaggcttgtaaattgtaatgccttgtgctctcccgcaaccccattttaatggttcaggcttctctcataattgatttttcaacgataaagacaaaagaagttgactacctgtgtagacctttcacctgcacatggaattaatctgtcactgtaaaaaaacctagatttgtttttattccatctggacagagtagaatatgtcacatccaattctaaatttattttttttgatagagagagtatgcaggattctattgtatcatagtcctaggctgggttcgttgttgtgtgttgggaatacatttctagcgcacgaaaaattgagcggtccattagcatgtgattaattcagtattaggtaattttattttcaaaaatggatcaatatgattttttaagcaactttcatatagaaactttttacaaaacacacaccgtttagcagtttgaaaagcatgtgcgcggaatgtgagggaggtgagttggaaagttggagaaagaactcagccctagcgttgttggtcatcctattggacccgctattgatcatcgttttggtaagctgcaacaagcttagctaatcagaggagaccctctccttgggcatatttttacttctactactcaacctatggggtattaggaaccatttccagattcataatttatataaatggactcttgacattaaaataatcaattaaggtatcattagttggatttccaagattaagaagggg

SEQ ID NO: 63272 - DNA, 1078 bp, Oryza sativa
ctaagtacgtttgtattgttttgatagattttccttagttaaattttattaacaatagttttttctatttgatccctagttaaattaactagggatttttttatgttatttagtcgattgaaaatttggattgattttaaatttcagttgaaggatatcaggaaattgacactggattagttttaattactgtaattgatttaattgcaaactgcgatataccgttgcattttgcacttcaaaaaccaattgattattcactaaattaattaagcgataacagccaagatattctgttggtaataaatgctgtagttttttatctatactatttaattcattagcccgtaatacgatacggcttaaacttgagctttctaaaatatcactaatattttttatggtattatttttcatcttttacgggttgttatctaaacattgattcaatatatgctaatttgttgcccattttactagaatttagagtataattgacactctttttgccttataaacgcggatattaatgaatttatttaaacattttcacaaaacacctttttggtcgcaattagtctttggagtaatggcaattttaacgttacctgaatttcaaacaacagcagcaagtgaaagtcagcatgagcaaaatactattattaatcaagcggctatgcaatctgcattaagtgtagatgaagtcgaacagcaagcactttttgttgaattaaaacaaatcattcataacattgcgccacaagcggtcattttttaagattttttaactaaatgctatcgctttgaggtcgattatcaaccacctattcgagcccggtccttttatttaaatctaaattaatcaatatttcatcatcgcattaaggtgataggacactattgcgcaattttatttaaatattaaagatcctttattatgatttcaaaaattattacctctattttcggttcaagtaacgatcgcacgttaaaacgtttaaaaaaacgtgtggtacacattaataaattagaagctgaatttgaaaaattatcagatcaagaattacaagccaaaaca

SEQ ID NO: 63273 - DNA, 709 bp, Oryza sativa
cgtaaaagattcgctcgccctattgtggataaagatcggccggatattcgtattcacgtttatttagatcgtgagaagctaattgtatcgctagacttaagtggcgaagcattacatatgcgaggctatcgtgaagataccggtaaagcaccattacgtgaaacccttgctgcaatcattgtgttacgttcaggttggcaaaaaggaacgccattagttgatcctatgtgtggatcaggcacgctattgattgaagcagctcaaatgcaagcgggtatcgtaccacaattacagcgtaaatattggggattcaacgcttggaaagggcatcagcaagcgatatggcaacaagtattagaagaagcacattcgcagaaaaatactcaaattgacccgcttttttatggttttgactcggatcatcgcgtccttgctaaagcaaaacagaatgctcaaaatgccggtgtagcgcatttgattcattggccacaagcggatattgcagcgttaaaaaatccgtgcctagatcagaaaggtacattggtatctaatccaccatatggtgaacggttaggcacaacacccgccttgattgcgctttattctgtatttggtcaacgattaaaacagcaatttgctggttggaatgtttccatttttagcggtgaaccatcattattgaactgtttacgtttaagatctacacgac

SEQ ID NO: 63274 - DNA, 827 bp, Oryza sativa
gtgagtaagtggattgcttgctcacttttttagtgagcccaaccgttcttatttgtttttatccaaattaacaaagatgaaggaatttgtaaaatgaaacaaaaattagaccgattacttgtgcaggcagatattcagttaactgaacggcaaaaagaacaacttattggctttgttcatttattgcataaatggaataaggcttataatttgacctcagtgcgcgatccagaagaaatgctagttaagcatattatggatagtttagtcgtcagtgttcatcttcaagggcaatcttttattgatgttggtacggggccgggattgccgggtattccgttagcgattgctaatccagataaacagtttgtcttgttagatagcttaggtaaacgtattacttttatcaagcaagtattacgtgaattagccattacgaatgttacaccggtgcttagtcgggttgagcaatataccgcacgtcagtttgatggcgtattaagtcgtgcgtttgcttcattagatgatatgttgaattggtgttatgccttacctaacgatagcggaaagttttatgcgttaaaaggtgtgtatgacggcactgaattgcaagcggttcaaaagccgattaaattagttgacgcaataaaacttaatgttcctcagttagtgggggagcgccatttaattgtattagcaaaatagattaatttttgtaagattaaccatattttctaccgcattaagcaggcttataatactgagtaaaccattacttacttgtatgaaattgttgaataattgtattaaaatataccaatgtgttg

SEQ ID NO: 63275 - DNA, 1423 bp, Oryza sativa
acttcctatccaaatataaaaataattaattcccacttagcgcgagcaacacacatcaggcttagttaacctagtccttgaaagtgtgaaaaagaacaatagcttagctactgcgttttttcttcgctacaggttttttagtgactgacttattagtttcagtggctttttttgcaacttttttagttttctttaatggcgcgactgttttttgttgttctcgccattcatttaacttggctaataatacacttcccataggactaggatcgccggtaaataaagtagctaaaccattattctcaataatatgtcgacgcaatgctaaacggttccgtatgtttttccgctaaacgtagcgcacattcaatatattcatctacagtatcagcaatttaaccactctggtaaacctaagcgtttaaacagtccttcatcaatatgttcatgtacttaatcaccggttttacaaatgccgaccagtcctaaagtcaccatatcaataatgccattagtattcccaaatgggaatggattaagcatcatatcgcaattatgtaacacggttaaatattgatgataaggtgcgtgaggatatgctgtcgctgaatcgcctaaataggatttaataaaacgagcaatatgaggatgagtaacgccggtcgattgccctaatgcaaagtggaagtgaattttaactttagctcgatcacgaatcacttttaatgcatctagaaaatatggattcaacttcattgtagtggcagcaataccaatattaaccacttcaagattttcgcgttgcagatattttacttttttaggggctaaccccgatggtacgtaaggtaaagcatcttttggaaagggtataatgtttcactaaaacaagcctctgaaccaatataatcttcttcagcaatcacataatcaatgaattctgaatatgttgtggctgggtggcataatgcaatcacttgtatcggtgctagacgcgtattactcacaaaaatagtgcttaaatccattccaacgctaggcatatacagtactgctgctccgttttgtttataaatagaacgaatatgatctaatttatctttcatattgtcatcttctaacaaatgaaattcatcaaatactgcttgtccattagcatcaactgctttgctccccaaaccaattaaataaaaatgttcacgagcagcaatcattgaagttgaatgagtgtgataaatagaatgggttgaatggaaatgctctagtaacaccaccatcacgggcttatcattccgataaccaatgcgagttgtatcacgatcttgccaaccatattcattaacaacatggcgacgaataacatgatttaaagcttttttaaccgcatgcttattttctgcaatatcataactacagtgcatat

SEQ ID NO: 63276 - DNA, 753 bp, Oryza sativa
ggtttcaaatctagccctaaaagaaagtaatgaagatatttcagatgcaattgaacctcaaactagatcaagaaaacttgatgagccagagccgatttacggtacaattaataaatcaccagaagcaattgcacgagcaaatgcaaaagcagatgaggccatacaagctttaggctatgatccacgaattaaaccggttgtgcctgaagaggcacctccagcattgccgccgagaaacttgcaaactaaagctattagtgattacgatgatgtttcatatgtacctgacttcaaagtaagaaaaacagatgaaccagagccaatttacggcacgattaataaatcaccagaagcaattgcacgagcaaatgcaaaagcagatgaggccatacaagcttcaggatatgatccacgaattaaacccgttgtgcctgaagacgcacctccagcattaccgccgcgtacgcaatccttgatagattcaactgaagtaccaagctatagaagtgctttagctaatgtaaaatttgatgatgcatccccatggccacaaccaagtgcgttacgtagtaaggcttttgctgatgaaccttcatcagaaacgcctaagtctcgtggtaagcgtggtatttctaagaagtctttatcaaggacagttcaaccacgtagtagaaagatttcagaggaatatagctcttttggagcgtttaccattgcgtataatagataatgggtcagactatgctgaaatat

SEQ ID NO: 63277 - DNA, 790 bp, Oryza sativa
  unsure (1)..(790): unsure at all n locations
ccattagaaaattaagacggattggaacaatatccggaccccgcatganaaattctcgagtctcccacgtaaagcgcaatctgatttaggtgagaatgcattatcttatggtttacaaagaggcagacnagcattaatcagtaaagcgaatgcggcagataaagaaggcaaaaatgcgatattagcagacagttacataggcaaactgaatcttggttttgaatttggagaattaccaaaatttgcaaaacaagtgaaagatggcaaagtanccgagcaagatatacaaaatatcgcttcatttaatgacgaaacagctaaattagcgcgaagaagcgaaccaaaaaatcgtattaacgatgctaatgtagatgataaccaacgaattattcgtgagttaataaataatgaagcggcagttgatgcattaaaacggatagctacgctaagtgaccaagaaaaagcgatgcacagtacattaagagcaaacgaaaaatttgatatggatgaactagaggagtcccctaactatactactgcggaaaataaatcgattcgtgattataaagatacccagaaagcattaaatgatgcacgtatggacttctttaccgagaagacgaaatttatcgcgaaagaaacgctagaacgaggaggacagctttactttgcattagatggtttagtgacaaatagcccaggttttagagctgatacgcagattaatatggataaattgaagggtaccgagctcgaattcgccntatagtggatcgtcactcactgccgc

SEQ ID NO: 63278 - DNA, 1856 bp, Oryza sativa
  unsure (1)..(1856): unsure at all n locations
acccaatttctcagctagttgagcattattacctaattcaggatgaacatctaacggcaaatgatagctaaataaattaatatcattcaataataactgctttatccgcttgcttttcattccacgaatacaaggcgattcatttttccaaaaatagccatgatgcactaatattgcatccgctttcttagcaattgcttgttcaattaacggcaatgaagcagtcacaccggtaataatgcgttgaatgttggttttaccttctacttgtaaaccatttgggacaaagtctttaatagcataactatttaatttttgattaataatctgttctagttctatatgggtgagtgccataatctttccttgtattgagaaaaagcggtctattttttgcaaaatagttcacaaaaatagaccgctttacctaaaatgtattaaattattcaagccagagtggtagtctagtttcaactcttaaaccaccaagaatacttttcattgcttcaacacgacctttatgttgttgagcagcatttgctnnnnnnnnnnnnnnnnnnnnnnnnnnnnnnnnnnnnnnnnnnnnnnnnnnnnnnnnnnnnnnnnnnnnnnnnnnnnnnnnnntatattctgattctggtacaccttcaccatcatcattaactgacataaccaattctttatcatcaatgtaaatcagtacagtgatactttgtttagcataactttgcgcattacgaattaatttttctacagcactggcaagaataatttcatnaccgttaataaaatagccttctacattatcaattcgttgctcaataaataagtctatttgattctgttctgcctcaaactttgcatcttctaaaatatcatcccaaattttattaattgagaagacttctcgcattagatgctgattaatttgctgacgtgaaagagaaagcaaatcatgtaccatcgtatctagtttcataatttggttatcaatacgcgttagctctgcagaatctccgttacgttgacggattagcgctgttgctaattgtaagcgcgcgagtggtgtttttaactcatgcgaaatatcagaaagtagtcgttgttgatattccgtcaactcctgtaacgaagtaatcatttggttaaaactacgacctacctctctaaactcatgaataccttccgtttctaattttgggttaatcgccaaattacctgtggctaccgcattggcacagattcgtaattcttttactgggcgcgcaattttccacgaaagccaaagtagaataggcacacttacaattaatacgatcataagcattagccaaggcgagtcaaaaattctattaaaaaactcttcctgaggatccactatctgtgcaaaatattgcatatattcgcgcttattagacttaaccaaaaaaggaccggaaatttctaaactaccaaagcgacgttgtaatggttcaagtggtgtttgtgcacgataaaggaaaacttggaatgattgaattctattagagtcagctcccgctccaacgaaaatgcgagttttggggtcgaataaaataatattaaagccattttgagtggctacagaaaggcgacgttcaaaaatttcatctaaattatattgtaattctgtttgacggctttcttgaataaaaaattcatgttcacctttttctaaacgtgagaatgaacgcgcatcgaaattaggaatggctaaggtaatagctaacataatagcaaatgttaagccaaaataggcaaagagttggtaagctagataatttctaacagattttatcttttttaaaaatttaggcatatattaaatactttaaaaa

SEQ ID NO: 63279 - DNA, 1015 bp, Oryza sativa
tttgcttatcaccaagcacgtgctaaaaagcgtgtagtggctgaacaaccatttgaaatgccagtaagcaaaaacgcatttgccacagaagcggatattgaagctgaatttgagtttgttgcagatgaagcgacccaaaatttagcggcattattaaatgcgacagatgaagaataagcgatagcgtttatttgaaaaagaaaaaagctaggtaatttacctagctttttttatgtctgaatgtaagcctaaatatctctttaatattaatttatttcatttgaaatatagatcgcattaaaaatttttcgcaaattttcctgatttagtgggcaatatctcttacattgctgtaacgaaaggggtacactaatcgtctaatataatatgcaaacgattatctattaatataaaaaggtagtgattatgaataaaactttaggcagtacattattggtttcagggacgatgattggtggcggtatgttggctatgccattgacgtcagcaggtattggtttttgtttaactttagtattattggtcgtgctgtggatattgcttacttatagtgccttattatttgtggaagtatatcaaactgcagaacatgatgttggtattggcacattagcggcgcgatattttggtaaaacaggacgagtcattgctacgttagtattaatggtctttttgtatgcgttgttatccgcttatgttacgggcggtggtaatattttagcgtcaatgtttccagctgcgcctgatcatttaatgacagagaaagagaaaattgcgatagtcatgtttacgataatttttggtgcttttattgtttttggcactagaagtgttgatggtattaaccgttttctgttttttattatgttagccggtttagcgttggtactgtttgctttaatgccttttattcagatagataatttactcgcaatgcctgtggataacttattattagtttctgctagcccgatctttttcaccgcttttggat

SEQ ID NO: 63280 - DNA, 714 bp, Oryza sativa
attgagggcctattattccgcaaggttcattccaaattgaaaaaatcgaggtttttccccgcccaagtgatcacgtggtagttttggcaaaaccttacaaatgaaggagggggccaaattaacgctcagtaacgacacgtaaatttaacgtatttgttctttatctgacaaaatgcgttattttaagaatgggcataagccaaattagggctttcagtgcggggtttatcatgggattttaaggatgtcacgcatattgcagatttagcgaattaatcacagattcagcaagtccattaagctgaggcgttgggtatcaagcaatggatcggttattgcaacgtttacaggcagatatataactttatccagttaaaggtagcaaattaaggttaatgcggagcagaaagtagttaattgtgtaaagttttcttagttaaataatcgttttgctttgttttattgaaataagtccccataaaggtgttggtcttttatgtttaaacacaagtaataaataatggcattaaattttagttcagttgcattagaaagtacgcaagcaaaaggtggttatggtatcgggtgactaattggtcatctattcaacagcagatagtccggtacgtgtacattatacgggataatagaaaaatggcacggtatttgatagttcggtacaacgtggcattccagcaaaatttccggtagggg

SEQ ID NO: 63281 - DNA, 771 bp, Oryza sativa
aagcaaatgcttgctcaatttgtgcggaatcaacaacatctaattgaatacattcaaacccttcagcttgcaagcgctcaatatctgccgtttttctgcaacttgcaatcactcgccaaccctgttgttttaatagtttagccgttgcataaccaatgccagatgaacaacctgtaattaaaattgtttgcatcacatgatcctattacaaataactgacaaaaccctctgtattttctgtttcacgtgctaatgaaataccatctcttgcttccttaggcgatccaactaacaataaccctattattttatctcctgtttgacaaccaaaagcctgtcgcaacattttgccttctacccactgattactaatccaaacagtatcaaaccctaacgcattcgcagctaattgcattgcataagttgcacagcctgcactgatcatttgctcccaagcaggcactttttcagattgatgatctatttttgccacaatgccaatcataagcggtgcttgctcagcaattttatccgctttaagcgcatttttttcgtccatctcaaactcaatggccgcatccaccaaacacgcttttaacattgacatactctgtttttcaatcaccacaaaatgataaggcttcaatttaccgtgatcaggcgcacgtaatgcggctttaaacatatgttgcaattgttctgcgttaggcgcaatttgccctaattttttatttgaaaaaaaaaaatgtaataactctaatgttttcatgg

SEQ ID NO: 63282 - DNA, 892 bp, Oryza sativa
cgcacttaatgatttaaatgccgattgcaaacgttttaattttgccggtacatctggacgatttgcgatagctgaaataagtacattcatatcaaccccttgcaattcaactgacaaaatcgctgggtactctattggcaaaggctcatttggctttaaattcaataagttacgtaaggtttggtcccccacttttagagtagtgcgatagccaatcaaaccattacgtgcattcaaagggccttgcttggcttgttcaaccgctaagtgatcaattgcccccacttccattttattttctagaatatgattaatctgttcataatttttaatggtttgttcactaacattaatcacatctttcaaataggcaatttgataatagctagccacaacggcattaataatagaaagtcgagttgcttttaagtcttctatcgttgctttatattcccattccgacgcactagcactatcagctaaacgacgccataaatcaagcgtataacttaaattgaatgaggcattgtgtacaacatttgacgccttggtaacgctattagatgattgtaatgagccatcagaaaccaacaattttgatgccgagcttgaaccactaccactaaaagttggtactaaactagcaccaactaaattcgcattatatagcgctttattaaccaaaatagcacttttggctaagttaacattattagctaaggcttggctaacaagacgatttaactgcggatcgttataccctttccaccattcttcatcaatattaaactgcttagtcaattcttcatattgctggtagctggtttttgcttgttcaagcgagccatcttttgtcatactcgatgtacaaaatgacaaaaagcttgctaac

SEQ ID NO: 63283 - DNA, 929 bp, Oryza sativa
aaaggcaggggctgatatcttaaatgatattcgcgccttaacagaaccacaggcattaacaaccgcagtcaaactagcgttacccgtttgtttaatgcatatgcaaggtaatccacaaactatgcaacagcgccccaaatatgatgatgtgctagcagaagtcagcgattttttaaatcaacgcatttttgaatgcattacatcaggcattgccaaacagcatattatacttgaccccggatttggctttggtaaaactgttcaacacaattatattctgctaaaacacctaaaagccttcgccgattcaggctttcctgtgcttgctggtttatcgcgtaaatcaatgatcggcgccgtaacaggcaaaagcgttgaacaacgcacagcaggatcaataaccgcagcattattagccgtacaacatggtgcacggattattcgtgtacacgatgtagcagaaacagcagacgcattaaaagtttggcaagcaatgcaagattgtgaataaggaaatatatgacaactctcgtttatggtatcaaaaattgtgatacagtaaaaaaagcgctcaaatggttacaagcaaataatcagcaaccacaattacatgattatcgccttgatggcttagatgccgaatggcttgcacaaatggaagccaaatttggatgggaaacattagttaacaaacgttcaacaacgtggcgaaacttagatgaacaactcaaaaatagtttgaatcgttcaaccgctttacaactgttacaacaacagcctaccttgattaaacgccctattgtaattaaagacgatattgcgttgattggctttaatgaacaagactatcaacgcttaataaaccatatttaaccgcatccaaaaataattgaacaacaaaggtaaacctctgcaacatttcaaccgct

SEQ ID NO: 63284 - DNA, 756 bp, Oryza sativa
attagccgccattgaaaaactagcaaaagcagctcacaggtagtattccagattcattaagtttgacagaccaagcgattgccctaagttataccaatattacattacccgatagttagcgaaatgttaggcttaatcgatgatgatcaaccgcttgaattagtgatggctctagcccaagcaaatggcgatcaagttatggctattatccaaaacattgcaacaaaaggcattgactggcaacaattgctaaatgatgtggcagaaaccttacaccaaattgcaatgttgcaattgcttaaacaagaaacaccatcagacacgccattacatttgctcgcaaaacagataccacctgaagatgtgcaatttttttatcagttaatgctcatcggcaaaaaagaattagcttatgcaccagaacaaagtattggtgtagaaatggtatttttacgtgccttagcatttcatcctaaacgtactgaagaaattaacaacgtgcgcaactaaatcaagcaaataacgaacagtcggcaatggttgacaatacccaacataagcttgaacagctcaaagccaattttacacaagtaaccacagataaaacaagtgcacaagcggtcgaattttcaagcaaacgatcaataaagccggcgcaacaaactgtgccggctaatattacagatagcacaaataatacgctaatctcacccgcacttgttgcaatgcaagcgcggaaacaattacaacaaaagg

SEQ ID NO: 63285 - DNA, 2013 bp, Oryza sativa
  unsure (1)..(2013): unsure at all n locations
annnnnnnnnnnnnnnnnnnnnnnnnnnnnnnnnnnnnnnnnnnnnnnnnnnnnnnnntcctctacgctttactgctctcgagaaaagattcagattaaaaagctgattgtctgtagattgttttaattcctgtaacttattaagtaagtttgttaagtaaggatataatgcattggaaataggtaaggtatggtaatcatggtttttatttatttcaggaggtatgtaaattattcttttttcaagatcaacatcctttatttttagttttattaattgagtccgacgaatcgctgtacaacgaagtgtcataataattgtttgtacaaaccaagtaggacgcagatattcaggaatgttagcattttcttgtataccacaactcaatttttgtaactgttccgggctatatatcttctttctatgttttccctctttaactgataacttattaaatggatttttctccaaagaaagtatttcgtattctataccaaatttgaagattgtttttagttgtcgaatgtagctattccaagttacagggctaatagatttatctacaacgttctttctccactctaacaaacttgtaactgtcagatcatctggatattcgactttgcagtttttctttaactgccgtattgctttttcatagcttttgtattgctttttcatagctttttatggtgtcaatacgcaaacgacgatggaaaaaaatgagtcaagtaaaatatcgaatgaggctttatcattctgtttctcctctataagtgttaaatgtagattgtcaatgagaacctgtttaccgaagaaatattcagtatctttaatgagatatccacctacctttgaggattttcttgggccaattaccgaacatttccaaaagttctggctatctttattgggtagatgatatcttttgtgcaattttaaatcttgaaaagcatattgcaaactttcaatatctttttttgtataactaactcccttgctattaaaataatctgtaaaaataccaggcgttactaaaaataggtgattcttcacgatatgaagtttggcattttttacgtttatagagagtctttttgttgcaattccttgtcttaaccattcaataaacgcttgtcctgacatgatgttggggttaaccatttcttcttccggtaaatcaattactgtaccgttttctatattttcagatatcatttgaatgggtttaactatctctatagtatcgttactacttagattggttgtttgctctgaaggtgtaaataattccaaaacaaaatctgtcatattttcattttttttcgcttcaacttgattttcagtctcgtctaatatgacttcactatttgttgtttctaaatctgatgatggtacagcctgttcaggtttgtttgttaagtctgcctcagtagtcatagtttcaatagatacttttccagcaaagaagtctgggcgatcgctaacattttcccaaatagtttccggctttattttaagtagagtaaaaggtttcgggggacaccatcctgaatctgctttttctgcaatgccaaattgccatatcatcaggtgttgactcaataacattgagcgattgcatttcactaaataatttagggttatccgatggtgcagatataccttgctctaataagtatgcccgaatttgatcagctgtcgatttactcattaaccaaagtccgtctatggtataccaaccatccgcaggacctttaggggtatttatctttaatttatgttgcaataagtagagcaatgcaatgattaattgtttagcaaatgatatagttggacgctgtgctaatttcgttacatcgccaccgagagctaaagttacgctgttttggtctgctttttgtactatttcagatagtattccggctttatccgggtgatcagccattgcatacattaattatgaaaacacttcaggatattgtgtcagccaatcaaaggcttcttgggga

SEQ ID NO: 63286 - DNA, 770 bp, Oryza sativa
  unsure (1)..(770): unsure at all n locations
gattttccaataatgccgacaatgccgcacataattaaaaacctctctatttagtagtagtcgtagaatttaaaaaacttgaattagcttgtaattgttcaaagaaccatttcacaataaaatcgaaatgcggaataagttgagattcctgccataattcagtttggtttgatgttgtaaaagtatctatgaaaaataaaatagcggctacaatcaaaataccgcgtaatgctccgaaagcaatgcccaatactcgatctgtcgcagataaacctgtggtgttaataattttacttagtaatgcattaacaatcccacataaaattaatgtgataataaataagatagccgcctctataccattacgtaagtattctgaattttgaaaataaactgaatcaatttcatttaagtgactgctcaaatnagaagagacgtactcgcgacaaagaagcagaatccatcctgaaagagaaagtacttcacttataaatcctcgccaaagactaactgagatagaaaaagcaattaagctaatgataattgtatcaatcataaaaaccccaaaaggcgaatcgctatattttacaaaaaaagaaaacgtttgcgtagtgcaaaaacaataaaaaacgaaacaaatatgttacaaaaaaataataagcggtttatttctgcaaattcttagcaaaatccaaccgcttgcatatatattatgcgggctgataaccaacatcttctaacgttgggttatttgcgccgagtttagccag

SEQ ID NO: 63287 - DNA, 1255 bp, Oryza sativa
attaagtggtattgcacaatctgattcagtgatttggaaattatcagacgctgattttttgcttaataatgcgttacgtaaaatggtgcttgataatgatattgataccaccaaaaaattattattagaggcagatgccatattagcacaagtgccaaatgataaagtagcagacatacgagaagcgattagaaatgactgggagctactagccaatatgaatgtagtggatcaaaatagcttgatgcaacaactaacgacattagcaaatagcttagatgatttaccgatgctgtctagtgggcctacagaagatgatccgattaccaatagcaaagtgagtgattcgatcaatgattggcaacaaaatattgaaaagagtgcaagttcattcttagaccattttattcgtgtcactgatcgtaacaaagcagatgccaaagtatttattgcaccgaatcaagaaatttatttacgcgaaaatatccgcttgcgtttacaaattgctattttagccgtgccacgtcagcaaaatgaattatataaacagtcgattgatgcggttagcacttggattcgtagctattttgatacgcataatgagaatgtgaaaaacttcttaaaagaattagatgatttagctgaacaatctgtttatattgatgcgccaaaccgcttaggaagtttagttttacttgaacaattactgaataaaaccccaaaagcgatcgataaaattgaaataaaagctgaaaaagcgttgcctgagccgacagacagtgaagttaaaagaggtgaagcaaatgcagaagctatcgctgaggatgaatcaaccgaagcaaatcattcagcagttgaaatggacgtagaatcagaagcttatccatcatctagatcagccgagcaaacggctcaataggagaaagttatgtttagagtgctgtttttaatgctgttattgcttgcaggtttagtcgcaggcccatatcttgctggaagtcaaggttatgttcgaattgagactgattcgaaagtaattgaaatgagtttagtaatgttggtcgtattctttattatggccatgtcaatggtttatattattgaatggaccatcattcgtttttttcgtttaagtaaaggctcatatagttggttctttcatcgtaaacaaaaacaagcccaacaagaaaccttggaaggcttaatgaaattccgtgagggggattattctaaagcggaaaaattgtttagcaaa

SEQ ID NO: 63288 - DNA, 1018 bp, Oryza sativa
ccaaatttgcaaaatttttacaaaaattaatggctttgtaatgcttgttgcgtaaactctacgcttaacattcgccggtggtttatgttgaccaaaacctaagattgcttctggttcgctgtctgcgtaagcaatataaggtttgatatccaaaataggcgtaccattgactaaatcaacactaccaagttttaactgtgcttttccatgatgtatttcgatcgcttctaatgcgactttagataacccgatcggattcgggcgatgagtggcacgagaagcaaaaacaccaatacgttgattacctcctaaacgtggcgggcgaacggttgaatgccattcccgtgcggggagctgatgaaattgaaaaattagccataagtgactaaattgtgccaaaccgcgtaccgcctctgcacaattgtagggggggaataaagtaaggtttccttttccttgagccactaaattgggttgacgtggcacagaaaatttttcatcatacgggctttcaataacaccaatcggatttaacactagaggttgtggattcgccataaaaatgcactttttctattataaatcaaaatcaacacgggtattttatactaaaatacgttattttatatctttttatttaatccattattacttttatgaataagcgttctattttttcgaactggtttatcacggcaagaccaaaaacgttacctttagcgttggcttcaattatggttggatctgcattagctaattgggtggggcaatttgattgggtaacgaacttattagccattatcactactatgctgttacaaattttatcaaactttgcgaatgattatggggactatgttaaaggctctgatacgcaagagcggattgggccattacgtgccattcaacaaggtaacattaccggcgaacagttaaggcaagcggtcatattcttaagttttctgtcgtttatctcaggattggtattaaccatttatgcctatcaatctttacaaga

SEQ ID NO: 63289 - DNA, 833 bp, Oryza sativa
tatccggactcaccttatcaacagcgcttaaatcaattaatgtttgagcgtttatatcagcaacaaaaattttcagcattattagcttatgcgaaaaccattgcaccggaaaatgctgataatcaatgtcgtgttttttctgcgcaatatcagcaatttatggcacaacaacagaataaagaagctcagcaaaacagcaaaaaaacgatttggttagccactatgatgcaggatttattggcacaatttgagaaaatgtggttaaaaacagcagaattaccacagcactggcggatattgaacaatattggcgggatcaaggtagaaaaaccgatgaaaatatcagattaaaagcggttgaattagctaagcaaaatgctaaaaaaggctttgaaattttggatcaacatcatcaaaattcggagttaagcgattggttggtagaagtcagcaaattaacggcaaatgtcaaatatttgccaacttttgttgaaatgcaactgcttaccacacccaataaagcgcttatattagctttttttccaaaatttattaaaaccctttcagaaacattagcacaacctaactttgatacttatcaagcatgggcagataaatggcagttaagcacggatgaactgcgggagtggaaaattgcgtttattagtcgtttatttgacaatcaagatccaaactttaatatttggcgggataaacaactatcagaaatacaaacagatagcttgattgaacgccggattagaatggcactctggcaacaacagccattagcacaatggttagcgctcctttcgagtaaagcgcaagaaaaa

SEQ ID NO: 63290 - DNA, 764 bp, Oryza sativa
ggggaagcaaaagggcttgaatttaacttaccttatcgcttgaaaaacaatcaattagactttggtttaaaacaacctattaatttaaaaattgcttatctaaatgttggcttaccgattacaaatattcgagcaaaagtctttggacattatccttatacgccacaacacccattaaaattagaacaactatcaatgaatttattagatggcgctttgcggatagaacattttgccttaccacaaactaaagtcgcttatcttcatttatcacaaattaattttgaacaaattttagctttgcttaaatatcaacaaattgagttgaaaggacgtgctaatgcaacttttcctttttggattgaaggaaaaccttgttatgtatgtaatggatcaatggcacaagcggttagttctaggctaaaaattgcccctgaattgatgcaagctatttcacagagtaatggttattctgaacgtttattagcatatttgctacacgacacacgcattactgatttaactagcaaggtaaatattaattctgaaggcgaaatggcattacaagccaagttaaatatgcaattaaatcaacaagcacagacgaaaattaactttaactaccatcatcaagaaaatgtatttaaactatggcggacactaaatgctggcacttacgttgaacaaaattttgaaaattcaatttatcaaaaactggatcgcacaaatgaataaaatactgttattaatgggtaccgagctcg

SEQ ID NO: 63291 - DNA, 733 bp, Oryza sativa
agacgacaacatcggcgtatatagcccgcttgttgaagaattgggtcgctccgctggcgaaacagcctgacgaattagtatttggcgcgttaaaaggcggttttacaaccgaatgctacgacaaacaatacttttttgacaccgaccacccggtcggcgcaaaccctgacggcaccagccctacttcggtatctaacatcaccgatgacggtacaagcgtgaccgcagacggcgcatggtatttgctcgactgttcccgtgcgttaaaaccgcttatcttccaacagcgcaaacctgcaacgccggcgcaaatgaccgacgccaacgcgcagaaagtgtttgaggataacgtgtacacccgttgcaacgtgggctacggattctggcagatggcgcatgcggtgaaaggcaaactaaacgccgagaacttatggaaagccattaaagcgatgcgcgcggtgcatagtgacggcggtcataagcttggcattaagccgactcacattgtggtgccgacaagcttgcaagaagaagcggttaaattgttggagcgtgaattgcgcgtagaagacggtgcagccgtggacaacgaatttaaaaacatgaagttgacattaatcgttgccgattatctgtaaatttcaaaagtgcggtggattttaaccgcactttaaatccaatttaaagtagttttaaacggagaaaaaatgcgatgtctgacgttaaaaaatat

SEQ ID NO: 63292 - DNA, 730 bp, Oryza sativa
cctctgctattgcatcttttgaaaagatgggttcaagaaacgtacaagcgaatttatttggtgaacaaattcaattaagtttaatttttgctcattataaaaccggtgaatattataaagcactaagcctggctgaacgttttgtacgtgcttatccaaacagtaataatatggattatgtacattatttagtcgggttaagtaatgttcgcttaggagataactttattcaggatttcttccatgtaaatcgttcttcgcgcacaattgagagcattcgtaatgcttacggaaatttccaaatgattgtgagaatttatccacaaagccaatatgtaaatgatgctcaacagtggatggtttatttattgaatcgtatggcagagcatgaattatctattgtaaaattttatgataaacgtgatgcatctgttgcggtcgtaaatcgtgttgaagaaatgcttcgtttttatcctgcaagcaagtcaacctttgatgcattgccttatatgcaaaaagcatatcagagaatgggattaaaagattcagaggcaaaagtcgcagagttgattgaaatgaataaagcaaaagtattccctaaaattactaagccagaatatagtaaacaattctaagtagttttatcataatattaacttaataaggggcgttatttgagataatgcccctttccctatttgattaatcagacgaacataatgcgaatttt

SEQ ID NO: 63293 - DNA, 976 bp, Oryza sativa
  unsure (1)..(976): unsure at all n locations
caactcgactaaaatgctcttctttaccgccaatcacttcacgcaaatgccaagcaattgcttccccttctctatccaagtcggtcgcaagataaatatggtcagcttttttggctaaggatttcaattcggaaaccactttatctttatccggtagaatttgataatttgctttccaatcgtgatatggatcaatgcccatccgtttaactaatgccgctcgcgctttatccgcttttacttttgctttctgctctgctgttaaacctttagttgagattggtttgactttttccgctttttcactaccgcttttgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgattttcccattaatgactatccacaaataaaataatgattgaagaaatttataagataatttcttattagttgatatttaatactaattgactcaaaataccggcaacaatagcaagcatttcgctaaaatacaatatatagataaagaaaatggataaactaaatacgcactcatcgccaataatggttatgggttacaataaaatactaattatccaatgccaacattaatacttttgacatacgttgataattataatggcgttgtttttcaacgggtaaatccgttggttgtatttgcacaaaacctcgttcttgaaaccattgtattgtttgggtagttaatacaaataatttttcaatatttaatttataggcgcgtcgtttaatcgcttctagtaaaatatcgcctctcgcagaatcacgataatcaggatgtacggcaacacaagccatttctgccattttctcagcgggataatgtatcaaagctgcgcaagcaattacaataccatcacgttcaataatcgtatattggctaatttccatttctaa

SEQ ID NO: 63294 - DNA, 1055 bp, Oryza sativa
ttttcgtttactgatgggtgttaaagccagtattcgtggcaatttacgtgaattactggctgatcaaaaagtcgtaaatggcttaaccaaaatagcagaaaatatagaatttctacaagaagtgattaaaaaatcacttggtcgctcagaaacgttagataaaatcttcgaaagattggcggaagtcaaagttcaattacaaaaattgagtaatactagcatagttggttattgctattggtatgaagccaacgggcgttattttggtttacatatcaccccgttaaccgtggcagataaatttggtgaacaactcaaaaagcaacaaattggttgggtttttgcttcagcaactttagaagttggtggtcagtttgatcatttttgtcaacgcttaggcattgaaaatgcagaacaaatagtattacccagtccatttgattatgctaatcaatcactgctttgcgtgccacgttatctgcctgataccaataaatctcacacgttaaccacgttaggaaatatgttaatgcccgttattgaagccaataatggccgttgctttttgttgtgcacttcttattcaatgatgcgcggtatggctgattttttacgagaacatagccagcttagcgtattgttgcaaggtgaaacaagcaaagcgcgcttattagcacaatttattaccgaaaaaaatagtgtgttagtcgcaacgcaaagtttttgggaagggattgatgttcgtggtgatgcattatctttagttattattgataaattaccatttacctcaccagatgaaccgctattaaaagcgagaatggaagattgccgtttgcaaggtggtgatccatttaatgatattcaaattcctgaagccgtgattacgctaaaacaaggtgttgggcgtttgattcgtgatgtaaccgataaaggtgtagtgattatttgtgatgctcgtttagtgatgcgtcagtatggcaagacttttttagaaagtttgccaccatcaagccgcactcgtgatcttgctaaagtgattcaatttttgaaaa

SEQ ID NO: 63295 - DNA, 985 bp, Oryza sativa
  unsure (1)..(985): unsure at all n locations
atattcaaagtactgaaacaggacgagttttaattagcgccttgccagatatagcgactcaaccagatatgactgcccaatgggaaatgcaactgaaacaaattagccaaaaacaagtctcttaccaacaatttatgcaccaattaacgactaaattacccgagctactgcatacagaccgacaaaaattgcaaaaactcaacataattacaccgcttaagctacctgctaagcgaacacatactaaagcatcaataatggctgatgaaaaataagtcaaatgtggatggtggaataaaatttacttgcaaccaaaatgcataatctatatcataccccccatcgaaaatggattttaatcttgaaatcacttactttatcgcgtacagaatagagaaatcaaatgttaaatgtactcacaattatttatcttatcgttgctataatattaatcggttttgtgcttatgcaacaaggtaaaggtgccgatacaggtgcttcatttggtgccggtgcttcaggaacggtatttggttcagcaggttcagcaaattttttatcaagaacaaccgcttttttagccactattttctttgcacttagcttattaataggcaatttaaactcacataaaacaggtaatgtaagtcagtttgaagatttaagtggtattcaacaaaaggtagaacaatctacaaaagttgaaaatcaaaataatgatattcctcaataatatctaatcaaaaaagctctnnnnnnnnnnnnnnnnnnnnnnnnnnnnnnnnnnnnnnnnnnnnnnnnnnnnnnnnnnnnnnnnnntcgctcagagcaccaaatacaaaaaacgctaatcttatggttagcgtttttttcatttttatattggtttttaaacaaatgatgatgttaattgcattattgactgtagatataaatttctttacaaaaaataaattatacttgcttacaaggaattttggttatt

SEQ ID NO: 63296 - DNA, 737 bp, Oryza sativa
gctgattttgctattttatagccatgcctaatgagtttttcagcgtccggcattaaagtcggtggattacactaaatataaataattcgctctggtgttaatgccattaaatgatctaaacaaaacaaggcaccttgacgagcgggatcgagtaatactttattaaaaggttgtgtagcccaatgttgatcaacaaaagattctgctaaattagtttggtaaaatgctatattgtttaacccgctagtttgctgatttattttggcttgcttgaccatttcctctacaccttctaccccaactacgaaacccgcttgttgtgcaatcggtagactgaaattgcctatgccacagaataaatcaagaatgcgatcttctgctgtaattgctagccattctaacgctttattaaccattttttgatttaacggctgattaacttgaataaaatcacgaatgcaaaaatgtaatgttagcccgttaatttggtaataaggtgcttcaccgcaaagatgttcaatgtgattctcatcacacattaaataaagcgaaagctgttctgcttttgcaaaattgagcaacatgtgctgatcttgagcatttatttttcctatatggagaaccaacatcgctcgcgtattatcagcgttaactagttcaatatggcctaatgcttttttcattttccagccagcaaataagtgttgtagtttgggcagtaatgtagaaaggggtac

SEQ ID NO: 63297 - DNA, 906 bp, Oryza sativa
agttgtttaatccaacgtaagtattgtgcggtaatatcttccgaccattcgctggttggctctaaaaccggatgtccgcgataagtcggcaagtgacgaatatcagcggcatagccattgtgctcgtgaatttgcaggcgaatttgtgcggttgccacctcatcacttaaacgagtaagttgtggcatatcggtcagcacggcggagcgtagcggataaaccacggtgctggtatcaaagcgattcagtaacgaacgttttatttcaagcttatcaggctcaatgccggtaatatccaccatttcacgtttgttcccgttcatcaaaaccgcacgcccaccgacataaaagtcaaagcccgtggtggcaagtgataacgttttatcgcctggtttagttggcttgtctaaatagacttgatgagtaaaaattggcaatgcccacacccttgcaccgtaagcgtagagcatattttctaaccgctgacattctgttccgacagtggaaactttaaattcaaaggttcgacgggggataaccgtttagcaatacgttgttccgcaccggtaatagattgatgcaccgtcgttaaaaactccagtttttcggtcacgtcttcagaccaatcggggaaaaattcccagtcggtagagcgtgaaccagtgatacgcaacgtaaccggatttttgccagcaatcgtaaaagttactgtgcaatcaatttctgccggaccattcatgctgactttaactgtccactttttaagtgctaacgcgcgtagcgtaaacggcgcttgactgctggttagcgtaatgccttcgccgtctttaatgtcaatcttagttaaattaacgctatgtcggttcgcgttccacaagtgcacatcaaacacttgctctgtcgaga

SEQ ID NO: 63298 - DNA, 1054 bp, Oryza sativa
  unsure (1)..(1054): unsure at all n locations
cgtccttttcccgtgattcctgacgagaagaatctaactgaatatccatatcatcaattttaacgtgaatgttatccaacgatagtttttttaattcaatctctaacggaatattcaattcagtaaatggcttactttctacttttttcgagggcggaagtttagtgctatcaattgtaacgtgagcatctttcagtgcaatattttccacacaggctctacgatagattaaacattcaaaacctatatgtaaggtcgcttgcccaacattaacatttactccctccataacaaattgagtatctgataaagttaacccttgttggatactgccttctactttgccaatagttaatggttctagccatctatctactaatcgaaaagccgtttgttgccctttagctgtaaataaaaatagtaaaagaagaagcaataaggctaataataagcaacaggtacggcgaagccatcgccatttattttttgaagtcgattttgctggcgcagaagagtcagcaaaatgctctgtctgatgtgtatttggttgtttatgcataataagattgagtaattataattctgaacctaagccaatataaaattgtacaccacgtttgttattaagtgatttaacaggtgttgcaatatcaaatttaatcgcaccaattggtgaaatccaacgcacgccaacgcaagcaccagaatgtaatgcccgatgatcaaattatctgatattaaaccggtatcataaaaaatgccagccccccattctgggtaaatcgaatattaatatcccccggtattggtcattaagtgtgaccgccttattactttcccccttttaggttctttaggtgaaatgttttaataaccaaaccttttaaggttcatatcccgccagcaaaatagggtaatgttggcgggatttaatgaaaatctttagtatgaacttgccctacctctccacccaaccataacctgtgacgatctnnnnnnnnnnnnnnnnnnnnnnnnnnnnnnnnnnnnnnnnnnnnnnnnnnnnnnnnnnnnn

SEQ ID NO: 63299 - DNA, 926 bp, Oryza sativa
cttctgcttgtaatgaaaacgaaaaaagcggtatcaaaaaacataaaatttgctaaaataattggataatcgactgcttactttttaataaattctgcattttatttcacccaccccatcggattttttggattgcctttacggcgaatttcaaaataaagcgctgaccgattttgaccaccggtattgccaaccaaagcaattttttgtcctagtgcaacaacatcgcctttacgtaccattaaagactgattataaccatataacgacatatcatctttaccatgatcaatgaccacgacttgtccatacccttgtaaccaatctgctaacaccacacgccctcctgcaattgcgtgtactggcgagccttggttagcctcaatcactgtgcctcgccaagttaactctcccatttgagtggtaccaaatctattgatactttaccaacgacaggcatattaaattgtttatttggcatacctaaaccttgtaccgttttaatcaatttctcaggtattttaggttgctctactacttttgctgttgattgtttttctgtttcttgctgttgttctttttgttttcgtgcttgttgtaatttatcttctcgtttagcgtcttccatcgctttggctaactgagctcgtaacgcaatttcattatttttcaatgcatctaaacggttttgctcctgtgctaatgttttatccagcgaatgcaaggtagtttcccgttccatttgtactttttttagtgttttttcttgtgttttttgtatagttaattgcgcttgttgttctttttgttgctgttttaattcagttcgccgtgttttaagcgtttcttgtgtatgacgtaattgatgaataatatcaatccgcacttgattaagatacccataataagccatcattctctctact

SEQ ID NO: 63300 - DNA, 1904 bp, Oryza sativa
cgaatagcacgactttcgcaactatcgccacaagaacgacacgctatacgatgttgtaataaacaacattcctgcactgcgactttgtgttgccaagcaacttcactggtggcgagaaaaacgcccgcttgacaactttgcacacatttttcacaaaaggtacattcgcctttgctgaaatctacttcaggataaccacccgcacctcgtacaataatttgtgtttcacagattgttatacagttatcgcaagcggtacatttagttaaaaaattagctaaatttacccaaggcggacgcacggcattatgcccttgcaaagtcgcttgttttgtttttaaggtgcttaagaaatgcccacgtaaaaaactgcgacgtggtaaagattggtcagttaatttagccaaaacacaccttttacaaattaaactcgatatgatttattatctgatttttactggtctgccttcatcactccatttaggtatttaataaataaacggcgttattcttgataagaatcaaaaaacacgccgtttaattttatattagcaaagtaattaaaaatcattctcaatttaaacaatcgaaaataacatttcctaaccagatttaactcaataaattccatattttagaatattgctgttatatatcattttactttttcatagcatttattacatttagataatctttgctttcattattcttctcaacactttatttaacctgccatttcaagcattatggctacttacgttgtatgccaacagactcatcacatatttatcctaaaaaacagtaataaaattttatagattattaagaattacactcatcatataaagataataagattgaattaattctttattgcttatttttagtatattccattcatattttttcagcttattacaaaccttattttttctgttctatatctattcacgactcaatattcttgcaaagaatatttttataaatttagccttataaaataaaaataaaccgaaattagtatacaactatatggataacatattttattgcgggaaaatttgttttagaatcagtaaatattctctgatttctggtcgctagtatttatgaaaaacttcttcaaaaaagtccactctgagtggttgtctgaaaatattattaagacattgccgatctttatcgcgatcaatttaatctcaatcatcgtttggcgattacagatatcacaattatcaatgccgttaatcttaggcgttatagcgggggggttggttgacttagacaataatttaaccggtcgaattaaaaacttaatgttaagtttaattgcctttactatttcctcattaggtgcgcaattttgttagtatttggttggttatttttacctgcggcaatgttaagtacctttattttagtgatgatgggtgcggttggacaacgttatagcaccattgccttcggtactttacttgtagcaatttataccagtttaacgtatatgcaggagcacccttggtatagcaatattatccttattttagttggcaccttgatttatagtttagtcagctaattggtctatctatgctttccaaaccgcattgcccaagaaaatttagccaaagcctatgatgcattaagtctttatttacaagctaaatctgaattttttgatccagataatgatgatttagccgctaagcaatttgccttagccaaagccaatcagcaagttacccaagcattcgaacaaactcgtgtttcgcttttttatcagttaaaaaggaatagccgtaaaacgcgcaccaaccagttattacaggattattttattgctcaagatattttagagcgggcaagctcaagctattatcaatatcacgaactttttcaac

SEQ ID NO: 63301 - DNA, 785 bp, Oryza sativa
aaaatgctttattgccacgtttattagacactctaattggcacagcattagcttggatcggagtacatatatttacccagattggaaatatttgaatttacaccggaatttaacgcatactttacaagcaagcagtcaatatcttcgccatattatagtgcaattgcaatttggctataacgatcggttggcctatagagtagtacggcgtgatgtgcataatcatttatcagaattaagcgcggtgatcaacaatatgcacagcgagccacaaaaatatcgttccgcattacaatttgctccacaattgttaaacactacaaacacactactcagctatatttctgcgttgggtaattatcgttctgaaagcgaggaacttagccataatatacatttttcagcggttttcttctctaaaggcaaacaagtgattgatattttagatgccattattcactcagatgatcggcaagttgatcaagcacaattaacacagcgtttaaccacaattaaacacgcccttaaacagtttgaaaatgaacagcaacatagccaagacaaactggcattattactcattcagcagttattaatgattgtgcaattattacctcatttactcacgttggttaaagaagaacaactttattcacagcaactcagctaatgcacccaaataagcggtgttttttgctaaaaattggcaaaaaataaccgcttgacgctttattaaacagaaatcatcattaaaaaatacagatataattctgcatttagtacgg

SEQ ID NO: 63302 - DNA, 885 bp, Oryza sativa
  unsure (1)..(885): unsure at all n locations
tgaaggggaattcttttttttggaaatctttattttcagattcattccagcttgaggtttttattttcttttaagggtaaccgtggagcttcttttttaatgcggctattttttttttaagtgaagttttacattagcttgttcacttttgtattttttaggctcgcttttcagtttattttttccagtcgttaaggctttgtttcttccggctagttttttatcttctcgggcatatttgttttgcccatttttgataattttgtcgaattttttgtacttcatccagtgcaaccgggtgattttgccttaaaaagtttggatcgccaaacgcaatattatcatttgcttgagctaagccaactgttgctaatgcactgcttattgttgcaattttaaacatttttttcatttatatatcctttaagttgataagttttagtatatataagcggttaattttttgtttatttagaaccataaacagaaattttaaccgcttggtaagtgaaattagaatgtgctgccaactgtaaattggaattgttctatttcatctcctgcatattttttaattggttttgcataagaaaatgataatgggccaataggtgattgccattgtaatgcaatacctgcagaggctcgcacgcgtttgtaatcaccaaagtcaggtaagattggataatctgctttactttgtttccatttagtattccacactgttgcagcgtcaacaaaagggtaccgagctcgngttcggccatatgattgtcaatcacnccccttnnggggggggnantcaggaatagcgcatattccgagtttaccgaggtagccgggagtagtgggtgtttgccccaatataccacgtacacccgttct

SEQ ID NO: 63303 - DNA, 3185 bp, Oryza sativa
  unsure (1)..(3185): unsure at all n locations
aattaatttaacaattcgatttgtggaaaaaaacgaccgctaatgcctttgttccaaccttaaatggaatagcaagcggtccgttttgcgaaaattctgatttttcgattgaataaaatagataaaataccacaaatcgcccaaaataaaattagtacgattatcgcaagaaatcgcacttaatttcaacctactaagcggttataagtttaaaattttgcattattttaaaataattcactacttgttgtaggactcgttccttccggtagagaactaggactttcttgttcttgcagaccatcaggaatttgataagctttttcgacaatatatttttttgtcggttcagtgcctttaataaagtattccattaaatcatcgcctaagaagcctgtcgtagcatcaattttagtttcaataatattcggtggtagtggcgagatgcgctcttttttatcagctagcgcaactttcatatatttaatccaagcgggcattgcggnttttgctcccgcttcacctttacctagatcacgtctattatcgtcaaatccaacataaactgtggtaacaatattagcaccaaacccagcataccaagtaactttggaattattcgttgtgccgtcttacccaccaatatcttaacgtttaaacgccttggcaatggctctacttgtaccatccaaattctgcccaggttcaccataaattgcactattaaacgcattgcgcattaagaaggcaagctctccattgataacccgcgggggcgtagcgcatacttgcatcatttttgatagactctgtcatcaaacttggcgcttgaggtttaattgtggttgcaatttcaggttcctgatcatcttcagtttgcgtattgctggctgctggattagcatttatttcatcaatttctgctcttaattgatcttcatcgtgaattttaacaccatcaaaataggttggttcttggtatgctaaatcaatgtgattacattctaaacaagccaatgcaggatttgctttaaataattcattgccttggttatctaaaatacgatcgataatgtaaggctcgattaaatagccaccattatcaaatacagcataggcacgagccatttcaagcggtgtaaaagaggctgcgcctagcgcaagtgcttctgttgccataaactgatctggattaaagccaaaacgacttaaataatctgctacataatctacacctgacatttgtaatgcccgaatagcgaccatattttttgacttacctaatgcaacacgtaaacgtaaaggtccttcgtaacgtttatccgcatttttaggttcccacggtttttgtccttgtttattaatcgtgatgggtgtatcacttaaggtcgtagaaaggcttaaacctttattcattgcagcagcgtaaataaaaggtttaatcgatgaaccaacctgtactaatgattgtgttgcacgattaaaacggctttgttcaaaactaaaaccacctacaattgcttcaattgcaccgttatcactgttaagtgaaactaatgctgaattgacttcaggaatttgccctaacaaccattccttttttttaccttggtagatccaaatttgctcacctaagtgtaagctaatttctttgccaaatattgcatttgcttttttcaattcagctttatcgccattaggtaacataatcgtgtagctatttttattgaacccgataatcgctgcaccaataaaaggttctgaatgtggcaatttgcttaaatgttcaatgattttttcatcatcccaagcattacctgtccacagtatttcagcaccacgccagccatgacgggggtcataattaattacattttcacttaatgcatcttgcgccgctttctgatcggtagaaagtaccgtggcataaactttaaagcctttattataagcaacatcttcaccatagcgtttgaccatttcctgacggatcatctcggtcacataatcagcacgaaactctagtgcagtgccatagaacgtcgcagtaactgtttcagctttagcttgttcatattgctgttgagtaattttaccgacctctaacattctacctaatacgacattccggcgtttttctgcgcgtttaacggaatagagcggattcatcgtagacggtgctttcggtaagccggcaataatcgcaatttcactgagggttaattgatctaaacttttgccaaaataagtttttgctgctgcggctacgccataggaacgatagcctaagtaaattttattgagataaagttcaaggatctcttctttgtttagcacgtgttcaatttcaagcgctaaaatagcttcttttattttacgttctaaattacgttcaggcgttaaaaagaaattacgtgctaattgttgcgtaatggtacttgcgccttgagtatcaccttggcttgaacgccatacagcacgaataatcccttttggatctacgcctttgtgttcataaaaacgtacatcttcagtggcaataatggcatcaattaacgtttgcggtatctctgctaatttaacaggaatgcggcgttgttcacccacttcaccaattaatttaccatcggcagtaaagatttgcataggttgctgtaattcaaccgtttttaatgtggatacatctggcaaactttgtttgatataaatatatgtaaatcctagcgcgactcctcctataataatgcaggaaagaattgcacttagtattatttttgcgatcttcatcgaaaaattctctttggataaatgacgaaatagaaatttatagccaagataggccaacaaaacgttaagtataagctaaaaatgatgaaaaaactgcttaaaaaacacttattttttggggagtaacagccataaatgaatatctttagcaaaatatgcaagaaagaaacaaaaaaacggcagattggtcttgccgaaaatgctgagtattattgcgttgtctaccaaaatagcgatcaaataatcgctgattggcatattaaaccttttaatgttcaagcgtggttaacgcaaacgcttccattcgatgaagtcgctacatttattcgtccgattccatttagctatatttggcgtaaatatctcttttttccacttaatctggataaaaatgtact

SEQ ID NO: 63304 - DNA, 3307 bp, Oryza sativa
ccttgatcttgggcataagcagtacgcttgcctatttatattagtatgccgcgcactaattaggatgtcgcattaaacattcattttcacccgtagggaaagatatttccttacgggaatgtcgttctctatttttgggacaaacaatatgaaagttgaattgactttagaatgttttgccggatatttaaacaatgactttactaatccgattgataaaaccttggtagatgagatcaagacgcaagcacgtcaagcatggcctaaacgtcctagtgataaagaaaccattcgtattttagtaaaaatgccggcaacttgcggacaacattttcgttatctgaaagtgcgacaaaaaaacgaaaatacgttacaaatctatcacaatgcgttattgaaataacacctttcatttattcaccccggcgggaacagttacccgtttggggactgttcccttattttttaggagaacagtcatgaaaaaatacattcaacctcaaccgaaagatttataccaacaaatcaccgaccaaatcattgatgagctaaaaactggcacaatgccttggattcgcccttgggataatagttctcctccaatggtaataccctgcaatggagaaaccggtcgtcattattcaggtattaatatattgctcttatggatgagtaccatgagacagaaatttacacagcgtaaatgggtcacctttcaaggagcccaacatttagaaagtaaagtacgagtcgaagaaaaaagcaccgtcattattttctataagcaaacacagcttgaagaaacagatgatgaagccaatgttgtttttgacgaaaatggcgaaccgaaaatgaaaacgtctatatttatccaaggccatcatgtattcaatattgaacaatgtgatggattggaaaaatgccatgaaacatttccggaacacaaacctaatcccaataaagtagctcgcccagaattagatgagctgccaattaatatgggaatgcaagtgtataatcgcctccaaagtaaagcttgctatataccggcccgggactgcattatcatgccggattttaagaaatttcattccgctgatgattattacgctacactcttacatgaatgtggtcacgcaacaggccacaaagataggctcgatcgtgatggtgttaccagatttgataaatttggttcagaacaatatgcatttgaggaactgattgctgaacttactagcgcatttacttgtgcgaatgtaggtgtagccaacaatatttctcaaaatgcggcgtatattgatcattggatacaaatgctcaagtccgataaaaaagccattttccgggcatcatcacaagcacgcgaagccacacaatatctactggatatatttcacaatgaagagcaattagtagcttaagtaatttatataagaagccaacaaatgttggctctttcatcccacaagggaataacttcccttgattggttgttgttcccttctctttcacaaaaacaaggagcaacttatgccaaattggtgtgaaaacagactaaccgtaaactgcgaaccatcacggttaaatgaaataaaatccaaacttatccgttacaacgatgaaagtaatccaatattggattttaatctattaataccgatgccggaagaactggatatcgtcagcggcggatttggggagcgcacaaaaatcatgctggaaatgccacaggatttaccgttgactgaggattttattgccagacatatcgctgcatatgacactaatgatatgtgttatctgcatctttccctattgtcccaacaagagcaatggcaagttaaagactttgtgcaatggttggacgaacaccctgataaacaggcgaaataccaatatgacttacctcttgggcgggagtatttgaacaatattgctaaatacggagcaagtgactggtatcattggtgtataaaaaattggggaaccaaatggaacgcagagatgcttgacgatagtattttagaaggtcaaaaacattcattagaatgcttctttaatactgcttggtgccctccggaggaatggtttcattcactttgtacagcctttaaagattgtgaactgaagctgtatttttatgaacccggcatgtgttttgccggcttttttgaatcacatgctgacaattatatatcttattatgtgcaaggacagaataaagtcgacgcttttgcacaagaatatatttatatataggttagcataactatttttttaaaccctcgggggtgattccccgaagggaattactctcgatattataatcaggagtaattaatgactagttacgaaaaagaatttacaacactgttcagtaaaattgcaccgcactttcgccgctcagagcttttctatgactttattactatttttggcttggagttttacttagccatttatagtaagcatgccaatgaacagctagtaaaacgttatcaaactgcggtgagtcattacactggcaaagagaagcaacaactaagccagctcttcgtcatttatattaatgcactggagcagaaaacgtatgattttctcggtaccgtatttatggcgctggacttgagtgatggttacaaagggcaatattttacaccgccacatatcgctcaggcgatggcagccatgacgttaatggactgtcacagcattattgagaaacgtggatttatgaaattacaagaaccgacctgcggttcaggtgtaatgattatcggaagctataatcatctacgacaagagcatttcaatcccaacagcaattgtgggtaagagcgcaagacttggatttcacgacagcaatgatgtgttatatacagatgactcttttacatattcccggcgaagttattattggtaatacattaaccgatgaggtgtgctatcacttgtatacgcctgcgcacatactcggtaacgggacgatgaggttgaataatatgactgaaagcgaggtagaggctcaccataatactgatacagttaataacccaccattcgagatcgactgggaaactgaagcagtgttttattaataaaatgcgcttaccttttggtaggcgcattttgtttgataatcaatttgaaacaaattgattctaaatgtatcattataaaataatcattacttaatgatatagaaggagtcagtatgtttgtaaaaaccattaatgtaagaggattagaaccacaagtgctagctaggatgcaggagcttgcacaacaaaatgaacgctcttta

SEQ ID NO: 63305 - DNA, 995 bp, Oryza sativa
taaccgttcatcaagtggtaaatgataaagtgactaattcagattggaaagaagtaagcacatccgtttcattaccaaaagcagcattaacggcggatattaagtcgcttaatgattttggtagcaatttaaatcaaacacattgtagtggttgtcacgctccaattagcgccaatcattacacagcaaatcaatggattggtgtggttaactccatgaaagatcgtacctcaatgtcagcagacgatgttcgtgcggtgaccatttatttacaacgtaatgctaaagatatggcaggcagttcacactaattcagttaacttaaacgataccgagcttgttagcctaagtctattgataaggcagcaaagcctgcaatataagcggtcgagttgatgaaatatttagctattaatcgcttattttgcacaggatagtaaagaaatgcactatcctttcatattcagaaaggtgtcaaattttcattcactttcagaggactatccagatgaaaaaaccagaaaatattaatccgagccgtcgaggttttattaaaaatacttcgtttggtcttgcagggacatctttagccggtggtagcgtaaatgcattgcttacaacagaagccgttgccgcagaaatgcaaactgtcgttactgccgcacattggggcgcattaggtgtcgtagttgaaaacggtaaagtggttaaatccggtccggcaatgccagtttctgttgaaaatgaattacaaacagttgtgccagatcaagtgcatggcgaaacacgtataaaatatccaatggtacgtaaaggctatttagctggcaataaagacacttctttacgtggtcgagatgaatgggttcgtatttcttgggataaagcctttgaattagtcagcgatgaaatgaaacgtgtgcgtgatacttatggcccaagtagtatttttggtggttcttatggttggtatagttcaggttcattgcatgcgg

SEQ ID NO: 63306 - DNA, 1306 bp, Oryza sativa
ataaacaacaataaaaagctcaacttgtttatctaaccgcaagtcatttttagtaagaaactcacatactgcgagcatctttttatggttatgaatactgactctttcaaattgcataaaatattaattaatgttgtaaataagaaaccttaataataattggcattctaccccaaaaaaatcaccacttctaatcataaagaggtatttttgatttttgtcaagaatttaaactattacccaaaatgctctgtgtatttgacaattctgaggggctagacaataacaggcgaataatggacaataaaccatcgctttatgatccattcttacgctattatgctatttttgactaaatttattaccgctattattttgccgccgttcaatacgctagcattactgctcctttcattacttctttataaactaaaacatttaagactgagctatttttgcactattttgaatatcacaacgctctatctgtatagtacaccttacttttcccaaaaactgattcaagcggtctcttttagtgaaaaactaacaattgaagaatatcgacaagcacaagcgattgtcgtattaggtggcggagtacgtaacagccgtgaattatttgctgactatgcaattgccgcaacaccattagagcgtatgcgatatgcagcctacttacataaacaaaccagattacccgtactggttacaggcggaagcccaacaggcaagcaacctgaagctaatattatggcacaagaatttgctaacttctttgatgtacaagtgaaatggattgaatccgcgtcaaatatcactgaagaaaatgcccatttaaccaaagctattttagataaagaaggcataactaaaattattctcgtaacaaatgagtggcatatgaagcgggctaaaatgttgtttgaacgggagggctttaatgtacttgctgcaagtacctcttcttatgaaggattaaatattattggcgtattaccgtttattccacaagctatcgcaatgcaaaacagcagtatcgcactcaaagaatggttaggttattggaaagtaaagttaattaattaatcgctattttttcatcgctaacagataatcaatgattaagccggcaatgtctagtttactggctttttctatcccatctaatcccggacaagcattcacttttagcactaataagcctttatttgagcgaattaaatcaacaccagctacatcaagccctattgtttttgccgcaagcaccgctaattgttgttcagcggtatttaattgaataacg

SEQ ID NO: 63307 - DNA, 1050 bp, Oryza sativa
gtgctctaaacgacgttgtaattctgctatttattgcatatcggcaaaggcaattgaagacaatgaagaaaagagcacggtcaagattgttttttggatacgttttttcatttatttcctctttatcaaagtatagtttttcatttgacagcatttttagtaaaagtttctatcatcactgcatacgactaatgcgcttcatcccaattagcacctacgcccacttcagcaatcagtggcaccttcatcgcaatagctttttccatttccgttttgattaagccagtgtagtactctatacattcttgtttaacttcaaatattaattcatcgtgcacttgcataatcatttttatattctggtcagcacgaatttgcttatcgatacttatcatcgcgattttaatgatatcagcggcggtgccttgcattggtgcgttgatcgctagccgttcagcagctttacggcgtatagcattatttgatttaatctccggcaaatacaatcgacggccaaacaatgtttcgacataaccttttacacttgcagattcacgaatatcgcgcataaattgctgaacatttggataacgttggaaataacgcgccatatattctttcgcttcatcgcgtgagatagctagctgatttgctagcccaaaatctgacataccataaattagtccaaaatttattgctttcgcactgcgccgctgttcactcgttacctcagctaagcttaaaccaaaaatttctgctgctgttgcttgatgaatatcttggccattagcaaaagcggtaatcattccttcatcatttgctaaatgtgccataatccgcaattcaatttgggaataatcagccgccacgattttataaccatcacgtgcgataaatgcttgacgaatacgccgtcccgcttctgtacgaatgggaatattttgtaaattaggatcacttgaagaaagtcgacctgtggtggtaactgcctgatgataagaagtgtgcactcgacatgtaggctgattaatcatcttcggtattttatca

SEQ ID NO: 63308 - DNA, 785 bp, Oryza sativa
  unsure (1)..(785): unsure at all n locations
gatcatggaatcaagcagggtaatgtattgcgtaaatatgttccaacaaattttataaggcgaccaacaacgcgttcttgnccactttaatgtaatttggcttcataacatattctgcgcgttggcgtgtaaagcgaatgacctcaagcgtagcaggcaaagctaaaatcaaagtaggtaatgctaaatggtgtaatacactctgcatcattttcaatttatacggcgaatctgctaagaaaatatctaacagccgaaaacctgtcactaatgaaatttcatagattgggtgcaattctccaaccgcagcaatctgccaatcattactcgctgcataatataacgccataatcgctaaccaaaatacgggaatagctaaactgaacgcgctaacaatagcgagtaatttgcctacaacattataccgaaagctcgcagcaacaaatccgagcggaatcccgataatcacagatacaaataatgcggcaaagcatagggaaattgtagcaggaaatacattcaggatttgattagcaataggatcaccattactatagctaataccaaaatcaccgtgtaatagccccataacataactaaaataagcttgaataccatataaatccataaaatgatttaatggatcacgcaataaaatgttataaacaattaatgttaaaataatcaaggtaatcagcgaaagaaataaccgacgaataaaaggggtaccgagctcgaattgcgcctatttgaaatcggtnactcaagcaaatcaaatggccatg

SEQ ID NO: 63309 - DNA, 714 bp, Oryza sativa
caattcaatttgcagcgcattaatttcgtttgcaagttgataaccgttcgaatcatctacataccaagccccctcacgcccatcttgcggttcgaaccaaccaaaagggaaaagctgaatgagcccgttcgcctcgcggttaagctgaaaactgcaagcaattggattaagtttgaatttttgtttaaacacaaaacacctcaacacaaatcattgaggttagaggatagcgaaaaggcaaatgccaaaaacgaggaggcatttccacattggcagattttttgagggatttttgtaaaatgcagttgaaagtgagaagaagaaatgaaatgcgttttaaaaccgttttaaatcattttaaaagcatttaaaaaaagactttcggtaaatcttatcataaaaaagataaaccgctcaatttgcgattttgagcggtttaagttaatttattgtaatagtcgctgccagtagtctgtgatctcttccagaatatccgatttatcttgctcggtcagggttaaaaatggacgagcctcaatcttcactttgcacccacgcccagccatccctccgaattgatgaatagccgcatattcctcatttgtccccacaaatgcggtatcattatcataggcgctggtaatgctatccattaaattttccgaatcaaccaacggcacccccttacggtgtttaatacctagccattttggg

SEQ ID NO: 63310 - DNA, 1618 bp, Oryza sativa
  unsure (1)..(1618): unsure at all n locations
ttttctttaaatatttttgatggagtgaaatatcaggttgtagaaaaattatctgagattagctagaaattaatagcgaggtttctatcttagctattatttatccgtaaatattctacctatttcgataggtgggatattttacgcctaactttaatatactattcgcattaaattatatatcgttgaaaatttcatcattcaaactactaaaaatattttccttgataatcttcagcctttaccacacctgcatttcatcaaaagttaaaaattttcaaaaaacacttgacaaaagaaagtgcttgacaacccccccctctctttattttacatttttgcccacagagaatagtcccctcattaggatttttactttttaagccataaaaggtttaaaaatttaagagttttaatgaggggatttttattttctatggcacagcatttttcgctatctgcagaggcacgccacttgtctatacaagtggacgagctttctgatgtcgaaattttgtcgttgctgaaaaccgctcgttggggcaatgctgataatataaatgatattgaatgtccgcattgtcacgttagacacgaagcctacttcattaaaactcgccaacaatggcaatgtaagcattgttgctatcgcttttcaattactgcaggcacaatatttcaccttgctaaattatcactgcgaaagatattaaaagccttacgttattttgcacttaaaagcaaaggattatctgccattgagctttctcacgaagtatcaacgttttaaacgattcacattatttaatcgcagcataacaattgaggtaacacaatgaaactacgtaatatggaaaattcaccgattaataccgatttagccgtaatggattatgaagaatttaagtgctttatgaaagaattagccacaatgtattccgatatatcagataatggctacccattactttatgatactttacgaaaaatcagtaaggcgatagccacacgtccttttgaataccatattatttatggagcgtatgaaatcgccaataaacaagtggtagtcgctatttttgaaatgcaatttaatgaaacaaatctcggtcgtacttccgtcagttttgccgaagataaactgcatttaaattgtccgtccaaagtccgaaaacaacttacccaacaggactatatcacttccgcagagagcgcctatccttgcattatggaagaaatgctatttgataaaattcgagaaagacgagaaaaggaaagaagaagtgtaacccctttaaccaaagaggaattagaagcacttagttaatattggcacttaattcattttagtgcttgaaataaaaataaagtaaaatacctttacctgtataaatgggtaaaggtattttttatgcggttaaagttaaatttgggttttgtgcaactgctacataataccgccgcaattttttgcaaaaatgaccgctttctctgctattcgaaattattgtgccattttttcggtgatcgttaaaaaaccctcagcgctattaaaaatannnnnnnnnnnnnnnnnnnnnnnnnnnnnnnnnnnnnnnnnnnnnnnnnnnnnnnnnnn

SEQ ID NO: 63311 - DNA, 758 bp, Oryza sativa
  unsure (1)..(758): unsure at all n locations
cgtggcnatgaatgctnatacnatcgatcgaaaangccgaattcggctttgtacccctcttgcggttgtggttgttctggcgcttgcgtaacaacccgttctgcttcttttttatcttgtacttttgctacagaaagcggtttagtcacttcggtctgtattggcgtattttcaattgctggttcttcagttgtaattggttctacacgtacttttttgcgtaaatcacggcgttgtcgacactctgtgctttgttgatcgcgtgctacacggcgttcaaggtgcgcttcttgtacgcctgctacttcttctacaatttgacgacccgcgtttttcagttccgttcgctcttgacgtgtaagttttgcgtcctcttgcgtttggttttgtgtctcttgtttacgttctttgcgaaccttaccatttgagctaacactgcgattaccgctctctccttggtgcctgttttacggcttggctgggctttccacttttccttaatcttacccgcataacccttttttttccccagtaaacggtttattaataaacggttatggctgaagtttggcatagttcccagttgaaatttaactctgacgttctaaaactattggcgataataccaggttctttcgggcggtacaattcctggcctatagattcggtttcatcaacgggcttcttcactcccattgataaaattacctaacctaactaaggaaggtgatatattttcggtaacctatacccttacg

SEQ ID NO: 63312 - DNA, 965 bp, Oryza sativa
  unsure (1)..(965): unsure at all n locations
cgtgcaaatgtggttaatggggataatggcccctgtgagattgattaggcacataaatgttgaatgaaaggggcttctgtacagtaattgacggcatcgcatttttcgcctagcagtttttcaacgatttgcaccacttgagatgatggtgggcattcgtagccgggaatcgcgtcgtgtagatggcggatttcaattaaatcgccatattgttctaacagtggttgtaggttttgattgaccattgcatagagatctgcaatcactaaattaggcagcggtcgtagatcaaattgtaattcgcaacaagcacagatgcgattaatggcatctccaccgtggatgttgccaaagttcatggttggataagggacttggaataaatcattatgatatcgatcgcgtaattgattacgcatatttattaaataacccgttgcttggtgcattaagtcaattgcattaatgcctttagcgggatcgctagaatgtccacttttgccggtaattctgaccgcttgtccaaggtgtnnnnnnnnnnnnnnnnnnnnnnnnnnnnnnnnnnnnnnnnnnnnnnnnnnnnnnnnnnnnnnaatatgtgtatgcttggcaaaagttcttgcacctaacatggttgtctcttcatcggcagtggctaaaattcgcagaggtttgtttaattttttgagatcgaggctagccaatacctctacannnnnnnnnnnnnnnnnnnnnnnnnnnnnnnnnnnnnnnnnnnnnnatttacccgctttttctgtcaaaacaaaaggatcagattgccactttccttggtcaaaagggaccgtatccgtgtgcccggctagtaataaaccgccttgcccttcaccaagtgtggcaagtaaattatatttattacggctacctgctacttcaataatatcaatattaaagccaaaatcagctaaccaactagccagcgtatc

SEQ ID NO: 63313 - DNA, 1690 bp, Oryza sativa
  unsure (1)..(1690): unsure at all n locations
tcccctgcttcatttatttgataataaataaaacgatgaaaaatcaacatactaggatacttgcttaattgttgatataacttaaaatgcgctgcaatcaaaccatctttttgttcaattaactccgctaatgctatgtccacactgctattatgtttaacttgaattgatctaattagaaataattcgtaatttataaaatcatgtaatgccgcatgacacgttttaatgttatgcaacacttcactaatataatcaggatcttaactaaaatatgctcaaaatgtgttaatgcttgcgaaaattgtccttgcgccaaataataatcacccaataacatagaggctcgcgtacacaatggtgaatattctaatgctttacctaaaagcctcaaatataaatcctcatcttccgattttatagcttgtgcatactcacaataataatgcgataaaggaatacgatcagttttaggatcaatttttaaaagcttttccgcaacattaatcgctttcttccactcatttgttttctgataaagaaccattaattgtgtaagtgaatttaccgcaaattctggctcatctaacaacaaaatataatagttttctgcgcgatcataaaaacctgccgccataaaatccttggcaagttgctgtttagctaatagtttttgttcaatagaataatttagacttgaatctagcgcttgatgaatacgtaatgcgcgatcaacttcaccgcgagaacgaaaaagattacctaaagtaagttccgcttcaaattgtgattccgtggcaatctgattttcagattcctgtttttgaagcattgatagaaaaagatcaaccgctttttcttgctgattagacaaaagaaaatttaaacccgtaacataatcacgagaaaatttattattgatagattcttgctcctttttaacactaagacgtccaatataccagccataaagcgctgcaataggtaataaaaggaacaataattcgaacattagttagtcttccgcgtattcgttaattctgtaatttgttgagcttgacgctttacacgacgattcaatgcgatagtttttactttcaatttcaaataaaaaataccggtaagtaaccaacctaaaattaaaccaaaaccgaatagaatagcaacaaggctagataagcgtaattcactttgtgctacaacataattaaatgtaatcagttgatcattatttgctccaatagtaaccgcaacaataacaactgccagggtaattaaaacgcctaaaatatatttcattgtttatcctcttagtatactaatagaaaagacaaaattgcccttagaaaaccctatactaaatcaacgcgttcttttaaatccttacccgctttaaaatgtggcacatattttgcatctaacttaacacttgcccccgttttaggattgcgaccaatacgtggctgacgataatgtaaagaaaaactgccaaaacctcttatttccactctcttagcctgctccaaagtgagcataatattttccaaaatatctttaacgccgtcttcaactgccttttctggtaaactcggatttaacgctattaatttttcaataagctctgatttagtcataaaattnnnnnnnnnnnnnnnnnnnnnnnnnnnnnnnnnnnnnnnnnnnnnnnnnn

SEQ ID NO: 63314 - DNA, 729 bp, Oryza sativa
ctatcaattgccgactgaattgagcattccaaccacatctagcccgttaaaaaatttagtggtagatattgattataatgaagtgttgatcgtagtaaaaactagcccgggtgctgcgcaactaatggcgaggttattagattcgatgggcaagagtgaaggaattctaagcaccattgccggcgatgatgcaatttttatcacgccaacacactccacgccgatggaaacattaatcaaaaatatcactacccttttcgagtcttcattttaatgaatattgtactcaccggtggcacaggcttcataggaaaagcattaacaaaagcacttctccaaacgaggcatcaattgacaattctcactcaccaaacgcaattaacctcaaattcaccaacagagactttttgtcaaaaaatgacagattggcatcacttaaatcacgttgatgccgtcattaatctaacaagtgaacctaattttgataagggttggacgaacaaacaaaaacaacaattattaaccaggcgcgtcgatttgactcatcaaatagttatttgatcaatgcggaggaaaatccaccgcatacttttatttcaggatcagcctgtggctattacggcaatttagcgaattccaaccatttctatgatgaatcaacccctgcaggcacgcactttagtgcaaagatttgtcttgaatgggaaaaagctgcattaaatgcgcaaa

SEQ ID NO: 63315 - DNA, 1069 bp, Oryza sativa
ttcaacgcattggttctggttaagccaatcacagcagtggcaattattgatcggattcgctgggttacttgttatgctttatggcattttttacgctaaatcaaaatggttttggtggcaaagtgcggggttaatcttagtgagtgtattgtttcatttattcatttttagtagtaaaaaaattgaatggattactttcgatgttgggcaaggcctatcacaagcttttgtttattaacaaaatggacagaacaaggctattttttatgataccggggtaagctggggcgcaagtggtaattcaatggcaagtcttgagatcttgccttatttaaggcgacataatattgaggtagaagcaatttttttaagccacgatgatcgagatcatgcgggcggaatttctgatttgctagcagtgtatccaaatgtgcgcttgatttcaagcagtgctatgccttatgcaaataaaatgccagaagcttgtattgtgggaaagcagtggcaatttaatcaattgatttttcgaacaatttatccgcctaaattgacaccaagatctaaaaatgctgattcttgcattataattgtggaaatagaccgctttcgtatattgttgacaggcgatgcaactgcccaacaagaaagcatcatagccccatcattaccacggattgattttttacaagtgccacatcatggtagtaagacgagtagtagccaagcactattggctaaaattaaaccgtatttggcaattgcttcggtggggcgttggaatccttggcgaatgcctcatcctagagttgtagaacgttttgaacaatacaacattcctttagtcactaccgcaacagatggcatgataaaggttatttttgagcataatacctgggaggtaatcactaacagaaataagttttctgcgtggtatcgacagttatatgcaacatcggctaaacagtaaggatcaggcgtaattaatatttattacgccctatcattttgttggaggcaattacggcaaatcatttaatgcattaggatttttattgataagcattgcgtc

SEQ ID NO: 63316 - DNA, 1546 bp, Oryza sativa
tcatcgccagagattaattacgaccccgtagcgattgctatggggttttttgttgtttaggcgaataaaaaagaacaaagaataaataacaaacaataaacaacagatagcaagtaccaaacaacaaataaggtaattgggtactagatagctaaaaaagtcgcgggatagacataattctagttgtttttataggcgtgcaaaatgtaaatccattttagcgtacttatctttttttcttctcaaattgcctatttctcgctatgctgatatgattttagtattaattggtctatacggtttaagaattctttgcaattactattacctattcatcaaatcgatgatgaaacgcttgatagtttttattctgaaaatagcttgctgctattagattcattacgtcaaaatttcattgatgtgcaacaaccctttttttatatttggggcgctaaaagttgtgggaaaagccatcttttgaaagcggtaagtaatcaatatcttttaagtcaaaaaccggctagctatattcctttaactaaatcacattatttttcacctttggtattagataatattgagcaaatggatgttatttgtttagatgattcacaagcaatagcaaataatgaggaatgggaattagctatttttgctttgttcaataaaattcgtgagcaacacagtttatttaatcaagggcataaggcattattattgatcagtgcgaattgttcgcctcatcagttaaagattagatcacctgatttgaaatctcgcttaacttggggggaggtctatcagttatatgatttaacagatgatcagaagattgttattttgcaacgtaaggctaatcagaaaggtatagagttatctgaagaagtggctatttttttgttaaaacgcttggatcgtgatttgcctgtgttattagcggaactgaataaattagatcgtgcatccttacaagcaaaaagaaagttaacgatgccgtttgtaaaagaaattattggcttgtagcgatttgattcctatcaatatttactataaaaaaggtaaatttgcccgcttgttacctctaaagaagtagttgttttactatttgaaaatcaaggcttatggtaaactttgtcaatcagtttttatatattaatcgttatgcatttaaatcaacttgttatttctcatcttgcctgtgagcgaggtgaaaaccgtttatttgaaggttgccatttttctgtctctagtggggagtgggttcaaattgaggggcataatggtattggtaaaacgagtttattacgtattttagctggattggcgttgccggtagccggtgaggtgctttggaataatttatcaattcataagcaacgtgatgaatattatgctgaactcttttatttagggcattatgcggggataaaaccggaattatctgcttgggaaaacttgcgtttttaccagaaaatgcaaggtctgtcgttagatgatgaagcattatggtttgctttagataaggtttctttagttgaaagggctg

SEQ ID NO: 63317 - DNA, 752 bp, Oryza sativa
ctagcaatcaccgactagcataaaatagtacaaacaaataatgttagcttaccaataacgtaagcgaggtgattaagcatagaagtgcaaaggagtgacaatgaatcctaccaaatttgtattagcgaccagtaataaaggcaaagtaaaagaaatggcggatgtattgtccgctttcggatttgaagtaattgcacaaagtgaatttggcttagtttcaccgccagaaacaggcttaacttttgttgaaaatgccttattaaaagcacgttatgcctcaaaaatgaccggtttacccgccattgcagatgattctggattggcagttgatgcattagcaggggctccaggcctttattcagcacgttatgccggaattgaggacgatgatacagccaatcgacggaagttattagctgaaatgcaaaacgtaccagatggacaacgtgcggcaaaatttgtcagttgtattgttatgctcaagcatgaacggatccaacgcctaagattgcatttggcgaatgttttggtgaaattctacgtgaagaacgtggccaaaatggttttggctatgacgcattattcttttatccagctaaacagtgcacctttgcggaattagattcaacggagaaaaaacaaatttcacatcgtgcattagctttagtcgctttgcaaaagcaactttaaacggtattaacgctaaaagtaaatagcatgcaaaaatttaggaaggacaaatgattattacg

SEQ ID NO: 63318 - DNA, 852 bp, Oryza sativa
taaggatcataaaaattacgaaaaaacgtataacgagtcatttcatcatcataacggatattgttataaccaataatgcaagtattaggttgactaaattcgtgatgaatacgttgagcaaattctggttctgacaagcctttttcattacagagttgtggtgcaatgcctgttaccatcaccgcttcagctgaaggcaaataatcattagtttgtttacaataaaacattaccggttcaccaataatattaaattctctatccgtacgaatacccgcaaattgcgcaggtcgatcagttgctggatttatgccgaaactttcataatcataaaagaaaaaagtaaaatcgttgttcatcgccttactcaaataacaaatcaaatgattaatattataacatagacaagcaggcaaatttgcaggaaatttatgcttaatggatcaagctaatgtaattgccgtctgctaatagcgctgatagataaataaattgcataaaaaaaacccgacacaaaaaattctgtatcgggcgaggtcttacctaaggaaatgaaaaaaactgcttgagttccgtcaagttagcattaagtatgactgacgtgatctgataaagttcagttaatttgcaaaaaaagcggtatttttttatgatttttattttcatttgcataagctgtacaaaaacaatgcaaacaaggttacgccgattaaatttcaatctcacacaaattctgatgaaaatgccaaaaagtccaaaaaaaatggacaatttcctttatttcctaacatattcttgtaaaatatcgaatattattttaaacataaaactcacaataacgtttgaggtatt

SEQ ID NO: 63319 - DNA, 897 bp, Oryza sativa
  unsure (1)..(897): unsure at all n locations
acatcattttagatatcggtagcccagaagaaatggacgaaaaacctttagttttagcacaggctcaagtgattgaattgcctttctataagttatccacgcaatttgcgcatttagatcaaagcaaaaattaccttttatattgtgagcggggcgtaatgagtaaattacaagcactttatttaaaagaaaagggctatcagaatgtgaaggtgtttaacttaccaaaatagcgagttaataagcgcttaaatttgtgaaaaaaagcgtgaaattgatcgctttcactgaataagaaagggattatgcataaaaaactttatcttgcttcaaatagtccacgtcgttgggcattattacaaaatctaggtttagctttattaccacttgcaagtgaaatagatgaaactgcacatgcaaatgaaatggctcaagattattgttcacgtattgctagggaaaagaatcaagcggctcaagcagttagaattcgccagaatcttgctgaatatccgattctaactgccgatatcatggtttcgattgacggagagattttaggcaagccaagtcatcagcagcaagcagttgagatgctcaaaaaattatctggccgaactcatcaagtctatacggcagtctgtgtaagtgctaatcaacaactatttgagtgtattcatagcagtgaagtcacctttaaaagattatctgaggctgaaatttatgcttatattgcaactggcgagcctatggataaagcgggcgcttatggtattcaagcactaggtggtatatttattcagcatttagcaggcagttttaccggtgtaatgggcttannnnnnnnnnnnnnnnnnnnnnnnnnnnnnnnnnnnnnnnnnnnnnnnnnnnnnnnnn

SEQ ID NO: 63320 - DNA, 863 bp, Oryza sativa
tagtgcagtatcaaccaaaactgattttttgattgccggtgaaaaagcgggcactaagttgactaaagcagaacaacttggcattcgtatcttagacgaacacgcatttgcagatttaattaagcaacttgaatacgagtagataaaaacgcatagaatacaagcggttgatttcgctaacatctgcctaaaagaggaacacatatggctattttagtaacaggcggggcaggctatattggcacccataccgtagtagaattattaaatgcaaataaggagattgttatattagataatctgtctaattccaatcaaattgccgttgaacgcatacacaccatcactggcaaacacgccaaatttaacttaggcaatatcttcgatcgagttatttaacgcaagatttttgccgaaaatcaaattaatgcggtcattcattttgcgggttcgaaagccgttggcgaaagcgtgtttgagccattacgctattaccaaaataatgtaaccggttcgattgttttacttgaagaaatgttaactgcgggtattaataccattgtatttagttcttctgcaaccgtttatggcgatccaaaaacaatccctattgtcgaatcttgccccgtggggcaaaccactaatccttacggcacatcaaaatatatggtggaacgtattttagaagataccgtaaacgcaaatccacaattcagtgcggttgtgttacgctattttaacccgataggcgcacatccaagcggtttgattggtgaagatccaaatggcattccaaacaatttattgccttatattagtcaagttgccattggcaaactaccgcaattatccatatttggcaa

SEQ ID NO: 63321 - DNA, 762 bp, Oryza sativa
  unsure (1)..(762): unsure at all n locations
caggcatatgatgcatcgcacggtcganngagcttgtcccggatacctgcgtggaaactatggcattactagcataattttatctaactttgttttttttaattgactaatactaacacgtaacctgattgtgaaacactcccaaggtgatatatgcaattaatgattaaaaatggcacacttggtcaacaaagacaacttgcgtctccgcattttaatgcgcgtccgcaaatagatgatatttcattactcgttattcattatattagtttaccgcctgatcaatttggtcagccttttattgatcaattttttcaaggtaagttagattcatcgcttcacccttcttttgcacaaattaaagatttacgcgtatcggcacattgtttaatcaatcgtaaaggtgaaattacccaatatgtgaattttaacgatgtcccttggcatgcgggcgtttctagtttcgaggggcgcgaaaaatgtaatgattattcaatcggtattgagttagaaggtaataataatcacgcttttactgaagcacaataccaatcttttgcacaattaactcaagccattatagcttgatacccttaaataacgatcgatcggattgttgggcatagtcacattgcttcccggtgaaaaattgatcctggccatattttaaattggggtattccaatcgttactcaccacttaccatataaaaaaagctgggttctccctaaccaagattgatggataaattttaggcattgg

SEQ ID NO: 63322 - DNA, 790 bp, Oryza sativa
  unsure (1)..(790): unsure at all n locations
cgatggccatttgagtgcagtagcctctcgtcgaanncgagctcggtacccttgttgatgaaatgttagccgtcacagatttagtgatcttagatctcaaacaactcaatgatgaaattcatcaagacttaatcggtgtttcaaacaaacgaacgcttgatttcgcccgctatttacataaaatccataaacaaacatggattcgttatgtggtcgtaccaggttatactgacgacgactctgcccataagctcggacaatttattcagaatatggataacattgaaaaagttgaattattgccttatcaccgcttaggcgcacataaatggaaaacgttaggctataaatacgaattagaagacgtattacccccctctaaagaagatttagaacgtttgaaagcaattattgaaagttacggacatactgtcaaatactaacctagcggtctatttagcccaaaagattgccaaatagacccgcttattntactcaacaacttgatatttttcacaagactccccaaatataacgatactttttaacaaaaaggaattaaatacataatgtcaaacccacttttaccatacacaggtttaccttgcttctcaaaaattaaagctgaacatattccaccttgccgtgaaaccggtatccaacaatgtcgtgacgtgatcgaaacagtcgctcaaattcgacaacccacttgggaaaaatttatataccacaagcagaaagtcgcggataattttcacgggttgggcaccggtgggcactaaaatgcgtg

SEQ ID NO: 63323 - DNA, 799 bp, Oryza sativa
  unsure (1)..(799): unsure at all n locations
gatggcatttgatgacttcacttcgggcgaacncgagctcggtacccgttttagaagatattgttaaaaaaattccagcaccagaaggcgatccagaagcacctttactttctttgtttattgattcttggtttgataattatttaagtgttgtctctttagtccgcgttaaaaatggatcaattaaaaaaggcgacaaaatcaaagtaatgactactggccaatcgtataatgttgaccgtttaggtattttcacaccaaaacaagtagatacgacagaatttaaaacaggtgaagtgggttgggttgtttgtgcaattaaagatattttaagtgcaccggtaggccatactttaacacatcaacaccattctgctacagaagttttacccgtatttaagaaagttgtaccccaagtttatgcaggttattccggatcgtttacatgatattgaacttttctggattgcttagggcaaattagccctaatgacgcttttttattttatgcaccaagaaatttcaccccgttaggcttttggtttccgtggggattcttacgtttattacatatggagatcatttcaagaacggttagaacgtgaatattgatctgatttaaattacccctggcccctacacgtaggtattgaggtattaccaacacaattggcgaaccgattaacgtattatggcccggcaaaattaaccgcccattatgtcattttgatgaaatttcgcgaacccaattgctgaatgttatattcttgctcccacaaggattattatggtattatat

SEQ ID NO: 63324 - DNA, 1129 bp, Oryza sativa
accatcgctggaatacctaacgccacaaccatacggacgccccaatctaatgtttgcttaaatgctattgcacgttgttcttcatttaatgcttttttcttcgtaatacgtgaaagattaggcaatacgaccgtcgaaatggcaatcccaaataatcctaatggaaattcaattagacgatcagagtaataaagccaagtaattgatccggtcactaagaaactggcgatcacttggtttaatagtaagttaatctgagtgacggatacaccaaacaatgcgggaatcatcaaacggcgtacttttgtcacaccttcatctttccaagcccacttgggtttaaccaataacctttcttttatcataaacggaatttgaaataaaaattgcaataaaccgcctagaaaaattccccaagctaatgcaatatctggctgttcaaaataatctgcgccaaataatgccatgctgatcatagccacattgagtaatactggtgaaaatgccattacaccaaacttccctattgtatttaacacggctcctgaaagggcaatgaaagtgataaaccacaaataaggaaaagtaatcttaagtagcaatgacgcttgcgtaaatttttgtgcatctgggccatcattaaaccaatcaataaaccaaccggtcccaaataacgcagcaattattggtgaaatcaacatggcaactaaagtaaccaccgttactaaaagccctaaggttcttgaaactttcgcaataaattctcgagtcttatctaaatcattatcagcattatattctgctaacactggcacaaatgcttttgaaaaagcgccttcagcaaataatcgccgcaggaaattaggaatccgattagcaaatagaaaaacatcagacattgcccccgcacttaataagcttgcaataacaacatcacgtactaaccctaatatacgtgagataagcgtcatagtactgacaattatgctggattttaaaagtttcttactcataatttatgactaacagaaaaatagaggcaaagtgtaacaaatatttgcctgtaacagggaagaagttatagcgcgatttataattaatataataatcaataaccgcgatcatctag

SEQ ID NO: 63325 - DNA, 1082 bp, Oryza sativa
  unsure (1)..(1082): unsure at all n locations
cgagttctgattcagtatcaagtgcagatgttgcttcatctaacactagaaccggtgcattacgtaataatgcacgagcaatggctaaacgttgacgctgaccaccggataaacttgcgccattttcaccaattacagtatctaaaccctgttctaatttttcgataaactccattgcgtgagccgcttgtgctgctgcaataatttgcgctcggctatatttatcttttgctgcataagcaatattatttgcaatggtatcattaaataagtgaacttgttgtgaaacaacagaacattgctcacgcaagttttctaaggtatattcttcaatattaacaccgtcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggaatagtaaatgaaacttggttcaatgcctgctcttctttaccttcataactaaaaataacattatcaaatgtaatacaaccttgtgctcgttcaacctgcttagtgccattattcttttcggtttttaaatctaaaaactcaaataatgtttgacatgctgccatgccacgttgaaattgagagttgacactggttaacgattttaaaggacgtaacatagccatcattgatgaaaagacaaccgtaaaagagccggcagttaaattttcactcataacctcagggaaagtagcaacataaagcactgctgatagcgctaaagaagcaattaattgcactaaaccatcagatataccatcggcagagactatcttcatgcctttccgacgcatatcattactgactcgatcaaaacgtgctttttcaactttttgcccaccaaatgaaagaacaactttatgcccttttaacatttgctccgttgtgactgtcaattctcccatagaattttgaatattacggctcaaaatacgaaaacgctttgaaacaatactaattaaaaatgcgataatgnnnnnnnnnnnnnnnnnnnnnnnnnnnnnnnnnnnnnnnnnnnnnnnnnnnnnn

SEQ ID NO: 63326 - DNA, 787 bp, Oryza sativa
  unsure (1)..(787): unsure at all n locations
catggcattgagtgacttgcgattcactatgggcgaattcgagctcggtaccccaacgggcagagcatacagtgcttttcctagcgcattaatgccattgattaaccaacatggatttgagctttttgtgactattaatgggcaatataatttctatcaaactcagctaatcagtcagtatggattaagccaacaacaaattgaacgctgtatccattttttaaaacaacttaatattgcttatggtttcgttaccaccgatcaaatcgctgtatcagaaaataacctaatggtgcatgaggcactctcgcccatcaaagccgattatattgttgatgctgaacattaccgacaacataacgtcatgcaactattagcattttatccacaagaacgtgatcacgaaatctttaatacaggaatctttcaacaggatttaaaagtgcctcgttggcatcaaaatgcggtcgatattctctgtaaacaacattcaaaagcccaagggattaaagatgtgattaaacattttaatctcaacctagccaatacattagcctttggtgatggttttaatgatttagaaatgttagaaacggtcggggtaggcgttgcgatgggtaatgcagaagaaagctgtaaacaattagccgatttttgaacccaaccaatcaacgaagatggtatcttatatgcattagaacatctaaacaatatntaaataacccactcgtaaacaaagggttcttacgaagatgcattcatcagccttatttatcaagcggtcgat

SEQ ID NO: 63327 - DNA, 831 bp, Oryza sativa
ccattgttctttaaggaaaatacccaaatgttatttggtgatgctaaagaacgggtagatgatattttacgagcattaaattagcattattagtgagtcaagcggtctgattattgaaatatgatgtaaataaagtagataattagatcgcttatgaatgaaaaaagccttaatttaaggctttttatgttgattaacggaaagatttatttatcttcattgatacgacttgaaatcgcactttgttgatttttatattttgcatcttcacgggcgttataaggcttagccgctgctccactcaatacttcaaagcttaatgcaccaatcgccatattaagacgcaaggctaatggtagtttaccagcattaaagaattctaatacaattttgccgtgccaaccttggatcaatgcgatgagcggtaacatgtaccattaatcctaagcgagccaatgaagaacgttcatctagccaaccaacaatattatccggtaatttcactgactctagggtagtggccaaggctaattcgcctggatgaaggaaaaaagcttcaccttctgctaaaataatttcatcactcatgattttttcaagttgtgcgctgacttgttcaccaggcccacttaaatcaatataaggtgtggcgtgctcacgaaaaacacggaatgaatttcctagtcgcacatcaacggtcgcaccagaaattttatcattagttgggcgagggctaatgttaatgagatcttgatctaaataatgctcaatatcggtatcacatagacgcataacctatcctatttttttgataataattgtttgatttgg

SEQ ID NO: 63328 - DNA, 834 bp, Oryza sativa
gaatctcaaagtccataatttcagcatcagaaatcccgataatatgtttggcaagtgcgcgtaatgaattaccgtgggccgttactaaaacgcgtttgccagataataatgccggggcaatttgatcttcccaaaatggcagaacacgttctaaagtgacttttaaattctcgccatttggcacaacttctttgggtaggtgcgcataacggcgatcattatgggctgaatttggatctgatggtgctaatagtggtggtagggtatcataagaacggcgccaaatatgtacttgttcatcgccatatttttctgccgtggcttttttatctaagccttgtaattcaccataatgacgctcatttaaacgccaatgtttcacctgtggaatccataattgattagattcttctaatacaatattacacgttttgattgcacgagtcagtacggaagtgaatgcgatatcaaattcatatcccgcagctaagagtttttggcctgcggcttttgcttcttcaacgcctcgttcggttagattcacatcgcgccaaccagtaaataagtttttcgcattccattcactaaatccgtgacgaataaatactaattccataaacactcctttgtgttaatattgatttgaaaatggtacatttataacaaaaatcaatatactttgaaacagttatattatttctttttataaaagcaacagaaaagctgattttcctcaaagatttaattaaaatagtaagtttaataatagtttatggatgattggtgtaggtgatattcttgtgaaagtgtttttttctttttcttcaattgtgg

SEQ ID NO: 63329 - DNA, 1809 bp, Oryza sativa
ggtaataatcactaacgtattcattaataaattatgttgctgtaacgcgtaccaaatttgattaaattgtgcatcaacatgttcaagtggtgctagactattgtgagtccttggcatagcgagatccaagtaactgaaaaaaggtttagctaaacgttgattgagccaagcagtccatttttcaatcgcttgtgcattgccttttattttaggtaatgaaaaacccgcaaaaatactttgttggtaaataggtgcggcgaaactattatgagaaaataaaccaaattgataatttgcttgtttaaatgcggttaataatggtgaagtttgcttattagcgagcattgagtctaaatattgaccgcttaagctataaaatattcccaataagttagccgcgttagaatcgccactgccataatgattcataaagcggtatgttttttcacttatttgtgttaaatgaggcattttttccgccacaatcatttcatttgctaagccagacatatttactattaaaacattagtatatggtttgcggttaaaagttaaatgttgttttggataattgaggtagaaactatcaagccggccattttctgcaatgtttaactgtaatttcgtacgattgatcaccccgtgtttaaacaaggaaattccgagcggtcattgggtgtgataatggatagttggctttttgtgatgtaattgggcgatataagcgcatatctgcccaagcataaattaaatgtgttgcagtaaagcaagctacaaagaatagcgcgacaaatttaccccatttttgccggctaaaactacgtaatttctgccaacaccaacgagagtaaagcatttgtgctagcaagataatcggcataggcacaaataataattgccattgatgagagagctcactattatcatctggagtaactaataaatcccaaactaatggtgataaatgcaaataaaactgtttaaatacttcagtatcaaccaataaaacagtttgcccaatcgtggcgataataacggataaaccacgaaaggtgcgttcatttttaatgataaaagaaagtggaaataaaagaagtaggtaagcagcaaaaacaataaagctaaaatgcccaaataaactagtaaagaaatacagtttaccggacagtgtatttggccaatcagcgttaaacgcgtaacgagttgagatacataatgctaatactacattaaaaagtgtaaaccaatgtccccaggtgatgcgttgggatatttcttccttatattggcgagaataagtcggtagcaattgacgcaagggctaaacattattagcgcgcttttaaagaatttttaagtgcagtggaaaacgtatcagctaataccatacgttgagtttctgtttgaatattctctaataaaatattgctaactagattgcctaatgccatgattgaaagatcaacgggcgccttatgtttttcaagtattgtaattaaatcgtaagaaagttgttcgaattgcttactttgatattttgatcgtgtcgccataataacgatcagagttatgttaaaaacatgtattatatagtagcatacaacatgtcaataacagagtgataagagagtgataagtcctagtatttttaaatttttgtaaaagccataccagttgaataagttagtgctacaatactcaattaatttttatagatgaattaatcgattttattcttaataaagcattttgaaatcataaaataaaaaaaagaatagatggtaaaaaatagccgggcaatggactaaa

SEQ ID NO: 63330 - DNA, 859 bp, Oryza sativa
  unsure (1)..(859): unsure at all n locations
caacacgtgaataaaacagaatccgccgtgcgaattactcatatgccatcaagtattgcggggcaatgccaaaatgggcgttctcaacatcaaaataaagatcaatgtctgatacagctgagagctaaattataccaaatggaaatgatgaaaaataacgctgaaaaacaagcaatggaagaaaataaatctgatattggttggggtagccaaattcgatcatatgtattagatgactctcgtattaaagatttacgtaccggtgttgaaaaccgtaatacacaagccgtactagatggtgatttagataggtttattgaagccagtctaaaagctggtttataaaacaagcggtaacttttacagttcatttttacacaaaaataaaaatagcccattaatttgggctatttttgtttctgttatgtacgctcaatcacttaaactttttttctcaatactaactgacttaatactactagtgacaatgagaaaataatcataatcgtcgctaaagcattcacctctggcgttacgcctgttttaactaatgagaaaattttcagtggtaatacttcatagcttgggctagtcacaaaagatgaaacaacaacatcatctaatgaaatggtaaagcttaataaccaacccgaaataattgaaggcaacgccaacggtaaaactattttgcgtaaagtcgtcacctcactagcgcccaaatctttggcagcttctaacattttaccatcaaaatcactcanccgtgatgaaatagtaataaaaacatatggcaaacagaacgtaatatgnnnnnnnnnnnnnnnnnnnnnnnnnnnnnnnnnnnnnnnnnnnnnnnnnn

SEQ ID NO: 63331 - DNA, 766 bp, Oryza sativa
acatcattacgacaaataacattccgccaacaaattgcttaccacggaatttataacgatataaagcaattgaagtcaatgaacctaaaatcgtagacaatgtagccgcaaaaaaagcaattgtaatcgaatttgtagtggcattaatcaacgtatcgttagcaaataaacgttcataccaattccaactaaagcctttccattttagaccgtaacgatcagcattaaatgaattaatcactaaaatgatgataggtatatacaagtaaacaaagactaaacaaacaaaaaggtttctaaatatctttttcattattcaagctccacctttttatttaaaaatttgttagcacgataatatacatacaacatcaatgccatgagcaaggttaatgcaatactgactgccgatcctaatggtaactggttagtattcaagaatagactcttgataatattaccaattaatggcgttttaccaccgcctaatagatctgcaacatagaacattcccatcgcaggcaataatactaataagcaaccggccacaatacccggcatcgttaatggaatagtgatacgaataaagcgttgcaatgcatttgcacctaaatcttttgccgcttctaataaacgattatcaattttctcaattgaagaatacagcggtaaaatcataaagggcaatagaatataaaccaaaccaataataatggccaattctgaattgagtaaccgtaaaggttgatcaatcaaacctactgcg

SEQ ID NO: 63332 - DNA, 785 bp, Oryza sativa
tgtgggcatttgagtgacatatctgatcactataggcgaattcgagctcggtacccttttggatttaccattaacttgctgaccttacttggactaattttagcgattggattgttagtagatgatgcgattgtagtattagaaaatgttgaacggcatatcaaacaaaacggagaaacaccattcagagcagccattattggtacgcgcgaaattgcaacaccagttattgcaatgaccatcaccttgatggcagtttattcgcctatggcgttaatgagcggtattaccggatctttatttaaagaattttccttaacacttgctggagcggtgtttatttcaggcgtagctgccctaacactttctcctatgatgacaagtaaaattctcaaacaatcagaaaaaccaagctggttagaacaacgtatagaaaaaaccttacataaagtaacggatatctataccaaaatattattggttgttatggcaagccggtatgccatattagtgtttgctggattaaattttgcatctttgccgatgttatttaattcactttctagtgaagtaccccctggcgagacccggggattggatgggaatgggaaagtggcctgcccacgttatatggactattttgcagacgtgatgtttcctgttgttaaccaaattatcaactgccagaagtaatgccacacacattatgcccgggttttccttttattattggtcaattatgtaacggcgcttaaagattgaagtgacctccttgtcacaaaaag

SEQ ID NO: 63333 - DNA, 767 bp, Oryza sativa
atggcctttgttgagtgagcacccatgcaaataggccgaattcgagctcggtacccgggcttgaattatcgcatttaatgcaagcattagatcaattttcaacacgtaagattgtttatgccgatctctattttcaattgagtgtggacgaaagttggtcattagaagattcaattattaaagagggtggcttttatatcgatcgtggttttggtgtccgtgcggtttcaggcgagaaaacgggttttgcttatgccgatcaaattagttttaatcaattattacagtgtgcgcaggcagcacgttcaattgataatacgcatagccacttagccatacagtcgtttaaacaaacggttgctcctcagcgttatgctgcgatcaatccgttggatagtattagtcgtgagcagaaagttgaattattacatttagtcgatcgtaccgcacgagctgaagatagccgagtgatgcaagtgaatgcgggtatttcggcggtttatgaagaaatattgggggctgctactgatggaacctttacccgcagattttcgaccgcttgtgccgttggcggtttccgattagtagaagaagatggcaaacctgagcgtggttaaccggtgccggcgggtcgtatggcttaccgtgtttttgagcctcaatactaatggcaaatggagggctttcccggccgaatttttactaagaagcggttctcaggctttttaattaggggattactgttcggcgggccaaggcaattggtt

SEQ ID NO: 63334 - DNA, 741 bp, Oryza sativa
ggcctattcgagctcggtaccctgttgtgcatggttatggtttagccgcgtcacaactacaacgattgcgcgatcaccatattccattaacagtagctgtcgataaagtcgcggcaagcggtggttatatgatggcatgtgttgcaaataaaattgtcgccgcgccttttgctattctaggttctgttggtgtagttgctcaagtgcccaatatccatcgcttcctcaaaaaacacgagattgatgtagatgtgatgaccgcaggcgaatataaacggacagtaaccttagccggtgaaaatactgaaaaaggtaaacaaaaattccaacaagagttagaagaaacacatcaattatttaaacaatttgtggcaaataaccgtcctcagcttgaaattgaaaaagtagccacaggcgaacattggtttggccaacaagcattaacgttaaatctgatcgatgaaattgcaaccagtgatgatttaatattaaatgccgtcaaagacaaagaagtcattaaactagcctttaaacaaaaaaaaaagttagcacaacgtttaggctcacaaatggaacaatcactcgaaaacctcattgctaagctattacataaaaaccgatcaaatatgctttaatatgcaaaaaacagaagcggtaattacaccgcctttttagggttaataccacccgtattttgcgcctatgttaccccaaatcaacttaattagctggctcttcttt

SEQ ID NO: 63335 - DNA, 1058 bp, Oryza sativa
caccttaaacggttttatgcacattccgttgaaataaaaattaaagcagataatacgcctgtaacggaagcggatctttttctcagtcaatttattatccagcaacttcaacaattaacgcccacgattcctgtgttatcggaagaaaattgtgccattccattaacagaacgggcaaattggcaagaatattggattattgacccacttgatggtacccaacaatttatcaatcgaaccgatcaattttccattgcgattagcttagtacaacacaatcagcctgtaatcggcattatttatgcgcccatattagccaaaacttattttgcaatgcgaacaagcggtgcttttttgcaagaaaatggcataattcgcccgcttactcctcacaaaattatggccaataatgagcgcttacgcatcgcaatgggagcaaccaataggacgacagtagcccaatgcctacaacaacctctacaagcagatatctttcaatatggctcgagtagcttaaaagccggtttagtcgcagaaggcaaagccgactgttacattagattaggcgatactggcgaatgggatactgccgccgctgaagtgctattaaatgaaatcggtggcaagatttttgatcttaattttcaaccgcttagctataatcagcgacaacattttattaacccgcattttgtaatggtggcagacaaacaggctgactggcaaaaaatctttcaattcaatgagtgacatctacatgcaaccgctattaaaatgttgcatattaggtaaaattttcattccaatcgagaatcaaaatgaatatagaaaatagttgtatcgtaatttttggtgcatcaggggacttaacattccgtaaacttatcccagcactatataatctttttaaagtaggtcggttaggcgaacatttttctgttttaggtgtttcacgatcagacctaactcacgattcttttagacaaaaaatgcgtgaagcattaatcaaatatgagcaagcaagcgggcagtttttagatgatttttgcaatcacttg

SEQ ID NO: 63336 - DNA, 751 bp, Oryza sativa
tgctgaaaaacagccggtcgtgttaatttataaccaactaaaataagtaccgcagctaaggttgctaatggaatttgattaagcatagttggaatggtcagtacacaaactaacaataacagcccgtgcaatatacttgatattttatgggtttcgcccgcatttgcatttgcagaagagcgaacaatcacagcagtaatcggtaagccccccattaatgctgaaactagattacctataccttgcgcttttaattcttggttggtatctgtaatgcgacgcttgctatctatgcgatcggcggcttcaatcgacagtaatgtttcaattgaagcgactattgccatcgttatgcctgtgctccaaactatcgaataatgaaaacccgcccaatcaggaaaatagagcaagtcgcctatttccgcccaactgtgtgcgataggcagttgcaccagttgactttcgggtatggctaaaggtgtaccggcaaacaacttattcaaaccaatactcatgattacggcgatcaaggcggacggcaacatttttatgctttttaatgttgcagagcgctcccaaccaagcatcatgagtaacgacaataaagaaataattaatgaacctaaatggatattgataaaacttaacgataattcattaaataaatgtttattaccaaaagcataaggcaattgagaagtaataattaaaataccaataccggctaacattccttcaatcacagcaatcg

SEQ ID NO: 63337 - DNA, 797 bp, Oryza sativa
tttttagaaaaattcggtatgccgaccgcacttggacggtatcaaccaaatgcgtctattgaagaacaaaataaattattggaatccttgtacgcaatccaatctgatagcggcattattgtgccagcagatatgcccattgaattactcagtgctggacgtagcggaacgggtgattataaagccttatatgacaccatgaatgagactatccagcgtgtcgtattaggacaaacatcatcatctggaggtactccaggtagattaggcaatgatgatttacaggaaaaagtgctggaatccattattaaagccgactctgacgttatctgcaaatcctttaaccgtggtccggtaacctggcttacgcaaatgaatttttctaacgctaagccaccgcgtatattcaaaatgtttgaagaatcagaggatttaaacgaaaaagctgaacgagacaaaaaaatatttgagacaacaggttatcgtccgaccttaaaacaaattcaaatttcatacggtggtgaatgggaaaaggcggaacgtttaacctattctacaaagaacagcaaaagtgctgtcaaaaataaggttgattttgcacatattgtaagtgatgaacaagatatacccgcacaaatggtaaaccagctaaataatacccttgcaccagtaattgatgactgggtaagccaagaacaggcattagcaaataatgttgaatctcttgaacagttacgtgatgaattatttacccttaatgcctgaaatggatttagcccgttatatcgaagcaatgg

SEQ ID NO: 63338 - DNA, 871 bp, Oryza sativa
atttaagttccgttaaatttttaggattctcaatttgcactagcgcaacatccgataacgcatctgaaccgattaatttcgctttaaactctcgcccatcttctaatttaatggtgatcttttctgcatctttaataacgtgattattagtaatcacatagcctttttcagcattaataattgcgcctgatccttgacctcggaaattacgtggcacattacgttgttcaccaaaaccaaagccaaagcgttcagcaaaacgctcaccaaaaatatctgggccaaagaaaaattgaagttcttccggaagttcacgtttatattgtgcattttcaactttagttgtaccttcaatagcaatactgactactgccgggcgaacccttttaatcatagatgctaaacttggtaatgcttgaccgcctaatattgttggtaataccgcttggctcatagcaggtactgaaagtacacttaaacctaagactaatgaagataaaattgattttttcatgactttattcattcgtatcatccttgtatatgctctaatttataaaataagtgtcaaattaactgtgttatttacgacagtgtaattaaacaacggttcactaaaaacaaaataactgttgataaaataaacgaactatagcgttctgtcttttacaggtaagcggtgaatttttcaccataatttaaaaatcctttgactttaataacgacttgatagagtattgtcaactatattttatactctaacgaagaaaattccaatgcgtgataagagagacttggttgaaataaaaaaccttacctttaaacgtggcaagcgggtaatttatgaaaaccttaatttgcgtgtgcaaaa

SEQ ID NO: 63339 - DNA, 2235 bp, Oryza sativa
  unsure (1)..(2235): unsure at all n locations
actaatgaaagcaacagaacagctatcaagcctagaaatgatggcggtggatccattaagacgagtcatagcgcctcgcttttgggcaggggttatttcaatgccaattttagcagtcatttttaccgctattggtatttggggcggttcattagttggtgtggactggaaaggcgttgatagcggcagtttttggtcagtcatgcaacattctgtaaatggacaagacttgatcaatggttttattaaaagcatcatttttgctattgctgttgtttggatcgcattatttaatggctatgattcaactgctacctcagaaggtattagccaagccactacacgtacggtggtacatgcatcattaatcgtgttaggcttagattttattttaactgccatgatgtttggcggttaactcaagaaaggaaataaaaaatgcgtcaatcaatcaagtatgaattttgggtcggtttatttggtcttatttggcttagcttccttagtgtttttaggcttacgtgttgctaatgtacaaggctttaccactgaaaaaacatatacgctatatgcaacttttaataacattggcggactaaagaaccattcaccgattaaagttggtggagttgtaattggtcgagtttcaaacatcgatttagatcctcaaacctatactcctagagtcactttagcaataaaccaaacttttaataaaattcctgatacgagttcgctttcaattaaaacttcaggcttattaggtgagcaatatattgtattaaatgttggctttatgctagaaggcgaaacggaatatatgatagaaggaaatagctttgccgataccaattcagcgattgtcttagaagatttaattgggcaattcttatatggcgataaaaaatcagcaaccactgaataataagaagtagagtaaattaaaacacgacactatttaaacacaacgagatattcgttgatgattaaaagtgacagattcattttatcatttggagatttacatgttaaaacagcttaaaaaagttattattaccacggcgattgcattagctacactatgctcaacacaagcatttgctgaaactaacccatatctattaatgcaaaaaactgcggataaattattcactaatattaaaaacaatcaaactaaaatcaaagcgaatcctgaatatttacgtgatatcgtacgtgaagacttaatgtcatacgtacacatcagatatgctggccaattagtgttaggtaaatcactttcttctgtatcagagccacaacgcgaaaagttttttaatgcttttggtaaatttatcgaacaagcgtatgcgcaaatcttaacacagtatgaagatcaacaaatacaaattgaaaatgaaaaaccacttggcgataaatctattgtcagtatccgcgtaaatgttttatcttctggtagcacgccacccattaaattagattttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatatcttacgccaacaaggtattgatgcattaactaatcaagtagaaaaagcggctaaacaacctatcactttaaataaataatttatttatgatgccagaaaaaacattacaattcggtattcaagagcaaaatggaagcctttttgtaacattattaggtgaattaactcgagacacgttgctaccattatggaagcaacgtgcttcttttttatctaacccacataatgaaacaatttattgggatttaaaccatctgctacgaatcgattccgctggttttgcattactcatagaattgctaaaccactaccaaaaacaaagcacaaattatttaatcaatgtaccagatgttatcttaacattggcaggtttatttggcttacaagattggttagactcatttttaacaaaaagtaaaacagactaaggattaaaatggaacctacacaattagcagaaattttacgtaatgccctaccaaatgcggttgaaattcacgcacaaggtgaaaactcacattatggcgttattgttgtaagtgatgaacttgctcaattatcaaaagtaaaacagcaaccagcggtttatgctccactgagcgaatattttgctacaaatgcagtccacgcattaacgatcaaagtcttct

SEQ ID NO: 63340 - DNA, 1102 bp, Oryza sativa
taagcgggcaaatggatggcgttgatagtagtgtgttaatgatgaatggtattcagtatcttgcttggtcagcagttgagatgtggctgaaaattgaatacctttaattgcttgaatatctgttatttgtgctgagatggtgccaactattttggggttatgtacataatttgtgaatggcgtgtgtttttactggtcagtaaaatcaaacgcgccatgttgtgatcaaatgcataaaaacaactggctgtccagaaatcatcaatagtgtatgctgcaaaattgacgacgtggttatcttgaataaaacgactgatgaatgatggtattttttgcatatttgtgtagcgttatttctctccccaaccaggcattgcgatatcaatattaaatacatctaatgcgcgacttacgctatcagtcacaatatcatcaatggatgtggggttttctcaattacatcaataggagttttaaaatgaaagtgcctgtttattccaaccactatttgcgagccaatcacggacaaattgtttatcgaatgatggtggatttatcccttcttgataagtttcgaccgaccaaaaacggcttgaatctggcgttagcacttcatccatcaacgttaatacaccattctcatctaatccaaattcaaatttagtatcacaaataataattccttttgttaaggcatatttcacgttcacactcttcgtatgaaatattcacatcgtgatcacccacttcagctttactagacggcgtaaaaataggttgtggtaatttactcgcctcaactaacccggcaggtaatgctaaaccacaaatactaccggtttgttgataatcttttaagcctgaaccggtcaaataaccccgcacaatggattcaattttcacaggtgttaaacgtttacaaaccactgcgcgatgttgaatagcctcagcttcttctttagctaacacatcgaaaacagaatcacccgtaaaatgatttggcataatatgctcaagttttttaaaccaaaaattggagatttgcgtcaagatttcacctttagcaggaattggatccgctaaaataacatcaaaggctgac

SEQ ID NO: 63341 - DNA, 752 bp, Oryza sativa
caacaggtcgtgtaaccactgttgaagctaaagtgttattttttgtactgttaatcattgcttttttattggatttatcactcaatcaatacgcatttttgctttcatttgttgccgtggcattagcggttatttatccgtttatgaaacgttttacgcacttgcctcaagtcgtacttggtatggcttttggctggacgattcctatggcatatggtgcagtgattgaagatttgccgttaacatgttggttattatttttagctaatattttatggacagttgcttacgatacgcagtatgcaatggttgatcgtgatgatgatttacgtattggagttaaatcaaccgctattttattcgcacaatacaacaataaaattattgcgctattacaatttttgtcactcattttatttattctgtttgggtggttaagtgaatatcacattggttattttattgtattagccttaacttcaaccttatttatttatcaatgttggttaacaaaacaacgggttagagagcaatgttttaaagcattcttaaataataattactttggtttcggcattttcatcgcgattctagtgggcatttatggtttttaagttgttatagatgaatactataaattgatcattaaacggttaatcaattaaaagcaattgtggcaatagcctcaatgtaacggctttatttgtaaaggaagcgctaagcggtagaatttttgcgaataaaagcatttt

SEQ ID NO: 63342 - DNA, 707 bp, Oryza sativa
aataaatggtttataatataaacgcacgccccaagagttatcttccaatttttcacctaacgccgcatataaatctcgactaaagccccaatcaatcgcagcttcagtcattcccattttactgacattatagaaacgtttttccgcattcaaagttgcttcaaatttaccattatgatggacttcaatttcagcagtaccgccttgatagttagcaccgtcagtaatttttatccctttaaaggtaaaatcataatctttaatttgaacagtatcgccaaccttcatccgtacatttttttcaatactgaaattttgactaaacgtaatgccaaagactaacattgccacacctaaatgcgccaaaaccattccccaatgcgaacgagaaagcttaaatataccaacaagaaagctgtgtcgatgtgtagcacgttgatacaactcatacaggctcaacaacacgataataaccgccatcatgacaccaaggatcaaggtatcgttattcgatctataaaccaataaggcagtcaaacaccaagaatcaacatcagtacaaatgaaataatcaccggtagcctaatagctgaaacctgatctctacgccatttgactaaaggcccaatacctaaaaaaaatgcaaatggcaccattaaaatcaaaaacatctgatcaaaaaaacggcgcaccaattgaaatcgtgc

SEQ ID NO: 63343 - DNA, 852 bp, Oryza sativa
agcatatttgtagatcaagcggtcgatttaagcaattttttgcaaattcgaccgctttttattatgcgtttaaaaattatttttaagttatgcttgttttggttagaatggcaaatacgttacggaatagatgataagaggcgtacagatgaaacacgtttatatttttagtgccgggcctgcgatgatgcctaaagctgttttagcacaagcacaacaagaattattaaattggcaacagcaaggtacttccgtaatggaagtcagtcatcgaagtaatgcttttatggcgcttgccactcaaactgaacaagatcttcgacaattatatgctatacccgataattataaagttttgtttttacaaggtggtgctcacggacaatttgctgcaattccgatgaatttaattggcaagaaaggcaaagcgctttatttaattagtgggcattggtcaaaccgttctgcgcaagaagctcgtaatttttgtgaggtcgatcagcttaatatattaactcaagatgaagcgggtgttttttcggttaatcagacagattttagcgatattgctgagcaatatgattatgttcattattgtccaaatgaaacaatcagtggcgttgaaattccggatattccgattgtcggtaaagcggtattagtggctgatatgtcttctaatattctttcacgtaatattgatattagcaaatttggcttaatttatgcgggagctcaaaaaaatttaggtcctgcgggcatcactattgtgattattcggcaagatttaatcggtaatgcacagcgtgcaaccccgtctatttggaattatgccacgcaagtgaatgccga

SEQ ID NO: 63344 - DNA, 773 bp, Oryza sativa
gcgtcaaacattagtaccgccaattatcacgactcccctttatttcttgatttttggtcaattaattggcagtcgttttggcgaaatgaatggggtcagttatatacaattttttgcacctggcttagtgatgatgacagccattacagcgtcttatgtaaatacggcctcatccttttttctaagcaaatttacccataattttgaagaactattagtttcttctctttcaacccataacattatttggggttatgttgtcggcagtatcgtgcgtggtgggctttcaggtattttagtcacgctgatttcattgctattcgtttcttaccaaattcattcttggagcattattctgttaactttattaatgaccacaattgccttttcgttaggtggcttaattaatgcggtatatgctaaatcttttgatgatattggtagcattcctacatttgttttaacgccattaacgtatttaggcggtgtattttattcaattacattattaccagaattttggcaaacactctcaaaatttaatcctattgtttatatgattaatgcctttcgctatggttttttaggtattagtgatgtatccatcgcttatagtttctcggtattaatcatttttattctaatactatactattttgctttttcattaattgaaaagggcgtgggattacgcacctgattttcattgttataaattgtacgagagataatgctagaatcatatccatctctcgtataaaacattaaggaac

SEQ ID NO: 63345 - DNA, 976 bp, Oryza sativa
  unsure (1)..(976): unsure at all n locations
ctttagtttcacgtattaaatcaagtttcattcggatatttgtttttaagcttttgcgctctgcgagaataggcatattttctaccacttggtataagctatacattgcggaatagcgactaaatcctaaacccaatacttcacacaagggttttaaacgtaatactccttctgaaaaatcacattgtgccgataacatagctcgactaatcacgtcaatgctttccacaatgcttgctatccgtgcttgtttagcttgcatcgtttgttgcaataatcgttgcttagcggtttgttgttgacgtaatttaaccaataaatagaaagcgtaccctgccatagtaaatacgatcaggacagctaatatgataagcacaaactgaaacataaacgcttccgactaattatttaaatttattaatgtctatcgtttcaaattgacgtagtaaaagatcctcgttattttcttcatcatcttcaatacctaattcaattattagttcatgtacacgatctaaacattcatcaacaaactgttgatcttgggttgatagtactttacctgcttctaactgatccaataattgatttaaacattcattattttctaattgcgttaattcaacttccggtgaaaccgttgcttttgtggcgtgatttgatggttcaagcggtacgggtttaatcatttgtcctttttctggtttattgacaaattcgaccattaatggcacttttttgcggctgccaacacgtggatcctttttaacttttgctgacgctgtcttttgctctgttattacattacgagagccggttggtaatcctttatgcttacgctttttcttctcttcacgtgcttgtacatctaattcatagcgtgttggtttccgcttcttaccgttgcttattggcaannnnnnnnnnnnnnnnnnnnnnnnnnnnnnnnnnnnnnnnnnnnnnnnnnnnnnnnnnt

SEQ ID NO: 63346 - DNA, 748 bp, Oryza sativa
atagtatagcaattaatttcagataaggccaacctttgcctgtgctatgtttgcattctatttcctgctggcttagaatacattgttctcattggggtgctgaaaataagctgagaaatacccatagaacctgatctgattcgtatcagcgtagggatttgaggccatttctactacaactaggaattttaccgctcaaatccttctagtttatgttttgttagaaggactttttatatgaaatttaccaaacttatagcattttctgcggtgatcttcagtggcagtctatttgctcaaaaaccacttttaacggtttatacctatgattcttttgtttccgattggggggccgcgcccaaattagaggaaaaatttgaaaaagtatgcgattgcgatgtgaaatttataccgtttgaagatggtattactatgttgaaccgcattcgtttagaaggcaaaaaaacaaaagcggatataatgttaggcattgataatttcacaatgcctgaggcggttaaatcaggcttatttgctgcgcataatttgccaatagatcaaattaaatggcaagacaatacattttttccatatgattacagtgaatatgcttttatttataataaagaaaagataactaatccgcctaaatcgcttaaagagctagtcgaacgtcaagatttaaaagtgatttatcaagatccacggacaagtactgtcggcagaggcttgttattttggttaaata

SEQ ID NO: 63347 - DNA, 1073 bp, Oryza sativa
  unsure (1)..(1073): unsure at all n locations
nnnnnnnnnnnnnnnnnnnnnnnnnnnnnnnnnnnnnnnnnnnnnnnnnnnnnttctgaatctgcaaggtatttaccattagctttttcagcattagttaatgcataatcgtaagattttcgtccgctgttattttctgcggtaagggagagtacggcttgctctagtgcatcatttaacctggccttatcttgaattatgcctgctacctctaatgaaacaaacaataaggctacaataggtagcgtcaataacgcaccaaaaataatataaacgccagattgattttggataaaccgtttggtttgagtaataacatattttctcataatcattattcctttttagttttgctaataacagattatttatcgagcgacgcctaatgaagaagcacgtaaccaattattagaataatcttttctatttaatgttaagcctttaaataaattatccatttttttacaaactgttacctgataaagggtcgcataacgattggtaccacgtaaattctccggtaatggagaggcttttttaatatcatcaattttaattgattgacaattttgtgcgttagttggatatattttttcttttgaggtatccagtgttatgtctggcctaggttggtaatttttattttcatcaagctttgatgaattaatatctttgaagccatatttatagatagtaacagcaatctgatcttttttttctcccattaagttagcggctaattttgttatttgtttcagttcttcttcttttatatcttcatctccagcacgctctatatgtctttccttgataacattggttaatgaataaaaagtgcgctgtaatttaccgacggtagcctgtagaatagcaacgtcaatcaagaaaataagaatgacgaaatacataaagaaaaataaatcaaaattctattaagacagcaccttgggtattttttagaaattttttgatctttttcatattcttgggagtaccacgattttacgttcaaataatcgctgaacagcttgttcaggtggtataaaaaacattggtttatatggatatttaaa

SEQ ID NO: 63348 - DNA, 1005 bp, Oryza sativa
  unsure (1)..(1005): unsure at all n locations
nnnnnnnnnnnnnnnnnnnnnnnnnnnnnnnnnnnnnnnnnnnnnnnnnnnnnnnntggctaaggtgatctttcgttaactttttattattttaaacaggaaatcattatgaataatcttgatccattagcattgccattaaatggtaccttannnnnnnnnnnnnnnnnnnnnnnnnnnnnnnngttcacaatggcaaatttatatttacgtttattggtgggccttggttgtcagccgttaacggtagaaaaaaatttagtgggtacttttaccaaagcggcaaccgaagaattgcgtgatcgtattcgtcgtaatattaaagcctgtcgaagaattttttgggattatgaacctaaccaaattgatcaaaataaatataatttctatagtcaactttatgaaagggttgataatttagatgaagcaaaattacggttacgtattgcagaacgagaaattgatttagccagtattttcactattcatagtttctgccaaaaaatattatcgcagtttgcgtttgattctggcattcgatttgataatgattggcagacagatgaaagccatttattacagcagttaagtgaagagatatggcgagagcaattttacccgctgagtttgcaagaatgcgagatcatttataacgaattagaagaaccattaaaagcacttaaaatggttcaatcatttattgggattgaattgccggcgttatctgccgaacaaaaaagaatatttacgccagagctatctactcgttatctaattgaatataagaattttttacagcaaatcaaacagtattggcaaataaatggtaacgaaattgttactattattaatgcggaattaaaaaaaatatataaaacaggggagaaaaaagccttaaatcgtacctcttatcaaccccgttatcttgcaacatatcaatcagagcttgataattgggctaattcaatggatcttactttaccaaaaaatttcgagcgcttttgt

SEQ ID NO: 63349 - DNA, 807 bp, Oryza sativa
  unsure (1)..(807): unsure at all n locations
aattcacggccgaactcccacgtgaggtggtattaaatacgttcgctaatttactgactaatattgacttaccgctactttccccgccgacaatagcaattgttttaacaaagaatggccgaacttccttggggataaagcgccaatatttaaatggattattgcgaatttgcgttgctgagatattaaaagatgtacgctcaggatccatcaaacagacttctagattcaaatattgctcataagatgttttatcttgtttttcactggtaaacactattttgggctgaatatttttctcagcaaataattctttaacgcgctcactccaatcaatccaaccatttggatagctaggaataccgtcttcttttaaatgatgaataacaatttgcttttgttgatatttaaaaatttgttgtaaccaacggaggcgatcttcgttagtcggcatacgtttcattttactatttttaaagagttcaagatcacgttcagtatccgtgcacacgaccacatgtaatatatccactttactaaacgcttcataaatcatattaatatgaccggtatgtaccgggtaaaacttgccaaagataaccccaacccgctggttcatatcttcaacgagatttaatacctgatgtaatgcatttaatttattagcgcttggatttttaatttttccactaaccaattgattaaaataggctctagtcaagcccgcttgtccacaaatatcattaacttnnnnnnnnnnnnnnnnnnnnnnnnnnnnnnnnnnnnnnnnnnnnnnnnnnnnnnnnn

SEQ ID NO: 63350 - DNA, 801 bp, Oryza sativa
aaaaagcaaatattgcttttaccggtaatattgataaaaaagttgagaatggcttagctattcttggccaagcaaaaggtgctgctattcaaattacaggtcttgatggtaagccagtaaaattagatggttcaaaaactaatgtaaacatccaagatggtgataattccttacaattctctgcttatcttaaaggttacccaacagcagcggttggtaaagatgatggacctggtccaactccaacaggtaaagctattgtagctggggagtttacttctttagttaactttactatgagttatgaataaaaattaaatagtgtgctagttatagaggaataggatagatgttaaagcaagcattattacaaagatggtttattttgcttgttatgagttttgattctcctttactacatgctatagggtatggtgcaggtttcgtatcaatgaatggtagagttgttgatgctgcctgtaccatcgctatggattcaccttatcaagatattgaaatattgcttttagaaaagcaaactttagaaaaggaatttgaaattcaattagtcaattgtaatttagctcagtatcacaaacctaaacctaatttgcatatgttgcatatgctctttcgtaattctgaaagtgacttaactaaaaatgataaggatctgatatatataagaagtgtgcagtctcctttttctagtaaattattttttgagcaaaatttcatccctcctagtatgctattaaagtaccgagtacatttaattgcgaactcaaaattatttcaggc

SEQ ID NO: 63351 - DNA, 981 bp, Oryza sativa
acccgccagatattgttcgtacaggtaaggtttaaaatcgcctcgatgtgcacgttggatcatactcatcaaataaccctgcggttttttcacttctcccttgccaatacgctgttccacttcaaatagcaaggctttgcatatccccaagtccagacctttcatcgtttgagccacagcttgttgttccaagacggagagatttaatgtggttggccattcaatttccatacggttacccgtacagtacttatttatacaaatactcgtacttgtactgtactgagtcgctgagttccgtatgggaacgctgtgattttttactgagttccatttgggaactctgtatatttttactaagttcccgctctttttgactgagttccgtatgggaacttagtatgttttgaggaagttgacgcagttgatgttgttgttctaaaggtatctcatcttcttgttgtatgcgttgttgatacgcattaaagcgtgcttgtatccaatcaatatgggaaacataatgccattgggtcgggtcggcatgtaaattatcaataatatgattggcaacattgcgtacggtgatgtcacggtgattcgccgcattttcaagcagcttgaggtaattgttatttaattggatcgtatcaacaataggcatcggttcgtcatgtaataaataaacattccccatcacttgtccttgttcgttgcgtacggtttcacaaagcgtcagccagcgggttaactgtaataataagagtgtttggctcacaagcttacgagagagtttaccctcggcatacgttttatccgaaagtaactgtcccagtatgtcataagacgggaaaagtacggttttaaattctcgggctttatacttgataagctgccaagctaatttggcccgtgatgttaaatacggatcgaacaacaatcgagtcggtaccgtctcgtgctgattgcaaagaaaagcaaacc

SEQ ID NO: 63352 - DNA, 2090 bp, Oryza sativa
  unsure (1)..(2090): unsure at all n locations
ttctctatctcttgcaattcctgtttggaaaaaccgatactaccgcaaaaattgatgtttccttcttggagattggatgaggatttcattaaggacaacttgatttaagctactaaacattgtatgaatggcttcttggcaatataacgaactaaaccaaataaggggaacagcttgactagggtcacatcgtcaatcttctccgcatctaataagaaactaaaggttatcgaaaccgacggatagcttgtctatctaccgtttgtaacagcatgagcaagtcatagcacattttcaccatttcgttttccactgcattttctaaaggcagcatacgataggcataatccacccggtgtgtttaccacatgctcaacataacgttccaatccgacggattccgcaatatctaatgccaaagaataagcttccagtttatgtttgcgggcggggtaaatttgccagatatcatctaccggttgacgaccgacccaagcaaaagtcaacccgtagcctctgcacgctgttggcgttgctgttggatattgacgcccggtgcgataccctactgggtttccacactctgtgaaaagtcatgtaaggcgtctgtgggcatattgtaagattctgtcgactcgtcctcagtcggggtgctcgccggtgccacgggcgggtagcatattaatcaatgtcgaatagtcttcctcatcggaggggtaaatccggcgtatatgttgtcggactcaccgtagaggaaacggcacctttagcatggttatctgtaggcgtctttatactctcggtgtgcatgattggtttatgttgggggttatcatgctcactacactatgtaacggatggtgaaagtcggcaatatcttgcaaactttgatctaccgaggcgttaatctcttgttgtttttgcgctagctttttgaagcgttgttcgtctaaatcgatttcatgataaagtaactcataggaggtgttgtcacccaatacatcaaccatctcattaatgaggttgtcctgaaaatctttaatattaaacggattatcttcgttacaacgtgaaagactatgttgccagatgtcgtcaaactgaatttcagtgtcaaatcgatagttgtgccaaacggtcagcgcattgatacaaatggctagtagcttatcaataggggcatgccctaatccgttaataaaacgttttgaatatagggataaagaaatgaaatacatttctccattttatcaactaatgtatgagatataatatagcccatctttttcaagctcggaagacagttctccacaggaaagcgctttgtttaactttttctcgtaatatgctttcgcttgctgaatccccaatgctttctcgataaaggagaggtcggcgcgggtatcgttctcaataagatgaccgatcaataaatccaactcggcttgtacgctgtccgccgattctcctttccaaggtttgaattgacattcaatcgaccaaaaacgttgatcttgggtttcgggttttccgtgggttgtgctcataagggcgtaatttatctaatgtcaccgtaatatattgagattctgtcggatagtgagtcatacctgcggcaatatatgacggtgtcgtattggtgattggttgcacatttaagcctttggcgattgcctccaatctggcttgattctttttatctttggctgaaaaagtagcattactcataacggctatccttattatccatgttctcaaataatgagtattgacctaaaaactttgcggtaaccgtcgctaacggannnnnnnnnnnnnnnnnnnnnnnnnnnnnaacacaaccgcgttgttcggactgtgggttataaacttcatcgcggtagaggtgataaatcacatcggcgtcttgttctaacgaaccggaatctcgtaaatcggaattgaccggacgtttattggcacgttgctcgaggctacgattaagttgtgataaggcataaaccggacaaccggtttctttcgccaactttttcaactcagaggagatttctgccagttctaaattacggttttcaaacttgccggtgctg

SEQ ID NO: 63353 - DNA, 764 bp, Oryza sativa
tttgcattccaattgccacctcttcttgtaaatacggcatttctggagaatcggaattaaagactaatacatttggcactagtttttgtaaacgttgataagcctgcttaatttctgcttcttctgtattcggtgatttaccatcaagcaataaagcaatatgaaacacttctcgtgcatcattcattaataataatttgcctttatattcatcacgccataaatcttcccagcttgaaactgtgtgaggatctatttctttggcattgacgccaatcccagtcaattcatagacataaggcaatgaataagtattgtcaggatcaaatggtttacccattaattcaggggtaatattttttaaattgcttaattttgttttatcaatggcggttagcataccttcttttgccattttattaacataatagctggaagggaaaacaatatcgtaaccggttgaatttgataatttcaatttagagtacatttcttcattgctttcaaaagtagaataaatgacctcaatacctgtttctttggtaaattgctctagcaaagaagaggggacatattccgtccaattatagacatatagtttttcagcagcttgtgccgcaatactaaagtaagcgagagcgattgccgttaattttgcaaaaaatgtatagcctaatttgatcaattttatgaaatccttattgaatgcgtgatggttaatgattcaactgaatcaggtaacaaaagtccggcattatatagat

SEQ ID NO: 63354 - DNA, 704 bp, Oryza sativa
cgtgataatcgtaaaattcaccatcaggaatgatttgcaccgcaggtaaaacttcgccatctaaaacagggactgaatattcagcaccggtcaaaaattcctctactaatacgatagtatcaaattccagtgctgcggtaatcgcgggcagtaattcttcttttgttttgactttgaaaacgccgacacttgaaccttcacttgatggtttgacaaaaacaggtaaacttaattttgcaataatttgattaatatcgattgcttgtcctcgttgcactactaccatatctgctgtgggtaaaccgacagcattccataataatttggtacggaatttatctaatgtgatagctgaagccattacaccacaaccagtgtatggaatccccatttgttctaaagcaccttgcaatacaccattttcacctattccgccatgtagaatgttgaagactcgctgaatgcctttttcttttaatttctcaatagcgatatcttttgtatcaataccttctacattgtaacctaggctttttaatgcttctgtgactgctgcacctgagtgtagagacacttcacgttcttgtgaagtaccgccatataacaccgcaattttttcggtcttaatattcatgtatgatgagttcctttgattatgcttgccaatcttcagccaatttgcgggtaagtttactgatgttacc

SEQ ID NO: 63355 - DNA, 870 bp, Oryza sativa
gatcatattcaaattccaccaaccaatattcatagtattcgaggtgagcaacctcctgaaactgaactggcaagatttactcaagaattaaatgaatgcctgcctaatttaacttttgattggatcatcttaggtatgggaaatgatggccataccgcttcgctattcccctatcaaacagattttgctgatcagcatcttgcaattatcgcaaaacaccccgtaaccggacaattacgtatttcaaaaacagccaagctaattgaacaagcagcgcgtattacttatttagttactggtcaatccaaagccactatattgaaagagatccacgacttaccggcaacacaattagcttatcctgcggcgcatatccgcgcaaaaaacgggataaccgagtggtacttagatcaacaagcggctgaattattccgttaatttgcatttaaataaacctagtatgaaagatgaaaaattgcgcaaaaacttaaggcataccattgatattagcccaatgagcaaatatcaatgggcaattgtactaatggccactattatgaatttcttagatggttttgatgtattggcaattgctttcactgccagtgcgatttcacaagattttgcattaaccaaaactgagtttggggtgcttgtcagtgttgggctgatgggaatgacaatgggttcattagtgttaacccctttggcagacaaaataggttgtcgcttgatgctattaattgctgtaacattttcagcgatcggaatggcgatttctgccatttcacagagttatgaaatgcttggtttttcacgagttattactggcttaggtgtgggggggattttagtcggcactaatgtgat

SEQ ID NO: 63356 - DNA, 1237 bp, Oryza sativa
aagccccgaaagacgaatgaagtggaaaatatcgctactcaacttgcaatgttccaagatattgttgaacccactgccacagtggaaaatatggcgtatgaactcgctttgcgtttaggttttcaattaacgaatagcattgagtttgccgatcaagtggtttggctgaatgataaaacaggcaaaagaaaaactgcacttttattagcacagtatcacaatgaaatgcttaattgcattattggcgcacaaccacaaaaagtgtttgctttagataaagtatttaatggcaatgatgacttaaaagctaatctcgccctgcaattaaaagacgcaggtattgcctttgaaacattttagggggcgttatgcaattaaaatttgaagaactcacccaccaacagcaagccattgaagcggtgattgccttatttaaaggcgaattaaataaaaccacggaattttcccttaataacctaggcagtcagccgattatggcaaatcagctggcgttaccccttgaagaagtcgagaaaaatttaaatgcggtgcaggagaaatttcatcaaaaaacgaccgctctttccgatcacggtttgcatttttccgttgaaatggaaacgggtacgggcaaaacttatgtctatttacacaccatttttgagttaaataaacaatacggctggcagaaatttgtgattgtcgtgccaagtgtcgccattcgtgaaggcgtacaacaaaccgtacgaaccaccgccgaacattttactaatttgtttgataaaccgaccgttaataccacggtatatcgtagcgacaggctaaatgcgctacgcagttttgccactaataaccagattgaaatcttgattatgaacattgacagctttaaaaaagatgacaatgtgattaaccgtataaacgagagtggcgaagccccgattttgcaaattagccaaactcagccaattgttatcattgatgaaccgcaaaatatggaaacagatttagccaaacaggcgatagaagccctgaatccgctatttgtattgcgttattctgccacgcataaaaatccataccataaaatttatagcttaaatccgttagacgcttataaccaaaaattggtaaaacaaatcgaagtcgaacctgtgctggcagaaaacgatgtgaacggggcttatgtggtgctaaaagagcctgtggttggcaaaggtaaactcaaagccaaaat

SEQ ID NO: 63357 - DNA, 1875 bp, Oryza sativa
atagtaaataagcctattgatgactcattatttcgtgatttttatggcattgggatcactaaatatcactttgatataaaaggaaataataaaatatatggtgtttatattcatctgttgataatcaaagaaaagaacgtaatttggtttataaaaaatcagctatagaggctttagccgctaagtattcaaactggaatgttttgccatcttcaaggaaatttttacacagtgaataaaatatatcgtgcagaaactatggtttcactattagtgggaatagcaatttttgctattttatttagcgcttttagccattggcaagaaactcaagtgagtcaaacaaattatttatatcaacaacaggcattacatattttagaaaatcaaatagccttaaaacaagcaacacaagaatgtgaaaaacaacttcaacaaaacgacgtgttatttacgattgactgtggtgcttcatatattcaagtgaatttcccattaggcaacgtcagagtgaataagcaaatggcagcgcaactatcgctagaatagcgtgtttcaccacttataaaagtgattgaatatcagcgctaattagtagaaaatcaaattctactttaggagccattatgtttacggtctatttttctcagaagctatcatcactcgctaaattatttattcaattacagcaaagcaatcctaatcctaatccatttgaagcagaaattgttttagtgcaaagtgtaggaatggcacaatggttacaaatgcaaattgccaatcaaatagggatcgcaggtaactatgaattcccttttcctacgagttttttatggcaacaatatcgtgtcctctttcctgaacttcctactgaaaatatttttgaacgtgaaacggttacttggcgtttaatacgtttaattccagattatttatctttacctgaatttcaatctttacagcactatttaactaaagattcgcgtcaataccaattaaagctttatcaattagctaaaaaagtagcggatttatttgatcagtatttagtttatcgtccacattggttggttcattgggaaaatgatcggcttgagattgttcaagatgaaattctgacccatgcaaatttaaaagtgaaaaataccaaagatatttggcaaaatttaagttggcaggctattttatggcgcgcattaattaatgatattaaattagattgtgatgaatcggtgtttgtgacttcacatcgtgcttatttgcaagaacagtattttaataaattagataatttaacagaaatagaaaaatcaaaattacctaagcgggtctttatttttggtatttcctctttgcccgcgacgcaattagctgttttaaaaaagctcagtgaacattgtcaaattcatctcttctttttgaatccaagtgcagaatattggggagataatgttgaagatcgggtattagagaaattagcacttaagcagaaaatgaccgctaaagaattagaagcgttatttgtacagaaaaataatcagttattatcaatgtggggtaagcaagggcgtgattttttagcacaaattcttgagcaagaacccgaccaaattcttgatgtttttgatgcttgtgaaggcgattcaaatctgattaagttaaagaacgccattctttcttttgataatcctcaacaattattgcttgcttcgcaagatgattcagtacagtttcactcttgccatagcattatgcgagaagtggaagtattgcataaccgtttattgcaaatgtttgctcaagatccaacattggctgcaaaagatattattgtcatgtcagccgatattaaccaatatgcgccttatattgaag

SEQ ID NO: 63358 - DNA, 1694 bp, Oryza sativa
aaagcgttcacgcaattaatttattaaatatcgccttagcagaaattatccaaaaaataacagatgcgaaatttgaccagcaaattgatattgaaattattagtttattgtttaatgaaaaattgaatagccaacaaaataacttaaatttcctggtcggtaaggtaaatttttgcactttattacctatgcgcgccattccatttaaagttgtttgcttattaggtatgaatgaaagcgattttccgcgtgcacagacggtgaatagttttgatttaatgcagtatgcctctaaaaaaggcgatcgggctcggcgtgatgatgatcgttatttatttttagaagcactattatcagcacaacaatttttctatattagttatattggacaatctaatattaataataagcaacatttaccatcggtgatggtttcgcagttactagattatttcgctgaatatcttgcgcctcaatctttagcattagtcagcccacaaggtaaattttctgaacagcacttttttgcagaaatggtgcaacaacatccattaacagtatttagcttaaacaactttagcgaaacaaattatgcctatgatcgagaatggctcaccatgacccaaacggaaaaaatgcaagagttttgcccgggtgaatttaattcaaacgctgaattgcctactgaaattcagctcgaacagttaattaagtttgtggtcaatccggtgcagtatttctttaatcagcatttaggtattatttagggataataataaacagattgaagaaagtgaaaaatttgtattgaatgcattagatcgttataaactacgtgataaattggtttgcttagatgatgatttaattcagcaaatgtttgaacaggaaaagctgaaaggtaatttacccgcggcgaatttgctcaactagcacaacaaaaaattgtagcatcggttaacattataaaagacgaattagtgggttatttaaccgaaagtgagattttagaagttgatcagacctttttaattaatggaatcgaattacgtgttgtaggtaatatttgccataggtttggtgatgaaattgttttttggaaagtcagtggtttaaaagataaagattatattcgttattggctttattatttgtttcttcgaatacaatcacaaccgttgaaattaaagattatctatttagatgaaaataaaaagaaagtattccaatttaatgaaattagccaagatgatgcaaaaaagcaattacgcatttatttaaccgattatttatccagtttttcttgtttaaaatgggctatgtttgaaggtttagatgattattttaaaaatcttaataaggctgaaaatattgagcactactgtcaggaaaacttagaaaagttaatcggaaaagaattttttaatagtcgctatttaaaacgtattttaaatcaaagcgtaatgttagattatggtagtattcacagtactacattacaatggtttgagttaatgcaaactagtaaaaaaagccctcatagtaaggaaaatgaatgaaaaagaattttattgcacaatcagtccgttatgcgctctgttcttatttcacattagcagtgatgaacccaacatttgctaatgatttaccaaatcagaccgctaattcagtacaaacaatgccaaatatggctg

SEQ ID NO: 63359 - DNA, 1333 bp, Oryza sativa
gaaatcttccgtagaaagttcgccggttgggaagttggaaaaaaaatattctcctagccgtattgttacattacaacgcattgcaatttgaatgctattcatcaacgcttgtggtaagtcggcaaataaggcgcacatttcttcttctgaacgaaaatattgttgcggagagtatttttgagggcgtttgggatcgtcgagtgtataactatcgtgaatggcaacccgaatttcgtgtgcatcaaaatcatcttctttcaagaagactacgtcattgactgcgactaaaggtaattgatattttttggcaaattgaaccgcttgctgaaggtaacgttcctcatctgagcgccctgttcgacaaagagaaagataatagtgatccgcgaaatattgttgataaaaagccactaatgtggcggcttcttgttcattttctttaagtaaagctttgcccacatcacctgaacgtccgcctgaaagtacaatgattccctcatttaattcagctagccacgctttttcgacaataggaaactcaacatacccttgctgataagcacgagaaagtagaacagtgatattgtgaaagccttgattattttttgctaatagtgtcagttcaaaaatatcttcactagttggatcagaacgaacataaatatcagcaccaataattggctttaagccggcagttaatgattcaccataaaatttcactaagccacaaaagttactaaaatcagtcaacgccattgcagccatctgtttggcagcggcagttttgactaaggcttttactttagcaagcccattaatcatagaaaaatcactgtgtactttaagatgaacaaagcgtggttgagtcatatgcgaattgtttagatgaggaaaatagaaagcaatgttaacataaataagcggttaagtttttgcaaatttttgcagaaatttaaccgcttttagccgggggaaggtatattaatcgcgttttttagtaagtaaccaccaaacgatcgctaaacagataaggcttggaattaaagctccaatggcgatgggtagccagctaaagactaaagtcatattgccaaagacgatatttgatacgtagaaaatgaagccagcgataatgccgataaataattttatacccattacactcctacgcaatggtccaaaaataaaagaaatggctaatagcatcataactgccattgagataggctggtaaactttacgccaaaaagcaatttggaagcgttttgaatcttgccctgtttcagttaaaaaactgacgtaatcagttaagcctgcaatagacaaggattca

SEQ ID NO: 63360 - DNA, 718 bp, Oryza sativa
atcagtaagccattcggcttaataaaagaaaaacttgcgtgataaatcatcatatcttgatgatctcttaacgtaatcgcccagaacccttctaatgggtcaagttgattcgccattagacaaatctttaaattatctgttaatttagctatttctatacttttgccctcacttaatgctcgacaaagcgctaaaggcaataatttttccattaacataaaattagttaagatcgcttctagccgttcggatttattaaatgatcggttacaatatttttctaagagcgtattgactcggtaaggctcgtgattaaataaaggttgccattgcgtattatgctgaagatagtgtacaaactgctgacgttctttattacataagatcgttctgaattgataacgaatatattcttttacctttttcacgattcttgcttcattagcgtacatttggctaaatgtcggaaacgaatacgtttttttcattattttgccttgaaaatctaaatatataaacgacaaagccgtacctaattcaacattaggtacgggctttccttatacacaataactaaaatcgtaggatagcgttattttttattcaattgtggaataacattattttgcacagataataaacctgcgtccgtataaacagctagtttatcacgtgtatcaacaatgtataaattacgcatagttaattgacctatacg

SEQ ID NO: 63361 - DNA, 793 bp, Oryza sativa
  unsure (1)..(793): unsure at all n locations
tgactaatacggccttctaaggtaaattcacaatctgttgcaagcggtaaatattgataacacgcttaattaaacggactaaatcttctgtcgctaatgccgttggcgtaccgccaccaaaatacaccgcttgaatcttgccatttccttggcgaattgaagcttcgtaagcaagttcttcaatcaatttatcggtataaactttactatagtcttctttccaagcatttcgataaaaaccacagaaaatacaatgactggcacaaaatgggatatgaaaataagctaaaccatcctcttttaatacattaattgccgcttgttgccaacattgttgccattctgcttgaggtatagcttctccctcccagacgggcattaaggcttgacgttcagggaaggcgttgggttgtgcttgagttgctttccaaggtattgttgtaatcattttcgctcacttacattcttcaaaaagaggaatttactttatacctaattcatttttaactgatattgatttttatcaacttatgattgagttaatacaggctaccgctatttagtcagtaatacacttctcattccgccacaattcagcaaaatctgaccgcttcttaatcaaatggctagttgcaccgtccaccataatttcaaccgcttgtggtcgtgaattataagtagatgacattgaagctccataggcgcctgctgaatataccgccagtaaatctccttcagnnnnnnnnnnnnnnnnnnnnnnnnnnnnnnnnnnnnnnnnnnnnnnnnnnnnnnn

SEQ ID NO: 63362 - DNA, 1505 bp, Oryza sativa
  unsure (1)..(1505): unsure at all n locations
ggaaatcataatggttgggagccttttgcaccaaaaacgtgatcttttaccggggccaactgaagcagaaattactaaatatggcttagacttggcgtggaaacgtaaacttgtcgcacgagaacagcaagatagaagctattcattacaataccaattcttacctgaaaataacccttggattaatactgtcgcgcagctcagccactcgagcacttatcaacatgatacacgttcagaacaagcatcaaaaacatatttggcttcattaggtaatgaaagctggacgcgttataccgatttaacattcgatgtcaacaatactagtttgtttaatgtggcaaaaacatctcatacacttttagtcggtttacaatgggtaaaacataaacgacaaacgcttatttttgatccgagtaaactccaaaaagcagaatataaccatggatatttccaaccatcttacatgccatcagggcatcaatacacacacgcattttacgcacaggataagataaaaattcacaacctaacggttagcataggtgctcgttatgattatgtgaaaaatataggcaaacctaatatagctactatttataatgaccccactgcagggcatgattacagcagtaaacattatcctggctggtcttcttacttaggtttgaattataaactgaccccttacttaaatttattcagcaatataagtaacacctggcgtgcacccgttatcgatgaacaatatgaaacacagtacgcaaaagcaactttaagcccaacagcgagctcgttagacctcaaaaaagaacgtatcacacagctacgcgtaggaaagcagatacatttcgatcacattttatcaaataacgatcaattaagttttaactcaacttttttttactataaaggaaaagatgagatttttaaaactcgaggggtccgttgctttgaaagtgcacaaaacaacaataatgaagtttgtagcaaaaaaatcggcaattaccgcaatttacccggctatcaaattaaaggatttgagttagaggcgaattatgattcaacttattggttcaccaatcttagctattcacacacaataggaaaacgattagcatcaccaagaaacccttggctagccagtacaagctggattgcagaaattccacctcgcaaagccgttgttactttaggtagccatattcctgatacaaatttaacgttaggatggaaaagtgagtttgttcgacgtcaagatcgttctcctacagatcaagataaagatgcaggccattgggcattacctaaatcaagcggttatgctttacacggcatcttcgcgacttggcaaccgaaacaaatcaaacatttacgcattcaattcactgtcgataacctattaaatcgatcatatcgtccttatcttagtgagttagcggcgggtannnnnnnnnnnnnnnnnnnnnnnnnnnnnnnnnnnnnnnnnnnnnnnnnnnnnnnnn

SEQ ID NO: 63363 - DNA, 1149 bp, Oryza sativa
  unsure (1)..(1149): unsure at all n locations
ggtccaaaaccccataagttcaccaaaggccctacagtcacattaaatgcgccctctgtaattttattcaagcggatagcttctgccaccaccgtagcaaagtctggtgaaatctcaaacggcgtattaacttcacgtaatttattaaagcgactgatttgtgaatcaagttggtaagtagacatctcatcattaacgactttaagcacatcatctaactgtttttttacttgttcagcggtaggtaaattagcgatcttaccatcatcaatatatttgactgtataagtggtgcccattgttttaccttgtaaagtaatttgttctgcagatttattacaagcggtcagaataaacgataaactcgcgacacataccaacattagagatttaagtttcacctggtttcctcatataaaattaattgataatcaattagcaaaaataacgagattaaatcaattatctattagccattaaatgcgttaagcggtacgatatgcaaaaaagtttacaaatcgtaccgctttatcatagtgtattaaagcaaattaaccaccgaaatcatctaataagatatttttgtcttcaacacctaaactcttcagcatacctatcactgcggcattcatcactggtggaccacacatatagtattcacaatcttccggtgcttcgtgatttttcaagtagttctcattaagcacattatgaataaagcccgtgtaaccatcccaattatcctcagggagtggatctgaaagtgctacatgccatttgaaattgtcattttcagcttgtagttgatcaaaatcctctacatagaacatttcacgtttagaacgtgcgccataccagaatgacattttacgtttagattttaaacgttttaactggtcaaaaatatgcgatcgcattggtgccatacctgcaccgccaccaataaataccatttcattgtcggtttctttagcaaagaactcaccaaatgggcctgaaatagttactttatcacccgcttttaatgaccaaatatatgaagacatttgacctggaggtgcatctggttggcgtggtggcggagttgcaatnnnnnnnnnnnnnnnnnnnnnnnnnnnnnnnnnnnnnnnnnnnnnnnnnnnnnnnnnt

SEQ ID NO: 63364 - DNA, 1617 bp, Oryza sativa
  unsure (1)..(1617): unsure at all n locations
ctgcattaaccattcacggtcgcactcgagaatgcctttttaatggacaggcagagtatgaaagtattaaagcggtgaaacaagccatttttatgccgattattgctaatggggatattacttccccacaaaaagcaaaagatgtcttgaatatacaggggcagatgcagtgatgattggtagagggagtttcggacgcccttggttgtttcaagaactgaaacagtttttagagacgggtgacataatgatttatcaatcgatgaaaaatgtcaattgatgttgaagcatatcgaaaatctttatcatttttatggtgaacannnnnnnnnnnnnnnnnnnnnnnnnnnnnnnggttggtatttagatcaattaacgcccaggctcaaattttaaacgtactttcaatgcattaagttcaacaacagaacaattgatagcattgaaagaattggtcaaatccattcgttagaatcctttgttaagttggatagaggacaatgttagaacaacaacctgcacaaaacccattaacggtatcaatgctgaatgcacaagcacagcaagtaaatagccacttcgtgataatgtgaaagcggcattaaaaaactatttatctcaattaaacggtgaagatccaacagaattatacgaattagtattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctaaatgcttaacaagggtaatcaataaaaaaacttatcggcaagaatcaagattttttgtgtgtgatatttataaataagcgcacttatttgctatttttttgcaaataagtgcgctttattatttaggattattgaatttttaattttttgccgacaacaatatgattgttttggattttatttaatttactcaatttatctggtgtggtgttatataaacgggcacacgaataaagcgtttcatttttttgcacaatgtgatagccattgttcaatttaccattttctttgttggccgttgctgttgattgggttgttgaagttgatttttgggcgctatcttttttaggcgacggtttaacttcttttttgttattttctttcaccttgtttatattagggtgatatgcccaataagtatttaagcctttataaatagcttgtgcgattttgcgtcgataaatagagctggcgagttgtttttcttcaattgcattagataaaaaccccgtttcgactaaaattgaggtgatatctggcgaacgtaagacgcttaaacttgcgtgttgaggcgtttttttagcaagtggagtaactttttaaaggtagataatacggttgaacctaattcataacccgaacgttgtgaatgagaaaactgtaaatccaatacggtttgattaagataatgttcatttttattagataataatgagcctgcactggcgagtaattctgattgcttttggtgatcttataaccatttacccatttcattgctagcgcgtctatttgataatatccatattgaagcaccttttg

SEQ ID NO: 63365 - DNA, 724 bp, Oryza sativa
gagctcggtaccctaccgaatctcagcgaaatattaagttggaagatggcgctagcaattagcattggcatatttgttgcttggttaggcggacgaggcatcaatttaatggccactcaaccattaatcattacaggcttattgatcggcacaattatcggcattgccttttttgggggaataccagttgggccattgatcgccgcaggcattatgtcgttactagttggcaaattgtaaccgccaacgtcaaatgaacattttatattataaactcacttaattctttgaatagctatgtattacccacatcgaatgaaacgtcacctgcaaaaaaatcgcgtaaatcaaccgcttgatgctatgcaaaaagcattgtggcacaattaaccgatatctctaatttagattattaccgtttacgtagccgtattcatagcctgtctaatataaaaaaactgagctcaaacaagccgctacacacgaaatagcacaacaactacaaacggcaaaaaaccatttttcagtacgacaagcacaacatcaacaatagattaccccgatttaccggtttctgcccggcgtgcagaaattttaaaagtgattgccgaacatcaagtggttatcatcgccggtgaaacaggttcaggtaaaacgacccaattacccaaaatgtgtttagcgcttggacgtggtgtaaaagggatgataggccatacacaac

SEQ ID NO: 63366 - DNA, 783 bp, Oryza sativa
ggatttaatagcattaaagaacacgaataaacactaaactatttcagtccctttaagtacaacgtaattatagaattttctttcacctgcaacaaactaaaaattttaatttttataatcaaaaaaaataatgaaatagttaatcgccatctcaatataagggctcgaacaattttatgaataagaaacttcctccgcttaacgcattaaaagcctttgagtcagccgctcgtcatttaaactttactaaagcggcagatgatttattcgtcactcaagctgcggtaagtcatcaaattaaattattagaagactttttaggcgtaccattgttttatcgtcgtaatcgtcttttagaattgaccgaaataggacggcaatattttgaagaaatccaaccgctttttcaacaaattgcgctatcgactgagaaaataaaattaaaaaatagcaggcaaattttatcaattagtaccacaccttcttttggtatgcattggctagtgcctcgtttaaatgaatttcatcataaatatcctgatattgaagttcgtttagttacagccgctcaagacgaaggattgttaggtaaagatatcgatgttgctatttattatggtagcggtaattggcagaatttagaagcggtcaaattagtacaagcgcgtattatgattttagcctcgtctgaatatttgcaacgaaatccaatgaccaagcctgaagatttaaccggtaaaaatttgatccatgtttgttcacatactaaatggaaacagatgg

SEQ ID NO: 63367 - DNA, 705 bp, Oryza sativa
taccgttgaaaacctatctgtacattttgattcgttttgtgaatgcggttaagggtgtctctgccctagaaatctctcgtgatgcgaaaatcaactatcgcaccgcctttgtgctttgtcataaattgcgtaaagccttgctagagagtcgagatatgcaaccacttcaggcgaagtggatatgggcggcacttacattcatcctgcacctcgtaaagcaaataagaaagccgaccgcattgattaccgcttaaaagaaaatcaaaatccaaataagcgttgcgtggtagtcgctcgtgagcatttttctgcggatgaaaaagcggaaaattcactttatcgtggggcaaagcgttcgcacgtgttcgtgacgtattctgaaacccagtcggtagtgaaaaatttcgctcacgcttacattgagaaaaacagccgtatcaatacggacgaaaacaccgcttacgaaagtttgttactcgactatgatttacgcaccgtaaatcataaagacgaataccgtagtgattttggcgtaaccaacaatcaagctgaatcctttttctctcgttttaaacggatgtactacggacacgtgcataaaatgagcaacacctatttactcaactatgccaacgaaattgcgacacgtgaagataatcgccgtaaaccgaatggctggcagttccacgatattttaggcaaatg

SEQ ID NO: 63368 - DNA, 1176 bp, Oryza sativa
  unsure (1)..(1176): unsure at all n locations
nnnnnnnnnnnnnnnnnnnnnnnnnnnnnnnnnnnnnnnnnnnnnnnnnnnnnnnttctgcgtgttgtataaagctacatcacttttactttgcattaatttaatggcacgttttaatatatcaatattggtatcaagtaaagcaagatgatgtaatacttgtttacgctcaaattctaattctttgagtttcttatctaaggtataagccattacttcccctactgccaaatcacttcttgatgaacgattttccgttgccaataaccgcaccattcgttattttcattagttgttgttaagcatttaccgagaatatcctgagattgccaaccattggcttttctacgattatcttcacggtaagcgatttcatttgcatagttgagtaaataaagattactcattttgtgaacgtgtccgtagtacattcgtttaaagcgagagaaaaaggattcggcttgattgttggttatgcctaaatcgctacgatattcttctttatgattcactgtgcgtaaatcatagtcgagtaataaactttcgtaagctgtactttcgtctgtattaatgcgactttcacgaacaataaagcgatttgagaagtcttttacaacaggttgtgattcagaataagtcacaaaaacgtgtgaacgttttgccccgcgattaaattggttttctgctttttcttctgcggaaaaatgttcacgagctaccataacacagcgtttattaggacttttattttctttcaagcgatagtccaagcggtcgattttcttgttttctttacggaggtgcagggtgaacataagtgccgtccatatcaacttcgcctgaaagggggtgcatatctcgattttctaacaaggctttacgcaatttatgacaaagcacaaaagctgtacgataattaattttagcgtcacgagagatttctagtgcagatacgcccttaaccgcattcacaaaacgagctaatacatacaagtaggtttgaatggaagccttacggttggcaaagattgtgcctgatgtcactgaaaaggtatgatgacaatgtttgcaacgccattgtttatgactagcaataaaataggcttgatgttgtacaccgcatttaagacacgttacgtgctgtttacttccccaacgcatatcacaaagcaagtc

SEQ ID NO: 63369 - DNA, 1379 bp, Oryza sativa
  unsure (1)..(1379): unsure at all n locations
nnnnnnnnnnnnnnnnnnnnnnnnnnnnnnnnnnnnnnnnnnnnnnnnnnnntttttatttttcacgatgccgtgtattgccgatccattttatggagatgtcgcaaaaaataggaatgaagtaataatagaaaataatgttttaacggaaaatattatgccctgtgcattacctaatacgttatcaaacattagtttgcctgtaaaatttgaacaattaaaattgattggtatattaaagaaagggcagcaggctaaagcattttaattaatgataaaaaacagattttcgatttaaaagttaatgattttttattagatgagcatatacaaataactcgcattgatttgaaatcactacattatattgattggcataaaaagaaagattgtcaacatccaaaagaaaatgtggatgaaattataaggaattacgatgagaatacttttttctttattcttttttatttcattatcattattagcacaaccgttatcgctgtctttaaaaaatgcacctactgcagaaatattaagttatttagctgaaaaaaaaatgaaaaatatcggattgagtgagcaaatagacaaaaatacgacctcttagaattgaaaataggcattttgatgaaaatggtgaaaggattgtgcgcgctaatcaattatcaaaaagaaaagaaaaacaggtttatttatcgggcatttaaaagaagataaggcaatagagaaaaaaaaaaatggggagaaggccaagttaaacactcaaaccattaaagggggaaatgctaaaagttcaaaagaaattggaatccttactaaaggtaaaggtaatggtaatgtattgtcagaaaaaggggtatttatattttgatgagcgaagtaaaagcttaattataaaagatagtcctgattcaatgaagcatattttggcattaataaaaaatttagataagccaacagaaaaattgcaattgaggctagaattgtgacgattagtagtcaagatttacaagagcttggtgtccgttggggaatgttttcgccttctgacgattatcataaggtggccagtagtttagaaaccaagggtttaacaacagcaaatcatttaaatgttaacttcccagtaaataatgcaacttcacttgctttgcaagttgcaagaattaatagtcgcgtattagatttagaattaacggcattagagcaagagaataatgtagaaattattgctagtcctcgtttactgaccactaataaaaagcctgcaagtattaaacaaggcgctgaaattccttatgtattgtataaccgtaaagatgaagtaaaaaatattgaatttaaagaagctgtattaggattacaagttactccgcata

SEQ ID NO: 63370 - DNA, 1784 bp, Oryza sativa
  unsure (1)..(1784): unsure at all n locations
annnnnnnnnnnnnnnnnnnnnnnnnnnnnnnnnnnnnnnnnnnnnnnnnnnnnnnnttacattggtctatatctgttacttgaagatgattatgatagtgctctagatgcatttaatgctgttttagaacttgatcctcattacaattatacgtttttaaaccgtggcttagcattttattatagcgggcgttattctgaagctgaacgtgatttattacgcttttaccaagaagataaagcagatccctatcgtgtcttatggttatacttcaatgagctagaatttaaacctaatgaagcaaaagcaaatctaattacacgatcaaaagcattatctgctcactattggggcacaaatattattcattattttttaggggagttaactctcgcgcaacttcgtgatataatggataaagaagctcaaccaaatacagcttcatatgcagaaattttaactgaaacatatttctatttagcaaaacaacaactcaaattaaataaaacggatgaggcaattagtgctttccggctctctcttgcaaatcaagtgtttaactttgttgagtatcgttttgccctgtttgaattatcacagctaagagctatggaaaatcaaacttatcctgttgttgggataaattaggacgcaaacaagcggttaaaaatggcaaaattactgtttttttaccgcttgtactcatttagacaaattgtaaaagcattgaattcgcttcgttatttcattttttctttcctaaaaactcaacaatttttatcaattagtaataagataatcttgaatataaatcagcatatttaagctaggtttaatgttttcatttgcttattactcattatttatggttttttatgacaaataatactttaactttctctgacttaggtcttcctcaatcaattctcgatgctgtcaatgatatgagttttgtaactccatctcctattcaacaagaatgtattccccatttattagctggtagcgatgtactcggtatggcgcaaactggtagcggtaaaacagcggcattttcattgcctttactcgcacaaatcgatccgaatcaacgccatccacaaatgttggtgatggcaccgactcgtgaatagcgattcaagttgcggatgcttgtgagcaatttaccaaaaatatgaaaggtattcgtgtagttaccgtttatggtggtcaacgttacgatattcagttacgtgcattaaaacaaggttctcaagtggttgtgggtacacccggtcgtattcttgatcatattcgccgtggtacgttaaatttatctaccctcaaatcaatcgtgttagatgaagccgatgaaatgttacgtatgggctttattgatgatgttgaaacagtaatggcagaattaccagaaaaacaccaaacagccttgttttcagccaccatgccagagcctatacgccgtattacacgccgatttatgtctgatcctaaagaagttaaaattcaagcaacacaacgttctgcaccagatattacacaaagctactggttggtaaatggtttccgcaaaaatgaagccttactgcgctttttagaagttgaagaatttgatgcggctattattttcactcggactaaaacaggcacgattgatatcaccgaattatgtgagcgtaatggctatcgcaccgcagcgctcaacggtgatatgactcaacaagctcgtgagcaaactttagataaattaaaatcaggtcgtttagatattcttgtggcaacagat

SEQ ID NO: 63371 - DNA, 1188 bp, Oryza sativa
caccctgagctacttcttccacaactaaatacgtatctgagatcactgtttcatctgctgctttagcactatgcgcggcttctttaatcgttaattgatgatgatgtttctgattgaccgcttttacacctaaattacagaaaaagccaataaataataagcccgccataatatacatcgttacactataagcctgtgccgcaggcacaccactatcaatttgcatatgacgaatataattaactaataccggtcaattacggctgcagttgaccaagctaataatactcgcccatgaatcgcaccaacttgatatgagccaaacaaatcacgtaaataagctggaattgcggcaaaaccgccaccgtacattgaaataattacacagaagcctataacaaataggactttattaccactttcaccgatcgatggaatgataaaataaagcacggcacctaacaaaaagaaaatggaatacagatttttacggccaattttatctgaaatacttgaccagaaaaaacgccctgccatattaaataaactaagtaagccaacgaaacccgctgcggctaaagtaccaatcgcagcttgttttccaaccgaaacttcagagaaaagctctggaatcattactgatgcttgccccaatactccaattcctgccgttacattcaaacaaagaatcgaaaacagtagccaaaattgtggcgttttcatagcttgattcacaccaacattgtatgcactgactagcttatctgcttttttatgttcaacaaatccttttggtttccaagttggatgaggcaaacgaatagtgaaaacaccaaacatcataaaaatgaaatagaaaacacttaatactaaaaaggtttctgctataccaaccgatgtctcactgctaaagaaattcatcaaaccaacggaaataggcgaagctaacattgccccaccaccgaagcccataatggctaaacctgtggccattcccggcttatctgggaaccatttcatcaaagtagataccggcccaatataacctaaccctaaaccaataccacctaaaacccccgttacccaaatagagtaaccataaattgtgttgatacacaccgattgctgcaacaacaaacccaaggctaaaacaaatcgtcgccacaaacattgctttacgtgggccaa

SEQ ID NO: 63372 - DNA, 713 bp, Oryza sativa
ccattggagtcactccataaattgctttgaaagcttgcttaatgtaattctgattggctttggcattaactaagaaagtgtactttcttggttctgacatcatgatgccataagttttttcagtaagtattggtttaataagtacgtcagtaatttgcatgattagttcaacctttcaactcagttattaattgcacttttttgcgctaagacacagttagcatcaattaagtcttttactgatacttggtttcatagtttgtatgaaacgttaggtaagttagcactagatttttctaggttttcgtttttttcaaaagctacgattaatacttttttattaaccttaagttcttttagtaatttagcaattgcttttgtacttggtttatcttgtttaatcgaatcaactaatcctaagaattcgttgttattaactttagaagtaattgctgatttgaaagctaatgaacttacttttttatttaccttaattttgtaattacgatttggtttaggaccaaaagcgataccaccacctacgtaatgagggttacgaatcgaaccttgtcttgcacgacctgtgtgtttttgttggtaaggtttcttaccaccaccgctcacttcaccttttttaagggttgagtgagtcccttgaatttgtgataggttttcagcaagaattgcatcgaagattgcttgtttatgtactt

SEQ ID NO: 63373 - DNA, 739 bp, Oryza sativa
agctacgtgtaactgtgccaacgatgtacggcgtaaagtttccgccatcacatcggctgtaaattgtgttcagttaaaagaagtgacggttaaacagacaccattcacggctatgctatcgcctaaatgtacatctttgagtaccttgcaagcattaatgggcagtaccgcaaaatcacctggatgcttgatattcgcaactttacccacttcttcaataatacctgtaaacataaattctcctgctgtcagttgctaatttttgcgatgatgaaacgtcataatctaacaagatatcgtcgcctatgtattgtgtggatttaagcgttaaattaaccgcttccgctagttgcaaaatacctgcaccaccgataggacttttggcagtgcttccgcctaataatttaggtgcaatataacaatgaattctgttaacaacgccagctttcaatgcactaaaattcagtgttgatcccccttcaagcaagacactgtcaatttgcattgcacctaatttggctaataaatcaactaaatcaacttgtttgttggctaccttacattggataatttgcacgccaaaggctttcaattgcgctatttttgtactatcagttgaagcggttgcaataatggttggatattggcgcgctgtttgaactaattgacacgctagaggcgttcgtaagtggctatcgcacacaacgcgtattggttgtttagcattcggcattcgact

SEQ ID NO: 63374 - DNA, 1120 bp, Oryza sativa
  unsure (1)..(1120): unsure at all n locations
agcgtgttgtatgaagtattacaaatcattttggataatgaacatttacgtgcgattgaaattcaggtctatggtgcagattattggaatgtcacgattgataatgcacccgcacaaacatgggattttactgaaatagcggttgaaaatgaaaaagtcgcgcgattaggttggaagccgtcattattatgcccagatgaacgataattaaaaatgtttctgaaatgatcggccgtagtctatacgttttacaagtcaaaaacaacaannnnnnnnnnnnnnnnnnnnnnnnnnnnnnnnnnnnnnnnnnnnnnnnnnnnnnnnnnnnnnnnnntcgctcactttttttaaaattcaaattagcttattgaaatataatagcgaaacggtgaaaaattggcataaacagaaaacgattttagcggattttgaaaaagcgttaaacgaggcatatagtcagttaagagagctattatcgacttttcgcttaactattgaagaacctaattttaacctgtgcattagaacgtgttttggattcgttacgctcacgaacttcagcaaaaataagtttaaattgtaaattgccttcgcaaacgtttagtgctcagcaacaagtccatgcattacagattgtgcgagaagcggtcattaatgctataaaacattcaaatgcaacccaaattgaagtgattgctgaaactaatcaagatggcgaacaatgtttaattgtacgcgataatggtaatggaatcgtgaatggcattgaaccagatgatcattatgggctgacgattatgaaagaaagagcggcacaattaaaaggcgaatttactattatcaatcgtggtgaggcggtgtacaagtaatggtaacattacccaataccttactttaagcatcattcactttttattattcagtaaagcaattagcaacgtatttgaaattatgttggttatttataatcaaccccatccaagctagcaatcaccgactagcataaaatagtacaaacaaataatgttagcttaccaataacgtaagcgagttgattaagcannnnnnnnnnnnnnnnnnnnnnnnnnnnnnnnnnnnnnnnnnnnnnnnnnnnnnnnnt

SEQ ID NO: 63375 - DNA, 905 bp, Oryza sativa
ccagcgattgttttaatggaaccgaggcattcaataacatagctaactgattaattaattgagtgatttgttcgctttttggtttcctaactaaaataaaattaccttggaatatggatttttgaatagcctttacctaatagcccgtggttctaattcatcgtgacttttggccagagatttacctttttgccgttgattaaaacgattaaaagcccgccaatgaaattcatatattttcagcatcgcctaatactctgttaatttctgctaaggacgtaatatcagcctctaacttatgcttcgcactatgatgtaaactagcaaaatcaaggtaagcggtctctttttcaaagatttttcccgtacggcttaataattgataaatgccaatgcgtcctctatagccctgatagcaagcctgacagcctttaccaaaacattgcgtgcatagcttgcggacaagccgttgtgcaatgactaataataaggcgtttttaagctcatattctttaatacctaattgtaatagccgttcaattgcagagggcgcatcattagtatgtaatgtagaaagcacaagatgccctgtttgtgcagcgcgtaatgcaatttcggcactctccggatcacgaatctcacctaacataataatatcaggatcttggcgcaaaaatgttcgtaatagatggctaaaatctagctgaatcgctcgattaacttgtgtttgaatgattccttcgatctcaatttctattggatcttctgccgttaaaatatgcttatccggttgattcagatgacttaatgcactatacaatgtgatacttttgcaaaagtcggtggggccagtaactaaaattagactttgtggttgatgcaataagtgtaataacgtagttttt

SEQ ID NO: 63376 - DNA, 856 bp, Oryza sativa
  unsure (1)..(856): unsure at all n locations
nnnnnnnnnnnnnnnnnnnnnnnnnnnnnnnnnnnnnnnnnnnnnnnnnnnnnnnnnnaacgctaagtgatacgttacgggaacgcgctattcgaagcacttatcttgaaggtgatatggcgcaaacacaacgtaatcaggcaattacacgcctaaaagagggcggagtgaatgtattagttgcgacggatgtagccgcacgtggcattgatattgatgaagtggattatgtcattaattttgatttgccatatagtgaggatacttatttgcaccgaattgggcggactgctcgtgcgggcaaaaaaggttcagcgatttcattagtggaagcgcacgattataagttactgggtaaaattaagcgttatacacaagaggcattaaaacctagaatagtagaaggtttagaaccacgtacaaaagcgcctaaagatggcgaattaaatagcacttcgaaaaaagcaaaagcacgacttaaaaagcgtaaagaagccaaaaagattgaggctaaaaccaaactaaaagttcggcataaagagagcaaaaacataggtaaacggcgtaaagtggcaacaacaaatgcataaacgcgtttttagcaaaatgttgcgattatttgatcgcttatcttagccaatcgaataggaaaccgtatggatttacacaatattcgcgcagactacactaagcaacaactttcaaaaaaagagtgtgatgcaaatccaatgaagcaatttgagcggtggttaaatgaagcgataatggcaaaggtgaatgaaccgacagctatgaatatggcaaccgttatagatggcaaaccaaccagtcgtatcgtattgctaaaagaagtcga

SEQ ID NO: 63377 - DNA, 1232 bp, Oryza sativa
  unsure (1)..(1232): unsure at all n locations
nnnnnnnnnnnnnnnnnnnnnnnnnnnnnnnnnnnnnnnnnnnnnnnnnnnnnnnnnnnnnaatactcattatatccgcgccggtcgttttttaacggatcaaacgattcctttattattcatttcttgttgttggtggctaatcgcatttggcttagtgatcagttatccaaaatcagctagcctttggtctaaatctattacagcaaaatttatttttggcttctgcacgttaatcccattttttattgcaatacttgcattacgattcaacaactacgccttcaatcaatttcaaggcgcgtatttattactttatgtatgcctattagtatggtgtgctgattctggtgcttatttcttcggcagagcatttggaaagcgaaaattagccgctaaagtatcacccagtaagtcttgggagggcgcattgggaggcttaatcacttcttgcgtgatggctttattattcataaaactaacgccaaataatatttttggtcgcgaatttgaaacactcccctttattatagtctcggttgctacagtcgccgtttcaagtttaggtgatttagcagaaagtatgttcaaacggcaagctaacataaaagacantaataatttaattcccagcccatgccgtattttagatcacatttatagtttaactgccaccattccattttttgctaccttattcttttttgtattataggatattatgaccgctattcttgcattcttaattttaatttgtgtacctgtttttgtacacgaatatggtcatttttgggcagcacgtcgttgtggtgtaaaagtccttcgcttctcgattggctttggtaaagttctatttcaaaaggtagataaacaagggactgagtttgttttttccttaattccacttggtggctatgtacaaatgtgggaaggtaatgaatccattaacacggataaaacacaatccctaatgcaaaaatcccgtttacaaagagcatttattatcatagccgggcctatggctaacctattatttgctgttttggcttattttgtagtgtttagttatggtatgccgacactcaaacccgtcatagctgaagtcacgccaaatagtattgccgccgccgctaaattaccgacagaatttgaaataaaacaagttgatgataaacaagttcaagattgggatgaagtcacgcttaccttagttagcttaattggctccaaag

SEQ ID NO: 63378 - DNA, 1047 bp, Oryza sativa
  unsure (1)..(1047): unsure at all n locations
tttatggcgctgatcagtgtcaatttaggtataatgaatttatttccaattctaccgctagatggtggccaattagtcttgattgctacagaagccataaaaggtaaacctatatcaacaaattttcaattacgttttcaacaattaggtgctgtatttgtattggctttaatgatctttaccttacttaatgacgttattcatttttaattatagcggttaatttcgctcattatttacaatcataggatagtttaaatgaaaaaattattactctcttctcttttagttgccaatggcgttattgcggcaccatttgtagtaaaagatattcgcattgatggtgttcaaacagaaactggcaatgcaattattgcatctctaccggttaaagttggtcaaactgcaacagatggagatgttactaatattgtaaaacaactttttagtcaaaaccgttttgagaatgtaagtgctgcacgtgaaggccaaacattagtcattaaagttgctgaacgtcctttgattaacaatttaactattaaaggaaacaatgcaatccctaaaaatgcattagaacaaaacttaaaggcaaatctaattgtggcaggtgaagtatatgataaagcaaaattagaagcgtttaagcaagctttagtagatcattatcacactatgggccgttatcaagcagatattcaaaccattaccactcccaacaataacggcagtataaatgtagaattaaatatcactgaaggcgagattgcctatgtcaaaaaaattaattttgaaggcaataatgcattcagttatgatgaattaattaaagaactagagattaaacctaatgcgccttggtggaatatttttgaaagtagcaaattccaacaacaagaatataacaaagatatagaaatcttacgcgatttctatatggatcacggttatgctaaatttaccttaaaagacaccgatgtgaaatttaatgagaataaaactgaannnnnnnnnnnnnnnnnnnnnnnnnnnnnnnnnnnnnnnnnn

SEQ ID NO: 63379 - DNA, 767 bp, Oryza sativa
  unsure (1)..(767): unsure at all n locations
attacccaggtgaatggttattagatttaccgttgttatcacaatcattcaaagaatggtcgcaagctcaacaagctgtagatcaaggggagcgcgttaccttagccaaaacgtggttagaagcggtcaataaaattgatttattcgctaaagcggacgaaaatcagttagctgatttaagcgaaatatacaccgcctatttaattaagtgcaaagcagcaggaatgcaatatactcagccggggcgttttgtgctaccggcagaaaatgctaaaggtgcgcctgtttttcaattttttccattattacatttatcagaagcagaatggcaacggctagaaactgctagcgacaatagcacttacaaaatattaaaaaaacgttatcgctattatcaacaaaagattattcaaccattttatgctgactatttttcacaatttgatcggcaagtgattttggcggattgcctaacaccactgaatcacggttatcctgcatttatcgaaatgaaaattaggttacaacagctatttaagcattttcattacggcaatcgttcactttttcaccgcttattctncgccaaaattgataagttattnatttttagccacctaagagcgatcatatttagtagccgatcaagatcgcccaatttagaaaagtttaaatgcgacaatttagtccaagaagggcggtcgttatgctgaatttgacgggattgaaattggctatcaagctatttcggctatccgtgccactga

SEQ ID NO: 63380 - DNA, 919 bp, Oryza sativa
ccacgtaataaatcatagttataaccattttgtagatctaataaggttaattctgtttcaaatttaactttttctgctgaagaaaggttggtattacctagtgcagcgttaatcatctgtcgccgagttgcattatctgctaaggctaattgtgctttatcaggcacggcattttgtgctactaaattaccattgatagtggttaattcggtctgaatcatttctaattcagtttctaaactcgttaatgctttttgtaaacgccaatcgaacttttttccaacatatcaactgttggcacaattacattttttagtttttcaatattcgcttggctaatgcctaatgcaacgctcgcgcctttaatctctttcgttaaatcttcattatcatttttttgttgagcaattttctctaacaaactgcgcgtttcttctaagtgtttcaccagtgcattattgctatcgttcttatctagcttttttgcatcattaatttgcatttcaatcgctttatagcttggtaattcagccgcaagtagcacactactacatacaaataaattcagcccaaataagatgacatttcgcatcagtttcataattaattttgccctaataatttagttaatgctgtttgcacttgttgtctagcaattttaatgttgccctgttagtcataatcttgaatatttaacagataatacgcgatccacaacttaaatttttctaatttatcggttaaccaagcggtcagctttgtaacattttcagtaaaatcaccattattaaattgaataatcgcaaccggtcgctggccaaattcactatcttctttgggaaaaacaaatacttgttgcacccaactggattgataaatcagctgttctatttcttctggctgaatattttccccacct

SEQ ID NO: 63381 - DNA, 3195 bp, Oryza sativa
ctcatgctccatttgtgaccatgtagaaattgaattaggagcaagtaaactataccatgtagatgcaaagtttgacaaagaaagaggaaacaattttaacttaagcaaatcatcactaccggccttaccacattgttcaataaattggccgatatgctcctttgttgttctagtatcctcacctatgaattttgtgaagttgggcacctcaaatccttgcggatatgggaccgaatctacatgttcaggatacggcctttgatacgtatgcatagctactttgggttctatctcactactatcccgcaagacattgtcatcatcttttccaacatccacataaccgattagtgactcggtcttaggtgataatgctatgcttgtgatataacctgaaccgtcacttagttcggctatattttcaatgatgctattctctaagctagcaacacaatccgaaccattacttggttcggctattccatcgttgtctaaactagtaacaaaatccgaaccaatacttggttcggctataatggttgttgcattatcatccaagctagtaagacaatccggaccaacatttgattcagctatacttgtcacagcatcattgcacaaattattaacacaatccgaaccatcgcttggttcggctatgcatgatattgcattttcatctaaactagcttgtaagctattgtcatccactcggctttcctgagccagagcttcatgcaacacatgatcaatatcaagaaatatctggccattcaatttctctttaatagaatcaagcaatccattatatgcaatgtcggccaaatctttgtcagttattttcaaattgaagcatcggtttttaacatctccaatcctttcaatataatcaacaacagattcattgtatttatgtctaaccaatgttaaatcagacaacttaagctcagtttcattagtgtgaaaataatcatgaaatttttgttctaattgagcccaagcagaaatagaatttgatggtaaagaagtaaaccatgtaaaagcagtaccagacaaagataaagaaaacaagcgcaatttacatgtatccatactactagccctaccacattgcgctaagaattgacctacatgttcgcatgtggtcctactatccttaccactaaacttggcaaattcaggaattttataatcaggaggatatgggacaacatcataaaaattaggatacggcatttggtaaaccctagcatgattccttacctccatgatttcaggccttggtggatttggtggtggatttgatggcctaaaaggtggttgttgcggcgcaatattgtcatattggccgtacccggtgtcatgagaatatcctctattatgatcattgtaagcattagggacatgtggagtagcatgactaacagtattacagatgatgaataataattaaaatcagcactgctagtcgtggtatgaaaacctggagaaatttccagggaaccagtctgagtatgaccggccaagcacccagtctgaccagcccatgcccagtctgaccggtggtcaatggtacggtcagaccggccacaggaggcgcgatctggccaggataggacacggtctgaccgtttatggtaggcatggtctgaccggcgtagtacacggtctgaccggccatggtgggcacggtctaaccggcataggatgcggttagaccggtgtcatgaccagtcataccgttatctaggttttgcatatagccgattcctgtgtaatcagccgtataaacactcattgaccccccatagcattataagcatattgtataggagtaaaactagaagtagtatatacatctacacagtgattattagcaaaggacgggttgggcgaatcggaggttacctttggtaaaactacaacttgaggaagcgagacgttttccttcacgatgccttgattggtcctgatgtatgatttcatcaacagctcctgcgtaaccaccatcatcttgtgttgctccgcgtcaagatcctcccatgtgacctcgtcgatcttattcccgctcatcatggttgatgaagaaattccttgattaattccggccatatagatcatagccgaaatcgctgaccgaatagattaatatacggtcttgtaattttccttgtatgctactgtacttagcaaaaaaattggagaatttgaagcttctcgggaataaccgatatagcaggaatcggctttttttttatgtgaacagaagtagatcggcttggatagcctgatctttgttttagcacgtgcacagtaataaaaagaaacaaagctcctgctgcttgtctgccaggtagatcggctctagaagcctgatattttctctgtttgccttatgaaacaaaaagaaacgaggccatcgagccggcctctgcctcctgacgatgatcctcggtatacgcggcgtgctgaacggcaagtattcagatggattcagtgacgactagataattaacttcgccgccgaaactcctgatttgatgaacagtaattactagattaaacgaaattcggccgtgatatggccgattagatcgttccccagcggagtcgtcaaaaatcacgttggcaactttttatgacaagtcgacaagtacgatcgcaacacctaaacgccttgtggtgatatggagtcgccaaccacctcaatctagccaaagggccagatcaacatgggtactgtagaaaaacagctaaaccgactagcggagccgatttagagctcaaaatcagcctctaggccgatttagatcgatatgaggataactacccgtctcgtgggcaaacggaaggttttcaggacaaacctataaaagggtgtcgcagtctcgcagcggcgacggacggtttacggcgcaaaccgacaaagatggactaaattagggtaaaatagaaaacatagtaaaagaactattcaagtagattgtattcgggggttttacagtgaaccggccttgtcccttaaatagggatagaaaccaaaggaaacacgaaacatgccttcccaggtaagaaacccgagacccgacgaaaacagactcggactcggaccctgacggtctaaccgcccacatacctgcggtcagaccggccctactagccggtcagaccgccaatacacctgtggtctgaccg

SEQ ID NO: 63382 - DNA, 1194 bp, Oryza sativa
tacacaaaacgacaagtaatatacagttccaaacgtaaataaagcgtaaaatacttacagaagaggcacttagtcctcacaccgaaagagaacgacagcagcgaaaaaaggcgatcctagcggggcttcagctccactccacaggcaaaactcaactggggtctgagccttggtcttctaacttcggcttcagctcagaagcactacacttctgaaaagggggaacaatagcaaggctaagtacaaccaccgtactcagcaagccataccaatgatgcagacgtgcaaggggatacgaggatggtttgtggctatttgcataaaggcggttgtagaacattttattgatcaaaacagtaaaacagttgagtaattaaggtaatattaactctcgactgaacaacgctacaccacattgaacaggcccaaccaatccacctgaactacagtgcattgggtcgatttattaagtgtgagactaatcacggtgaatctggttgatcgcctataaccgtgggcatggctattcgaatagttttactctggccagaggtgcacaactgtacccacaagacacaatccaccggcatgtcaccgtgtcatcatgtgcccatgatgaacacgtcaccatgtcgagtgattgtgacaagacccttcatataactctcccctaaccatccacaccacgctaaggtttcacctgcactcctcgcaaggcagccggcagtcccctcgtgcgccgcggtgaatccggcagctggacaaccggacaccccggccgacccaactccatgacgcccaccctcgccaccggtgcctaggaaagggtcgagctatactccagatcaagcagttacccactcccgcttgtggtaagcactgtaattcttctagggtttctcgtgaaccggtccttaattgccatgggcacaactaacaaaaccatgcacccacagcccaccattcagttgcattttagttggataattacgaccatgaaacatggctagatgtctcgagcacgcagcttgtcaagatactagatgtctaaaactgtaattatcccatcaattgagctagtggtaattaagcatggctaagcataaagttctagctaggtcacataagtaatacaagctaggcgatttattacccacggttgacaaaggacagatatcaagtaaacatggcaca

SEQ ID NO: 63383 - DNA, 1154 bp, Oryza sativa
aaaaatcatcatgcaatatcccatcccacacaggttaagaatttagagtctagccaagtgtaatacatgtcccggtgctcagtaaccgcgagcacgactattcgaatagatttggtttactcacactgcagtggatgtacactttacccgcactccgcgactgcccaacacataagcctcgtctcaacacatgagacgcgtcacggcaaagcttttcgataaccttgcattggcagtacccgctccatgaactcaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccaatgtagggcacgcctctcggccctacctcaacggctgccccaccgtagcgcacctgtctcactcaggggtgaaccatctatgcagggatactgcctccgctcggctatctaatccgctaggtctatacccattcgagaagtacggttgtacgggggttgtttcatgcttaacttcatggctcggtctttaattgaccggggacggtactagccttttccagataccacccaaatcctccgtccgtcctagtcaaaaatagttgtttaattttatttccctttgataaatcatgtcatcattatcatggcaatgtggcgctcctgtctccacatgtcgcatctcaattaccttcccaaaggtaattgcccaggcatatagcatttgctaaatatgagcatgcatgaatctagagtagcatttctaagcaattgtcatggttgactagggactcatacataatcatgcgtacaaagatttaaggataaacaataatcaaggcatggcataatcacaagtgagatgttcatcattgcatgcaattttatttgtaaacaaaatagtttcgcaattgggatcaacatgtttaaagaatagtgatgacttgccttgctcgtagttctgtgggtcttgatcctcgctcggatccgcaactccctctggctctaaaattacgtgcgaagaaacgatttgaattcggttagatttcaaataaagatccaagtaaatccacgaagatatcgagagcg

SEQ ID NO: 63384 - DNA, 1775 bp, Oryza sativa
gtctaaagaatgctattgcttcaaattacaatctgttgtttattaacaggaatgcttctatcatgcgagtgaactgatataggacgaagggtcaggaggcgttgggatttgtactgctccatcaagcatctgcatcaccttatgcattgttggccgcatcgatggctcctcctggaggcaccacagtgccacagcaacgaagcgctccaccttttttatgttgaagattgcctcgtcatcgctcgccaccagcaagtcaatcctcccacacctgtagcaatcatttgcccaataagttagtattgtctgctcctcatctgcaacttctaattccacattcttcctgcagcacacaagctcaagcaggatcactccaaagctataaacgtcgaccttagaagtaatccctatgttcttgaaccactcaggtgcaacatatcctcgagtaccccgaatgccggtgtttgtttgtgtctgattcaccggaagaagctttgctagaccaaaatctgaaatctttgctacaaaattatcatcgagaaggatattctgtggtttcatatcgcagtggatgatttgtttattacactcctcatgtaggtagaacagtcctcgtgaaaccccaagtgcgacttgaacacggaggctccaatgtggatgggtatcgctgaagaggaatgtattgagtgatccattgctcatgaactcatacactaacagcctttcagttccctcgttgcaaaaaccaagcagtctaactaagttcctgtgaaatgtctgcccaatggtttggacttccaccaagaactccttttgtgcttcctgctgaagcttttcgattttcttgaccgcgatgttagtcccaaactcatcttgcagctgtcctttgtagacaacaccagaggctcctgtgccaagtacttcttggaaaccaccggttgccttttccagctcgctgtaagtgaaaatctttggaggtaatccagagttattggacggttgcgataactgggttttcttcctcgaggtgatactacaataagtaccaaaaagcataacagagattaggagaaagttcaccaatacagagcttccaaaaagtaatgaactcccaagaatccaatactttttggtcctccttccatttgcttgagccgctgctgaacacggatggtgaattggtgctcctaggcaccttaataagaactgtcctcggtacattgacatccattttaccgttcgacaaagggaaccttttcttccaacaagtgcttgaagctttatcgaacacagctacggcacagaaacaatcagtcacacacagccttcggcattcggtctgatctatgggattgtattgctcatagtcagatagaggccaatcaacgcgatcgattggtgccatgtcatactgcaacattgctgtcgtctcatccagatcacagttttgtggctcaaaatctggcctgcagcctttgtatttccttttatcatcgatgaacttataattctgtgggcataaacaacttgtcgtgttcttggtgccatcaatggtgcagtaactgttaaagccgcatgctccactacccaccattgtttgtattgactggcagatgttttctggaagtacatcgactgcagtccattgctctggccataagggcctggcatgtatgttttttgggtaaacatattgccggaacacaccatctgtgtcaagggtagcacgatggaagaaatcacccatagagtccacccctgcagaagtgatattt

SEQ ID NO: 63385 - DNA, 801 bp, Oryza sativa
acatatatttaactttacataagtatgttatatgtatacataaatttaagcttatacaatataaattataaattaactccattttagccatgcacaaaagttagatatttgattgaagagtcaatcaatctgtaagtagagacatgccctataaatatcgacatatttagaatacggtaattatcatattataagaaacggtaatttccacaagaatacggtaaatacggaaacgattggtataatagcaaaaccatttccgttttcatttccatattttttaccatttccatttttattttggtcgattaccatttccatatggctcaactggtagaaagtcgaaacgaacatcggtcggcggggaattactgttaccgttttcacccctacttacaagtttgcacaacttcaatccccgttaaatggctaaaaaatgggttaatttgatctgtgccattgcaaatatgtctgttcagataaataccattataattcatttatgcgtagccgtgccactcaaattttacgaaattagaaccatgctatcactgtcaggttttccatcttccgaatcggcacatgggactcacccatcagattcttcttcttccttacaccctccattatcttcttccttccccatctcttcgtcgtggcaaggagcgcgggcaggatgggagggggtcggcgacgtgtatggtgtggccctataggagagcaccgactaaggcgacgaggccgtgagcccctacgcttccatgacctagaatgatgggacacgcagcacggtcttcgcct

SEQ ID NO: 63386 - DNA, 4078 bp, Oryza sativa
  unsure (1)..(4078): unsure at all n locations
nnnnnnnnnnnnnnnnnnnnnnnnnnnnnnnnnnnnnnnnnnnnnnnnnnnnnnnnnnnnnnnnnnnnnnnnngatcaaggtgaagaaggcgagcaagtgctaccctcctcgcccaagaatccaccaaagtatccaaagagatcatcccaccgacaacatcttaggagacatcaacaagggagtgtccactcgttctcatattgcaaatttttgtgagcattactcgtttgtgtcttctcttgaacctctaagggtggaagaagctcttaatgatctagattaggtgatgccgatgcaagaggagttcaacaatttcacccggaatgaagtgtggactttggtgtagcgacctcggcaaaatatgattggcacaaagtggatcttccgcaacaagcaagatgaggccaggctcgtaataaggaacaaggcgaggttagtggcgcaagggttcacccaaatcgaaggattagattttggtgaaactattgcgccggtagctagacttgagtcgattcgcatattgcttgcttttgctactaacctcaattttaagctatatcaaatggatgtcaaaagcgccttcctcaacgagcctatccatgagttggtatacatggagcaaccactgggcttagaggatccgaagtatcccaaccacgtgtacaagctccacaaggcactctacgggcttaagcaaacccctagagcttggtatgtcttcgcaattttcttgtgaaaaacggctttgaaatcgggaaagccgattcaactctttttactaaaagacatgataatgatatttttgtttgccaaatatatgtcgatgacattatatttggttctactaacaagtcttttagtgaagagtttagtaggatgatgaccaaacgttttgagatgtccatgatgggtgaattgaagctcttcctcggccttcaaattaagcaactcaaggaaggaactttcatttgccaaacaaagtatttgaaggacatgctcaagaagtttgggatggagaatgccaagccaatccagactcccatgccatcaaatggccacctcgacctcaatgagcaaggtaaagatgtcgatcaaaaggtatatcgttccatcgttggctcacttctttacctttgtgcatctaggcccaatattatgcttagtgtgtgcatgtgtgcaagatttcaagccgctccgaaggactatcaccttgtggccatgaagagaattcttagatatttagtgcacactcctaaccttggtctttggtatcctaagggagcgaggtttgatctcattggctatgccgatgcggattatgccggatgcaaagtggataggaaaagcacatcgggtacttgccaattcttgggtaggtcccttgtttcttgttcttccaagaagcaaaactctgtcgccctatccaccgccgaagcggaatatgtttcggcggggagttgttgtgctcaacttctttggatgaagcaaacctgagagactatgacctcaatgtatctacaatcccactcctatgtgacaatgagtgcgccactaagatagccaacaaccccgtccaacactcccgaaccaaacatatcgatattcgccaccatttcttgagagatcattccacaagagacgacatagacatccaatatgtaagaaccgacaaacaattggcggatatctttaccaagcctctagatgaagctaggttttatgagttgaggagtgaactaaatattttggattctcggaatgtggcttgatctattgcatgcatgtttgcttggtagaataggtttgcataccactttgtgacaaaatggtcattcaactcatggatggacactagtcacttttgtggagaacttgaatctatgtgtatggggatcttatttttcaatgaattttggtcctagcacaacttgaaatagattcacacattccctctctcgagggtgaattatcttgtatcatggtaattccctctcttttgatccctcggatcgtccatttgacttgtggctattgttttgtgtgattgattgtgtgctagtcacaagttcaaatggagcctctagtgctcgaccatccctcctttcctaaatactatcaaaaacctttgagaaatgtgtttttgtcaaaaatttcccggtgcttgtcccttgcaaaatccatttcaaatgtttgcaaaatagtttcatcaaaattcctagcgaaatccccttgcaaaactgtgttttccaggaattttcggactttccggaaaatttttggacttcccgaaaaattttcggatatatccgaaaaacattagaaccgtgcgcaacccttctggatccgttcggacttatccgaaaattttcggaaatgcccgaaaatttcggggtctttatatatcaccccgtggactcccttctctctcctttccactttttttccccacgggattgactccctcctctctccccaccggcgaccacctcctctccggcgacttcctgcggctcccctcctctctatcctcgtgggagcgcgcttgggggacttcttggggcttgcattgtcgatcttcaccgcgttcttcaagtgttcttcgcgttcttgaggtattcgccctaaaatcaaatcctttgattcctcaagttttatcttgcgattccctttggtggagatgttcccctagtgccctagaacctgcggattcaatctcacaagtttttgttggcggatttgtgcggcatctgagttatagggttcggcaggattcttttcggacttttccgaaaattttcggatatgtccgaaaatccctggccgacccctatcacttcagtgttgcacgattcttaccttcacttacttgtttcttgcctttttggcttccattcactggtcccttgtatctcgcttgtttgaaggatgcctcccagcaagcaaacctcccacaagtccaagcgcccgagggatcgctctcccactccatcctctcatgatgattcggacagtgattggtctggtggagaggatgcggttcctcaggttgccctggtggctcggggtggcaacctccctcctcggcgatctactcaagctcttggtgctggtggtggtggtgaggactcctctcgtcaactgcaaacgccgccgcatcaacccaatgtccccattggtcctctccgcattcatacccccgagagggatccagcggtgattcgccaagtgtatgattggaggcggaagactgaggttgttgctccctggtgggatgaggatccgcgccctcttcaccactccgccacgaatccgcggttttggactctctttcaacaagacttttatgagtcagtgatcaagtccaaagctcatcccaccgttcccatgcaatggatcaactgggaggagttgcaggcgcataatgatccggtgctaaactctgtgattgcaaattgtgagcgcatggggattcgctctttcatgactttgcagcaggattggtgcaacgaagtcatcgctcaattctatgccaccgttttctttgatccacaccgtgccatgcattggatgacccaaggatcttggtattctgtctcctatcctcctttggctgagatttggggtttcgacttgcatgacttactcaaccttcctgatctgcataatctacccattcctaccaacactgatctcctccctctttacattccaaatgatcctaatgtggtgttgggtaaggtcgacggtctcaaaccgtactttgcctacttgaaccggatgtttcgccggtcctttgtgccaaaggatggtgatgctagcagcattaaccgcctctccaggactgtgcttctcaggttcgatccccctcctcatcgctttcatccttatcactttgtgtgggaagaaaaccgcatggcttccattcagtacaggaaggggttggtctatgctcctcacattatgcggatgatcgagtctgtcactcagcttcagtttcgccatgatgtgtctcattcctagcttcacttgtgccttgttaaggcgccccgctcctcagccgctcgggacatcccctcc

SEQ ID NO: 63387 - DNA, 1206 bp, Oryza sativa
ttttatttaagcaaatgtgaagcttgttatgtccttaatgagttagcgtaatgcatatcccgccaaatacgttgaagtgatgtgttgcggcaaatgagcaaatggtattttgtacccttttctttttgcttgagtcaataggaaagccgcactattaagagggatgatgcattgacaaatgagcagtgatcaaagtgctcaaaatcaatttttaaaagtgtttctcctcagttatagagttctggagtttttcggagttttccgaaagtcattttcggactttccgaaaatgactatgaaggcaaaaatgtttctgtgtattttcggacttgtccgaaagtgattttcggacttttccgaaaacatccagaatgatgttttggctatgagtattttcggatttgtccgaaagtgattttcggacttttctgaaaacatccagaacgatgtttttggctctgagtattttcggacttgttcgaaagtgattttcggacttttccgaaagtgattctagaacgatgtttttggttctggatatttttggacttatccgaaaaattttcggaatgtccgaaaattctctcgttgactttgctgttggtgctgaactggaatttttggacatgtccgaaaatctttcagaatatccgaaaatcacaattattgtgtataacaggcagaatttgggctttggctataaatagccccctcccctcacttgtgagggctgctggtcacattggatatttttgtgcccttggcttgctcttgttgagattcacttttgagccttaccttcttgtttcccctctcacccatgttcgattcggatttggtgtgtgtgtgagagttgtggattcgagtttgtgtgagtgcttgttgctgacttcgtgaagatttgtgagcacttgcatcatctccgggagttcaatgcttcatttgttactcttggaggttgaggactcctaggcggctaggtgtcgctcccgacccaccgatctacatgtggttggccgggagaagtttgtgaaggtcggatctcacctccgaaagggaagagatacccttagtggaaggaggagtgcttagtgcaacctcttgaggaaagggttagctaagacccggctcttagtgagctcctcaacggagagtagaatccctcaaggattcgaactttgggaacaaattcgtgagcttcatctt

SEQ ID NO: 63388 - DNA, 1426 bp, Oryza sativa
ccaaatatgccatgttgccagaaagaaaacctcaaggaaacccctttgtgcaaacctgattcttgccaaaacaatcatctgaaagaattccaaattacaatcccaatgaatgcctagctattgccaacaagccatactgaaaggacatgtgaagaagagatgaagtctggtggtgtgtattgcataaagcacatgtgagatcatcatcttcttttgcacaaagccttctgtcaagcatatcccttgtgttaagtctatcacagaacagaagccatgcgaacaatcttcatgacacatttggtttccacagccaaatcatgggcctaggaggttgcaaagaagagtaattgagcttgtaaaatctcttggctgtgtatatacctgttccccaaataaaactccaaacatcacttcttcctagctgaagctgcagatgattcaattcctcttgcagttgcaaaaattctccacatgcatcatctgagaggggaagaacaaaagagtcctccattggccgtaggcacatggtcctaactgaatcattcttatacaaagtcacactgaacagattagggtagcttgtgcacttaaaatcatcattccatagatcattccaaaaaagggcagttgcacctgactgaattgtacacttagctatacccctgaaaatatctgaaagagatgtgatatccctccaccagaaagaacccttgttcaaaaccagatggggtactctagaaacataataagtctgtgagatcagtttcacccatggcagctcaacaccattatataattttaccatatgcttgaaaagcaaagcaatgttctgaactctcaggttaatcacacccatacctcccttatctttaggtgtgcatactctgtcccaaaaagctaaaaacttttctagttgaggatgggttgttgcctctccaaagacaactcttccttgctgtatcaattgcctttatgacagtgactggaagttgcaaagagcacatataataagttggaatagaagaaagaactgaattaatcaatgttaaccttccccattgaggcaaaaacatagagcttgctgtcaatctcatttctactctgtccaccaatggtgcaaaatcaaccactctagacctagtggtaccaagaggcaaccccaaataagtgaaaggcaaggaaccaatggagcatcccaaaataccagcgagcaaagaagcattgtcatgagaaagattcaaaggatacaaactggatttgttaaaattcacctttagacccgtggactgtgcaaacatgttcaggatagttttgaaacagaagatttccttttgagaagctttgagtaagatcagggtgtcatcagcatattgtatgatagggaacccactcccatcattttcattaattggcttagagattaagt

SEQ ID NO: 63389 - DNA, 1239 bp, Oryza sativa
tcctgagctattatatgccaacattttttcataaaggaaccgttgaacccatctggtccaagcgctttatctgctgggacaatggatataagactgtcaatttcctgtgtggaaaacatgtccaccaaacattccaaatctgtgcttcgggagaagagagtactcaaatcaaaggccatttgaggaccagctgtaactcccattctattcttaaaactgtgaagaaaaagagatgccttttgtgcatgtagctgcacaatctacccattttgatccaaaacttgtgacactgcattgattatgtatctctcagttgcaatagattggaaaaatttagtattttcctctccaagcatcatccacctgttagtgcacctcttcttctaataatagatctttctaaattcctgcaacttgagaatttgcacttttacaatttctgttagattccattcaaagactgagagaattcttgtttcttccaccaaatccaaaaaatcaatcactttgttacagttggtcagaagcaacagtaatttggacagatttttgctccatgcaagtaatctctttcttagcaatttaagcttaaaagaaatgcatttagcagggtcctcaaaccctggatccaaagaccagacctgctgaacaatgtcaaaaaatccctccatctgcacgcaataattctcaaatctaaaaataggggattttggaatttttgtatcaatcttcactacacatggcacatgatcagagatatttctagttaaaggcaccactgtagtgtttgggaaagccaaggtccatggagctgaagtgaacacccaatctaacctttcaagaagagggttttgttgcgtgttactccatgtgtattttctacccttaagagggatctcaagcaagccaagggagctgataatgtcattgaaaaagatatcattcatatctgctccagatttgtttctatcctgcactgatctatagaaatcgaagtcactaaaaataaagccaattttgctgatcaccaatgctaatgttcttggcaaaatttgctacagacatctaaaaaacgtgtaattagctaggggacaccgtaaaaacgcgtatttgctgtagggcatcgcaaaaaactggtaattagctgctggacacccgcgacattattttattattttcggaggaataggagagagaaacaatcattaaagacaaatttgcccttggctcaaatgaatc

SEQ ID NO: 63390 - DNA, 1124 bp, Oryza sativa
tgcggctgctaatgcctatgcatcccttgctcctgatgatagcaactcagctccactgccgccgccgccgccgcatcactgccgcacggcgtgcccgatctacccttgtccccactcatacccgctacgacattgttattgggcatcgttgttgggctcagcatcgggtttgcaggtgctgaaggtccatgcatgagaagagcgcccgctgcgatggcttgagcctcgccgcgtcgccgttggcggccgcctcgcgccatctggtccagcctcccaaatccggcccggagccgctgcgctcccggcgtggtcgcgcccgctgagcccggccgtccttgcgtgcgcgctgacgccgcccaaccccgccggcaccacctaaccctccagctcgggcgccacctccgccgcgtcgtgctggcctcgacccttgcgcacgaccgcgcaacgccgccccagccgaggcgctgcactggtccacgccgtcacgacgctctccctctccctggggctcgcttgaatgaagagcagagaaagagaattagagagaaaaaaaaaataaggaagaataaagaaaaagaaaaaaaatcgaagggtataaccgtatttacacaactgtttctctctcctattcctccaaaaataataaaataatgtcgtgggtgtccaacagctaattaccaggtttttgcaatgccctacagcaaatacacgtttttacggtgtcccatagctaattacgcattttttggatgtcctatagcaaattttgccaatgttcttaaaccaagtaacaaaatcagatctctctgggccaccacaagggccataaacacaagtcaaggaccaggtttgagcagtatgcctcaaattgaaatcaacaaacacagagaacagattaatttccgccacagctccgacaaaaacccttgaagactaaacaaccaaaatgcccctgaggcaccactagagggtgcaaaagcaaacgaatcaaaacgttttggggcaaacttcctgatatctgagagatcaaaatgatcctttttttgtctcctgaatgcaaaaaaaacctggcactcacagtcctcaattttctgtctcaaagagagcaattttggctctgcatt

SEQ ID NO: 63391 - DNA, 2355 bp, Oryza sativa
atgaaaagattacacctggcttgaccataaccatacaagctggccaaaactgttcttctgaaacgcggttggaaagaccaacctcaggaggaaagaaacacatagaaagacttctgaacacgtatttctttctctaaagacttctgaacacgtctttctttctctctccatacaggtggtcaatgcattcaaagccgacattttctatagttttgataaggaaatgtgaaccaatctccctcttatgtctatcatattgacagctttgtaattgcatttgacaggttcaaccggttgcctcgcagagaaacttttggttagtcaagtatggaagtgatcaagactaacaaatgccgctctccaagggctataagttttgttgtcatctagtacgagcaaaaggttgatcaatagcaatggcacctctcctgttcttgcccatcctgcaactcttgctactatactgcaccaaatctgcccaagctcagctaaacatcagcataggctcctctttgacaccccaggggataaacaactcatggatctcgcccactgctgattttgcattcggttttctggcggtagatggaaactcctcctcatacctgctcgctgtctggttcaacaagatcgctgacaagaccgtcatctggtatgccaagactagctccaataggcaagatgatacaataccgatacaagtccaagctggctctatcctcaagctcgctgatggagcactctctcttcgcgatccatctggcaacgaggtatggaatccacgagtcactgatgtgggctatgctagaatgctcgacaccggtaatttcaggcttttaggcactgatggcgcaacaaagtgggagtcctttggtgacccttctgataccatcctacccacacaagtgctcccactagggacagcactccacagccgtctcctcgccacagactattccaatggccggtttcaactaaatgttcaagatgacggtaatcttgtgctgtatctagttgctgtaccttctgcatactaccatgatccatactgggccagtaacacagtggggaatggctcacagctggtgttcaatgaaactggaaggatatacttcacgctgactaatggttcacagataaacatcacttctgcaggagtggactctatgggtgatttcttccaccgtgcaacccttgatacagatggtgtgttccggcaatatatttacccaaagagcaaacaggccaggagcttatggcaagagcaatggagagcggtggatgcacttccggagaacatctgccagacaattcaaacaaaggtaggcagtggtgcatgcggcttcaacagttactgtacctttgatggcaccaagaacacaacaaattgtctatgcccacagaggtacaagttcttcgacaatgagaggacatacaaaggttgcaggccagattttgagccacaaagctgtgatctagatgagacagcagcaatggtgcagtatgagatgacaccaattgatcgcattaattggcctctatctgactatgagcagtacagcccgatagatgagaccgaatgccgaaggctgtgcgtcattgattgcttctgctccgttgccgtgttcaataaaccctcaaacacttgttataaaaagaagctccctttatcaaatgggaatatggattccagtttacaggcgacagttcttcttaaggtgcctaggagcaccattcaccatccatgatcagcagcggctccagcaaatggaagaaggacaaaaagtattggattcttgggagctcattgttttttggaagctctgtattggtgaactttctcctaatctttgttctgctttttggtacttattgtagtatcacctcgaggaagaaaacccagttatcgcaactacccagtaattctggattaccttcaaagattttcacttacagagagctggaaaaggcaaccggtggtttccatgaggtacttggtacaggagcctcaggtattgtctacaaaggacagctgcaagatgagtgtggaactaacatcgcagtcaagaaaatcgaaaagcttcagcaggaagcacaaaaggagttcttggtggaagtccaaaccattgggcagacgtttcacaggaacttagttagactgcttggtttttgcaatgagggaactgaaaagctgctagtgtatgagttcatgagcaatggctcactcaatacattcctcttcaacgatagtcatccgcattggagcctccgtgttcaagtagcacttggggtttcacgaggactgttctacctacatgaggagtgtaataaacaaatcatccactgcgatatgaa

SEQ ID NO: 63392 - DNA, 1825 bp, Oryza sativa
gtaattacctgcagtggttaacagtaattaactgaggttagctcagctcagctgggttgcgtacaaagtaacacgactgtctagaagaagaaaaatcaaatgaacactatattcagagaaaaaaaaatgaaactatatatttagagggggggaaatccttatttgctactccactttgagctgtcaccaaactaggtatgccgatgtaggcgaggctggtgatgtggagacttgttgccgcagccaccgtcccccacctcgtccatggctggcgccgcctccccatcctaagcatcatcgcccagatctagtttggtgtcaagcgcatgcgaatggctgctacttggggccatcagcaactggatggcaactgtggcgggctggcggcaaggtcaggaagccgatggaggcgggagaggaagagttgatcagcaaatgggagacgaggatgggcggccaacggccatactgcccatcagccatggggatgggagaaatagcaagaaagaaaatgaagagggaggaaggcgatggttcatggaaatttaagtatttgctactattctatttatcaattatccaaatgccaattttaattttgtgctggtaaatttaacgccccgcgctttgttacgggatatatattagatagcgtagaaataataaaatgagttggattgaaatatcgtgaaaaagatgatttggcatgtgcatatttattgttgggagtacctatagaacatttgacatttttctaggagaaaaacttaaatgtaattacaatctaactagtgtgtaactagaggtttactctgatctaacaaaaagtatcaaaaagtatcttgagtatcagtacatccaacgatcggaaacgatttggtaccgtgagataccagtacctcgaggtactttttgtttgaatagcgcaaatctcacgtaactaagatgtacttactccgtttcacaatgtaagtcattgtagcattctccacatttatattgatgttaatgaatctagatagatatatatgtctagattcattaacatcaatatgaatgtgggaaatgctagaatgacttacattgtgaaacggatggagtaatttatatgtaagaaagttttgatcgaaggcgggacctcgagcccacgagtcgcccacgcgccagtggctcgggggcaaaccctagccgccgccgccacccaccctcctcccctctctctgcctcgccgccaccggagttcaccgccgaacaaccatgcggggagccaggatggcgagcggggccataccgcggcgacgcgtcgtctctggcaagagggaggcggggcggagcgcggagcgcggtgagccgagcggagcacggtaagccgagcggagggcggcgcgctcgatggcgagggaggccggggatccggcaccgcggtggctagatccggtgctcccgcggccggatctagctgcacggcgcagggcgacggctccatcatgggcacggaaagctacggctgaaggccgccagcggcggcggcagcggcacgagggccgcgtgccggcgaggggaggactgtcgcccgcttggcagcatgctcgtgcctctctccggccggcctggtggtgtgcgcggggaggagctgtggggtggtggactgggctagctggtggctgagaagatgatgtggtggttcagcgacggttgttgtgtgaggtggtggtggcaatggatggaaatcgctggcgaaagccttgcttagcacttggctggcatgacgacggcgatgccctttggcaccgtttcctttcttggaggcgtagttatggcattt

SEQ ID NO: 63393 - DNA, 780 bp, Oryza sativa
ttctgaaacgcggtaggaaagaccagcaaggatcatgtcaggagaacccagcatggttaatgcattcaaagccgacattttctaaagttctgataatgaaatgtgaactaatctccctctcatgtctatcatattgacagctttgtaattgcttttgacaggttcaaccgttgcctcacaggtctcaagactaacaaatgccgttctccaagggctataagttttgttgtcatcagtacgagcaaaaggttgatcaatagcaatggctcatctcctgttcttgcccatcctgcaactcttgctactatactgcacgaaatctgcccaagctcagctaaacatcagtataggctcctctttgacaccccagggggtaaacaactcatggatctcgccctctgctgattttgcattcggttttctggcggtagatggaaactcctcctcttacctgctcgccgtctggttcaacaagatcgctgacaagaccgtcgtctggtacgcaaggactagctccaatgggaaagatgatacaataccggtacaagtccaatctggctctgtcctcaagctcgctgatggagcactctctcttcgcgatccatctggcaatgaggtatggaatccacaagtcactgatgtgggctatgctagaatgctcgacaccgggaatttcaggcttttaggcaccgatggcgcaacaaagtgggagtcctttggtgacccttctgataccatcctacccacacaagtgctttcactggggacggcactccacag

SEQ ID NO: 63394 - DNA, 2917 bp, Oryza sativa
aaaacttatttgaccatgcaagagatactatggaagtgagctgatgaaggaacagggatcaggaggactggggattgcaactgcaccatcaagcatttgtgtcacctttagcatgttaggtcgcatgcttgggtcctcctgaaggcaccacaatgccactgtcacaaatctttccaccttcttaatattgtagatgcctcatcatcgccctctaccagcaaatcaatcctcccagaccggtagcagtcattggcccagtaagtcactatcgtctgttcctcatcgacaacctctagctcgacattcctcctacagcaaacaagctctagtagtatcactccgaagctataaacatcaaccttggtagagatcccaatgttcttgaaccactcaggtgcaacataacctcgagtaccccgaataccggtgtttgtccttgtttggtttgtcaaaagaagctttgctaggccaaagtctgaaatcttggccacaaggttgtcatcaagaaggatattctgcggctttatgtcacaatggatgatttgcttgctacattcgtcatgtaagtagagcaaacctcttgccaccccaagcgcgatatgaactcgggtgttccaatgtgggcgactattgtcgaacaaaagacggttgagagggccattggtcatgaactcataaactagcagtctttcggctccttcattacagaaaccaagcaatctaaccaaattcttgtggaatgtctgcccaatggtctcgacttctaccatgaactccttctcggtttctggttggagcttgtcaatctttttcactgcaatgttggtcttgagttcatcctccaactggccccttggtaacccccaacccacaccagaggcaccggcacctagaatctcatggaagccagccgttgccttctccagctctttgtaagtgaaggtcttcaagggtagttgggatttacttgatgcttgtgacaatgggatattcttttttgtggctattctacagtaagtaccaaaaaggaaaatggagatgagtgcaaagttcaccaatatggaggttccaagaatcaaagaactccctaggacccagtgcttcctgttcctcttccatttgttggagcttgtactgatcatggattgcgaactattgctacttggcaccttgagaagaacggtcctctggacatagtcagccatattcccatttgacaaagggagcttcttcttccagcaagtgctggtgctctgattgtacaccgccatggcgcagaagcagtcgatcacacacagccttccacaatcatcttgtcctatgggctcatatttctcatagtcagacagtggccaatccacaccataaattggtctcagctcaaactgagcaagtgccgttgcctcatccaagtcgcagctatgcggttgaaagtcttgcttacaccctttgtacttcttctgctcatcgaagaacttgtaccatggtgggcattggcagcttgcaatctgattcctggtgccatcaaaggtgcagtaactgttgaacccacagacgccactgccaacatctgaaactatggcatggcagatattctggggctgcatgctcactgctgtccatgtctcaccacctaggatgcctgcattcgctttcttcgggtacacatattgccggaaaacaccgtcagggtccagtgtggcgcgatggaagtagtctgccattgatccaattcctgcacctgatgagatgttgatctgtgtaccatctgtcagtgcaaagtataccttcccagtctcactgaataccaactctgagccatttccagtcgtgtcagtggaccaatattgctggtatttggatccagagggaacagcaacaagatacagggcaaggtttccatcagtttgcacatcaaggagaaaccgaccactggagtagtcattgatgtcgagtcgggcacggagtgacttgttgcgagtcttgttgcaaggtatcacctgagtaggcaagatggtgtctgacggcatgtcaaaggtatgccactttgtcgtgccgtctgcaccaaggagcacaaaattgccggtgtcgcgcatgctagcatatgccacactggtaacctggggattccagcccccctccccagaccggtctttcagtgagagtgcaccatcattagtgagttggagaaaagaatcagatggcacttctactatcgatggatcttggtcagtatttttggcataccagacaactgtcttatcgctaatcttgttgaaccagacggcgatgaggtagaaggaggtgttgccctctacaggtcggaagccaaatgcgaagtcgccagagggtgatagccatgaagaggcaggactctggggtgccaaagtggagcccaatgtgatgttcttctgagtttgtgcacaagttggggacagtagctgcaacagcatgggaaagagtagcagagcaaccattgttctttgcttcaggctcttgcttcctacccctgataacagctggtgagctgccaaacttgtgtagttatagagctatcctaacacttgtcatggaaaggtcttcgtcaccatggaattctacatatacttgactaatcaagcacttactggaatttgccacgcagaaagcagcaatagggaattcgtgtcacgatagcagtaaatccgtagaaattcttgtccagacaaaaacaacaggtaacagctagtgagaccaaatagaccaaggcatcaagctagtcaattctggccattagtagcaccacggggaggatttgctgtcgtcgacattcttgctgaagtagacaggcttgacaggtgttaactagctatagattgccgagaaaatgtttttctaccctacacttcagggcagaagaaatgtttgcatacattga

SEQ ID NO: 63395 - DNA, 1567 bp, Oryza sativa
cgtggagcaagatcttgaagccccaaaggtggttatgcttgattaccggcagttaccgaccttccaaccgacttaaggaggctataaaagaaggagctcactacactctaaaattacacagcaagtggagtacaactcacttacacatttaggctgagttcgggagtgagcgttgggaaccctcactcccaacatgcaaaacagagcggtgattagtgcataatttattaagtattatgtaaaataaacttgaaaaatggattaatatgatttttaaaacaactttcctatatattttttttttcaaaatgcacaccgtttagtagtttgggaaacgtgcacgccgaaaacgagaaaggtgagttgggaaaagtaggggaagaacacagtcaaagggtgtgttcgggaggaggggttgggaatccctcctccccagcacggaaaatgaagcacgtattattgcatgattaattaagtattatctattctttaaaaaaaaagattaacatgattttttaaaacaacttttatataaaaaaatttggcaaaaacaacaccgttttaccattttaaaagcgtgcatacctgccccaaatgtcggacttctatccgaaggagtgctagagatgtcgacattcttccaaggagttctagaggagtgcccaagatgtcagctctctgtctctctatctctttgatcttgtacctcgttggatgcttcttttacctaagtatttgtgatctcatttggtattaacttttcttatttaagtaagatatattctcatcattccaggttcatcgctgtacttagagtaccttaatcttatataagtgtgacatcgagattggggtaataatcaatagcgtagacatggtgttaaggctagagtttacgtttgtttgttgtgtgctccacgggttgtagaagtagatggcaggtggtaacagccatatccgtcctttgtaattctccatgttcggtacgtcatcgagctgtaggccggagtctccttggaagatcacgagtaagctggtgttcgaaacaattgatagagttttaacttaacttaattaacccataggaatccgctctttcctaagcatcccaattagttgttgtccttggttgaatcttgttcttagattacacgcacatgttccctgtgatttgatacccttggaatactctaaagtgaagtgctacttcggtatccatgttcttgcggatttatttatgactgtagcaaataccaacagcgggccactattatgttgtcgctagtcatgcattgtgcacacattattaatagatgaggggtctcgacaagccattgcgtgcaataggtgatgacatgccctcccaagcaattagagcaagtttaacagtagagccaaatattagctataagatcatattagagttagtatgtatagtagatgggctctaactttgtatttatttttcttctcctctctctttctcatgcatatacatttagtgcatttattttaatgtgtgtgaagagttagctcttggataccatcagctcgccattgttgaagc

SEQ ID NO: 63396 - DNA, 1801 bp, Oryza sativa
cctgcagcccgtaactctgattttctgatgtctttcaacctgcaggtaattctatacatggaactgtttgtaagtacttcttactgacaattcagtttagttgtgtatttgtattagattattagttgatgctataaaaacattactctctcccgaataaattagtaacgcaatttacagaaagagttaaattaatgtattactaaatggtttgtaatagaatattgagtttagtggagcaatttggtttcagaaaaagaaagtcaagcattaaccctactgaaaattgaaatttatgcaagaatagaagctggaaaggttatcataaatcaaatataccagaattgtatgttaagactggaacaactttattccgtaaagcattctacattgtagtgttaaaaagaacagatgaattgaactttgaaccattctgttttattttgtacagaatattggcaacatattcattggtcctaatgtttctctacaggcctgttgcattgagtatctgatattagagagtgataatttgtcaaagttgttccccaatgcacacctgaccattgggacatttacaataaatgcgcatatattattcgcaatcctgactactctgattgtcatgccaacaacttggcttcgcgatctcagctgtctaagcttcatttcaggtatcaacacttgtcaccggaatcctttgtttcaccaaatatatttgcaaaacttgaacttattgaatattacacacacacacaagtactctttcaaaaaaaaaaaaatagtgggccaaggatatgctgctggtatttgttactttgagtatatgtggacacacaccaaacggatgtgcaagtgtggtgtttgcgcatacatataatcgggaaaaaaaaggggtgcacaatgtgccttggatctcatcttgttcattctgttatagctggaggagtgattgcatctatagtcattgttgcttgcctgttctgggttggacttgttgatcacattgaggccaaggatgaagggacagcactgaatctcccaggaattcccattgccgttgggttgtatggctactgctactcaggtcatggagtgttccctaacatctactcttccatgaagaaacgcagccagttccctgctgttattttcacctggtaataaccctagaacaaatgtctgtgattcataagttctttaaaaaacagtgatgccaagctttgcttatgtttttttttcttgacagcattgcattatctactgttttgtttgctggtgctgcaattatgggatacataatgtttggtgaatcaacagaatctcagttcacattgaacttgccatctaatctggtagcttccaagattgccgtctggacaacggtattgttcttgtctaaattagaggaagctatgacatctagtacaatgttgacataaatgcatcacttgtatgattgagtaaaattaagttatgtatgactctttatttcagtcatctttagcattctctgtaacatctggtatagcttctaatacttaatgttgttattaggaatattgtactctactgatagtgtatactttgctttttcttgcaggtgacaaatccaataactaaatatccttactgtgttattttgtcttttttacacctattttcccacgctactttgtcattattgaacaacatgttggcagttcattacaaactaatagatagctagttcaattatacggaataagaagattttcaatttattaggttgtaaaaaagcatatttaattcaagtttctca

SEQ ID NO: 63397 - DNA, 1597 bp, Oryza sativa
agtcttggggatcaattcagatgactatgcagacaaacacaagctgcaaagatcctgtactgtttccaagtaaattatgcagtagtcttcaagctttccttaattttcttacaacaggtcaacaaggcttgaagaagaaacaattcgatcatatttgcaagaaactaatttgatcatattcacaatatgcaacagatattagtatgctctgccaggaatagatgaatacatatatgtatatagtaatccaggtaatggaacaatctgaagattaaatggatcttataatttagactgatctgtctagttcaaagagttcaaggatattcattaattacgcgtcgctattcaccaattcaatctggatttttcagtgggaactaattagcattctttttgtatatgcaagaaccaaaatcccataatttcaatattcaagctcattttttttggaaatatgccatttaataaacatgaataccatctcttgcaggtactgctatgtgtattcatcattgttgttgggctctgctgtgctggtgtgggcacatactcatctttatctaagataatccaaaactacaagtgaatgcatgcttttctagcatcattgtttctactagaagaaatgttttctgcaagtttcatgtaaagttatatatatatttatatagtatgtaatctcaaaggtgtattagtctgaggtgctttgcaaaagggaggacattagggtgaaccccaccttggttttctttgtgtaagttttgttagtcatggtaaggttggcatattcaattttgacatgcatcattttttggtatccatgactgtccatttcgtgtgtgtcattctccagtcgagtgtcaagtaacttctttacagggggcaatgttacatgagatattctaagtgttgccattaaccttattccatgttttgccatcgacgaatgttagtcccacaaaatgccatcacaagttaatttatctaaaaaataccatcgccattaggcttccatggattcaactcttgtcaggacacctgggctagatattgagtaggctactaagtatgacaacatgaaatatttagttggatgggatattaaattaaacctaaataataatagtagtaaccatccaacctcatcgttgatctagcatgcgaaacaccaaacacaacataaaacccaaagcaccgagtagtgagcacaggagatcttcgatggaatagcccgacagtcaacttcaacttaaaatatgcccatcaaactactcgaaggtgacgaccaaatgtattacatcaggggacttgactcatatcgctaaatttcacgaccatctcaattgctcaaaactctaacttgtgatcggctagtctcaggaggttgctagcttcacactgttatcttagccaagatatcagaaacatgaaggcacgaattaaagtaacttaagaatagctagaaacattggtctaaatcatctatatgcagttgaccggtcaatagaagttcagcggaaaacctgcctgcccttaccacacaggcaaaccgactagggatagacacctagtaagaactatcctaaagatccat

SEQ ID NO: 63398 - DNA, 1038 bp, Oryza sativa
tttcccggcacggtggggggatgcataaaaaaaattcggaatatcaaagtacctcttaaaattaggatctttgtgtggttactactgagaaacaacgtgttaactaaagataattttaagaaaagaggatagaaaaaagggactgaaactttccagttctgtgataaaaaagagacaatacaacatctgtttttttactgccccatgactttacttgaaatgtggtggcttgtgctttcgatttgaaacctgtgagaaatattcaacatacttttggtatatggacaacactgtgacaaagatacaaaacaactccgtcctgttagtgggggtagttgctgtgacgtggtcgatttggaaagcaaggaataaggcgtgctttgaacaaactagaagaacagttaggttaaaagaacaggtgaaaattagaaaagtcaaataagtatttagaaacaaaatctaagaaagcaggcatacatgaaaattatcgtcagaggtaagcacacacagtgctgtctggactgcgtatacgcagagacattgcatgacatttccatgttcattgaccccagtgctaaccgaactaaacaagctgaaataggaagcctgggttttctttggtagctagtatgtacatacaaactgcacttatgctggatcatatttacagtagaatagtgaccatgctgcctgcaaaacaaacatatataaattgttataagtattcagtagcactatagctgtaaaaatggaccgtttttttaaaaaaaaactatatataaagcacccactataccaacagagggatgcagtgaattacttttctttcttggttacagccttgggcttctgagtgtaacccgaagtggcatgggtgcggaataaagcaaataacataattaactatagtcatttaaaaatagaagttctcaaccagatacgttcaaagagtaaagtgtaatgacactatatttttctttctttcctccattaggcacaacagcttctcctacggaacgcaagagttaatgtgctata

SEQ ID NO: 63399 - DNA, 2110 bp, Oryza sativa
taatataaatgtgacacatactagtacaatgaatctggacagacccataatataagagatttttggtagatatgacacatgtcacgaccggaaataacccaacgggtgttccatatgtgcgtgtattattccttgtcctaggaggcaaggtacaccaaaagttgatacaattcagagtttaatcaagcggaagcgtaaatagttaattattacatgggcaacgagggcccagcacacacgaagacaacgaaaaacagcggaagactagggcgacgaccacaggcgcttgacggcaggcacgagctaaacaccaaagccttcatcatccaggagctcctcttctgggtttgggaaaaattgagcaagactgagtacaaccaccgtactcaacaagacacactcacaagtgcaacataaatgcaaaggagtacaatggagttatagtataggggttaggttttgcaataaacagcatttaaaagactcttagttgctcaaagccaaatttaaaacacgatcctagaactatttaatattattaaacaaggccgtgaacccacacgaacctgccttaacccaaggcctacgatgattcagaccgaaccggcaacccgaccctgggtcccagctcgtcccaagccaacccaggccaaccattccacattttagttattaagcaggttttaagaattaaaaacactaacttgggtacattgctaggcttgcccataaccgagggcgcggctattcgaataggttttactctgatcagaggtgtacatctttacccacaagacacgtcttcctcatgtgcaaccacgtgccacataccaccacggcatatggacggaagacatgacatagtttccaacccatcctagccatagacaagagtaccgacccaaccccacctactgacggaacctccgggacaggtaggtaggactgagcccctagcagcaggacaccagccttgtgccatgacatctcgactaccgggccgcagctcgtgtagccttcatttgtcctagagatgtccatcgacccccgacttcgtccatctccatccgtgtacttttgtttataaccagactgagccacaaactaagccttacccactatacatgtggaagtacggtagtgctttgcaacagaggcccgaagaccggtccttatgtggccgaggtgctactatcaaaaccatgcaccccaagcccagcctataaccattttgagagttttgaatagagggagaggtgtgcatccaattccacaatagtccaaccattccataaagtccaagagatatgaatattcccaaagtctaaagttataaaaaccacctaatgttgtcttattaatcagcgaagcatctatctaaattcatactaggggaaccatgagtagagcgcccactagttggggttttgtttattctagggtgaacaaagtaataataacaataacaaaaataaggtcataacaaaggtaaataggcatggctaaataaaacagtgataacgcgagaatttaaataaagcgataatgcattaatttaaatcaaaataatttcataaagtgggatccaatatgttcaaagatgatatgacttgccttgctcgctttcccaaacgtcggcttcaacctccacgaagagcggatcttccgaagctgcagcgtctacacgaccaacggaaaagaaaaaggcttttactctaataaacttcatataacaaacaggaacaaagcacaaaaatgggttcttgacttcttaaggaaaaattagagacttgaacggtccaattccgagttcaaatggccaaagtatggccatttgaagtttatatgctctttaaatgaatatttacgaatttcttcatttaaattttaatttaaaaatggtttattgcgtcagccgagggggagaggtgcgaggaccgggtccacgggagtggggcccacgcggcagcctcacggtccacggtggaccgggtgcacccgggctcacaccggccggcgccgtgggccccacgcgtcagccgtacccgagggcgcgggcggctgacggccgggccccacgcggcagccgctcggcgcgcccgaaggcggc

SEQ ID NO: 63400 - DNA, 720 bp, Oryza sativa
cgctcctgcgttgacagcacttgtggacagatggaggcctgagacacacagcttccacctccccagtggtgagatgaccatcactctacaggatgtggctatgatcttggccctcccattacgggggcatgccgtgacgggcaggacagatactcctggatggcatgcacaagtgcagcagctgtttggcattccactgaacattgagcaggggcaaggggggaagaagaagcagaatggaatacccctgtcttggctgagtcagaacttctcacatcttgacgacgatgctgagccatggcgtgttgagtgttatgcccgtgcatacatcttgcacttgttgggagaggttctgtttcctgatgctgggggtgacattgcttcggcgatatggattcctttggtcgccaaccttggtgatctgggccgtttcagttgggggtcagcagtgttggcgtggacatatagacagctctgtgaggcctgttgtcgtcaggcaccatcatccaacatgagtggttgtgtgctattgattcagatgtggatgtggttaagactaccggttggaaggcctaagtggaggcaaagcttcactccttggccctacaatgagccagacatggagaagacagtggcctacctttttgagagtactgccactgcacatgctcaccgggatgtggcatacaagcattatgtcaatgagatggactgcttgca

SEQ ID NO: 63401 - DNA, 1055 bp, Oryza sativa
  unsure (1)..(1055): unsure at all n locations
caatacaatacaatctgtacatatatggcaaagtattcctaatacccacccgcagtcgcagcgagaggctcacggatgcaaaggctggaccgaaaatctgtaaataactgcactggcaagcctttggtcatgatatcggcgaactggtgtgtagacggaacatggagcacacggacctatcccagagccaccttttcccgaacaaaaaggatgtcgatctcaatgtgcttggtgcggcaatggtgaaccgggttggtggtcatgtagacagcactgacattgtcgcagaagacaacagtcgcagtggagatgggagcatgcaactcctggagtagctggtggagccaacattactcggcaaccgcgtgagcaacggcacgatacttcgcttcggcactggagcatgagaccgtcgtctgtcgcttggaggactaagacaccaggttatcgccgaggaagatgtagtagccggaggtggagcgacgagagtcggggcagctggcccagtcggcgtcggagtagtcagtcagagaaccgaccggacggtgccgatgtggaggccggcagagagtgagcccttgatgtagcgcaggatgcgtttaaccaaggcgaggtgaggctcgcgagggtcatgcatgaagagacctgttgaacgacataggcgatctcaggacgggtgagagtgagatactggagcgcaccggcgaggctcctgtactcagtaggatcggcgacgggggcaccctcctaggcggagagcttggcgcgagcatcaaccgggttggcagttgggtggcattcaaacatgccggctcgctgcagaagatcgatggcgtactgtcgctgggacaggaagaggccgtcggggccatgatgccgaaggcctgccctgaaaagtgaccttccaaaaaagccagctccctaacgacctgngttcggcctaggataaccttggaagctgaatatgaagtggaaagacacaaccagccctatacatgtccatatctacaagataagcatgtaaaaacctatatacttggatttgtagttagagc

SEQ ID NO: 63402 - DNA, 3571 bp, Oryza sativa
acagagtcaccgtccatctggtctcttctctgtttcaatgagatcaaaaggagatggtggtggttgctggattggggaatttcacagggatggggaggagagtttgaggattgccgtttggcccatagtgagcgaactaaagtttgtaaaataatctgcttgtttgtttttgtatatttgatttgcaatttattgttgatgtgcatttgttttcagtttttttttttataaaaacatccatccatgttcttgggtgtttgctcctgtgttttccagatacatagatcgcagcccttctgcccaggtattttagttttgggttccattttgactccgcgtataccgccataaattcttcgctgtcaaagaattaactgctgccctgtgcatgtatgagattgactctcatttcggttggatattaattaatgtgcatggctcagaggagctaaaggattggctgatgagctatttagtccaatacaacaacaccaattccagacttacgttttgtttgatgtttatgcattggttatttgaatttgaatttatttcgtttgttgtaggatcattttggaaattctgagtcattatctaatggagcaccaggcctccaccttaatggtacgagagagtttaatggacagcaatttggaccaacccgggttcatagtgttggcgctatgctggatcactctgcagttaatgttggttccccatggatacagaccaaaacagatgatgctgactttcataggcatgccgagaatcgcttcatgccaaacatgggaaagatgaatgcttttgctagaagggaccttcagtccacctatctctctgactctgatctttcaaatgctttatctagggtgaacttgtctaatcatttagaatatgatgaaaggggccttgccaaagacctgcttgatgaaatggaaatgcgtaatcacgacaggcatttttcctctaagattgccaatgactgccgttctcctttatctggcaatgctttgtgtacgcttggttgtgagcacttggatgttcattcactaccttcatatggagatggtcttctacgcaggcagaacagtattatggatagtccctatgtttcaaggaataataaccatcacatgaagaatgtggatcgcctatctcttgctgatcaactagctttgatgcagctaagcaatcttgacgagaataattaccatagcaatgcagatatggtaaatataatcaaccccttgagaaacagacgcaacatcacagacttggacttaatcaggagtaggaaccatttccttgaagaacttattgcacagcgttgtttgcaggaagataatgtctttcagtcaaaatctggtccctcatataatgacaacatactatatcatgatggacctcgttttccatattcaagaatgcaaagatcagggtcccatgcttattcacatttgaggggcattccatatcttggtgatcagcaatcgcggatgttatcctctagtaggaggacacctggtagaaatatgggatcacaaatctaccaagataatcctgtagcaaactgcctggatctgtcttctttggatcttgcaaatagaagtgttgcttgtcccttggagcttgttaatgtagtgggccatgttatggaagttaggtacatttctcttccattctcctgttgtagattttcaactttaatgctttgtcacattatctacttcttattttaatgcagtatggatcaatttggaagtcgttttattcaacaaaaactagagggttgcctcagctgatgacaggggaaaaatctttccagaggatactgaccaatgctattgctctgacaactgatgtatttggcaattatgtgattcagaaggtacgcctatctgtcctgctaatttgattactcatatttatattttgaaacctaacattcagaattgtacatttgcagttttttgagtttgctacagaaagccagttaagccagttagcagatcagctcagaggtcactttttgcaactcagctttcagatgtatggttgcagagttgttcagaaggtaagttatctttttttttcttggggttcatgtaaatctgtaacccatgcaaactctacaagtttataatcaatttcctacaagtttattgtggacagcagtgtagtctcctaaagtaaatctgttagtaatgtacaaaaaagaattttaatgtacacaaaaataatttgagtggaagcctgaaccaagattaaatcatccgctgcttttaacactcaatcttatctcactactagcattgagctaatgtgtaaaagctacaattgatgacaaatgatttaccatttatgatttttctaattgttatgtggcaaatcattttttcatggtggctgacaagagataatgaatctctgtttattaaaaaaaatgaacatgctttgttctttgtttgcgttatgagcgttatgtcttcaccaaaagtccatgcatggaatgccaccttaactaaaattggtgtcactctgtcagcattatgagtgagacattgatgaggcacgagtcatttcactttagaggtgcttgattggaattttatccatgcatttgccacaggtcattgatgtggttgacttggagagaaagatatctattgttggtgagcttaagaattctgttctcagtgtatttctgatcagaatggtaaccacgtaatccagaagtgcatagagtgtgttccagaagatcacattccatttgtaattgggatatacttcagaaaatttatccgctttgcactcaccaatatggctgcagagttattcaggtacaaattgcaaccttctgtttcctaagcattaaattctgtaactttaaatggtagtttctaaccttatctttgcagagagttttggagcattgccataatccagcaactcaaagtgctgtgatggatgaaattgtcgaacgtgcttttgatttgacagaagataaatttggaaactatgttgttcaagtaggttaacatattccatttatttattcacttgctgcaattgtcaaacttttgacttaaccctgtataaaaatagttacactgccttgatcattaaaaaacctagtagtttacagatattgtggataaaattagtaaaataaattatgtgtgtggagccagggttcaaacttttgttggatgtggctggttgccagcggttactaggattaccacatttcttctatgtattagggctatttttatctccatttgaaatggttacatataaatacaacagtaacctcctgaaatacgatatattcttcatactctggaaacaatcattaactgattaactgagtactttgacaccagcggattatcattttacctactgggaattaaaatatataaaacagcaccagcttatgatgttcctgggctcaattaacttgtaaatgtttcttgttattattttaaataagttgatacattgcagcatggtaaaaagaatgttatatcttttaggcccagtttggaatgtagtattattttttttc

SEQ ID NO: 63403 - DNA, 1993 bp, Oryza sativa
ttaaacatatagacctccaaattacagtttcacatagatgattttgtttccttccttctattcataaattttttgacaatgtcccatgtggcatttaatttaatcagaataaaacctcttatgaaacctgcactaaaaatggcctaatatatgttttagccatttctaccacgcaaagtcagtgctccattcaaggggagctaggacacattgactaatgatgtctgtctgtatttaatttaatcagaatgaaactcttatgaaaccatggtagcaacatatattttgaacatttaactggtcaattggaatcagtacttcctgagtcctttccaagcttgcgttgcagaagtcttcaagtcccccaggtccacgttaggtcaagacggtttagtccctagccattctagtcttaaaacaatttagtccctcgtcagttcgaaaaaccctatttgccaccctgcgaaagaaatctaagtcaccacaccttgttctccatcctcgcagccacccaagcacactgtatgtttgtgacaggcttgaagaagacggcagcatggctatcttcttcgtttttctcctccaccccttccctctcaatgacttagggatccttggatccgaagtctctggcgccagccacagttccaatgcagtgtcgaggaggacggttgtgactttgacattggtgcggcaaggtatcatcaatcatggttttggcattactgacaactccgactttagccatggctctggcatctctggtgtgtttgtgacaaggccatgtcggtcatggctctagcatatccggcgacgataaggcattccggcatggcacggtagagatatcctctccctgtcatttgctgcattgtcatccgagcacgacagtagcaggttgcaaaggcattgcctagcttcttgtgcgatagacaaaggatatgggggcacccagatctcaccaagaacggtatgacttcgccgacaaaagttgcgctggtagctaatggcagtgcaacaagggcgtcatgccttgatctagccttgactgccatcaccttgtagctaatcctcatgacagcattttcatcaatagttaagggcttccacaccaacttgtagagcaatgtcattttagctataatttatggtattatctacaccctcatatcattcattcttcatggatcatacggattgcggaaatgtgtattggcttgactgcaacacaataattgtatggtagcatgtctagagaagattgcagactgtcacaccctgaagttttctctttttctagccttaattcaattaataaattgcctcaagaaataattcaatttaacctcgagctaaacccaaattaataaatgcaattaataattggaaatagcatggtgggatttttcttgagttccccatgtttaaatacattaagaggattattagtggaattttctgagcaaagaaaataattttaataattaaaatcaattattgaaattaaattaaaagttaacctccttttatctctcttttcggctgtgggccattttcagcccactcctccgcgcacacgctctctcctttgggtcggcccgtagccacagcccagctacagccgccgcgccccatctctccctaggtgtaaacatccctccttccaaaaccgcgtagctagcctatcccacttatacataccactccacttacacttttcattctcacatcgtgtaaaagggttatctcgagagtgatatggttgaagggacaagcccttataagttagttccactcttgctaaactagcaaggtggtactaaacatacgtatacaatgctcatgggccacacatgcctcatcctaattgggccaggatgttacatacacccccccaaggacctgatgccccgttgacacaacttacccagatagccacacatgcacattgggaaatgtccaggaacacactccccccttagcacacgtccag

SEQ ID NO: 63404 - DNA, 2174 bp, Oryza sativa
gtaaaagggttaacccaggagtgatatggttggaaggacaagcccttataagttggttccactcttgctaaactagcaaggtggtactaaacgagcgcacacaacactcataggtcacaaaggtctcatcctaattgggccaggatatcacactgggtcgccgtcaggtaggaccactgttgggcccatcttcaaccttcgcaggcaaagccagagggcgtaaccgccgccccgtgcgccccgtccacctcgcggcgcccactttgcacatgtcgccctcttccacgcccccgcaccccactctccccacgcttcgtgcttgtggagggcgtggtattcgattttcgaatcccggccacatctctctctctcctctcccacatccgctacaaaatccaccccctaccggccaagtctgagctcccaccgctatataaacgatcctcgtgatcccctcctccctttccctcttctgccgctcgttcccgtctttctcgaagtggttgtagaggttcaagtagcgcggagcaaggcaagccatgcatccctcattgaacatattatacctatattgcaaatgtctcgctttcttattttataatgtcagaattatccgttataacataagggtatatggttttattttaaattttaaattgaaaaggttaaaaaaaataataagaaactaaccactccagcttgtgtggcaacttgagagaagaggattgagattttagacatcaattctagaaattgatggtcagattaacatgggaatttgatttttagtcccaatcttttgtttgttagaggtggtaaaatttcattgagaatttagttagagactagataaatcttaaatgaaaatagatggttaagttttgtttaggtaaattaaaagaggaatttcctccgaattaccacccatgcccacgtatattttgaaacagtaaatttttaatggcatgattataattaaccctattaaaaatgtcactcaattccctatccccgtcttacgaaaaactctcgtctcccctaatcaaactgaacattttatagccacatcccacaactccccctaacctaaggaccgttcgtgcgcgttcggctattttctgcccttcctcgtatccatctgcgacattacccaccgcgcacggcggcgacacggcagtggccggccggggtactgggcttcagcggctacagcctatgggagtttctgggcgctggccgcggccgccggaccggtggtctcctgacgcgcttccacaaggtccgggtgccatatgattgttgcaattgatgttttcacccattttttttttctcaaaatattaattgcgcgtcaggtagggtagaattcgctatgtgggaatcgatttaatgccgaataaattactcttgtacaagtagaatcgcatttggttaatttggtgcgtcgtctcatctactgaggggatttagagggtcagcctaacgggattgtggaggatttgatttttctttttgttgttggcatacgatgaatcgaggtgctagttttatgttcgtggatttgtttgagtgtgtcctcttaagagagcctaacaatgcctattaactgaagatagacttttgcttttatgcagaatttatctagctaagtcaatattggtagtgaagtttattttcccttttttccctcctggaaaatgcaagtgtagttttgaagatgtggattgtggaatatgctggttgctagaacagttttttgccacattttggttgtcaataagagaagtttgtcccttgtgatgagaacaaacatatagcccttagagaatgaaatttgtagctctaaaaaaaaaagaacgaaatttgtcagtcttgatcaccttggaaatttccatactagactgaataaatccctactgttcttcgtgatactttgagtctacagatatatggcacagtgcagtttcctggtagatgtcacatgaagtaaaaacgttgaataccataagtccagaacttgtgaggctgaggctgtacttctcaaatgcaattactacctgtcacgccctaaaaatcgcctaaattaaaaatgcatattttaaattatttttagaaattattttaaaagcctacaagctaaaccctaattttctaggaaaattttcaacataaaa

SEQ ID NO: 63405 - DNA, 1149 bp, Oryza sativa
ccccgtgcagatactctagaggatgtagttccgaaggcctgctcgtccaaaagacccgcgcgcgtaggattttcgaattggggataaacaagaagaaagaagagaaatgggggttgaaaaaaataaaatccccaaaattatggaaaataatatcagaagaaaaatcattttaaaaaattaaaattcagcgggatatgcatttgttcgatcctgagtggttttatgtaattaactttgacttttttttttgcgaggcagcaccaattaggtatttcgacattttttttgcgagaccccattgttacaatgaaaaaagaaattaaatatctatcagcaaaaagaaaaataagatgcactgtatcttggattaccgcaggagatacgagtagatgagtagtacagccgcagagctaaccaactcagacatgcacaaaagtaaataatatggatccatatcttttaaacatgttgcttgaaagaaattgtacaaatttgacgcactcggacaagagacggtgggtttcctctggcatataaacaacatcacgtttgtactgtgtttttttttaaaatatatataaatagacaggaaactatcaaagagcggttgtagtgaaccgacccttggtgtgggtatcatgagtcgactttccaagttttctatacctttaataatagggccaattacacaaatgccactagggtttaccgtatttgtcattctgccactggtttttggtcaattggtagaatgccactggtttcacagttgggcacgccaaaatggcactctgtcgttaggatcaaataattctgttagtcaacacgtttgactggggtaattaccattctgcccttgttctctaggacgcagctacaactccctactcatcagaaaccgccgtcgacgcccatgaatggatcgatctagggttcatattactctgtctcaaaatgtagctatttctagcacaataccttgtcccaaaatgaaactatttatccacctacctcctcatctcgaccaatcacaaccattctcctccacctactttttcttttcaaccaatcacacatttcctcctatcattctcacctaatttcttatattttgggacgaaggaaacttcctccaatcagtctcaccta

SEQ ID NO: 63406 - DNA, 3044 bp, Oryza sativa
tatcattaccctcgattattgtttggcaaaatttgctatatgatatctaaaatttgtgtaattggttggagaacactgaaggcactattttataatttttggagaaaaagtggacaaacattttgagtttaaagttttcaatttccaaatgaaggttttgaaatttgagttgaatgtttttggagttcaaattaaaagtgttgaaatttggttgttttttcaattttgagtttaaagtttgaaatttttcactaaaaaattcccaatttccttttcagatttgagtttgatacactccgtaaaaaataatgtgcgtcattgaaaaaagaaaatcatgtcgcaattcacattgcctatactgtcctcaccaagatcgagtcggtgtttgtaccgcgttcctgttcctcgtagttctatgcataacagtgcaagccattttctcctgtaaaatcaaagtgtaaaatcaaagtgtgtttgattgttattctgtgatgaacaattggcatatgagattattgattttgatatttggagatcattgacgaagtggttttggagatgattgatttgcaggtgatgaacagagactgttgctgacaggtagtgaccggtcaggccgggttgttgtagtcagtcagaccagaggtatgtgtgcggttagaccagctagctcgtggcttgaccggccggctctgtaccggtttcggtttagggttgattctttggatatccatggacaatcaatgtttattctagatggatactatgcatatgtaatactgttgttcgctaacaatgagtcaaattggtgagaacttgtgctcggatattgtttcttggttgatgcgtttgtaggtggtcttgatgcctcgggagagtgttgccggtgatggatcgggagtcaacttgggataagatgacgtccggacgatcagaatatcacgtgggatatttaagctaaagatcaatacacgtggttgtgtgtatgggatacatagccgaatttagagggagtccaaatttggttcaattggagtttgtaaagtttgtttcttgtacggaaaggtttcttaggggattatgacttcttgtacaaggttggtctgtggctttaggctgcttacgttgggtataaatggagaaggagggtgtgtcattctggtatcatttttgatagagttgcgttgagataagataggcatatttgtaatctctatacatccaaaacttaaatgaagagcttgtcttttcgtttggcaatatttgattcaactcctgttcgagagagtttatagtagctatagcttctcttagaaactccagctgtcagacattccccaaagagttatttttaaccagattctgataatttgttgatgtagaatccatataatgaactagaagccaaaagatgagaaacccaactttctagatcttaccaacagcttatcagaatcttaagttcccaaaaacatgatttaaattgttgactctatccaaacattcatcttaatacttctgggttatgcagacttttggataaaacgagtaacatagttaatggacgaaaattaaaccatggccattggtaagggaagaaatagactttggttaaaattaagaaaagagaagagctcattattgggcggggctgagtcttttgacgcagctttagaatctatcgagctttggtctacttttctttttctagccagacaaatcattaaataaaatgaaaacgtactactgtgcaaaatcaccgttaaaacaccaccaacaccaaagaaaacgaaataagaaaatactttccctattattatatacatcctgagtttaactcggtaagacgggtaagtctcaagtgagtacgccaagactgtgaagagcttttccttcccacgcatagtagtagccatagtcgatacagcaaaagattagcatgagcctcacttcaggagacatatccagattaaaattgtggcaagaaagcaaataattcagaagttaataagaacaaataaatgtaaagcgagaggtattcaggtttttttgccaaaatgaatacggcgaatagcttcctgagaacgtcgaaacttctgattcacatctatcatctgactcgtctcagctggcatacttcattgaagggcctagctaacaaactaaactgccttctcagcgactcaacagatcagagacataagaaaggattaaacgacacgctttgccaactgacagctcaaacaaatgtacagctgatacccatcagtaaacttgtacatggccaaaaaacagatttacagcggcgatacctaacactcatctaattaccttttaagtacccggagagatctatacaggccacagtaaaaaagaagagaacacatccagtctccaccaggacacccctattggctattacagtgtatctcaaaacaaaaatctccacatttgtcaattcaccagatttgcttattgatgccaatgcttaaaaaggattagcgtcaacatctgtacagcttagtgactgctgacattggctagtcttggaccccatccgcactcggttttctgaaaatcaaggagaaacgttagaagttggaaagatttcggtcccgattgcatgtcacgataaacaaacttatccgctcacctcctgtaatgattaacttctccacacgcgcaactatatgcttcccgaaagtgtagttcttcagttcgttcaaatgcatcttgatgcttgagaggatcacaactaggaatttgtcatcacatgtctgaaggattctctgtacaacataattgccaaactgatccttcatcagtccctgcatagattggtcaaaatgtgttattacaatcactgaaaaatcattgtgcatcaagacattgtcatacagtactagtacaaatacagtgaacattatattaaaacccagtgccatactgccatgtgttctgtatgaacaataaatcctaaaggctcttgtgcacttacttgacatacaaaatgaaactaaacacaataaatacagcattgatgt

SEQ ID NO: 63407 - DNA, 710 bp, Oryza sativa
gtcacagagaggggtggtataacgcgtggtggtgttagattcggcgcaagagccttcaaagttgaaggtgaggggaactcatgttcttgccaaaggccattgctctaccatatgccttgctcacatcttatacacgtttatctgattcatgcaattgataaggaatctcccaaccgaatgccgtatcagttctcttcaagagccgttgtgaacacatgggcaagtcgctttgagccatacctcgaccccacacagtggccatcgtacgatggtgaagaatttgttgctgacccaaatttgaagattaaaacaagagggaagaggagatcgaaacgattcaagaacgaaatggactcaggtctgggtggttctggaaggaaaccaccttcatgcgttcaacttgatgctgcgccggtgcaaaatagatgctcgttgtgtcaccaggagggtcacaagaaaactaagtgtcctaagcgtccaaaaaagaagaagtccaaaaaaaatttaagtgttagggaggtaaatattttgttttcctactcatgttctcgcattcattttcttttaatatatgtcacattggtaactaacggtgaatttattactttttcatgtaggatggccgaggagggacaaccgccgacttacccagccttggaggcgtactacgaggcccgtcatcgcggggctgcgatcgaggcggggagggt

SEQ ID NO: 63408 - DNA, 1886 bp, Oryza sativa
ccgcagtcctccggcgccgccatcacggggaagggtaccgttgctgccgacataatcctcggttgcttggcgtttctgatcatattggccgccgcgaccagtcttctgctgcactggcacatgagaagaattaacaacaacgaccatgacattgtgagacacttcaccaagaaggagctccaccgagccaccaatggctttcaaaggttgctaggaagaggaggcttcggggaggtctaccatggggtggccaagtcgctacacccacctgacatcgcggtgaagaagctcgtcacctccaacgagtacagcgagagggagttcgcgaacgaggtgcagtccatcgggcggattcaccaccggaacctggtccgcatgttgggatactgtaaggagagggagcagcggatgctggtattcgagttcatgccgggcggctcccttcggagcttcctcttccagaccccacggccgccgtggagctggcgtgccgaggccgcactcggtatcgccaaggggatcgagtacctacacgaagggtgcaccttaccgatcatccactgcgatatcaagcccgacaacatattgttggatgataggaacaatccaaagattaccgactttgggatcgccaggctcctcggtgaccagcagatgtacacgacggtgaccaatgtgagaggaaccagagggtacattgcccctgagtggttccacagcgagaggcgcatcgacaccaaggtggacgtgtatagcttcggcgtcgtgctgctggagatgatatgctgcaggaggtgccaagacccagtaaccagccgtggcgagggcggtgacgatcatgacaactccgtggtcacactgtttggatgggcaagccagttggtcaaccatggcagagtcgaggttatcctgcatagcgatgacgacgctgtggaggatctggagagagtggagcggttcgttcgtgtggctttcttgtgtatcgagacgaatccgtcgcttcggccgatgatgcatcaggtggtgcagatgctggagggtgtggttgaggtccacgcgatgcctcatcttccgagctctatagatacattaccgtccatctctaaggattcacgtactcccaggttcttcttctccagttgaactcgatttgatttctcacaagaacgtactgcagccttcatctcatggcttcacttatttctgataccataccgtgactagtctcagcctatgtgaacatagaaggcaagcaaaagcatacactgtgtgaaatcttactactttgatatgcgcttcatattctgtgtatttaagtttgtttttttttttgagcatttacggttttatggtgtggtaaacaagacacgtcgttgtaataaataacagccgcatacatcaaactagatgatacccatgcgttgctgtgggaatttgtgcatataatttgtatatgactttttaagatatattagtaagggcaatgaaaatattgaacaaaatgtcaagtaatgttgattgtaatacggtaaattatagcatgtactattcgtatgatttaagtaaatgcatgcagtaacagaaaaacatgtaattgtgtaatattgtaaagtataagacagtagttgaaatgtaggagggatactaattcctatctttttctttataaaaaaatatgtttgtttgtgatgctgcaaacctgactaaattgtacgaagattgttactgtttttttatcggccattcattgttgatagttatacaacacaaattggactttcggttctttaattgcatccatgtatcttctttggatcttctcatggaactagcatagtaatcaacatcatctagtgttttgcctggaatcctgaaggaaatagttg

SEQ ID NO: 63409 - DNA, 11311 bp, Oryza sativa
attcctgcagcccgtaacagtagtaagtgctggccattatattcctaggattaagactgagcatactcagtagcttttcaccttgcctggccaaattgatcgacctttttctatcaacttgtgccatgataagattgcttttactgccacttgctagagaaacggacgcagagtgaggagaatcgacggaagggggaaaagggaggggggagcgggacgacggcgcttggctcctgccctgctatgcgcgtcaaacgtggaaacgaccgggggagcaggaagtgatatgtatcgtttggaagttgggctcactttggcttggcccgttagacgaagacatcaggctttcaggtgttagctggacggaaaaagtacaccgaaggtccctcaacatcgagttacaaaatcatccttcaaccacaaaaccagatatatgacattcttcaacttacaaaaccgttcactttaggtcctccgacgtggcggctgagtcaatgtaggacccgcgtggaccccatatgtcagactgtccacgtcagccacttcttaccctcccccctcaactcacttcgtctctcctcccctctccacggacggtggccggtggagagcagccagggcacggcaggatggtgcggcaggcatggtcgccagtgcagaggagcacgttgcggtcgggcgccgccatggcctgccttgtctccgccgcgcttcgtccccgctatggcctcccttgtctcctcgccccaagggtcggcagcgagcacgactccgcgacgcggtgtgccccatcaaaggcctcccggccgaccagatcggcggatgcaagcggggaggggcgttagtggcgggaccataggggcagagcgaaggggagttggaggtgagcagcggtggcgaggcagaggaggaggacgccactctgattaaactcccatctagggtgaggaaggagcagaagacgaagacggcggcagcgggagggaggtggggatggaggcggcgaggagggaattggccggccgacacgctgtcgccaccgccgtcgttgtccttcctgcccttgctcatccgtgaggctgtccccaacgagccgccgctccagccgtcctcccccatccccgtaccaggcctaattaagccgtcattagcacatgtgggttactgtagcacttaaggctaatcatggactaattaggctcaaacgattcgtctcgcgacttacatgcaaactgtgtaattagtttttgtttttatctatatttaatgctccatacatatgttaaaagatttgatgtgatgtttttggaaaaaaaaaattttggaaactaaactgggtctcagaccgttgggattgggacaagaccggtcagatcgccattgcgccgccggtcatatactggtagttaagttgtggtccgaccggtcgtggcccagtcagaccttcacatgactagtagtctgacaggccttggtgtaaggctctgaatatttccaaatttaactcaaaatcgttctatattgagactgatgctaaatttggttgccgacaaatgccgagcggttaggaggtagtggggagacaacgaaggtgaggcaggacaggggagtctcgtcgccatgggagaacgacaagacagagaagaaggtcagcaaggttgctcgagaaagaagatgatctgatggtggagataaaagtgactgacaatcccacattcccactgggtgaaggcggtcttgcagccctctgaagttacgggagaattgttcagttatctccgtttggtccaatgcgttgttcattgggttgccatgagtcaaacaactgaacaaggtgaaagcgtatttaactgtagaatctgatagcaaagatgtgtacatataatttgaagaggtagaaactcaaaagggaaaagcaaaaaaaaaaaaggaaaactaataaaatgtatgatcacgatcaatgaaaaaaagacacagggcagtacttaggacttgtagcacaaaccgaggaacaactactaagattggagaaaatatataaataataaaccaaattgtgcccagtgatcagcctggtatgttcttcaactgcctgagttgtacataggttggttctatttaaaagatgagttctgcccactgtgatctccatgaagctctccaatcatgcaaggagtataaacaaatgactcatatataccatttgtatagtttcggtagtaacactttgggcgtgagtagcccagatattggaccttcgagctatccaaatgataggctactgttctgaatgtttcatccaagaaaatagcttccttataaggatgaaatccaagaatatctaagtgtgcataatcatgtactgattacttggtacttgtcatttgacagtgaaaacctgaaaaagaaaagatgagtcaatttacaacatataagtaattcatatgatatcttacaagttattaaaatattcagcgtatagaataacgtgagcataaacaaggataataaacacatccaacttgtatgtgcagtagtagcagtactgaagctaaatttgctaatcattaagcttccatagcatagcatttgtgtcctttactgaaaattatgaacactacctgattttggttgcaactgaaataacttctgtaagagtgctagcaggtttcaaatttcgaaagaagggtttctgccggaggggagcgaaataaccgaaatttcggatttttttctcgtaccaaaatatatactctcaccgtcccaaaatataacatgctagagcttagatgggatcctacgaatctagacaggctctgatacatctaatccggtcctaagttgctgaagatggattagaatctctctagtggacatcctaagttgctatatattttaggatcagtaaatgaaccaaatgtgaaataagaaacgagggcccaaggcgtgatctgctggcgatgaacttacctggtaacagaagtaccacgagaatgcacatacagtgctccctgccaggacacgctgtaccggtgtacccttggcgagggccttcaagaggacactcccatggttccatgtcatccaccgtcgtcgtcgccgccgccgtctcaccgccttccctgacgaaggccctctcctcccaccgcccgctcctcgacgagaacacgtacaccttgtacggcgacggcggccattccatcaaacggtacaggtcagcatcacccatggaggacgccggtggagatggtggcggcggcggctccacctcctccatagtccagcaggcgccgtccagcgatgcgagcagcgaatccaggcagaacggcggcgcggtgattgctttcgccttctgctttggtggtggcggcgggggcttctccggcaagccggggatcaagaacacctcgtagtgcggcggcgacgcggccgccggatcgaacgcgaggtacgcgccgccggtgccgtagcggatcggcttcggcgactccgggcatcggggcagcgtcgcccaccgccgcgtcgccgggttgcagacgcagagacgattcccccactcgacggcgcagaggaggaggccgtcgcagtggtccatgacgtgccaccagtccatgtcgcccttgggcggcaccgaggagaggttgccgtcgatatcccccccgccgctcgacgccgccggcgaggaggaggaccgggatcgggaccgggatcggcggcgggagaagaggtgggggcggtcgtggtcgatgtagttgatgaggacgccgtgcaccgagtggggcaggaggcgcgggaggagcagcgcgcggccgtcgacgaggtcgcgccacggcttgcagacgcaacgcgccgcggcgaggctgcgtggcggcaggcggcggaggatgtcggcgagggcgtcgtccggcaccggcagcgccatgggggatcgatcgatcgatcgatgggtacgagctgccgcagttgatcgatcgatgggtacttttttttttatcgttcttgttaagcagcatgatcagatcactcagactcagcatagttaatgggcccaggcccacaatataaaaaaaaaagaggaaaatgtctctcggcttcttcggtccaatgtaattgatgtgtccactggctcatgaaatgtcgctgataggtgaccatgctgcaattttttacttaaggtgaaaacttgaaaaccgatggtcaccggcgagcccttcgccaccggcatatggcgtcgttgacgaggccgagcccggcttcgtccgcgcggatcttgctctcgtccgccggctcgacgctctgcacgccgccggccgggcagctcaccctgacgccgttctgcgggcaggcgccgcacccgttggccacggtcacctcgtactccggcagcccctccaccaccttccctgtcctcgccgccgtgacggtgatgcccgacagcttgccgtcgccggcggcggtggcggcgttgcccgagcgtgctgcgtgacagctaatgacgatggcagcggcggcgaggaagaactaagaagaagacggtggcatttgccatgcatgccatttctgttttgcttctgatttgattttcgtttgatttggagtggaagaagaggattatatgtgggtgagaggattgatcattgatgtgtctgaggagaagaagatagaggagattggaaagatacacaaaacgagacgagccattagcgtatgattaattgagtactgccgtcccataatataaaggattttaattttttattgttttgtttgatcattcgtcttattcaaaaaaatttggaataattatttattttatctgtgacttactgtattatctaaagtactttaaacacaacttttcgttttttatatttgcataaattttgtgaataagacaagtggtcaaacagtaccagcaaaaagtcaaaaacccttatattataggacggaggaagtattaactattttaaacttcaaaaatagattaatatgattttttaaattaactttctatagaaaatttttacaaaaaacacatattttagtagttcgggaaacgtgcacgcaaaaaacgaaacaaactcactcaaaatcacccaggaaaaacacagccagtcaaatttggtgtgtgatgattcggaggagaaatgtgtcagaatgcactgattttctgtcgatcgctaccgctgctagttttctcgaattattgccttcctaaagtgtaaaagttcctgtattagttaaatttgaaaccagattcatccgtcttaattttagagaaaagctgaataccggccgactaaaaaaatggctacgccaggctgcaatacgacgatgtggcatagttttgcagctcgctgggttacaatagtagactactagaaaataagcgcgacagttggcgcgctcgatttatagcctatgtatgttatttttgtgttattaattaacgcatttttcataaaaaaaagttacagaaatcagtttagtttccttgaaactcatgtaaaaatcatagttgaacggaatttttagagttcctatttaacataatcaatcatattgtagagaaatttgtcaaactttctctcttttttccaaccatactattaattcttcttttgtttatctaaaattataattaaattgctattaattcttcttttatttgtctaaatttataattaaattgtttgctaatgataaaataggtgtcggtatttcttttattttaaaaaaacaaagtgttctagaatttcgttttgttaggagtcacaatgttttgtattgatggctaattagtggtaggtgatatataggttgaccatgagttatatatggtgatttaatctattcaaagagaaagtctattttaccctctgaactatttcgccagagcacttaacctcctaaacttttttttactcattttacatcctgaattattgaaaacagttcactttacttccctaatggtatttctctctcttttttaatttctctatactagtagcatgcccgtgctaacgctacggcgatattttattaattaaccaaaagataatgtatcttttgccaatcaaatataaaatgagataagttttaagaactaagaaatgtcaactaaagatctgtatagcattagtgtcaatccaaattgtcaaatcagccatactttgtaattgctatatacagaatgaaaattgttcatctccttgatacaatccatttatttttgttgcgtgacaccccatatttaacaatcacaaagaggatcaccttaggcaatccgatcgaaacaatgtcgtttgtcactacaagcatcacatgaaagagcagtatcttgatatagaactgttggaataatgttgcatgccctctctgagggcaccagcacaagctacaacatcatctgaagctacgcaattcttgctgaagatgtggtagatattgatgtccaagggaaagggggcggagatcgcatgtttctccgcatgggtaacgttacggtgatatttgatattgtaattcaaacatccaaagtataatataggttttggcaatcaaaactacgatgctccagatagtttatagattggaaaagaaaaagaacaagtgagataattatattgctcaaccatttatcaacctacagtgtgcataaacaggtccaaatatacgtattctataaaatacaaaaatatttgcaactaatgaaccgaccccatacccagaaaatattctatataaaaaatatttgaatccaaatggggcatataaagttaaaaaaaagaaaggaaaataaaatttgtgtgacacccaaaaaaaaagaatctggttgggggtgggggtggaggcgaccgaccattactttctcgcaattatatattaaaatcttgctatatgtagataatctgagctttgaactgctatattcatttatcagatcatctcatagagttgtaagcattcaaatttgtacaggactgtttatcaaattttatcgagcaacctatcaaagttcatccatcagtttgctataattttgatttgttaacaaattacttaggctgcattaagttgaacacattaattagtaaccccacaacacctgaacactgaatgaggatttatcggattagggccaactgataaatccagaaaatgcatgctattttatctaaaacagggaaagctgcaaaaaaatacttccaaaacagtagcagaggcaacatatcgtgcccatcttgccatccatatcaaggaaacatatgttttcaaatctgctttagaagaacatgtgagtaataaattagtggactacttacctccaaatctgaagagtaatctgcgattggattcaaaacaaacagaaagctctatgcataggggataaatatcacaacaatgaactgctaaaagctatattaaactgtttggtccactcgtcaagtaactataaagggcatgatataagaaaatattggacacgaaataatttcacaagattttgccggatcaaagggaaatcattagatagtatagcagaaaatcattggatttaatagtaatagattgcagcattatttgcataccaagaactcgtggtccttggtagccattggagattttccatcaggattgcgtaaaatttcaggtcaacacactgctcctcatccgccaaacaaaagcataaaaaggttgatgtataatgtaagcactaaaacagaaacaaagctagaaaacaatatgtaacatgagtaggtgtagaaaaaggagcaatctagttagatttgctatctgaattttgttcagtttatgcttgttgcaaacaatttaggggataggtaaggcaagctttacttcatgggatatctcggagctgatagtttgtcatctggctgattgcaaagtcattattctgattaaagaggtctccatcctcactgcgacaaaacattcagcaacaccagtgggcagcatcaccgcctagcaggtcaggtgtcaccgtagattcaattttctccaatggaaaatcacatcaattttgttaagtatttacatacagccaaatctaaatctaggataaatcagcactgaatgcctcagacactgaatgacgcttgaatattgtacagaggtaaacagatcgacaactacatctatattttttttaaagaaaaactcttcatgtactcaagagtgatatgaaataataccttggagctactattaccatgtgcaagctagttgccacccagaaaaaaacccagaactatatgtatatttttttcccaacttggacacaatacaccgtgatgccatggattacggtaccatttgtgtcctccatcaagatatgagaggaccgaggagagaaagtttgttgtttcagatactgaatcacactatacaccaaataaatctgagctgttgaaaacaccatgaactccgtatatacaggagattaattaaaccattgaatcatattatcgagcagtagggaagcatatacacaaagcaatgtacctggtggcaaactggatgatccagtgggctcagtgagcagtagagatgccatggaggacagccagcaatccaatctccattaccagaaattaaaatttttatttatgaagaatgaaaaagtaatgagttaatataacggatggtccaattagtaggtccaaaatcagtttttgacttcagctttgaagaaaggaacagaagatatgatgaagaaatgcatggcccgggtagcctcagttaccgtaggcacctgctggctgctgcactgttgacagatcgaagcattgctgctggctggcgacgacgacgggtcttggagaagaccttgtgccggcggtggtactcgtggccgcacagattggtggaatggtgggtgcaggactgcagggaggcagagcggctggcggcgttcttcctttttcacggatcgggggcggagcggtggagggagaggcggcgatggggagcggaggaggcggcgacaggagagggcgggcgggtgcgattgataagcgcgtggagcggttgtgggaaagaggcggcgaggaaggcggagaaaatcgcgtggcgtgtgggagggaagcgagatctgtgagggaggcggagaaacgtgcgtgggtgggagcgatctgcgaggggacgtccaagcaatctcggtcgttcgatcgaatacagataataccgtccgttagattcggacaatgatgaatgagtagatcagttggtgaagttagtgaattatagggtagataagtcatattttgcatgcatttacaaacatacatctcaacatttttttttattttttttctcattgtttatgtaggttgaaagcacttaagactaatttaaacatcacaatttaaagttcaagcaaacatccataacattttttttaaaaaaatgaactttaataatgatcccatgtatggttcagtttaaaagacaattaatacaaagagtaataaaattgagacgtgctattatggagtaaagtgaaccgagccaaaaattagatttttttaatagtgtctattgaattagtacgaagaaataaaatatgttttttattttaagatatgcagttcaatatttcaaaaatactcatagagatatgtatgaatatgagtagttgtatatatatgcattcaacattttttttttgtaaatgtactatagaatagtaatgactattgaacgtgtatatgtagggcaagtgggctgacataggcatttgctccttcccctaattttccataggaataagttcatccgaggtcccttaattttacatcgaatccaatttcatctttgaaccctaaaaccagatacagccggttcttgaactgtcaaaaccagtataaacaaagtcccttggtggtttggaaggcggttttgacggacgtggtgcccacgtggctagtttgactaggtctccatctgttaacaaccaaaattggtaaatcatgcatcggccgaggcggattcggaaggattttttcagatggagtcagcctcagtcctgccttacctctcccttctctcttcttcgtcctcacttctctcttcttcccccccccccctctctctctctctctcttcgtcttcccgggcggcggacggcgcgggtgggcggcggagcaggcgagcgaggcgggtgggcgagctccggcggcggcggggtggccttggccgggtgccttggtggatttggtgggtggcgcggtggccggacctggggtggtgggcgccgcggtgggggccagggtggcggggtggaggagaccgacagcgtggtggttggcgccgccgcgggggtgggcggagatggcggatttgggcgggaggccgctggcccgactcactccccgcccttcacgacgcgctcgccaccgcccacaaggagcgccgcaagctcagacccatgttcaacgtcgtgccggggctcgacgggaagcccggctccgtctcgctcgagctcgggagcaagcctgggtgcttcttgatcgccggcaccagcgcgaaggtgcaggttggttgcaggagccgcggcggcgacgggttaattaattctttgatcctttcgatgctcaatttagtaattagcatggcaattagcagttgaatgggaaaatgagttggatttacatatgtacactctgcctctcagtgtttactggagtagcagtgttgttactctgcaatgtcagctctttatcttgccattcttttcttagaaagagtatatacctcttgatgcagttgagtatactcgaaaagttctgcaaatgaaagagtaattaaggatcaaggatattcttgacctgattcctaaagcgcattttctgatgcctcattccaaatgcattatattagagcaagtacagtagcaggctataagtcagctgtagcacgcactctaagacgcagtgtgtgtatggcaagtgggaacatgtattaatagtgtgatatgaccaggtattaatagtgtgatatgtaactattgtatgaattagctattagactggctataaatgaattggagctagtagttggctatactattaaacttgcttttaccatcttggtgtataaaacattatctggaggccatgattacaacatactcctctctttcttagataactatggatcatattgcactaatctgattggtgcaaattgctgcaagtctgcaacttgtcgacgcgctccgggagcatggcctcacgctgcagaacttcgcgtccattcgggagcagcaggtcggcggatttgggcg

SEQ ID NO: 63410 - DNA, 2044 bp, Oryza sativa
ggggtccacgtgggccgtaccattttttattaatttctatgtgaaactgatatgtgggtctcataaggtttattattttttcgagattgaattgtcacgtaagcgccatgtcaataccacatcagatgaagactaagtcaaattagccacgtaggcgtcacgtcagctaaaaccacttttaaaaccgccgagggatctcatctgcactggctttgatagttgagggacctattgtatctggtttttcggtagaagaacgaaaatcggattcgttaacaagttaagggaccccatataaacttattccttttccataccgcagggcggctagataatgggcttcttatgcaggaggtgctttaggcccagatgcacgcgtacgtacgcgatggatagagaagaacagcagccgcgctggagaatcatctatacgttgttggttcacgccacgtgtctgaaaatacaagccgtcatctccaccaatcagctagcgggaagacccgccagctctagatagatagatagataagtcaactacaaacatattttaaaggcaacatatcctatacacataggccctcacgtgtacacacgtacacaccaactaaaaaatatcactaaaaaatttagaaaaaatcatacacatactttcaattgtattacacctagggttaaaattttaacgtcaaattcactgtattttagccgtaacaaaaaaaacaaaaaatctgacagttttaagattgcaattttgtcataattttatcttttttgttattctctatgtagaatgaatttgaagatgcgactttgcacgtagatgtaatactattgaaagtacatatatgaattttcctagaattttttgtgataatttttagttggtgtacacggtgtgtacacgcgagggcctgtgtgcataggatacactgcctattttaaaaagataaaagaaaaaagataagagcagcgggctacaaatttatagccggatgcagcacggacttcaaaacacatgtgtgtatgataggtgggaccagatattgattgtgtagtactatatgtttatatgtaactattgtatgaattagctattaagttaactatagatgatttggagccagtagttggctatagtattaaacttgcttgcttgaaaacttgctacagacccttgaactccttgaactctttttgggtgtcatgctttgctagattttattaaaaaacatcatagaaaggctgtgtttagttcacaccaaaattaaaagtttggttgaaattggaacgatgtgacggaaaagttggaagtttatgtgtgtaggaaactaaacacgaggtgtgtttagttcatgctaaaattagaagtttgattgaaattggaacgatgtgatggaaaagttggaagtttgtgtgtgtaggaaagttttgatttgatggaaaatttggaagtttgaagaaaaagtttgtaactaaactcggccacggtgaaactttaaacatcatatgttggacacgaaaacttatgactgcacttataattataagagcaggtacaatagctgactataagccagctataaccacatattgacgtgaagagagaagagagagaagaaagcatgctacatatttgtagccggccgcaagacggactccagacattatgtgtgtataagatgtgagaccagatattaatatgtattatagttttatagttaattattgtatgaatgggttattagattagtttatagatcatttgaagcccgtagttgattatattattaaacttgctctaatgggagtatgggacagagggagtagtacactactgatcgacctaccttaaaaatttgctacctttgacgagtcaaatttcaccgattgaagatagagacatttagtgcagctgtacacgttatacgagaaatctaatttgtgcagcttcgctacgtgccaacattttgagcccaacaggctcatggcatatctgtctattgatatgtcatacggagtagagcggatgcggtgtccgtgtagc

SEQ ID NO: 63411 - DNA, 3069 bp, Oryza sativa
attcctgcagcccacacgcatattttattgattcgtgggacccaccatcttctcctacctcacatcctctttctccctcctatcccctcacagttcgtcttcttctcctatcccctcgataacctatcactgacgatgaaatacggcggcggccgtgcggcagacgtcggagatagcggcagccgggccgcggcggaggcgaaagacgacgacggccatgtggcgagtgacgggggcagcggcagccaggccacacggcggaggcgaagtcggcagcgactgtgcggcgggtgacaggggtagcgacggccgggtcgctcggctgaggcagaagacggcggcgaccgtgcggcatacgtcggaagacggcgatggccaggccacgcggcggaagcgaaagacggtgacggccgtgcagtggacgacggggacagtggcggccagcccgctcagctgaggtggaagacggcggcggccgtgtcgggcggcgaaggcagcagtggccgggccgctcagctaaggcggaagacggcggtgggccgcgcagcagaggcggaagacggcggcgaccgtgcaagcgggggcgacggaggccatgcgccggatgtgggagacagcagaggtcgtgcgtcggcgccggcgaggctgtgggcggcggtccggtggccgtgggagttggtgacggaggcatgcagctcaaggcatggccgatgcttctccatgccttgcactttgctgtgagaagaggcagcacaaggtgggccccacaatctcgagcggcgcgtgcagcccggcgataaattagtcgccggctcacactctctctctcttcccctctctcctccaaatcatcccaaaatcctaggtggaactaccaccgcccattactgtacctgctctaagcgaactaacgcaattgcgccactgcgcgtattaggagtcctccccatcaacgttatttaataatgtgatgaatccaatatgcatgttagtatggcctcgtttagatctattggcaaaattttataccctatcgcatcaaaataactaattacacagattgcacgtaaaattgcgagacaaatattttaagcataattactctatgatttgacaatgtggtgctacagtaaacatttgctaatgacggattaattagacttaataaatttgtctcgcagtttacaagtggattttgtaattaattttgttattagtctacatttaatactttaaatgtgtgtctatatattcgatgtgacacgccaaaactttagactatggatctaacacagcctatgttacgaaatttatagtctgagaagatattcgagagttaccacattttcctcccagtactagcttagtttacgccctcaaatcaaatcgagttcgactggacaagaagagcctcttggcctgagagcaggtgaatccgtatggatgaacgaggacgacgatgaatccgtatagctcggaagatgaggcggcgcgtggacctcgaccacaccctccagcatctgcaccacttgatggatcgtcggccggagcgacggattgtgcacgatacaccagaaagccacacgagcgaaccgctccactctctccagatcctccgccgcatcatcgtcgctgcgcaggaggacctccaccctaccatggctgaccagcccggctgcccacccgaacagagtgacggtgtcatcatcgcaatcgccattgtcatcctgatgaagctggctggtgatcgggtcctggcatctcctgcagcaaatcatctccagcagcacgacgccgaagctgtacacgtccaccttggtgtcgatgcgcctgtcgccgtgcagccactcgggcgcgatgtaccctctggttcccctcacgttggtcaccgtggtgtgcagctgctcatcgccgaggagcctggagatcccgaagtcggctatctttgggttgttcttgtcatccagcagtatgttgtccggcttgatgtcgcagtggatgatcggcgaagcgcacccttcgtgcaggtactcgatgcccttagctatggcgagcgccgcctcggcgcgccaggtccatggcggcggcggcggccgtcgtcgaggctgctggtggaagaggaagctccggagcgagccccccggcatgaactcgaagacgagcatccgctgctcccgctccttgcagtagccgatcatgcggacaaggctccggtggtggatcctcccgatggactgcacctcgttcgcgaactccctctcggtgtactcgttggagacgatgagcttcttcaccgcgatgtcagtgtcaggtgagtgcagcagatgcagcgaattcgccacgccatggtagacctcgccgaagccacctcttcctagcaacctctggaaaccattggtggcatcgtaaagctccttcctggtgaagagtctcatcaccatgtcatggtcgctggagcttcttcttctaatgcggcggtgcaggagcacgaggctggtcgtagaggcgagcaggagaaacgccgagaaaccgaggaggagtatgtacggcagcggtggcgccctcctccgcgccaccgccgccgccggaggggtactgcgcgtccgaaccttgatcagcgccttccccgtgacgttactcccctgccgtccggcgcccgtgagggacgccatcttggtgcagcgggttccgtcgaacagcgccgccacgcagaagcagtcgttcaggcacaagccgccgcactgctcctccgccgtgtaggagtataccttgtacggcgaggccgtccaggtggtgttgggcagcttggcgatcacgaattcgccggagcggttggcgacatcgtccccgacgaagtcgcacctcggcggcgcgaacgccggcgagcagccgcggtaccgtagctgcgcgtcgacgaaggagtatccgctcgggcacgcacagtcgagccggccgtcgtcggacacgacgcagtacgagttggggccgcagaaaccgtccaggccacgggtccccatgctacagccgtcgccggggaacatgccggcgacggcccacgacgcgttggcg

SEQ ID NO: 63412 - DNA, 5489 bp, Oryza sativa
tcgtgcaccgtcccgtccttgacctggtaatagacgcgccccggcgaggcgaagaagagagtggtgttgccgtcctgggtgttgccgggctggttggtgccggtcgcccagtacgcgttgtacgggtcgacgttgccggcggcgaggttgaggtacaggacgacgttgccgtcggcctgcacgtacaggctgaagcggccagccgagaagtcggcatcggagcgcttggacacaagcgtagctccggctccggtggccatggactggccagggaggagcgtgtcggccgggtccctgaagctctcccacaccacggcgcggccaccggcggcgaggaactggaggttgccagagtcgagcagcacgagcacggagccgtactgctggcccgggttcgcgttcgtccagacgttgctgccggcggtgtcggcgagcgacagctggccggcgagggtgacgctgaacacagactgcgccgtggccgtcaccgccgacccggagcccgggtccctcgcgtaccataccaccgccttctcctgtacggcgtcgttgaaccaaacggcgaggagaaaccagccatccgggcggccggagccgagggcgcggaagccgaaggcgaagtcgccggacgggctggtgatgtagtgaggaggcctcagagtcgatcctgccgtcaggttttctgcttcaacttgaagcagacaggatgattgatgcagcagcagtgcgatcagaagcagcgggacgaacgagaatgacttcatttctgctcaataagctgctattgcagctggtcacaccaattttgtgattgtgattatagtggtgccagtgccagctttcttcatagtcatgtagtagtaacttgcattgattggccgaattttacatctccggacgtcctgtttcatcgtacttaaaaaaaatgtttctcccttcgtccacaaaagttacacgtattacttttgacaccaagaccagagagaaattaaatcaccttagatgttacaaaattaaagaatgaatgcaagcatgcaaccaatgagtatttagatgactccttcagttctaataaaatatttaatttatctcttcatttaagtcttgaatgtataaagactaaaaaaagaaacgacttatttagaaaaactttaatgtgaaataggtgtaactttgtggatggatagagtagtacgtactctctatcttaaaatataaagaattttaaatggaagtgacatattctaagattattaatctaaatagttttattataaaataatgttttcaataaaatcggatgcgcgtgatagttcatttgttcaatatacacgttagctgataaaaaaaatttgcatcggacggcggtttcgtcgtttgtatacgtggtctcatgtggttgtcaaggtcaagcatcacaattcacacccttggactccctctgtttcttttttaataattgctttttaatttgatcgcacgtttaactattcgtcatattcaaaaattttatacaaatacatcaaatataaatcatgcctaaattatatttagtacgaaaacaactcacaataaaataaaagataattacataatttttttataagataaatgatcaaatatgtgtccagaagttaacagtgtcacctattaaaaatagaggtggtataaaggccctctttgtttaggcttataagccaacttataagtcgaaaaatctaagtctaaacaaacaagtgacttttttgtttggctattttgaagctataaaccactctaacactattaagccaaaagctaggttagagaagcttttttgacttatgtgagatatatgcatgactccaccattaaacttacgacattaaatccaccggcttataaatcatataagccaacaagtaacttaaaatgctaagccaataagtctaagcgtaaataaagagagccaaagtatagacataaatataggcttaattggttattgctatttcctctgttttctaatacaggatgtcgttcattttttaacatatgtttagctattcgtctcatttaaagtaaattatgtaattatcatttattttgttgtaacttgatttatcactaaatactatttacacaatgattaaatgtatgttaaaaagttaatgacatcatatattaaaaaatagagatgatggtataatgcaaacttgcaatgcaattttactgtgcactcctcgactccctttataggaaactattttgattactctgattactcgagaggatgttccctcgttgtttacatcatgtcactcaagtggttatgaaaaaaattgaaaaaaatgagaagatgtattaacacggggtcaacgctataacaacgcttccaaggagaggaacgacgccgaaaggcgccgccgtcgtcaagccggccaacggcccggcaaagctttcgccagtgattccccattcaaatccacacaacccgcacaagaaggaacgtcgcaagccacatcaactcttcatcaatcagccctaggccaccgccacagatccgcccgaccggccgaccctgccgccaactcaagcaaggggggcaggacggagggggcggacggcacggcggccaggacagcgtcgccccatccaccgttgcactgtagagtcgccgacgccccccgccaacgacagcacggctccatgtcgggcgacgccttgcgcgccgcttgcgtgcaccggtgcacgcatcgacctcgcgagccgtctccgccgccatccatgccgcctccaatcgcgctgcgccacagcgccggccgcttcggccagatccggcttggaccaggccagatacggcgacggcagctgtggatccgtcgccgttttgctcagagagctcgccgccaccactccccgccgccggtgttcaccgcctcccccgcgccaagaggagatgctaccgcaggagaaggccccgccgccaccctcctagctcaccggcaggctttccggcggcggctggtgggggaaggggggcggcactaggtttcgccccccgtgtcacctgcgagtgggcgacgcgggggtcacgggagttctaatatgtgggctactggtaatcgtatgtagtaggtagtacttttaatttcgctggagcatatagtaaaagtagtccctcagtcccaaaaataagcgcatctatgagtttccgtgtccaactttgatcgtctattttatttgaattttttttatgattagtatttttattgttattagattacaaaacatgaatagtactttatgcgtgactaatgtctttttagtttttcaaaataattttaaataagacggacaattaaagttggatgtggaaactcttggttgcgtttattttgggatggagggagtataatagtagccttatcaggatggtttaagatattgttgatgctccaactaactctgaacctggaaagggacgcctggcttccattgttatacttgcgtaggctaaagaaaacttctgggtcattagacacaaacacaacgtaattaatgctaactaggacagttgtcttatatataaacatacacaggcatctaaacagaatggaacatggaagtaataattgtagcaatggaaacttcctaacagttgacacaaagaaccctataaggtctgttctccacatcttataaggaacataaacatagtagcaaactagcaaacaagaaatacaacagactatagtaaacttcagactcattcactcactcgatctggagaccaagacccgtggtgttgttgtgaacttgtgataggttccgctaccgccgtggaggtggagtaatgccgaaaagtcaggaggcctagataaggctggcagaggggcaacatccatgagcatgtgcaccacctcgcgtattgttggcctcatagatgggtccacctgtatgcaccatatacgccacacgtgcgtacctctcggcgctatcagccatgctcgagcctaacaccatgggtgccccggccctctctcttcttcccccacgagttgagacttcagacattctcccgtcctcgataaggctctcaacccagtttagcagcggcaccattgtgccgatcctatgattatcgggaggaagcctcccgcagcatattatctccacgaaccactcaggcgctgcgtagcccttggtgcccatgatcttggtgatggtgtagtgcacctgctggttgttaaggagcttggcgattcccaaagtcagtgatcttcggattctccatgtgatccatgagtatgttgtcgggcttgatgtcacagtggatgatcgggaaggtgcacccatagtgtaggtactctagccccttggcaattcctattgctgtctccgctcgccacctccatggaggcatctccggctggtcgaatatgaagctgccaagggagcctcctgggatgaactcaaacaccaatattctatgatttccctccttgcagtacccaatcattcgaactaggtttcggtggtggattggaccgatggattgtagttcgtttatgaactcctcttccttaaactcaccagggtggtcactggtcgagtaccttcactgcaatttcaggaggtcccagtgaatgcacaatccctttgaacactttgccaaaaccaccatgccccagcagctctgtaaacccgtttgttgctttggagagttccttgtgagtgaagactctcacgccaagcaaggttattttgggtttcatagaaaagtggcagcacaggatgatgctgatagagtttatgttgaatatgtaaacgtagtcggttatagtttaggacttggagttgtactaggtataggattagagtaagagtcagactctatcctaggatctctcataaatagaggggtgtacctgttgtaaccgtattgcgacttagcatagcgagagggagcggctgccagcggcgaccggccgtgagtcattgtaactctgatacgctgtaatatgctggatcggggaggagcgcccgtaatcagtcccccggagatgtaggcctcggctgaactccattatcaaatatcatgcctcggtgtcgtcaccgtgtttggatctcctatgacgttttcttccgagtttggtttccaatgtgatttcaagactagttttttaacaagtggtatcagagcttgcgggagatccatggtagaggtgcgagggaggtgctccacgccacgaaaactacacaggatgtccagggacggacaaggacgcaaggtagagcacgacagcggtcaacggaatttgatcggtggaatcggacacttcaggcagcggtttgaaccgttcgattgctgctttcaacagagagatgaccagacgtggtgctcgggttgatggcggcggaagcgattggcgattcaatcggtaggtcggacacttcaggcgggtgtcttgaactttccggtgagccactttcaacaaggagacatg

SEQ ID NO: 63413 - DNA, 2738 bp, Oryza sativa
ttgtgtgtatatgtgatgtataggtgttattcttacataaatggtgtataagcgataattattcaatgtattaagtgaattttgtgttttaggagttgagtgcatattgttatgctcaaatatagtacttatgagtgatgtacatatgcataatgtgatgaatatatatctaattcctatatgttttcttgggaaagatcttttttttgaagtgatgttttgtgccgccgccgatatggttgcccatggccatgggctagggcaagcgtactgaaagccactgcggagcttcatcctcgccatcacacggaggagagcgagcgaaggatggaaagcagaggagacgcgagaggagggatggaggcgagacggcacgcgatggaggcgaggcagagcagatgagtcgtgggctcgcatccggtggtggtgggggggggggtaaaactgaaatttcacaccctcctggccatttgggcaacgtgggctgtgccatgcccactgttggccgagtagcctccatctgtgtcttcagactttgcaggtgcgaatttaagtcccatgtattgtggttcaagtgtcttttggtgttccttagtccagttggtagtccaggtgtagcaattttcaggacgcattgtgagtgccctaagaagcaggtacaataacttgactcggcgagctgcaaaactattccacatcatcatattgcagcctggcgatagcgatttttgtaagtcggtatcgctcgtttgcagctgctcccggtttactgctgaattaagttcgatttatattttggaataggttcagctctcctctaaaattaagacgaatgaatcagctggtttcaagttttcaactaatacaggaactttttcactttaggaaggcaataattcgagaaaactagcagcagtagcgatcggcagaaaatcagtgcattctgatacatttctcctccggatcatcacacaccaaatttgactctttaccacatcaatgatcaatccgctgtacatataatccccttcttccactccaaatcaaacgaaaatcaaatcagaatataatcacagcacagaatcagcaaaacagaaatggcatgcatggccaacgccaccgtcgtcttcttcttcctcgccgccgccgccgtcattagctgtcacgcagcacgcgcgggcaactccaccgccaccgccgccgccgccggcgactgcaagctgtcggacatcaccgtcacggcggcgaggacggggaaggtggtggaggggcagccggagtacgaggtggccgtgtccaacgggtgcgcgtgcccgcagaacggcgtcagggtgagctgccccggcggcggcggcggcggcgtgccgagcgtcgagccggtggacgagagcaagatccgcgccgacgaagccgggctctgcctcgtcaacgacgggatgccggtggcgaagggctcgccggtgacgttcgtctacgcgtggaagcagccgctggagttcgccgccgcgcaggcgacgccgcggtgctcgtgattggctgccccgtcgtcgccggcgatcgaggaggataggtccacgggtggggaatatgagtggtggcgggaaataacagggtttgattgttattcagagtttcagaccaccatacatcaagtgattgtttttgtttaatttcttttgtatcaatcacatttttcaatccatatatcatcgtgcattttcagtttttgttcttaatgtgagacaaatatgtttcaactcaaatacatgtctagaaatatttaaaacctccaccaatatgaatagagatacagcctggagaagcataaaaccccatttggacgaacccatgaaagcataaacaaaagcgaacaaaaagttagatttgctaattatagattatgtattgacttgtaagtaggaaaatttcagacggagtttgtaaggaattacacaacactctcttggtcctatgtactcccatatccccagtccactgaagaatcacatttcagaagcaattgaagtgcacgacaaggaacattatcatctgattttatacagacatgtctcaggtcgtaagacagcttgaaggcgatcgcggtgactaagtaacaaaaatgagatacagaaggcaaaatagcgatgatgtacgataagaacattcgtgtatccattggtcttcagttaatgccggacagacaagggcgaaggacagacatttggtatgcaacttcttgtccagcaatttaccacttccacaagaatatgaacgacatatatgcctaaatctcaaacctattccagtaataccgaataaatcgagttatgtagttctaaaataaggctgaaatatcacccgctgatgttgcctagccagaagagcatgggaaattgcacaaccgcgaggaaaagaagaaagtagtgattccggctggggtgtctctcatagctccttggtgcgcccagaagaaccctcttcatcgtcttgacaaggaaaactccggtgcagattgagaaccatggcagtacaaaataatatgacgggctccagaagacgcggacaagcattgcaagtgatgtaccagcaaatccatacccagcataggccacaatgtccagcaatggcgcttcaccacttcccagcgtgtacagtagaactctgatcaggattacttgcagaaaccagccaagtaatccttttgtgaactgtagagtgagtgcctctggggtaaacct

SEQ ID NO: 63414 - DNA, 6301 bp, Oryza sativa
cacatccttctcttctcaaattctcaacataactactgttcttaccgtcactcaacacactatgcatagcgttctttctttactactaaagaagaagcaagtcagcactacaaagttgaatgagactaaatatgtcgttacctcccaagaacacccaaagcatatccagcattacaacatacgtcccaaaagccatcagaggaatgtaaagatctggagcattgatatcttgaattggaggtttgtatgacaaccttcctcccaccggttcagttatccttgtccagtgcccctgaaggaagtaaattggtaaatggcttgtaagaaatttcacaataagcatataatacctacaaaaaggtggataaatcttacccggtgcaggaaagggaacaagatcaccttcaacttgtttctcacatactgactgttgacttgaaagtagtactgaggattggacagatactgagtgatctgtccatgtgatgaagcaaagttaagattcaatgtctccggggaaaacacgtgtgttgatgacaacgtggtacacaaaatatagaaagcatacatttgccttgatgaaattttaccaatgacttacattgctttgcataaactcagagcttgaacctaaaaacttctcgccgtatgctcctaacccacttcggatgagtccaggtccagctccatataaagcactttcaaaaggattagcttgtgaagtagcaggtctgcctcccagtcctcccagatcattgttcatcgctgccatgctaactgcataaacaaaaacgaactaaaaaaagactcaaaaaataatgtatcaatgttcaggtcagctcaaacgtcttatgtctacaaccttaacaaatatcccctacggtggctctcagaaacaaacggaaaataacatgctgaggaaccaattactaatgtcctatccattagatagacatattcaagctaccaactgagcatgatatgctgaggagaagatgtatcataaacatatacttgaataaggggaaattagcatagtaccataaccttcaccaagtgccattgccataaaataaaacaaaactagcaaatgcttttggagaaccaacgtggatttgcatatccatagtctactgaaataatggcaaatccagtgtcaattgaaacaacagcaggtcaaaaatgtttctgcactaccaccaaagcaaaatttttatcacgctgaccaaatcttcaaccaaaatatggcatctagccctaggtacggataaacggcaagtgaaatacctccttcaatgtaacactgagaacacgattattgataccactggacacagttgattaaaaaaaaaggcttagacacatgatgatcaacaggtagcctagaattgtactcaaaatagtaacacgtctaacatttaacattttcaatagacaactggagtggtgagatgtaccttctgaatgaatgtcattcaggacagtagctactaatgcactagactttcttggattaggattcaaaaatagcacaataatgcttgcctcttggggttgggaatgtaatgggaaaaatccaaaaaaacaaaagcaggaagaactattcccgttgcaattcgctccctctccaaatgatccttccatttgagctgtaagatcaatcactgcatccccaaccattctgagaccttcctgcgctttcctcacggcccaagattccgaccaaaacatctggaactcgctcaccgaccagatctgggaccgcatcccctcccccccccccctcccctcccccgaatctcggatggcaccggcgatcttggccggcctccctcgagaagaccgcgaccttgcgcacacgcagcaaagctcgcatcggccacgaaaccctcacgccgtcgcggcagtttactgctcgctcggccctcacgcgcactaggggatgatccccgcatttgggaccaatacctacggggagggcaaactaggtggacgaagagaagaaaccctcacctgcggcggcgcaccggcggcgtcgcggcgccgctgggattcgtcggcggcagcagtagagggaggcagcgcgtcgcagcgaagaggagcaaatcccacgtcgagtgagcgaaccgacgaagacgacgctactcggccggatggatatttctcgtgatgggcctaactataatgggcctgaaatgttagcggcccaaacatttgatgggtctaaaggatcgcaaccattgaatacgatccaaaattactgtgggcctttttggatctctttcttggatgagaactcgagcagttccaacgttgggctcagccctcgtcggcccgccgcgcccgcgccacggcccacgacgcgtgcgcgctctagcccatggtgttcgtcaggtgagagtgagcggcgacctactccatgatcctctcaggaggaggaagctgccgggcgcgcgagtccacgcgacttttatcccttgaccaacctcattttccaagaattttagtgagtagaaagtctcacctgcttggctgattcgcctccaggaatcatttctttttaccgcaaaaccgcgtgttaatccggcataaaaagctcgaaggcagagcacgccatggcgacgaccaccagcacagcagccaagaagaagaagagaactagagaagagaagcatctccggcgatgagcggcgggaggaagcgggagtggatacggaggaaggtggcggcggcggcggcggggagcgggtcgccgcggtggtcgcggcgtgtccgggcggtgtccacggcagtgctgcaccggaggcggcggcttgggctcgggctcgggcttgggcttgggcttgggcttggggtccgagtgtacgagaatgtggtgttctacgtgctgtgggtggtggagtcggtcgtcgtcctcgccaacctctgcttcttcttcctgcgcttcggttttcgcttgtgatcacaccaagggtccaagatgtgtagttggtgataccacagaggaacatctgctaaatcttctcaatttttttctctctcccccctttgaagaaatgtaaatcatatgtcctcagcttctaacagactgttatgcccagttgctgacttgtcagcaatggagattgacagacgcaaaagcttgaatctatcgtacaaaagcttttcaattaggatacaattttgacagaaaattatgatacaagaaaggcctgttcactttgataaaaaaaaaaccttttggcatagttaccaaaattttagtaggatttcttatatagctaccaaaatttggcagtaaactaaatatagccatttttttggtaattgtactaaaatttggtaaggttgaaaatgacatcaaagtgaacagtcccgaactcttaggctgggttcatctccacttctccacacataaaacggtgttgttcattaacatgtgattaattaagtattagctaaaaaactttaaaaatagattaatataatttttaaagcaactttcctatagaaaaacttttaaaaaacgcaccatttagtagtttgaaaaacgtgcatgtggaaaaagagaaaggtgagtcaggaaataatggggaagaacacatccaaaggtcataccagcaactaccacgaaagcttaagtaacactgagcatggagcatccaatttttgtcttcttccaacatcacaatcaaattgtccttcaagaagaaaagaaacatcccgcaccactatcgggatgcttacaactgtatggagcatcccttttttttttcccagacgagttgcaatgaaaatatgtcttcgatcgttttacaatttacagcacactgacaaagctgacatcgctgggactagggtgcacaacctcgacctgatgggctgcgctatgcgcgctcgctgggtctggtcagcccgcacagcggctgagaaaccgtggcaaggtctgtccatggcggtctctcaacgtgaaaaggaataagttcactttgggtctctttatttgtcgtccagtccgattttcgtcccttgaccataaaaccgggtacgacccatcccccaactttcgaaaaccgggcaaacgagatccttcggcggttttgaaggtggttttggctgacgtggcgtctacgtggcttgtttgactagttatccgtcccacgtggcattgatgtggcgctgacgtggcaattatatattggaaaaacattaaaaatcgtgggcccacatgtcagccacagaaaaaaaataatttaaaaatggtgggtcccacatgtcagctaaaaaaataaatatggtggggcccacgtgggcctcacatgccattctcaaatgaccaaatccaatcctcttcttcctcctctctccggctctccccatctctcctccctcctctcgccaggcggcgtccagcacggcaggcgacggcggaccacggcagcggcgggcggcgcggagatggacagcgcatggccagcggcgggcgacggcgcgcgaggcgtgtggggtggcggcggccatctctctcttgcgcgccactcgcctagccgtccgccgcccttctccccggtggtgaggcctacgccgttcgccgcgctctcagcctccacgtgcccgatggcgatggcctgcttcgccgcctccaccgccgtgtccccgccctcgccgtttggagatgaaaaggcccatgatcttgataccgacctactactacatccacggcagcaagctactccagccagcaacactagcaggctgcaacagccattgacttcgagttgctacggacaaacgagcgagccagacatcacctcggcaccaaactgttagcgtgatatatgtacatgtgtagtttccggcttccttcctatcctcccgattctgttgctataagtcggttgagtagatatggttggttatacctatatatgtacccactccgtgattaattcaatctattgcgttgagtcatttcttctcacatggtatcagattccatctagcttccgcacacttcctctctcccggcgtttctcatggcgccgcccaccctcctccctgactccgctcgcgcggccctcgacgacgccgtccaagccgtcgccgacgccgtccgcacgtcctttactccccgtgaaggcagcgccgtcgaccctgccaccgggtcctccgttgccaacctcgctgcaaaccgggcctccaaggcagcgcatgccgctctctccgacgccctcaccgcgtttgtcctctccaccaacatcgatggatcgccgatatctgcttcctcctcggcgtctacctccgatacggtgctctcttccttgacttcatcctcgacctcgacgtcggctccggtttcttcctcgactccgcccgccccggcagttcctcctccaacttcatcatcaccggatcctgcggtgttgctcctgccggccctggaagccatcctcgacccggtgcggtttcctggcactcctcaacagccttcacggtgcccacctgctgcgccggcgctcggccccgacgccctcgcggccctccatgcgcaggccgtctcagtcctcaacatcaaggccctagttcccatcaccctcgacgtcgctaccgccaacttcacgcgctggcgcggcctcttcctcatcgccctcggcaagtatgcgttgacggcacacgttctttccgacgagcgccgccccgacctcgctgaatggatccagatggactgcgtggtgctaggttggctctatggcaccatctcctccgatctgcttcaagaggtcatgtcgcacgacgccaccgcccgctcggtatggcgcgcccttgagctacagtttctcggctactgtgagcagcgcgccctcaacctcaccacggagttccggaccttccaccaaggcgacctttccgtcaacgactactgccggcgcatgaagacgatggcggactcacttggtgaccttggcgatcctctcaccgaccgtgctctggttcttgctactctcaatggtttgaatgaaaagtttgataccttgcgtagcctcgtaaccatgcagcgtcctttcccgtccttcgccgacgttcgctcgcaactcttgttagaagaactcaccaaggccagtcgcccctccgggcagtccaccgtcctcctcgccggcgcttctagaggcaagccgccatcgacgcccaaccctgcccacgtcaccggctacggcgcgggcgcgtccgcggctccggcaacagctccaacaacaagaatcgccgtcgtcgcggcggcggcagtggcaacagcggcggcggg

SEQ ID NO: 63415 - DNA, 2010 bp, Oryza sativa
aaacaaaagcagcaacagcggaaaaaggcgatcctagcggggcttcagctccactccacaggcaaaactcaactggggtctgagccttggtcctctaacttcgtcttcagctcagaagcactacacttctgaaaaggggggataatagcaaggctgagtacaaccaccgtacttagcaagccacaccaacgatgcagacgtgcaaggggatacaaggaggggtttgtggctatttgcataaaggcggttgtaaaatattttgttgagcaaaacagtaacactgttgaataattaaggtaaattagatctccactgatcaacgctacaccacgttgaacaggcccaaccaacccacctatactacagtgcattgggtcgatttattaagtgtgagactaatcacggtgaatctggtcaatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagtttacccactcccgcttgtggcaagcgctgtaagtcttccagggtttcccgtgaaccggtccttaattgccatgggtgcgactcacaaaaccatgcacccacagcccaccatttagtcgcattttagttggataattacgaccataaaacatggctagatgtctcgagcacgcggctcaacaagatactagaatgtctaatactgcaattatcccatcgactgagctagtggtaattaagcatggctaagcatatagttctagctaggtcatcaaagtaacacaagctaggcgatttattacccacggttgacaaaggacagatatcaagtaaacatggcacaagcgagcagataggtaaaccctgatcccatgtaattagcaaaacatgcatatttatttgcaaacggtaaaacatttataaattgggaacaacatgctcaaggggaatgtgtgacttgccttgcttcttcacttggattttctgaactcttttcctcgcgaccgcgatcttctgaaaggacggattctacacgctggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaaggttttgagccattaaattaatatctataattattaccgaattattgcgcaattattaaatattttcacaaaggaaaaggactgccgctgacgtcagcaagagagggggccggcgccgacaagcgggtcccaccggtcagcgacacaagggcgccggtccaccatggaccgggaccaccgaggcggtccaccgccggtccacgggaaccgacggtccggatcggcccaagccgatcgggcggccaggggcggcgcgactgggcacagcacggcacaaagccagctggccaaacgacggcgcgcggcggcgcggccacccgcggcgacggccggcaacagctcccgtgggcgaaagcggcgcacgcgagagagcagcggcgcggcgcggcaagggggaggcgacaccaccggcaacggcgcgggcacggagcgccggagcgcggcggcagcgacccggtcggacggccaccggcggcggcagcgcgtcgcgaggacacccgggaggcggccgacgaatgggatgaaaaaggagagggaggggagtgctcaccgagat

SEQ ID NO: 63416 - DNA, 4818 bp, Oryza sativa
aagacgacgcgacggagctccggcgacgggcgtcgctcgggatggggcggacgggctcggcctcgatctgaggtagataaaggaggggttagagaggggaggactggtgcgtggtgaccggtaacgactgccgcccgcgacaatatgagaaggatctcaccggcgaccgaggaaggaggagctccggcggatttccggcgaagaggggcggcggccgaggtcctcctcgtccttgcggagctgagggaggcaacggcgcgggtcggcgtcgaccgaggcggcggcgcgacgcggctggagtcggcggcggcggcggagagaggtggttcgcgtggctacggcgctacggaggtggaggggggaaatggagcggtggccgagcttgcccgggcggtggcaaagctggcggtggcggcggagcagtgtggcggcgaccctagcgacgggaaacggcggccggagttcgccgaagtgtggcggcgcgcgggagcggcgtggggagagcgagggagagagtgccgggctcgggaaacaaggggaaatggacgaggggagcacgggggtgcttgttatgggctcgggaaggcgggatcgaggctggacgtggcggaatcggccggcgaagtggggcgccgacgtggggtggtggaggggttaaccggcgccgattttcgcggggagagtggggggaaaggtggaggaggtggaggggatcgatttcacgcgctcgtggggcggggtggggcgcgggagccgcggcgtcgtggggcgaatccggcggccatggcggcggttggggcgacgggaggttggggaagaagatgacaggtggggcctcgggtcccacctgtcggggagagagagaggggaaaacgggcgagggaggtaaagcagacttgagggagagagagagccgagcgggccgagggagaaggccggcccgagagggagagaaaaggggcgcgcgggccgcgggagagaaggaagacttgggccgaaaatggcccaaagagaggaagggggattttatttgttttctttttattttaattgatgcaatgatctttgtgctattaaaactatttctcgagctccgaaaattcacggaaaattccggagagtacattagggcacaaagaatattacaaaatattcccggccaatgatttttaaagggaaaattttaattctcccaataattcacttggataaattgcttaactttttatttaatttctaggaaatgcattattaaatgatttttaattccgaacgaaaatcggggcgttacaaaggcgcaccgggccaggccggctggcccactcccgcgaacccctgggccggcactatccacatgtggccgggtccagcggggcgcggactgctcggcccacgaccacaaggcgctccttttgctggcgcggcgttcaatgggccgccgaacggcccaatcggcgtgacgccggttgcctaccaagccaccttcccgcaggcccagctccaagtcggcctgtcttcctcaagccagccgagcacacctcacgggccggcgcagcccatgggttggtttcctggtgcaccaacacaatgggaccaattcctatcctcccgattctgttgctataagtcggttgagtagatatggttggttatgcctatatatgtacgcactccgtgattaattcaatctattgcgttgagtcatatcttctcacacaaacaataatgcaccccgatggatagcaacggatacaattcgatgacgcgcaataatggcggcaacgacgtcccgccgtgtcgtcaggtcgccgcaggcgaccagacgatgtccttgagcgccggccggagctcttcgctgcaaaacgactggtactccatggcgtcgccgccatccctcttgacgtccaccaggaccaccacgagcaacgacggcgccatgctgaagacgtcgatcggccgccacggcgagccgcaccccgcgcgcgccgctcctcgtcacgcgcgtgggcgtggcgccgcccgttgtgagcgcatccagccgcgcgaccacgccgcttgccgcctcccgtgtcgcgaaccgcgtgccgcccgcgcgcgccgtggctcgccctggcaacgcggcggggtcatgctcgaacagcggcgacaggtcgaagccctcggacagggagatcaggtggaaccgcgtgcagacctcgggtggcattgccatgtgtgtaccggcgtcggcacgaggtcggcgatgatggggcgtaggacgggcgccgtcttccagaaccacggcgtctcgaagaggccagggatggtgatgcgggtgcccgggttgggatcgagcagcatcttgatgagcttttgccgtagcgctggctgccggacctccccagatctgccttcacgcggaccagtggcgctccggtcagggggcagcgtcgaccatgccctccgccaccgccggagctcgcctgctccgccgcccacctgcaccgtccgctgcccgggaaggggagagagagaggggaaagggaagaagaaaaagagggagagggaagaagagaggagtgtggctgacatgtggggccacatgggccccactattttaaaattatttttttacagctgacatgtggggccacgctttttattatttttccgagatataattgccacgtaagcgccacgtcaatgccacgtgagatgaagacctagtcaaacaagccacgtagatgccacgtcagccaaaaccgccttcaaaaccgccgaggaaccacgtttaacagattttcgtaagttgggggatgggtcatacccggttttgcggtcaagggacaaaaatcggactggacgacaaatagagggacctaaagtgaacttattccacgtgaaaaagatctggttgcagcctcaaccccttttctgggaagatcactggttgggaggaacaagcatcagatcgatcgcgccgtcgatttacgacatggttcccaagaggattcgccgtcaaatatcggtggctgatgctttgcgacacagaagttgggttcgctacggattgagggggcagattcttggaatacctgcacttatggtctgccgtctcaaccacgaccctgatcgtcaatcagccagataagttaatttggacttggacaaccacaggatgttacacggctcgatcggcgtatctggcaatgttcattcattggaagagaaaaattcccagtgaacttggtctggaggaacaaaacgccgcaccgctgccgatacttcatgtggcttgtggctcatcgtcgttgctggacagcggatcgactgaggccgcgaggcttgccttcctcacccggcgaggtgtgtgctttgcgaccagcacgacgaaacgattgaccacatcctgatcttctgcccggaatccgcacaattctgttggattgtgatgaatgccattgggcgcccggatctcttccccgcttcttgtcccagtctggaccttctttccgctgaaactgctcctccagcgcttgatggcatccaaacaagatgaatgtctcaagtgatacaagaagaccactccagggcagtgacctcaactgacggcactgatcgatcttcagaaaacgaagcgagcaaaagtcatccatatcatgaagctgcaacagatcagagcaatcaataacatacagctttgtaagggaaacaagatcacacaacccttccatagatgataggccaatgcaagatcataggttcagttccttcaacgttgtctggtggccagatgttgcatcacctgagggcagtggtacaaatctaatttctgaagtcatggcatgccacctagatctggtatgaagcagcttccaatttccgttcgagtgcatcttctccccgtcgactctagataaactctcccattttgcatatggaatcattcatgaaaacagaattgctgaacccgacaaatgttttcacgagcaccagaacctctttctgaaaattgacaagagaacaaaaaataattaaagcagagacatggaatcatggagaggaagatgctaaacacttaaactgagcacatagcatgaccttacacaggatgacaggaatcataagattaacctgtgcattgtattttgcagctgggagcctgcacttttttgcagatcactagatcaaaagcaacatggcaaaaaatgtacagggatattacacaacagtaatgagccaaatataatttctgtgaatggcagacaataggcatgttgagaattagccatccctctagcaatccagcacatattgtacattagttcgtacagacagtatggttaaaaaggccatctcatgtttgaatctctggtgtatttaactagtcagaaaaatacatatgatgtaatgcatacccgattatccatctgatttcaaacaaaaaatacatactcagttctttccaaaaaaaaataaaagaaactccaccagaaccatggtcctgatgttcaaaggtgcacatacattgcatcctgtggaagagtacaaactgtaagcaatgactgatgaatgttctgcagctcataaagagtagtttaggagcgaaaatgcacaaacctcataataaattggcctggttaaaatggaacgcataaatgaattttatgacagcttatctgcacagttaatgcccagccatgggcaagcacaagctgactaacagcaccggtgcgcagtgtgcccagtggccaagttgcaatcaatgccacaagtgctagattcccagataactcactgaagaaaactggaagagcttgctgcagaatcagttggatg

SEQ ID NO: 63417 - DNA, 772 bp, Oryza sativa
ggaaaagcataatcgactgaacaccaatctgccagttctggcaattgtgttaattgtagtgtttccagggagggaaaaccaacatccccatagaaagatgtgtctatacactccaatgcgttcattgtatcaatatgaagctccttgagacatggtagctgacctaaaggtggaagcaacttccaacatgtgcaatcatggatgttaatgtgttccaatctagatagccagttgaactctagccaagacggagatttataacctgggtatccatcaacagtcagttccttaaggccagggtgaggtcttaaagcattgaacacatcatactctttatctgacttgctatctgcattagaagaatcccattgcagcttcaatctagatatttgactcttgttggctaactgagcattagctgcctcatccttgttattcacattctcaagagacgaaattacaagaaattcctggagttcattcatgtcctttagaatctctaatccctgcactttcgctttttcaacacaaaattctccgactgcccgaagaaatggtatattccccgcagaagccaaatcaacaagaaggtccgtatgaatatcaatataaaatatgctgctgaggttatccagattttttgggaagatgacaggtcctgtatccataaaacatgaatgtgggtgtacggataacatttgcaaatgataaagactgcagagtgattcaggtagaggatggttagtgtatggagaattagggctgcaggaat

SEQ ID NO: 63418 - DNA, 3315 bp, Oryza sativa
actttccttttcgtaatttcttgttgctacttgttctctactctatacttttcatattagaagtcgttcaagttttttcttagtcaaagttatctaggcatgatcaaatttataaaaaaaattagcaatatttataacatcaaattagtttcattagatttaacattgagtatattttgataatatgtttgttttgtattgaaaacgttactaaatatttctacaaacttgtcaaactaaaagaagtttgattaaaaaaagtcaaacgacttatgtagtatgaaacggagggattactattcacaagtcacacctctcgttgctaagaaacaaacgatagtatacaataattgataatgtagtgcttattttatttctagtgcactgtgcgtatcgttgtgttcatgtccactggatgtcaagggtattgtcctttgctgatgtcgactgcatgacgtcacagtttgagagcacgagggtttgaataattgttgttatttttctaaaacttcgcattgatgggcatggacccaaccaatgtaagagaagcattagcaataaaaaaacaaagttagcatatctttcgatagcaattagcacagcagatcaggacaggatgcagtggttggccgttggtacagcctcaaaggacaccaacttggggtgctccaatcaagactagttttcaaccaattactaattaggtaatttaaaataccgttggtttaatttatttatcatatagttttctttgttaatcttccatcttccctaaatgagtagttttaatcaatacttggtagtttcgacaatcattttctgtcccatatatagctcacatgatctcatatccagaaagcaagcaaaacaaaatatcatcaaaacaagaagaagaatggataagaacatgatagtccatttgatgtgcaattgctgaatggtaaggcaacaaggtcatcaattgtaaggaagtaattgctcctttttcgcaaaagaaaagaagaagtagttgctctaaaaatgttcagaaaatcctactttacgattgggagcaacttactttaggatcctatgtatctgactttattatataaaagaagtatctgacttagaaacttgccaaagaaaatatccacttgcaaatttttaaggccaacctttttgtttgttagttgtgaggtgacaactgtactaagaaaacgaagaaacacctcccacccaaaagttcttttttggctacaatagttgcaatgtacatttggactttctgagaggcaggatggagatggatatccaacatcttggagggacatggataatggagtggatgcagaagtatacctcaccaattataattaaaaaaaatctgaagaaatacatgtgctgttcttagcctcttgcaggggatgcatgaatctagcaccacaactgattgaagaattaaagccatgaaaaaggctggtagatgagagatagagagataccatactatgcagacagtggtgcatgatgatgagttcaattctttcagagaagtgtaatgtgggcaccaatttagtaaatgcagagagcaatttcttccaagcaattaaaggaagaaaatgataccaaaggtaggtcactgttattgacaacaacctaggattttttttcttctggtgataattaacagaaagtcaatcatgtggaaaaggaagaattttgttagcttgtagctattgtttgagataaagccaatttctccatccaaaacctttgattactgagtttatatatagcctttagcactgccatttgtctttttcatctgaaaaaagtatatataaatcttgtatcaatactatatagatcttccaaattgagtgatgaatatcaaaagaacaactagatcttgtttaagattacaggacatagaatgcttattatataaccaagcaagattaataacctatgtaagtgtcgttttctgccagcttacttacacacctctgcaaatgtgaaggccaacactcatccataaaaaagaaaaaaacttcacatacaagagtactataaaaaatctagtgttagtctcatgaaggtaattaatttccagctgttcatggtcatagacacctgttgttcacatccctttgcaattagtaaacttaaacaaacacttaatcataccatcctttttccgtgttcagtgaaactctgaaagcgagacaaaaataattggtggcttcaaacaaaccacatttctctgcacatttcttgtgcaagatcgaacaaatggaagatcatggagatccatgttgtgcaacggagacaatattttcaactgccagccatggaagggatgagtacaatttccattctgaaaacaagcttaaaaatggtgatcaagagggagagctccatatgcgaaagaacaattacatatttacatttgagagacctgcagacagatttaagcacccaaatttgatcattccttctataaatatcccaccaataacccttgcatacacatcaccaattattgcaaccatgggtgcaatacttacttaaccatcatcaccattgtgtttatccccttctctctctctctctctctctctctttttcttttttgaagaccatccaaacctctcaaccaaaatgcaaaaattctcacaaagtaaaccaaaaggaaattgaacctctaatcccaaatactaattaagatgcgtacatttcaccaacgaaatccatcctcgatgaaccaagaggcgattggaacaggtcggcagccatgccttggaacacgtcctcctcctccaagaagctcaagaaccctcccggattcagatccatccacaggtcggtgtgatcgggatgatcgtagccaaatccatggccttcctccaccttcacctcgcacttgatcttcttcttcttcttcttcctcatcatgctctcgtcctccgccggcgccggcctcttcttggtggtgaccttctccttcttttcgtcgagcaccgccaccggcgatggcggcggcaacgtcgtttctgccgattcttgctgctgctgctgctgcttgccggtgaggcgctgcacgaggtcccggaagttggcgacgtcggtcttgatgatctctggcgcaatgatgtggatgatccttatcttgggcctctccttgtgcgccgccgccgcctccggcgagcccttcttcgccgccgccgccgatggcggcggcggcagcggcgtcgatgggctcatgctgttgtagctgcactcacccatatctcgccgaagacgaagaagacgatggtagctagctaagctaag

SEQ ID NO: 63419 - DNA, 2872 bp, Oryza sativa
aagttgagagtagtttagcaagagagatgtttggtgttgctttgcactactatcatgtacttagctgatagctaggtagctagcaccttgattgccatgtgggtatggatcatatagttgcctcttcaggtgattaattaattaacatataatcaagttgtgacacatgctaacataactagcatgctcatattttatccctagagcatacatatatcacacacatgccctttggactttgttgttgattattattactacaagtaaatacatacatcgataggctcacagcgtatatacgtgcacatatgaactatgacgcaacaagttgatcgtggagagaaaaaaatattttcaagttgaagattgaaccactgctttggagccgtgtaactaaggccatatttaagagaacttttagccagttgtaccttctctaaacatgataaattctcacataaactttaaaaaaattgtaagtgtagaatccagatgacagaagccaaaaaataaaactagaagtactaaactgaggaattggctttttcagatttccaaagctagctacgcaacctaattttcactagaaaattttaagctccgctaaaccggatagggcatcaccgagagatatcctaaaatcaatctccacaattttgttttcagaaatcataagcaaaatttgaagtgtgaaaatatttatctttccaacatatgtctaaaactgatttcttataaggggaaaacatatattgcaaaccacatatatagtgaaaatatgaaaactattgttggatccataaatgaatgtatgcgatttgtctacgttatcaggagtaaaaattttactcaataaaatttgtactcatagttgaatctgggagtaaaatttttactctaggtaacgtggacaaatcccatatgtctatttttagatcaaacaatactttttaggttttcacaatacatatgatttgcgctacatatttctcctcttaaaagtgaaatgcatgtgggctcgaaatatgatttttcaatccttccaaacgccgttactgctgatgaccccccgagctcaccctcaaatccgtggaattctcgacttgtggagagtggatatccgcggattgggaacgagtcgggaatggagccatttttttttccagaaatccaaaattatagggttggggatagtatagcaaaatagcatagcccctgcatattttgcgatagtccgtaaattattttcgatcgttggatctagctgggtagaatccttttcaatcatttgatctaacaatgctcatccaataattgaaaatgatttgtttgtgtgaggtcccggtacctgaagatattttttattggaacgaagcaaatcttaaattttatcctaaaaactaaaattgaatttttctgttaaactaccaacagaatttcccttctcctccgttaatggcgcgctatctccttgcgcttctccctgaagccacgccatgcctagcaacagagcgaatatcctgcatagcaacaaagcggataatccatgcaaggcagtaattaagggatctgtgtttagttcacgttaaaattgaaagtttggttgaaattaaaacgatgtgatggaaaagttgaaagtttatgtgtataggaaagtttggatgtgatggaaaagttgaaagtttgaaagaaaaaattgaaattaaactcggccttaaatccttcaaaattggttttggggtgaaataggaggatcattggtgatgctcggcgcttgattactgctgatccagcgttgcgcgccagcgagagccgcggacgaggcatcgtacggcgctagcggcgggcggttgggatggatttctcaccgtctgtctccggacagcctggttgttgcacgtttctgtttcggctttagccgttggcatgcaaattttctaagttttacttgcactaataattttggtagaggattcttcgccctcgtgcgttgctcgcgtatacttgcttcattttaccaatagataactctgttgatttttgattttgatataacgtatacattgttgattggatgtacccgactacattattagtatagcatgagaaatgcgggtacgaaagtatacatgagattgtggtaaagtaagtgaaaataagggatttctttaccaatttagaccaacaagataaataatatccttaatttagtttatatatatagctttaaaatgtctcacatattacagtggtggagcaagctagctaattaatctagccttccaactaatactcgtcgagaactatccaacaactagctattgactttcttctatggatctacgatccggaaggagttttgtttattatctgctacattcctatatttgaacactccttcgtatataggtatacggtattttaggagattacgaacccaagtataaaaaatatacctaatttgaaacattgatagtagtccctgatctcaatgcaaatgatggaaacaacgttcccggctatataattcgagaaagttaactttgctgggatatttgatcactcgagaattagagaaggcttgtaatccttgaacaagttctcctcgaccataggtcgcaacattggcaagttttgaatttggattgaggtaaaaaaaaaacagccctcatagataggaaaccgctaaatttatgtagaaaatttctccggctttctcgaaatatgaaccatcacttcgtggtttataagacctatttacgagatttattggagttccttttgcaagcaatgtcgttcttctccctttccgccctcaatccaccgtagaccctagccaaagttttcctttcatcaccaagatcccgatgga

SEQ ID NO: 63420 - DNA, 1168 bp, Oryza sativa
cagtatggcagtaccagataatggttgaaacaaattgcttaacaccaataattagcatagttctgaagaaactaattgtagctgtggtgattatagcttgtgtattgctatgcacatctaaggacgatgagcataaaacatatctcctatttctatgaaggaatcattctactattgatgtaaattatggaaacagcacagaaggtacgaaacaactcgtggcctacttagcaatccaaccctgcgctgttaagagacacggtgtccaagataatgctatcaggctacagcacataaaattgttaatactgttacatacctagatgaatcaattccttcgggagttgtgaagaactcaaatcgaagagaccattgcacagaaacttttgaagtggaaaatgacattggtccatcaattggaactgaaaagagaaagcttgtctggtgaagatccgcaacaacttcatagtgctcactgtgtacctttgcagagagtccagagaaaaatgagtgaatcattaaaatcaatttgctgattttacagtgtaaatgactaaatgttttttagaccaaaaggcaagcaaagtaaccctgcttcccgtcgaaagcaaacagtgtaagtacataaagacaaaaggtggtctttttggtgaaaaagaagctagcagaatacacaacatttgatattggcatgttactagaatgcactagatttatcaatagcaggtaaaagtctaagactcagaggtgcttatagattcttgatggccatgactaatattttgtgtttgagggcaattagcacatgccctttcctcgacaaataaaagtgttaagcacatccctactgttcgaatggcattgtccatcatgcttattgttccatagttactgtttgctgcaattgctgttcatgcacaggtagtttgtttttccaaaggttaggttattttttcttttggaagctttactactaatgtactccatgtgttttctaaagactatttctacatttcctaggtagagtcatcaccacagaagggcattgcaccttctttagtcgagcaaagatgagtaaacaagttcctaatccctaaagtcccattgtggtctcccttggccagtgattgtactcccgacactccttccccacggtaaaaagaaaaaa

SEQ ID NO: 63421 - DNA, 1934 bp, Oryza sativa
tcaagactgtgaggtatgtctaaaatgaagaattttaatcattcatatttccagaactatcatgcaatactaggaaaaactgaactgaaacacacaaatgaaaaccaattcattttttatgacattaaactagatcagtccttcaaaacaagagatgacttacatgtttttgtttgccccgaagcaattataactttagggattagcgagggtgccgaacaatccagaaacaaatgttcacctacgtatgtaatgacaatataaaagaagattatcaggaagaaataaaaacagcaattaactgtttccagagatgataaaagaaacttaaagggatgcatagagaattgaacaagcatggcgcaaacttatgaaagggacaaaactacaatttcttaacttagtttctaaaaaccccatgcataatgttctactactatccaatgaatagaacataaacagaaatgctagctacaacaaatttgtaggttaattaaactgacagcaaatgcaaaatggcaaatggatataaaatcaacagaggtgaagtacatatgatagatgaaacgtagtagcactggtacagtggcactgaagtcaaagatggttacaatcatgtttgaagtcgattgcaagagcgtacctctcctttgcttagaccctggtaagggctttgaaacagagaaccactggctatccaacttctcaatccctttgatctcgaacgagagcccatccaccaagagcgagggggcatcctcaccggtctccgccgacgccgcgtcatccttcaacccagctggggtgcagatctctatagtcgcggtgaccgaatcaccgggtctgtacacctccctgtccgtctggagcttcaatctcggggagtgccgctgcctggccgccgcggcatcggccttcctctcctcgaaccacccgacgcttctcaggaaggagagcccttgcgggatcgggagcttcagtgacatttcatcaacaggttgcctccgattcaacgtatatccccaccgccgcatcaacctcaaaacgagaacaacaacccaatccaattatccaaatcccccaagctaacaaaccgaacggattcccaatctgtatacaccacgcacgcagggcggctcatcaatcgaagtggcgcgtacgagcgagcgctacaagaagagaatggggattaccttcgattcgattcgaagtgggaggtcgtcgcctctctctccgagcctgctcgccggccggccgtgcgcgcgaggggccggggagaggctcgggcggccgcggcgaggaggaggcggggccgcgggggctcgtcggcggccgcgcgcgagacgcaccgcagatcggatcggaaacagaagaggggagagagaagagtaatggagtcgagagatgcgggaaagagaaggacgacatttggtcaccggccgttttcctaaagttcgtttttgtttgaaaaaaaaaaagagaattctaacattgtttaaaccattgaaatcgatgtgaattactccatccgtttcacaatgaatattttccacattaatattgatgttaataaatctagccatatatatctatctagattcgttaacatcaatatgaatgtgggaaatgttagaatgatttgcatcgtgaaatggaggaagtagaaggcaaaatgattggacattaggttagcaataatataatgcttagtgtggccaattttaaaacaaagattgatgatttgctacattgaagattgttcgtttgattatgataccacttcacgatcatggcatatgggactatctgatcatgaggcaaaatggaaaatagttgaaaactattttgtggagtggcaaaatagcaatctccatgtctttggtaaggtttggctacaaaatggtaagacaattacacaattgcaatcaagagat

SEQ ID NO: 63422 - DNA, 1390 bp, Oryza sativa
aggtattactctgcaaatatacgtgaataataacagtcagatcaaattcagcttaagaaattacaattcctgtttatcttcaggatgccatgagaatcggctattacagaaaatctgagataaatcgggaaaaaaaatgctgaaacagaactttagtaccacatgtccacaatcccttatctaaaacttcaacgcacgggtcttttgtctttctcgagtcttttcctgataactttgacatccaaagtaatgtgaagtgcacagttgcaggtatattttagtctttgttagcacaaactttttggttccacctacactactggtgcgtgttgaaaccataacatttacagctggtaaatactaattacctaatattttacagcatttgtcaaaccatggaagttgtggatagtcagtataatttgttaggtaataatatgatattttttcaatctcaaacaaattatggttagtgttttacatgcctaatgtacagaataaataccgctattagtcatataaattataaagggtagaggtgcatcctctttgatagttaaatctgttaggcaatagaatatgccgtctgtggatatcccagctgctatagatagcagatgtaaatcagggattagctactatagatagcagatgtaaatcaagggaattatccttgccttgtacagcaggccagccggccctatataacagaaggcgccccctcccattgaggcgtggccaattgccccctaatccaattctctacatggtatcagagctccgggtcccgatccccatctaacctcgagatcctctcctccagcgccgcccccttcctccctccctccccatgggaacccaatcggacctcctctctgccactagcggcgcccttggggccaattctgcccccgtgatctgccccttcgccaccatcaacatcaagctccacgtccccatgaccctcgagttgaagccctccaacttcaccaagtggtcaacagcgttccaggccacgtgtgggaagttcgggctgctgcatcatctcgccaccgcctccacctcgcgccccaccgacgaggcctggaaacaggctgacttctgcgtccgcggatggatgtacagcaccgtctccgacgccgtcctcaaccttgccatgaccgatgacacgcagacagcgagcgttctttggacggccatcggcggggtgttccaggcaaacaaagctcctcgcgccatcttcctgaatcacgagtttcactcgatgactcagggggacctgtccattgacgcctactgcgttcgcatgaaggagaaggccgacgaactgcgcgacgtcgggcagcccgtatctgagcccaacctcgtcctcaacctcctgcgcggactc

SEQ ID NO: 63423 - DNA, 3151 bp, Oryza sativa
  unsure (1)..(3151): unsure at all n locations
aggtcctggtgccccggctgggcgcaacaggggcatcctcgggccttccccgcaggcccacaccgcctttgctccactccaggcgtcctccagcggctccaacacctccaccagcacntgggatgcagccggcctcatcgctgccctgcagaacatgcaactgcagggcaactcgccctaggtcgttgactccggcgcctctacgcacatgacgtcctcggatggtatgcttacccaacgccttcccccctccatctcctcaataacagtaggtaatggcactagtattcatgttacgtctagaggtcattccatccttcctacacctaccacaaatttcgctcttaataatattcttgtcgcaccatccatagtccgcaacctgttatccgttcaccaattcactcgcgacaatagttgttcctttgaatttgacgcccatggtttttctgttaaggatctcaggatgggacgcgtgattctccgctgtaactgcgacggggacctatacaccatgcctccctccacacctggcgccccacctcatgctctcctggctgcttcgtcgactctgtggcatcaacgtctcggtcatccagcccccgccgcattagagcgtcttaataaacttcatgctgtttcctgtcataaagtagaccactcgctatgtcactcatgtcagataggcaagcatacgcgtctacccttcagttcttcgcattccataactcatgcaccctttgaacttgttcactgtgatgtatggacttcccccatcaatagtctgtctggtttttcctattacctggtctgtttggattcactcactactgttgggtttttccgctccgaaaaaaatctgatgcccaccaacacttagttgagcttgctgcctttgccaaaacacaattcagcctccccgtcaaaagttttcaggctaataacggcactgaattcgtaaacaccgccaccatcaaattcctcgctgctcaaggtactcaccttcgcctctcctgcccctacacatcaccccaaaatggcaaggctgaacgcatcatccgcacactcaacaattccattcgtaccaagctcctccatgcctccctgccacccacatattgggccgaggggctcatgaccgcctgctacctccataataggcacccatcctcctccattcagcatgaaattccctacactcgtctgcacaaccagccgccaacctatagccatctgcgtgtttttgggtgcctctgttaccccaacatgcaagcaacctccaaacataagctcgcccctcgctccacggcatgcgtcttcctcggatatcccccctcgcacaaaggttaccgctgccttgacctatcgacccgtcgcatcatcatctctcgccacgttacatttgacgaaaccacctttcccttttcagccaccttagccgcctcaccctcctccgcttccctagacttcctcctcgacgacgatatggtttcggtgccttgtcctactgttgttgcaggtgggcttccatcctcgacgcccgtggtcgctccatcccactcggatgttgagcaaccgccctcagatgctgcggcctcacacggatcgccttcttcgacaccgggcaggcgcggtcccgtgcccccgcctggacccagcgtggtccccttcccacgagtctacgtccgccgctcccgtacggcgtctacgtccgagccggcaactgccccagcagcccctgtggctcctgacgccccggcgccacntacggcgcccacaccagcaccggcggcattccccgttccggcaccgccaccgccgccaccgccgcgcgccactcgcaccatgacgaactaccgcagtgccctggccgacgccaactggcgtgccgcgatgatggatgagtaccaggccctcgtcgacaacaacacctggcagctcgttccgcggccccctggagccaacgtcgtgacggggaagtggatcttccggcacaagtttcatgccgatgggtccctcgcccgccacaaggctcgctgggttgtccgcggcttctcccagcgcgagggcgtcgactacgacgagaccttcagcccggttgtcaaaccggccaccattcggtctgtactcaccatcgccgcgtcccgcgcctggcccattcaccagctggacgtgaagaacgcctttcttcacggccacctcgaggagaccgtctactgccagcagccgccaggattcatcgaccctggcgccccagagcatgtctgccgactgcagaagtccttgtatggactgaagcaggctccgcgggcctggtaccagcgcttcgccaccttcgtccggaagctcggcttcgtcgcctccacctccgacacgtcccttttcattttacgagaggggacgagtctcgcctacctactgctgtacgtcgacgacatcgttctcaccgcctcgtcctcggccctcctacagcgcatcatgactcggctgagctccgagttcgccatgacagaccttggcgctcttcaccacttcctcggcatcgctgtcacgcgctcctccgatggtctcttcctctcccagcgacagtacgccgtcgagcttctccagcgcgcgggcatggctgagtgtcatccgacatcgacacctgttgacactcacgccaagctatccgcgaccgacggggatctactgtcagaaaaggatgcatctgagtacaggagcttggcgggagctctccagtacctgacgctgactcgtcctgatctggcatacgctgttcagcaagtgtgcctcttcatgcacgccccacgcgagcctcaccgtgcgctcatcaagcgcatcctacgcttcgtccaggggactctctcctcgggtcttcacattggcaccgggtctgtcgacaaactgactgcctactctgatgctgactgggcaggatgcccagactctcgacgatccacctctggcttctgcgtctatctcggcgacactctggtttcctggtcttccaagcgccagaccacggtgtcccgctccagcgccgaggcagagtatcgggctgtggctcacgttgtggctgagtgctgctggcttcgacagttactccaggagctccacatccagctgccctccgccaccgttgtcttct

SEQ ID NO: 63424 - DNA, 2452 bp, Oryza sativa
aattgccccctaatccaattctctacaaaatctcccatatttgaatcaagcatcatgactaaaaagctattcatcattctaatttgttaaacccaatctaacctttatatgacatattgccttctaatccaatctccagggtttgatcatattttgtgctcttcagctgtataactccaatctcaaatattgtgaagatgccaaagaactaaagtcaacattattttgggaaactcaacacaattggcactgccactcaatgtttatggccaaatcttggagctgaaagcctgacacccaccttttaacaactccattattgattatatcagtactcaatacctaaatttgttaatttgaacttcttcccttctaacttgatgatcctgatactctagctttactatgcctagtgaaatgttgcacccttcacgatatgacctaaaaaaaggtctgttgttctggtaatgctaggtctagcgtattaccaggaactaccaggatagttagaagctatttcctttgtttcacattacaagaccttttgggttttgaatagatgcttgcatggatctatgtatgtgcttcatatatgtgtccatattcatatggaagtcagtgaatctatacgagggatggagaggctaaaatgtcttataatgtggaatgggaacgaagggaatagcaactagcacggcatcagcacactaaaaaaaattgaacctgccacaccagatcccaatcaaacgaggcttagaccagggaaaatctatgataaaaaggtccatcaaaaggatcaatttgagcatcggattgcagcatttaccttaaacacaaaggaaagctagcttgtagtagaaatcaagtaagtaaattattagtacctaaatgaaggtcatgagtccggcaagagccgggcctggtccttgtgctgcagcgccgcctcgtcctgcagccgctgctgcgcctcctccttccccttggcgaccatgctcatgtgcgcctcgtacttgcgcagcctctcctccatcttcgcctgcacatagcaccaaaaaaagcagtagcgaggtgagcttccccccgggagagaaacgcgcgcggggaggaaagcgacggggggcaggggcaggggcagcgagcgtaccttgtgggaggtctcgaggcggtgcatgacgtagaagccgagcgcgccgccgaggatggtcccggtcatcacccgcacgcacgcccaccgccgcgatcccggtggcgccatctcccaccaaaccttccgccgccgagagaggagagaatacgaagggagatgttgctgccgcagtggcagtggtgcgtggttgggccagatgacccgggccgaaatctgaagttgtcctaatatgtagacaaaaccgaaacgataccgaatcccgatccgtgagttagagcaggtagaatagtagactataagctagctataaacatattttaagaagataaaagaagagagaagagcagtgggctatagatttgtagctagctgcagcacggactccaagatgtaacatgtgtatgacatgtgagaccaggaattataaaagtgtagtgtatgtttataggtacaattggctattaaattgactatagatgatttggagctagtagttgattatactattaaacttgctcttatagtatcttatggtactacgaactcacaaaccgaaatgataccgattcgatttatagtatccaaattttcatagtatgttgattttactatttattttcacagaatcctacgaaatatgatagtatcccgactccacgatccttaggatcttataaaatattgtttacaataagaagaattaaaaaaaataatgtgaataagtatgctcaagtttacataaaaactaattaaatttatcaaaaccaatatgacatgttttaacttttacaacatactagcaaagtgcatgtgcattgcaagggaagaaaatgtgtgatccaaatatctatgcatgacatcatgagaatgaaaacggtcacgataacatttattcggatttttctttcaatttgtagaatttaactatttagtgatgacttcaattcaacactaacaaaaattagaaaatttatttttttatatatagctataaatatggatgtttgaaaacaatatcactttaacagaagaggactcggtactgtctcgttcatccaacttgccctcctcgattgatgggagaaccaggcacctccctaaggccttattcggttccttgggttccaatccccaaggggaacctatccagggagggattgagtgaatccctcccatatcactcaatccctttgggggtttgaatcccttgcatgttcctaatccctctcctaaatccccatgttcattttgactgggaataaacagcttggctacaatcccacaattacgggcccaatctagtga

SEQ ID NO: 63425 - DNA, 3284 bp, Oryza sativa
ataccagaccctgcaagttccgtaattcaaactgcatcctaaaaagaattagaaacaggcgagtagcttcagatcaagctcagctcaacagggaaaataatacaaatgaggatgaaattgttcagaaaattcccattggtaatcatgtgcccaagccaaactgacatagcgatacacggttatcccatagtctttcaaaggacaaagtaccatgcatacagatcacacgaccacagatttgttgacattttaaaaagatgataaaccaggctgataacatcagcttgtaccgtcggaatacaaacatgtatctgatatagagtatttcattattgtaactgaatgagatagtccaaaaaataagcttagataaagacaaaaatatcttttacttgagaatctgagcattgaatctgaggcagactgctaggattcagagatgaagctatcagatgattagtcaccatgcacaaatgcggcacgataaaaatacacacaagggtatagcaagagtttgaacttcagaaagtcaataagcaaagggagagcattttgagtggtttctatcagagcatgatcctaagctctaatccaatgtcttccgattccagttcaagggtagagagcattattccaaagaataaaaaaacaatgtataagatttgttcacatattatatgcatggtatgcgaaataaagtaacatcctagggtgaacagatactagtattagtaacaattcaaattaagcatacaaaattactatatccaagaaatggtattctcatgtgaaagaacagcaagcagttatatatcttcaagcagcaagaaatggtatagtttcatagttaccttcttggtcactatatctttttgttacaaaaaagaaagttgtagtgctgattcagttaaaatataacagggggtaaaaatgagggaaaacctaatatgagaaaaggaactagtttgcacaagagaagcaattaagatatagttacaacactattatactgtgccaattccaactgttataggtttatgtggatggtacctaaaacaaagtgtgtatcagactatcagcgaaccacattgaacgaatgatcttgaaaaattctggttgccataattgtttggcatttttttaacatactgaataagcacaagctagaacttaaaaaaatgctgcaagcgccagatgtgcaactccaggaaaaaatgatatcgattgattttttttctctttgaaaccaggtgttgattattaactcaatacgaaagctgcaaagcagcggactgcagcaattcttgaacttgttcgatagcacgagcaaacaaagaaaaacttataaacttgttgctggatttaaccactgaaatctgaataggatggccttggcgtttcttgcaaaggcacagtcttcacaattgcatttccacgactgcccagcataaacgacgcaataagtaggaaaagatttaagattcagagaagagaggagtgtgaatagcatcaaggctgaatctttgaaaccgatgaacacgatttacacgcgaatctgcagagcctagaaggccagagaatgtagcagcgggttagatctgtggctcgcgatcagacgatggtgcaggagtaaccggggtggtcgtcgacggcgacgtagtagggccggcacgccctgcagcacttcgtcagctcggcgcacttcttcttcttctccgagggcgtcacggcggtggcgccgttagtgagggcgatgggcggcggcggcggcggtggcggcggagtggatgcgctacgaccgggagcgagatggcggcgacgacgggaaagggagaagagaaggaaacctaaccctagatttggaagaggaggggagagggggaaaggcagcgtgctcaccggagagaaggtggcggccggaggagagagccgtgccgtcgccgtcgcgtcttcgttgcgccgcctcctcctctcgcggcttgtttggaaactccagggaggggactggattttacgcgagggaattaatgatgggattaaaatggggatttaatttttaatctcaatatcaatatcttgtttgtttggtaggggtgatggaaattgttagggagtttagttggagattagatcattaataaaaacggatagctgatatttgcttagacaaagtaaaggggaattccctcccaattaccttcccctgccaggtattgaaaaggagggagttccttccataattccccatcaccatcccactaaaatgcgcccaggtattaaaaaagagggagttcctttctcaattccccatcaccatcccaccaaaattaacatatctctcaaccaaacaaaacaattaatagcctcatccctctaaactctcaatccctcttaaaaactccatgcaaccaaacggtctgttgtagaaattttccacgccctacgaggagtagattctttcccgggcctagagaaagggaaacctcgtggtgggccaggctaaaatccacactagagcttaaccgaaggaaaaagtacatcgaatgtctctcaacttgtcattgagttaaaaaaaaccacaaaaccggatacaacacatcctccaacttacataaccagagcaaattagatcccttagcggtttttgactctatttttgtccgatgtggtagctaactctgcgtgggacccacgtgggccccacgtttcagcatattcttcctctcacctctcttccatctccacggtcggcgggtgcaagcgagtggtggaacagcgcgtgggcgggcgtcagcggcgggggaagtagctgcacgggggacggctggtgggcgcaagctgcaggggaggagctgcgtgcaggcggcgtgcgagcgggcgccggcagtggggaaagcagcggcacgggcggcgccgcttcgctgccttctccatcctcctcgagttcgtcctttctcgccctgcccttgcaccgacggccattctcgccttcgctgcctccagcgacatccccgtggcatagacatccggatggacacggtggctggaggccatctcgccgtagaagcggacgatgtcttctgtggcggcggaggcgggcggtagcggaacaacgcaaaggagatgggcagcaccagcgcaaaggagatgaggtgctcgtgtcgatgcatcgatgtggcacccgcagctcctcccctcgccgccggcgctccgctcctcccccccgggcagcgtcaccgccatcaccgttgccacgttggtgcctcgcactgggctgcaggaat

SEQ ID NO: 63426 - DNA, 2648 bp, Oryza sativa
ttagttgagggacgcacggtatctggtttgcggttgggggacgattttgtaactcgatgacaagttgagggaccttcggtgtactttttccttaaccgaacgcacaatttcgtatggccgggattgtttcctcgccaaggtgatccacagagattgggccccgatcgcggccgttcctggcccaaccgaacaagccttaaagaagaagaactacagcgagggcaagggaaagggccgggagttgaaaactactgtatgatttaatgtagttatcaatttcgttcatttgcttgaattggacagataagggcctattcagttggtaaaataaaaatttttagttgttacattggacatttggccggatatcgaaagagattttcggacatgaatgaaaagctaatttcataactcgcctggaaaccacgtgacaatcttttgagcctaattaattcgtgattagcctaatgacggattaattaggtttaaaagattcgtctcgcgatttacctacaaactatataattagttttttattcatatttaatactttatacatgtatcaaatattcgatgtgatgtttttaagaaaagtttttggaaataaacaaggcctaaaattactccacaaagtcacagcactctctgactttacaggatccaaatcctcctcgaggatggaacgaaacgaagtgattaggccgcttaatcaaatcgattaagcaaaccacttcccttccgcgacgcggcggcgactccggcgacgcgacatcggcgatgctcctcgtcgacggcgagcccgtctccgcctccgcctcccccaccttcggctcctcccgcggggtgcgcctacttggttgttggagggatttcttcccaccccgtctctcaccctcccgattcttgcaggggagcggcgggagggagctggtggcggcgctcatggggaaccccgggctccgcgccgcatcggagaggctcagggcggagccggagaggcggatctcgtcggggccagaggaggatgatgcggacgccgcggcggcggcggcgccgaggcacgtgtacgtgttccagcgggagttcgccacggttgatccggcgcgcgtcgaggtgcgtgcgtgatgcccgggatttcacctcgctgtagtaggttcaggcctcgcggtttgattgggtagtgtcgtagagatggggggggggggcactcagcgattaattccggcgttttgatgatgaattgtttgagttagttgttgcttagcagtagcgccatgaaatgcttgctgtcaatatggattttgtttcactagaggggatcatgggttgctttcaatataaatgctgggcatttgacatggagtgaagctctcagtagtttacgcatgatttagcttggaagcaaaggtgaggccttctgggaacgaaggataagggcataaggcccttctggaatgcgggaatttttcccgattctcgtacgaaattaactgattcctgtgaaattcctgcgacaaaccttgaaactactgcattctaaccgaagcttaaagttgcggtccttatgtttggaggtttgtttggggacattgtaggcagtagctgtaggtggtaaacttagtactaggctaccagcagaagtttctttatgcgatttctatgtagctaacgaactaccaagtccgttgtgctgtttaagtgtttattagttgactttgttagtgaccataaaaggactgttgacatctttgagttgaaaatgttctgaataaggatataagttgtcttcgactggaaatgccgatttgtgataactccaatccatattaaagttccatttggcttagagtctgttcatcgactgttgctgttacagtcccttgaacattttgatggaattttttccttatttcacttgggtcttttgcatgtctgttgctaaaagttaaattattattcctggaccattcgatgtcagtatattgcactttatatgttaatccattcttttgcatctgtagttagtgggcacagatgaggtgactacatgcgtgggtgtagtaattcgcaacaacaagactggaatgtaagtgaaaaaggaagtgagcatttaagctgaacctgtaaggcttttggtttcttgtgtaatttagtactcttatttatcttttccatcacttgatgatacctctttctggtattcttaactaatttcaggacctccattagccacatggacttcccaaaaattgtggagggagggctcaaacagatgttagaattacttggtgatgacaatgcaccgtttgatgtttgtatctttaccccctttgccctccaaacatagaatacgcacccttggtgaatggtgatattcttactaccatttgactacaggttcacctgattggtggctttgatgatgtttctacaaaggttgaatttcagagcgtactgtgtggttaaacttcctttaatttttgttagcatgatacctataggatcatgtaatttactatattttgcaccgcaggttgtacattctgctggaaggaagcacatcaaacaggaagggtattcctatccactatgttgcaggatacttgaggtgttgtataagtcccggcagcaattccatcttcgtacat

SEQ ID NO: 63427 - DNA, 4887 bp, Oryza sativa
  unsure (1)..(4887): unsure at all n locations
aatcacttaattgatgatcctatatgctctatcgatatcttgttctgctcgtataggatgccggattgggctgaaatggcatcatcacttaaccagctatcggactctgaggtcttgttgcagtgctccacctctccagctgccgagccaccacattttgtggaaaatgagagaaggtttgtgcccatatttttctacaaattaaacctgtcatcctgacagatgagagactgatgtggtttaagcttttctttataccatcttgatgtaggatatggagatacttgattgaaaatccatattggcaagacacatttccgaaatacaagcctcgggtcttccataggaccagtgatggaaggtggtcacgttactcaatagtatcatccagctaacattggtgctctctctacatgcggaacaaggggatatatacttcatatataatctctcctttgttagaacctgtgatagattgtggtgtggcaacacaggatttcttctgaacagcgggcatcaatcccagtcgattctagatttctttctcctgtgagttgtcccatgtaatcatccttggaaggtgaatgaggaattattcagattttccccgtagacgcacagaagtctcaagttgatgtattagcacagaacctgtgttaggattgttgattgataggcaacatggatgatggcattccgttctcgtctcatatgctccgaccattgttacttggtattttctgaagggaacatttttcattttggcagttgtgcatcctttccttgttctgtacggtgcaaatagtaggtgattcatgcgatacctggcgtgttcgttcccgcaagtatttacgttgcctcttttttaccaggtgtctgtgtgctgtgggccaatgtcgttttcactgcacgctgctcctcggacgtaattgtgcctcctctgcatctacacagcgttttgccatctccaccgtttgatgagtgggtctgttgctacgtgggaaggcatgttgtacacggttggtgcataacagcctgtgaaaatcggccggatgttgcagccaagagagattttccccctccaaatgagagagatttcttccccgcaacaccttggtgcgcatggtctatggtggaccctgtggttaagcgcttcttatccttttggtccggcgtgcaccgagaccaccgttacaagggtttcaaacatatcttcttgggattcatatggttatgtggacatgttccattgtatggttatatggtagatggatgaaaaacaataggttcttggtgcactaggatcgtgtgtgggtatagctagcctactgctcagcaaattagcgcttaacaacaacccctctttttcagcgtatgctatgatttatctccctacttttccctttcttcagtttcttaggtatgatgcctcgcaaaaataattggagaggaaaatataaaagaaagagcaaagcagcaaatagcaacctagtgctgcgttgtagttcgtggcactttagctgccgaacaacagagaaaatcacttgcttataaggatttgaggctagccaagagagtttggactttttgcgcgaagcgagaatggaagtgcagtgcgttgagtgtaggtgtggtccaagtagatgagttaggcccgataatgttttcgggtcctgtgtattacatttggcttatgagacaaccaacgaccatgaagatatctcggtaggtgtggtccaactagatgagttggcccaatatcgtttttgagccttgggcattacatttcgtgtgtgagacaaccaacgaccatggaaatacctgggtagctctgcctctatgcatgctacctgtatctttgtttgccaattctaagttaccccatgcgtcttacaaagatgctgcctctggatgtgcggttgcctccgcctaggaatcaagcttgacacaacaagttttaacaatttttcttggtgcttgtcgccgacgagattcgttcgtcaatttattgttttttgttaaggtagcaggtcgtcttgacttagctggcacccatctatgctccccttggtccgtggtctctgtgatcccctttcgacaaatcgtcttgatgtgctgctctcctccgctatcttccacgtcagctctccctagccccaaatccgctcccgacaagataatactatttagtttttggctttaagttgctttctatgtgcctttttattgctatttttattgtatttggtttgcttggaaattgggagttggtatgtgagcagccatatatggacaaagcccatgtttttcctctgagaaaatcaaacagtgatgccttcttgctggagagatttattaactctgattaaataaaccggaactttgcctaaaattatcacctttgctactaatcacagagttgatctatacaccgctcattttgtatagccattgattcaccttgatttattcttcgctttgtctcctgtttctttagtagaagcagcaactaggggcggagctacggtgagcaaggggcaggcacacggttccaaagattattttatctatagtaattctatgtttatcaattgtgcatcctccctcagttcagttaagtatactgtagaaattgttacctctctagaagttcgaaatcgttttccttttttttttaaagaagttaccctgtcactcagagcaagagaacacccaaaagatgggaaaggctgggtcgagcacgaatgtcgaggcggtcccaacggctcctcgtaccgtcccgacccgatttaacctaacccaccaccactcgccctccggttcgctcgtcgcctcgcgtctcgtctcctgttcggctcgactccacccgccgcgagagagagagagagagggagggagcaaaccctatctagggttttgcccgcccaccgccctcgccgtcgacgccatggaagccggaggaggcaagcgggccgccccggagggcaccaacggcgccgccaagcgcgcgagaggtgagcctcttcgtggtttccttcttcttcttgttttttttcccttttcttggttgctggctcttccattggaaggatggctggttcctagggtttctccagccggctaccttgttggggggctcggattctcggcggcgctccggcttggttttgagctgggtggtgattggtgaagacgggagacgaagatttggggggtgttgggattggggagcttgtggccgccttaagcctttcatgtttttttttcttgttttgttcgtttggagatgatgacggaaggctcgccactatttttttaaaatttatttttggcaatatttcgcaaagagatctagaaacgcgattggtgacctagtggacctgctaaatatgtgaacggatctagctgctcgtcgaattttcttgagtgagttgaaagagatgtccgatttctcaaggcgttaatttgaaagtgaaactcattaagctctggatactggacattattgtattgtaccatttaccttttttttttctttctgagaaggtaatgctcagtggattttgaaatgattaatgtgtacatgttgtttatatacatgccatgttttagtaaaaatcaacgctattaaccggcggaaataataaatttggtgtaacagcatcggagtcgtctcaagtgggtgtaggaagcaaattgaagccatgcaccaaatttttcaggttctaatctaacttaaaatgaactatcacctgtttacacatgctattctgcactttgctgtggttttgccttaaataattataatttgttattttgctaagaaattgttgttgaggggtaacaaatgggttaagtaagatttttctacaggtttccattgtgtataatggataacatagcagctatatgtaaaactccatttctgatgaacaatcaaatctatctgttacactgtggtaccatatcacctgcagcaatcaagataatagtattaaacgttccatatgggattgcaattgacttgccattatggaattatactacttactaaatgataacattcagtgtagcagcttattttcagtacacgcacagtgtgtttaccttgaatttgaacttggagagatgtttttctttttatattctactattgattgatcatgtgttttagttatcacatcgatataagctactccttctgctacactcctgagttgcaaaagatgttcttattatatacaattgtgaatgaatcatgcagtaaagtgataatgtgttgtcatgttcatataagtaaagtagctataagacaatagggaaataacttctttgacaaactaaaattctattattttttttaaaaaaaatggtgacacactgataggcaaattattctgtgttgctgtatgcctttattaatatgtatgctatatttactgtttaccacagtatatgtttgcttctgtattaatatgttcagtttcatgtgatgctacgagtgcttcttaataattagatagtattcaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcaggaat

SEQ ID NO: 63428 - DNA, 718 bp, Oryza sativa
attcctgcagcccttgggtttcagagtttttccagattctcagaagctggctaccaaacagctgcttctcagaatttaaagttccccaaacaggccctaagagagtatgggcggctccttcatgtcagcttcgtctcatagattgatagagtagctttcatgtacaattatgttactagtaatttcgctgttattataagacgagacgagacgacttggaaaagaggagccagcatgacgaatggattttactattatatatcacttctcttcccggtgatcaaggacgagatggtggagtacgtgcaagcgcacgtatccaagagcacacgcgataggcaagtgagaccaattgacatttgttaaaaggtgtacttgttttattcttttatttagttgccaattactataaaatgaatcatgtaacttctttcttttagaaacacagtacaaacacatacgctcgtaacatgcgcatatatctctggaagattgtgccggtatatcttgagattgacgagcgtctcgctgtataccggtacgtcgtttaccactgaaaataatgtgaggacttgaacttggatgggatggttccaccacaataaatcttaccaattatgctatactcacttcgcatgaatcatgtaactaaagcaatgaaaataagaatttcaactcatttaaaaaagagagaaaaaaaataagacttttagcatat

SEQ ID NO: 63429 - DNA, 1337 bp, Oryza sativa
cctgcagcccgagagtgacatatcaggtgatgttatgaaggttctcaggttgagttaccaacacttgcccatccacttgcaactatgcttcagcttctgcagcttattcccgaagaactggcgttttgatcccaggaggcttacagacatgtggatttcacagggttttgttcagaaggaggatgagtctgacaatgacatgaatgttgaagatgttgcgaagggctactttaatgatcttgtacaaagatcattcttcgagagatctttgttagaccttccaatagagtatgtcatgcatgacttgatcaatgaccttgccaggaatgtttcaaaggacgagtataccagaattgagagtgagaagcaaaaggagatcccaccaaacattcgccatttatctatatctgcacatttgtgggccggtatgaagaaaacagagatgaaaaacctgcgcacgttacttgtttggagcaaatcatggccttgctggaaattgtcccttccaaatgatgtgttcaagaaatccaaatacatccgagtgctagatttgactgttgttgcctggagaggttgccaacatcagtgaaaaatttgaagcatttgcgctatcttgcttttagggttcctgaaaaaccattgcccacagcattggtccaactttatcacctagaggttctagtcacaagaggtcactcttgtcggggaagtgaatgtttccaacttccaacaaacatgaagaagaacctactcaaattgagaaaagcttaccttttcaatgtagggggtgccacaatatctggttttggtggacaaactcttctgcatggcccaggggaattccatgtcaagaaggagagtgggcacagacttggagagttaaaggagatgaacaatatccgaggaagattaagtgttaggtttcttgagaacgtggaacatcagcaacaggctgttgatgcgcacctagattgtaaagagcacgtcaaacacttgcagctagagtggagtgaccttccaaggcctattacttctgagttggattctgatgtgcttgaggcccttcgacctcaccctgatcttgaccggctgaatatcacaggttacaagggactgaggtcacctacttggtttgagaccaattggatgaaagcactgacttctgtaatccttgagaattgcatgggttgggtgcaattgcctcctcttggacagcttcctctactggaggatcttgtactgaggaacatgcatgctgttgggcagataggtgaagaattctatgggaacggtgaaatgaagggctttccaaagttggaagaaatagtatttgatgg

SEQ ID NO: 63430 - DNA, 1250 bp, Oryza sativa
ttcctgcagcccccataatcattaaagactgtattttcctatcctcattggatggatttgaaaatctgattgctctcagaaagttagtggtagcagattgtaaaaatttctgtttcttgccagctgatctgaatgcattaatatctctcaaaacattagccatttatgggtgccctaagatgaaatttctcccccagaatggcgtaccagcttctctacagttaattttgctgtcactgttgcatccagagttagacagacagcttcaaaggagggaaggtactgaatgggacaagattgctcatgttcctgaaaagaaactagaggtatgcagtgcttgttatttatttccatcgtattctgatggggttcgttgttcatatcgccttacttactgtatgtagtgttgtgtcatgtaaatatatgtgtggttgttgctcaagctgcattattatcagtgattcagtgttatgaatcatgatctacaaataagtgtcaagtatctcagtttgctatttgatttgcaaattcttctggagatgtttttggcaaaaatatcatgaagtttcataatggcacacctaagtcctaactgtcttagcatatagttccttgacagagttcagtcttgtactaatacttaacctcttgcaggtagagctaattgatttgttgacactgtttccatccagttctttctgacgagtgttgtcatttttggacgtgtggtatgccttcctgaaccactctactacatttacttcaaccgaataactactagtcatgtaagtatgtgactttaattattctatggggaccatggggttgggagcatagcaaaattttcataagcttttgtttcattacaggctcacaaaaactcatatatgggcattactacctttgcagtttatcagtgccaaactgccaattcctgaagtagaggttgtttcaagctgaatgctatttagaccattttgaatggtacgcaacatctcaactagaaaaactctaaatgtcgtgtataatgaacagattataaagtgactatgtcatttgttttcctttgttttcctctcttagaattcaagcagttgaactcctgacaactctctattacagtcattatcataactttggcaagcaactttgaccaacctagtctagtgtttgttttgttgcgatatgtttgtcatgccacacttttcggttgtgttccacttgtcataggctcatctttaccaaaacat

SEQ ID NO: 63431 - DNA, 3069 bp, Oryza sativa
ttagtacaattttcaaactactaaacggttcgtttcatgtgaaaactttatatataaaaattgcattaaaatgttaaatatatccatttgtcaagtttgtaataattaaaacttaattaatcatatgctaatagctttctcgtttcacgcgcgtcaacttaatctttaccttcaccagtcccgtctcttctttctgtagattctcttggtcctcttcaatcttcctgtcagtgctagtctttttgaccctgagattcttgaattcccaagcatgaagccaaaaaattgctgagaaatttgtatccgtacttttgagattgtgacaacctgtcgatggaactgatgttttaagatcgtagaggtttacaatctcactcaactatcacagtgcgaatgaaactaattagctagaataataacccaaggttaggtgcgaaaacatttcccgtcgctttctttagcagaatcgttttcccattcttcgtgtatataactacttggcggtacaggccgcatatcctggagggggaattcggggtcggatttgctatttcactttcgattttttttgtccgtagagtcttacattaagatttgtgttcctgtagatccaacttatacttatactcagttgcataccacttaaatttagttacagtgcgccaaaattagattttacaactgcttttgtctcgatatttttggcatgtttgtccctttttgtttatttcgttcaaaacaggctgtatccgctggttaaaaatttctttaagattaaaatctcaaaatctgccaatctttttaaaccgaagccagcatttgctagtgttatattaagtaggatagaaattatttacaaactcaccaaaggtgaaagagataaagctgaaaagaaactgaaaaagaagggaacaacaagaaaacccgacagcctcgcatgtgttttattgggacattctcgcaatatctttggtgccgcacataatccacaccttgatctcatatgtgattttggtcactagttgaggcaattcagtctcctgattgcggaacagtcatttgtttcgttcacaccagattttccaagccaccatcatatgaattgatttcattgctttcattttgtgtttttccccttgggatgtccacttgatccatcagtcaagcagtggctcatcgccatcgtatgtgtttagtgtctcatgtcccagctgttgaaagatcttctcccagatttggtgtgcgaaggtgcagtccttgaaaaggtgttgtgccgtttcaaggttttcatagcaaagctgacataaatagttgttcggccattgacggatttgcagccgatccgccatccagattttgttttgaagagtcatgtgaaatatttgcattttgacggtgcccatcctttctatattagctttgccactgctgagtcaatcctccaattgaattgtgccatgtatgccgattgtgtgttgtatatgccactatttgtccatcgccatcttatggtgtcttcaactccatcagttagggtgacatttcttctccatatctgtaggaacacgtcgaagaattctttaacaagtttaactgccgaaaaatcaataggttagtcccctcagggttgagtaatatgcacactttcctgttcctaaaaaaagctagtactcatcaacttgttaaaatacatctgttaatctgtttagacccttctcaaattaagcattaataactcaccctgaaatcaactgctttaaaatagtagtagtcatgttgacttgccgtactttgaggagggtttaaacagacacagacacttcatctcagaggattaattaatggcgacgagtccatgtggcagtcggatgggtgaggcaaaacgcctctgcaccggcagtgctgctctcaagcagctgcaccacagcaccacccggtgcatcgtcggccggccggactgccgggctcggctcgatgctatcgcggttatcgcgcttatcatggggtacggtaggggaaaccagcgatatagtttggatgaattttgatcaaattcaaaattctgaaaaaaatcgaaaaaaaataaaaaaaaatcatggatgtagttcttaatttgtaattaccaatagtgaagaatgtttttgaaatagagtaagctaaattcaaatttgagagcaaaccaaaacatagtttacaaattgaaaaagggaagagaatattgggccttaaatatcctacatattcttccaattatttttaatttctagttttttacacatattcaactgtatttttgattttttccctatttattttacacttattttagctacacaaccccgcgataaccgtgcgaatatcgcggttattgcggtaaaccatgcgattatcatggtgaaaccacgaaaccgccgagttttttttttcgaatttttggatgtgatttttgtgcgattttaggcaattatcacggttatcgcgttaccgcggggtgacgataaccccgacccaaacgataaggtaaaccctgtgcaccatatagtgcaggtgccacgctcgcggaacctctccaccttctctaggtcaaatgccgtcacatcgtcgtcgtcaccgtgcagcatgagctctgtaccctccccgtgcacaccagctgaccggcccacccgaaaagtgtgatcactgtgtcggtgttgctgtcatggtgatgggggtggtgaaaagtttgataatttaacatttttttcgttgtccaattgctttaattgacacttgtgaggatgacatgtggaaccatatgagtgaatgaaagtatgccaggatgtcaaataacaacagctcatatctagcagagaaaattggaattttgccattgtcaaaacggggtttcgctgaaatgccactcccaaaagtggtaacctcaaacaagggcaacatgttgcaatgccatttgatccatttcttctcagtttaatgatttttgtaatgtttattcttgctgagatgaccaaaatacccttggatcctatcttatctctccctctggctcttcctcctcttcggggtggctgg

SEQ ID NO: 63432 - DNA, 13115 bp, Oryza sativa
catagccgcaccgccgagtcgagccacgccggcaccgccccccgtctgcaacggagaggagaaagagagaaggagagattagaataggatccaagggtatttttggtcatctccacaaaaaaaaattacaaaaatcattaaagtgagaaggaatggatgaaatggcattgcaacatgttgccttgtttgaggatggcattttaacgaaaccacttttggaagtggcattccagcgaaaccccgttttgacaatggcaaaatatcaattttctctctctaacagcaggacaccgaagctttacatgtatgccttggtatgtatgtgcacatcgccgttggagccactctggcgcgatgtactctgtggtacccctcacatcggtcaccgtggtgtgcacggtgtggtcgtcgaggagcttagcgatccccaagcagtgatcctcgagttgttcatgtcatcaaggtgtatgttgtctggcttgatatcacagtgggtgatcagtgagtagtacccttcgtgtaggtactcgatccccttggcgatgccgagtgcggcctctctacgctagctccatgatggcctgaagaggacgccgcggagcgagccgcctagcatgaacttgaacactagcatccgctcagtgccttcggtgcatgtatccgatcatgtggagtaagttccagtgggggacctcgttggtgaactcccactcgttgcacacatttgaaccaatcagtctctaattcaccggatgagccgtggctccgacgatctcaccgtcccttggtacaccccgccaaagcttcctttgccaagcagcttcaaaaatccattggtggtttggtggagctttttgctgctgaaagctctcacgctcgtcattatcaccaattgccggctctgtgtgtacttactgagccagttgtgtgccagaaagcctccgacgatgacggtggctagcaacatgaaggacaaacaaacggtggcgagtaagtgttgtccaggctattgttggtgacgaggtcgatgttgccgtcggtccggatgccatgctgaagcgatcggtggtgggagtacttgtgtttggattgtgttggttgggtgagattatgtcaaaaaatgctaattcacacgtgctttcgttcactacgaatagttcccagcagtcattgtttgcgatccgtggtgcaactggtcgattcaattcccagatagatgagggttacaaggtaggtgggaagtgcggctagaggggaaggggaagtgggggagaggacggatgatggcaacaaggcagggggtggggttggagagatggagaaggtggtttggagagctgtttgagctatcagcatcatcgaggaggtcgagctcatcggtgttgttagggacttttctagcacagagtgacaaaaccatcttgattttttctaggcgtactttctcgtgtgcagataacattggagttggcgagaggataaggtggagcgggacataggtcgtgggcaggaaacacatgcggtgaggtgggacgtgtgcgatacttatgcatgccatgagcttttatgaattagcatcacccgagatcgtgagctttcacaattttaaaccatactttccatcgacaggtcatcacaatctcaagcacatatacaaatttgtcaataattcatggttcaatgcttgggaatttcaagaaacgggggggggggggaggggggttaagaagacttgcacacaagagagttcaagaaggccaagagaaccctaaactcatattctttccacagtggtgtttcattgacaattttgctatatttttggcatcccttgattgtagttattttgtcaaaccttcattcagggagaaatcaaatcgagttcaactggagattaggaaagaacctgggagcatgtgattccatagagataggcaacgatgtatccgtggagctcggaaattgaggcagtgcatggacctcaaccgaaccctccagcatctgcaccacctgatgcatcgtcggccgaagtgatggattcctctcgatgcacatgaaagccacgcgagcaaagcgctccaccctctccagatcctccatggcatcgtcgtcgctatgcggaagaacctcaactctgccatgcttgactagctggcctgcccatccgaacaatgtggcggaatcatcctcgccgtcctcaccatggccggataccggatcctggcaccttctgcaacatatcatatccagtagcacgacaccaaagctgtacacgtctaccttggtgtcgatgcacctctcgctatgaaaccactcaggggtgatgtaacctctggttcccctaacattggtcactgtcgtgtgtatctattggtcgccaagtagcttggcgatcccaaagtcggtgatcttggggttgttcttgtcatccaacagtatgttgtcgggcttgatgtcacagtggatgataggagaggtgcacccttcgtgcaggtactcaatccccttggcaatgccaagtgcggcctcggtgcgccagctccatggtggacgtggagtctggaagaggatgcttcggagggaaccacccggcatgaactcgaataccagcatccgctgctcccgctccttgcagtatccaaccatgcggactaggttccggtggtggatccgcccgatggactgcacctcgttcaggaattccctctcgctgtactcgttggaggtgatgagcttcttcaccgcgatgtcaggtggttgcagtgacttggccatgccatggtagacctccccgaagcctccccttcctagcaacctttgaaagccattggtggctcggtggagctccttcttggtgaagtgtctcacaatgtcatggtcgttgttgttaattcttctcatgtgccagtgcagcagaagactggtcgcggcggccaatatgatcagaaacgccaagcaaccgaggattatgtacggcagcaacggtacccttccccgtgatggcggcgccggaggactgcggctcgtccgaaccttgatcaacgctttctgcgtgacgcttctctcttgccgtccggagcccgccagcaacgccatcttggtgcagcgggttgcgccgggctcgaacagcgccgccacgcagaagcagtcacgcaagcaaatgtcggcgcactgctcctccgccatgcgttcgtagatcacgtacggtgaggtcgtccaagtggtgttgggcagcttggtgatctcgaattcggcggagctgttcaccacgtcacagctctgcggtgcgaacgctgggcggcagccctcgtagcgtatattcttgtcgatgaaggagtagttgctcgggcacgcacagtcgagcctgctgtcggcgccggacacgacgcagtacgagttggggccgcagaagccgtccaaggcacgggttgacatgccacaacctacggctgggaacagatcggcgacggtccacgacgcgttggcggagctcctcgggcggatgtacacgcggacgatgccgtccgggtcgagcgttgcgcgccggtagctgccgccggcggtggagatcgccacgggaggtgtcaggtcgtacaacgagccattcttgatctggtattggatgctccccgtcgaggcgaagaagagagtcgtgttgccgtccggggtgttgccgggctgttgggtccgggttgcccagtacgctttgctggagtcggcattgccgccgccggcgaggtttatgaggtacaggacgatgttgccgtcggcctgcacgaagaggccgaagcagccagcggagaaatccgcatccaagcgcttggaccgaaggattgctccagcgcccatggactgaccagggaggagcgtgtcggtcgggtgccggaagctctcccacaccacggagttgtcgccggcggcgaggaactggaggttgcccgagtccagcagcacgagcaagaacccgttcggctgtcctggattcgagctcgtccaaacgttgccgcccacgccgccgccggtggtggtgtccgcgaggaggagctggccgagggtgacgctgaacacggactgcgccgtggctgtcactgccgacgcagagctcggatccgtcgcgtaccataccaccaccgccttgtgctcgtcgtcgtcgttattgaaccatacggcgaggaggaacaggccggcgtcgatggcgcggaagccgaaggcgaagtcgtcggacgagctggtgatgtactgaggaggcctcagagtggatccggccgtgaggttgaggttatccgcttcaagcagacggggttggtggtgcagcacgatcagcagcaacagcaaccgagcgaacgacgagagggacattcctgcaaatggcttcatttctgctctcaataaagctacggcacgcgcgccttgttgtgatgagttgtagtaatacgcttaataggtttcctcataggcatgcaaccttgcattgccacaacggatttgctatactactgtcgacagttaacaggggtgaaaactttcaaattttaagccgtctaatatgctggactgctggtgaaggaaaacgaaaaaaaaatcagacgcgtacagcaggtatggaatcgaacccaacacctccaacttggatttttttcaactaaccaattgctccatcatgcttttttgagttacacttgagttacatatcaattacatagtagttacatagtagttacaacgtaattacatagtagttacatttgaaagtttttcatcccaaaaactgtcgacagttctatagctactcccttggcacaattctacatcaatttattgctgacagattaatatgaaagcgaaattgcgtgttcacatatctatttatctatcttatgacccacataagatatacgaaagaaatgcaaggatattcaaccggaaagaaacagtccattaagtaatcaaccacatataagatgagtttggatttttcaatttttgtcccttgtgaaaacttattttacaaacagatcctaaaaaaacttatttcgggaatgaaactttttcgtgagcgccaacgtcattggtgtcgtggtcttgatggtgagctctgcgtagcgaagggcaacgagctccatggtggatgtgctcctcgatggtgcacggtggcggtggatctctattttcttccccctctctttttccactttctgaccacatttttctcatcgaagccattgtttcctatctgcacttgcccagttcgtgtgtccaagcagtgttgctgcagtccccgagttaaggtgcggcaagaccactgcgacctccacaagcatggcaaggcgtcgtgaggccccggttcccactaccacgaacgctcggctccaacgtgcatgctcaagaccactatccaccgtgattcctcgtcatccgcactggtcatcttcagccgtcaggttcttcttcgtttacttcgagcatcgccgccgcgtctccaagttgccaccttcgccgctctgggttggtggtctcgctacctctacatggctaccgacgacgtcgtcccggccgttggtcccactacttcgccttcgtcttcatccagcatgtctcatcactagcgttgttgtatcttcctcgactacacttcgctcctctctgacaacaccgcgctgctccggcaattctccttctatgccgttctcgtgtcgtgaccgtcttggaggccttctctgctagtttcctccgacattggagtatgattcatggtggtctccaacctcgcccgcgcggtattggcaacaccattgcgcgcgttcgtcccaagttgtccccaggtctggcaaacccggcatgacgtctcatcctccacggttcgacagcatagactctttggtgtcatcttcctcaacgattgccttgatcgcgtcaccgtcatcatcttcagcgcgtcctcacgcacgactactctatggcgccccatgcgcaccttgtagctcggctatctcgacatcaacacacccgatttcggctacatcgaccatggctactttacgcacggcttcatcgactacggctccctcgcaccctttgcttcgactacgtaaactatggcacaaagggctatcatccttattgagcactcttgtcggtttcttctccagtccaagtgtccacgctgctcacgtttggacgtctgcattgctcatgtttggactgcggagggatattagagtatatggtagttatagtcatattattaggataggattgatttgtgtggattacttccatatctataatccttccttatctcctacccaagtactcctatatgtaccggccctttgagactcaatacaataatccacgttacgcagtatacctctcctcttatatttgtttacttaaacattgtgggattgctggagagttaggggggccacgtcagatgccacttttgcaaaaaaaaaagccccacagttctgttaattacgcattggtccccgctgctatccaccgtaaaccgtccgatctcgatctagggtagatctggccatacacgtgtccaactgtggtggcccttccgcacccgtgaaatcgttggatccgcaacggacggtgcggatttcgctggcatgtaccaaaccctagcctctgcgcatcgccacgctctcctccctctgtgcaccaccatgctctcctcctcagctcctcccctcacatgcgccgccgccaccacatgcgaggggagccggatcggatggctgcgggtgaaggggagccggcctgcacgggtggcgcgagcacacaatggcgtgcgggtcccaaaggataccggtgacgagcggcggtaaacgctgcggaaggagacgggggatgcagggagttggaggctctctaggcatgcaaggtgagggacgacggtcggaggagttcggcggcgccctcaggtcgacgacgatgacgggagtccggtggttttctgtgggaggcgaaaggcggacgggggcgaccatgacctggggaaggaagtggagtgattagagagggaaggcgtggttcgggttgcgggaaaacacggccagagcggcggcggcgaggggtgagctcacctccgtgaggaaaaagctatcctggcagtgggttggggaagcagagtggttggaggtggcggcggcactgttgcgcgaggccccacccatcggcggcgagcggctggatatgacgaatacgacagtggcctcgggtcaatagggaaggcggctttagctttacggtggcagtttggaggagcggaggggttgccgcggtggctcttggcacggagatgccagtggtgcaagtggcggcaacaagcgatggatgggcggagtgcagcggggagtaaaagggagcgcgcagtgagctcgggcgaatgaggaaaatgagagagcgggaaccgggagggagttttatgggctcgaaaggcgaagatcatggccggagaggggcggaaaagccggtgatgtgggggaggtgagagatacagcggcgatggattcgaaaatcgaatcccaagagtggagagcgggcatgggaggtgcgggggagtgggtgcacgtgtagcagttgcgggtgacgcggggaagtcggcaaagtgggggcgccggggtgcacgggatggtgttgcccgtggccggctggaggtaggagatggccacgatagatgggccccacctgtcggtggcactagggaaggaacaggcgggccaaggagggaggtgggccggcggatggaagagagatgagggtggcctagcctgagggaagagaggaaggaggggagagcgggctgtgagggacgtaaagcgaacttcggccgaaacggcccaaaggcggggaagggaaagattttaatttgttttcgagtaaatttcagaaaactgcaactatagtgacaaaattatcagtttgctgcaacgatagcgtaggaaatcatcaaaaaaaaactgctacaggacatgtaggtgacaactatagcaacatatcacgtaaaagttgtagttttgtgataattttccacgctatcgttgcagcaaactgaaatatgttgctaatgttgtagcaaactgatagttttgtcactatagttgcagttttctgaaatgtactctttgtttttttattttaatggattaaatgttgtttgtgcctttaaaattattacttgagttttgaaaattcacaaaaaaaatccagagagtattttaggacatggagaatatcacaaaaatatttccagccatgattttaaaggaaattttaattctctcattaatttcacttcattaatttaatttttagtataatttctagaaatgaattattaaatgatttttaatcccatacgaaaatcgggacgtgacatcttctcctcgtccttttggccatgctgatctagtggtagccagagtaggcattgagggaactcaacaactcacaacgcggttaaatccaccagttggtcaatgagaggaagatggaagtggtccttggggcactctttgttaaggtcggtgaagtctacgcacatcctccacttgtcgttggccttgtgcaccattactaggttagcgagctgctttggatggaatacttctatgatgaagccgaccttgaggagcttgttgaactcttctcagatagcctcttttctatcctagtcgaatttacgcagcatttgcttgactgactttgcattggaatgcaaagacgaagaaaaaaaatctaatcacctcctcaatttgatcatctcaatacaagcaagcaatgaatgtgattgaggggcttgattgtagaggatttaaaataaaccaaatttagagaaccaagaggtgttaattaatgtatgtatgcatgcacgtcttatattatgatatatgagaaaaatggttgccttatattttgggatgaagagagtaggggtggaaaaaaaactcgaggagagctcggcttgggcttggtttgggctcgcatagctcggctcggtcgaaagccaaacgagccaagcccaagcctctttcctagctcatcctatatacttatatagttcatccccactaagtgtagtcaatgctatttctctcttctctcattaagccacatcaccctaattatttctaacctttggatgatagatctatgatccaaattgtctcttcttttttctctcttaaaaacatacaatctcaattacttttaggctcaaaaatgtatcaaattgttttagttctgtacatattatgcaacttaatttttcacagcaacgcgacggggtattcatctagtttctaaaacgagccaagcctgagctgtctcacgagccactcgcgagctcatttggctcagtataatagggtcatatacaataattttgcatcttttcaagatatttattaggttatgaagttgcgcatctgcgcgactttaaccattttgttatgtgctttgtgaagataagatatatacagaaaagagcatttagaatattcagtgatatacactcaaattggaaatgacatttgtttgcatgccttagttactgtaattgaagaagatattactccagtaaataaatttgggactgcttttagtgtcaatcaaaagcagatgagctaacttgttttgctttaatttgatccctcggcacaattaatggttctagctgaaaaagtggtcatgaatacatcacataagcatggtcttaaccatgtttagaatttcgtcactactatatctgtcgccctgtgtggacattcgtactctcctacctcaacacacgctgtagtctgctgccctgcgtgacaggttaacagaaagtcaaattccatatataaaatgcttttgattcaaatatgcgcaaattttatgcaagccaaaccatctcttatgatagtttccccctaattttttccagtaaaccaaatcacgctgactggctcatcttatttccttgtcatcattcattcaaagtagtttcccctatccttctttgagatgtcatacaggcaaacataatataacagtgattgtcttaccggcatatttttaaaaatagatctgatatttaccggtatcccaatagcccaggatttggccggccacaacaataacagctttattcacaatgctgtatcatcttttgcatcatcctcaaatcgaggggaggtaggcactgagcaaccattctgcaatagacgatttggtaagcaatccatcttctagaagatgttaaactggaggaaaggctggcaaaattttcctggccatcaatgaagggatcagctatcttgagcgtctccacgccaagaacggagcaaccaatggctgaatgcctgaatcttcatcagaatcaagtgatcgatcactcatcagcgaagatagggaggcaagacacatcgatcgctgttggttagaaaatccaattttatgtgactggatgataccctcgaggggcacgccgtcgtctgcaacgccatcattgcggcaggaagtgacggggtggcaaggagcaggtaggggttgacgctgccatggcggcatgcaaggtggcttggaagggtagcctccgtgcggagacggagccgtcgacgacctgcctcaccagtagcatcgttgcatcgtttcctcctccctctcctctctgttgggtggtggggttgttcgtgacgaacacccacggtggctgtattcgatggccagatttgatgcctccaactctccatgatcctgtgggaggacaaccgtcgatggggaagaggatagggaggcagcagtcgaaacggaggcggcggcggcacagggccggccctaggggggtcaggccgtgcggccgcccgaggctcccaaaatctaggggccccctacacacatatagtgtatatatactacatattgtataattttaatctatgggccatgtgcctatattaagttagacagctgaatagcccaattcagaaaatgaattttagtccatcgccaggcatgtttcagtgaagccgaagagatattcatctgactcccgtcgcttcgtctcgatcacatcacgccactcgcgtcgcgccgcctcgatcacatcacactactcgctgctcttgcgctcgcggcgacttctcagtctcgtaaatgaaaacagcaagtggacacagcaaatcgtagctcgccagtagccacgctcgtgtcaataagggcctccatataagtttttgccctgaggccccaaaaccccagtaccggccctgcagcggcggcaacggacgggcggtccacacggatggacgcatcgcggcgccgccgcgtgcggtgaagatggggaagcgacaattttttttctcgtacgaacgtggaggtggagggacctgtgtgcaaaaaaaacttcttaaaggatcgagaagatatttcacgaatcaagcaatgtgacggccagtagcgtccaaatgtagaatctgacggcttatgtttactgaatggcgtggcgctacaattttacattttgggggttcaactttcatatattaagatttgttgaaaatgataatcttgattaccatgttgtctattcatgtgttaggatgacatattgaagaaaaaatcactttactacacattctatgtgttaaaatgttgctcgatttctccttgacctgcttcaggtttacttgttgctagggcttgcgagacagcttgatctggctcgagcctattaacaagccatgacgtccagggcgcgaaaacagtattagatccatctcatttagttggaccacacttacactattaactctcttacgtttttgtcctcgctttcacgaaaaagttcgaaccggaaatcagactcccatccttataagctggtgctgctctagctgaactagcgatccgagccaagctgagttttccttccaccaaacttccacgagaactgatattcaatttggaagaatgcattatgcattagtattgagaattgatggatgtctgacataagcttagcaagcttcgatatttgtggatgtattgatgtacatgttatggtacgtggttaatgttcatttactatttcaagttgcaatgtgaattgtattatgtttatatatattttttgtccttaagtcaatttttctgacggtgtgaacattttttccctgtcggttagcacgtcagaaatttatctcacaaacttgatgaccgtggatttttctatgttgcatccacaggaaaaagccgtcggagatgatttttctgtaggaaaacccataggaaaattgatttttccgtggaccgttttatctgttggcgattcctgtcgtccatccacaaaaaataatttctgatgttaaaacgaattttcctgtgggtttcgcgcccacaggatagctgccaagtctgctagtgatcgcattatctatcaaaatcatctgctataattttcaaccttggcctcgatcttgagttagtttcactgtttcttcttcctgattatattcgtttattccactgtcgatttctaacaacaatacgtgatgacgcatcgacgagtgccgtcttggaacccaatcatctatagttcgattgcgcagcggaagaaaattcaatgtgacgtggcctcaaaactcgcatctcctagtacgtgctacctgccacagccccctcttggcctctttagaatttttctgatgcattaaaaaaatttcttttgcagcgcagtcagtgtgggcctatcagattttgacgactttaactagtctttaaaaaagggcgaggaaggggacagcagtgttccatacttatgtatgaagaaggatagagagtatgaagaagggaaagcgttttcatgcctaaagaaagtatctactcatttctggtatattacttgaatagttataaaaaaatgatattatagattaatatgacatatcattatgcaaacatgtaatttaaaattcaacttctacaaattataacaaaaataacaaatataaccgtgaatttacgttaacttgttttagttttatttattgtttttgctacaacatatgcaagtcgaatttgatcttacatgtttatgaaatgagggctgcaggaat

SEQ ID NO: 63433 - DNA, 2414 bp, Oryza sativa
tgtcatgcgtgttggaactcatgaagcttaaggctagtaatggctggtcggacaagagttttacagaactccttgagttgttaaaggatctgttgccagaggggaacaatttacctcagacgacatatgaagcgaagcaagtattatgtccgttgggcctggaggtcagaagaattcatgcatgtccgaacgactgcattttgtattacaaggaatacactgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacctagcagattcagtccagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataacctttctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacataggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggttacaggagatttctcccaaggtatcacccgtataggaatatgagaaagaatttcagtggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattttggagactaccatactggaaggatcttgaagttcgccactgcatagatttaatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcaaaagaagagaagatcgatttgctaatatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctagggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcattttacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgtctagtgaaacacttcagtggttgtcacagggtcctgaatggagtgccaccacctggcaaagatatgacataaatggatacacctttcacacggtaaagcaagacagcaaatgcacagtgcagaacagtgggttacgcatcgaggctgctagtgacggtggtcgtcgtgatcaatactatggtaaa

SEQ ID NO: 63434 - DNA, 2651 bp, Oryza sativa
acggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaacccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgatggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaaggaccagaagcgtgaacgcggcaaggggaaggtcggggagttggcgccggagccaaaaaggggcaaggctgcgacgtcgatgccagtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccatgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacctatcaacccccctgctatcagaggcgaagtgtgcgcctttattcttgcagaaataatgaacaagaaaggacgttttcatgccaaatagactaatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctccttttttttcccttattgataggttgtggaggttcacaacgaacagaatacaagaaattttggtaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggaggggggggtgactggcacctgtgatgtttctgtttttcagagggcatggctagcaattcctgaggctagccaatatttagcatttattttttttctggaattaactcatcagtgacggttcggaagaaacatccgtcacaggtaacctcacctgtgacggactcgcaaacgtcggaccctaacagctggccctcgtgtgccggccgcccaggggccgtcacaggtgggtcacc

SEQ ID NO: 63435 - DNA, 715 bp, Oryza sativa
catcctgtgtttacttgggtaagcgcgtagtaggtactgataagttccggaggaagctaaccgatatgttgaaaaaattggatgaggttaaaacaactgcggataccttgttcaaattggttagttttgatagtgctactgcaaagctgctcccagtcacacaggcacgtgtaacgtctcctttgaaggaagagaaccacatatatggtagaaaagatgatcttgataggctgagagatttgttgcttatgcaaagtgatagtagtgcacctggacctagtaactcatgtgttcctgttatatccatcattggtgttggtgggattgggaagacaagcctagcacaattagctttcagagatgaaaggatacgtgcgagctttggtctcaggatctgggtttgtgtatccgatatttatgatgagataacattggcaagggatattttagaatctgtaacaggtgaaaattatcgcagtgttactaaattggatgaattgaagaatgttcttcaagaaaagataagtcaaaagaacttttttcttgtattggatgatgtatggtatgatgagaacaggacaaattgggagaatgaattagttgggacggagttttatcaacattggatactggactcggaggatccaaaattctggtgacgactcgaaccaacaaagccagtgaactcctacgtgctggagccgggctgcaggaa

SEQ ID NO: 63436 - DNA, 707 bp, Oryza sativa
cgggtgaggtaacctctggttcccctaacattggtcactgtcgtgtgtatctattggtcgccaagtagcttggcgatcccaaagtcggtgatcttggggttgttcttgtcatccaacagtatgttgtcgggcttgatgtcacagtggatgataggagaggtgcacccttcgtgcaggtactcaatccccttggcaatgccaagtgcggcctcggtgcgccagctccatggtggacgtggagtctggaagaggatgcttcggagggaaccacccggcatgaactcgaataccagcatccgctgctcccgctccttgcagtatccaaccatgcggactaggttccggtggtggatccgcccgatggactgcacctcgttcaggaattccctctcgctgtactcgttggaggtgatgagcttcttcaccgcgatgtcaggtggttgcagtgacttggccatgccatggtagacctcgccgaagcctcccccttcccagcgacctttggaacccattggtggctcggtggagctcctttctggtgaaaaccctcacagtgtcatggttggtgatgttaattcttctgatgcgccagtgcaccagaaggatggtcgccgcggccgataggagaagcgccgagcatgcgaggatatgtacggcagcggcggcgctcttctccgagggctgctcgtccggaccttgatcagcgc

SEQ ID NO: 63437 - DNA, 1182 bp, Oryza sativa
attcctgcagccccggtgcttctcaaacttccataggtgtgtccatgatcctgaataaattcatgagctatccacatattcaccaatatgccaggctcaaaataatagccttttgggaacaaaccacagaatgaaaaacattgctgaaggtgctctggcaagcattcatagcttagacgtaaaattgtcataatatctttctcatttgataaaccattttttagaactcgattccattcatcatagttgaagtttaaactaagatgcccagcaacggcctttattgctaatgctgagccattcaacttttgcacaatgcattcacctatagacttcatttcttgatgttcatttggatctctagtgctgaatgcacatcttctgaaaagttcccagctatcttcactctctagaccactcaaagagaacggagtggtacagcctaatgtatttgcaacaatatccattcgagttgtaactaaaatcttgactcctttcaccccatgccgtaaaggagcaaataattctctccatctatcagcatttataggccctccaaccttttcatcataccaaacgtcatccaacacaagtaaaaacttcttcatttttactttgttcttgagttcttcttggagcatgctaaaattgaaatttgttaggtcaatggtcttatcaatagatgttagaatttctttggtgattctgaccttatcaaagacatgtgagacacatatccatgccctcaaatcataattatcctctattcttttatcattgtaaataagttgagctaaagtagtttttccaattccaccagtaccgactatggttattacctctgatgatgttggtcttgctccttcgcttcttgacttaggtatgcctacctgttctaacaattggttcactagttcatctcgctccttctgacgaccgaccacaaactcaccaagtgaaaatgagctggtaatacgccattggagcggctcaggcaacatgtgtgagctacagttttctggtccaatcactctgacaagcatgtcagcacattcttttactctactcaagcttttaagcatctttcttaacttggatctaaacttatcatggccaaccaaacgcttagcaatggaaatagaactggagcctaagcttctaagatttcggggctgcaggaat

SEQ ID NO: 63438 - DNA, 1155 bp, Oryza sativa
attgataagaggagtatatctagacatgttgttttagttaatttgcccctgctgttgctacccctgtgtcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaaccagccctccccaacacctgcgaggatccaggaagaagcaaacccagccacagaggcagttgccgaaggtcatcccgcgacaatggcggtccaacaacccgaaattcatggtaatttataggataaattttcaccatatgaccacataaattttagctagcaccccttagcaaatattgccttctgtttgtgctgcagaattgccgcaggaacaacatacgtcgatgtcgggcgggacaagtgcaagtaggtctagtagaaatccgcggtcacaaaatatatggccgaccacagtgcaagttataagagaggttgacgctagtggtaggcccacggcgcctaggactgtcattggaagatggtctaactgctgcgggctagcggcacgtgagaacttcgggatcctccataaagatatcggcaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacaccgttcgatgaataccctcaaataaccgaagcggtgtgggaggaattctgctctctcaagaccacccaagagtttagggaatcaagcgaggcacatcgcgtactgcaacagcggaatgagcacccgcatcggctgggc

SEQ ID NO: 63439 - DNA, 2543 bp, Oryza sativa
  unsure (1)..(2543): unsure at all n locations
cctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttgatagaaggccatccattattaggcaagcagtttgagctgaaaaatggtcctgactacaacaaggttgctgccctttctggatgcatgcgtcatacaaatcagagtaatattactttttattcactgttctgaatttagtattggaatttggaaattgaatatgtcatttatttattctggaatgtcaaatttctcgttgatacatagtacatagatctaattctagtgccatgacccgttccttgtagggaaagtttgggagtactggtcgaaattctgaactggcaaccaagcgaaactgttgtggacaagttctgatctggcaaccaagctaaactactgtgagtataatagttccgagttcgtaagaagtgatactccgtattacacataccgacacacctacacgcaccaattacatgaccattttgaaacgcaagttagcgcttacattttatatatttttgtatgcagatcgcttcttagcgtttacattgactgtttatggggatcggagaatttgaagatcaccagagtggtcagcacttgttaagttgcatgttttcatgaggattatgatgggttgcactggcttgaggagcgatctagttacccagataaatttgggtgtcagggtggcaaatggcatgcgtcccctgcgttgtgctgctgttcctgtgcaaattccaattgcatgctgcaatttgggttttccatgtgccaatgttactgaaatggtgcaccgttcggtttctgattatgcaaatgtgctcatgattcaatcggcaaaatccaatgcccacgttgttctcttcgctctatattgttcctgtttaaaatgtagaaaagctcagttgttgctaaagtggaattactggatttcaattcaatggctataatgattattctaggggtatgcaactaacaaatgttgatatttagaaataatgggtagaaatccgaactctatatccacaaatggatactccctccgtactcgtaaaggaagttgtttaggacaatgtttaagtcaaaccttgggaatataaatcatgaataactcttaagttgttgagtttgaaaatataaaaattatgtgaatatatttgtcttgaaaaaagtatacatatattacctttcaataaatatttttatagaaacaagaagtcaaagttgtgttttggagaccgtgtcgctgtccaaaacgactttctttacgagtacggagggagtatactctatcaataaatattgatagcagctgtctatgcgacgatcgtactcttgacaggcaaagtaaatgagaaatttctctcaattctaaggcatttagctttttaccacttttaagatgtggtagttaagaatatgccactcacagtatatgacatgtgggccctcatgtgtctgtaacatataagttcagtggcaatttcttaatggccacttatgaaagtggtaagccgatagttaaatactccctccgtactcgtaaaggaagtcgttttgacatggacacgatctccaaaacacaattttgacttcttgtttctataaaaatatttattgaaaagtgatatatatatatatatatatatatatatatatatatatatttttatgaaagtattttttcaagacaaatatattcatataatttttacattttcaaacttaacaacttgaaagttatttatgatttatatttttaaggtttgacttaaacattgtcctaaacgactttctttacgaatatgaatggagtatctctgtaaactcccaatacctccttaggaactgtccttcagtcagtgtcgtctgtcgtgtcgtccccttccttgatcctctgctctctttcccatccagcctccgggactccggtctcgcgtcaaacgcggattgatcgacaaggagattggagttctgatcctgccaatcaggtatggcgtttgtttcccctgtaacctagcttcattaagttatcctaggactcgtcgcgccgccgcgaaatcgtgcttaggtactccagtggcgcaggattcagtccttataatatcctctatttttttttaaatttttcggaggaaatacagatacttcgggttttcgggatagtacttcatacatgaagcaacgaagtttttgagaacttagtttatctg

SEQ ID NO: 63440 - DNA, 6109 bp, Oryza sativa
attcctgcagccctgctgattgcaatcaagtgttctccgcctttctgcagtgcccaccaccaataaaatttcagttaaaatagtctcgagctttttaaggtcatcctccaaattggactgccacttgtactgggttgatatatatgactggaccttctcaaccataagcttgatgacaggagaaactacccatccaactcctgtggctagtgataaagtggccatgctgctcaatatactgtcttggctcttcaatttctccttacagctttcaactgatgtacctaatatgcattggtaagataattatttaaaggtaacaacataaggagaacatgtagaagtgaggcatattggtgcccattagtataattaatactcgaaagcatgtaagatcattgtcatagacaactatagaaattccccattattccttgatttgttgaaccagtacacataaaaaaattcacttaaccaggccggcctaagacagttatctttgatgaagtaacttcagtcccaaaactatcccaaaaaggaagccttttgacaatttgtcatacatgtattcaaattattggacctacaaaccgatatctcccgtcctaataattaattagataatatatgccttccatggatacggatcaaactgtggattatgcctcgatgctgctccaaataatcagtctcggaaacttcgttgatccaagcacaaaaatatccttaattcctcacagaaaagaaaaacacaaagcgtacaaaaaagacccaatccctgcagcaagatcgagttcttaggcgcgatttcgccgcacagcgacgagttctaggataaactagtgaagataggtcgtcgtacgcacagtcgcacacaggcatgaggtgaaggagcatgtctgcctgattggtattatgagagcacacagctaggaagctatcaacctaggtcgcaggtaaacaaacgtttagggtaactagtaaaaagtataaaacgacggtagtgaatgaacacctaccttattggtaggatcagtactccaatctcctccaagaagaagacgctcccaaaatatcttcttgtttatcaagctgcctttgtcgtgagaccagagcccggaggagaaaccggaaacagagctggatcaaaggggacgaacagaacacggaaggttctggctttcgactcttccaaatcttgaagaaccggagacatatagtgctggtttgtggtatgatattgcctaccaaaatttgacagggtcaagttgacatgtgtgatttgataaaaaaaaacaaatttgatgtactcctacaagatatataaatatatgggtaatactaaaagaatttatgaaatggtattgttttttttgttgtttatggtgtgtttagttggccacaaactacttaaaagaattttaacttttttttacactgtttgacaactcgtcttatttaaaaaatttgtacaaaaaacaaaagttatccttaaagtactttggataataaagtaagtcacagataaaataaataataattgtttgaataaaacaaatgatcaaacagtgtaagaaaaagttaaaatcccttatattatgggatggtatattatgggatggagggagtagaattttggtaaggtcggacggacggagggagtagaattttggtaaggtcagaccaagctagcccgtataaaacagaagagcggaagccagtgagatcagcaaatttttttcactaatattagaaaaaaaaggaaaatttgccattgtgaagccctcgagtaattggaacgaagtactaaaacttaccttgttgaactagactacggcggagggacgacgacaaacaggccatcgccgtcgccggggaggataacatgccgccgtatgcagcggataaggccgctcgcttcaccgccggccaggtgccaggtggggtgaactggagcgccccgattctacttcccgcgcgcttccgggactcccggccggcgagtgtcaccagcgacagcgagcatccagcgccgccgcctcccccattctggcttggaaaaagtacaccgaaggtccctcaacttgtcctcgagttacaaaatcgtccccttaccgcaaaacaggatataacgcatccaccgaagatccctcagcggttttgaccccggtttgtctgacgtggcggctgagtcagcgtaggacccacgtgggccccatacgtcaggatgccacgtcagcgaccagcctctcccttcctctcctttcctcccttctctctctcccactcttctctctggattgggcaggccggccggcggtggggaggtcgttgccggggcgaggaggtccgacggccggccgcgacgtggcggcggcggccgggacgaggacgttcttcttcacgggcatccccctaaagctcccgacccagcgcaaggcccccgatttgcgcgcacgccgagaacgccgcagcggcggcgacggtgtcgatgcacacgccgctatcatccgccatgaccgtacaagaaacgacgtcccggccagccggcggggaatccgtcgaagagcgcccacgcggaggcgagctcgacgcgcgcgaggtagagctcgacgagcccatcgcggacggcgaggcggtggtcgaggccgagcttggccgcgtgtgcgtgcacggccgacgcagcctcgtcgtggtcggcgaccaagcccttgataagggccctgaggcaaagcggcggcagtggcgctccggcgagctcctcgccggtgcccttatgcgagctgcggtagctgtactagattaacttcttgcttttttttttgcctaattgtgatttgccagtagaatgacactgattttctatggcctcttagttggatgagataagaagagatgagtatgatgagatggcatttgtagcacgagattaatttcttgcctgtttctgctggatgccaaaattgcaagctttgattcccgatttaatggctgcgatggccgtagataaatcccagctggtggatcccttgatgtgtctcgatcgagttccgggaggcagcagcagcaatgtccggcgccgccaacgcgacctcgttggccgccggcgctggcacgccgcggtcgcggctgccgcggtggacgcggcacaagacgctggtgttgcttgccggccgccagcgctggcacgccgttgtggacgcggcacaagacgctggtgttgctcctccgtgctcccgccgccgccgcccttcccttctgggtcgccgccgcctcattgccggccggccgtcggacctccatgccccggcgacctcgtccccaccgccggccgtccaaagccccacagaggagtgagagagagagagaggaggaagggagagaataggggaaatagagaagaggctgacgtggcatgctgacatatgggtccacgtgggtcccatgccgattcagccgccacgtagggtcaaaccgggatcaaaaccgaatttattgtgactgattttgattagttaagagacgtcggatatcttatttgcaggacgtttttgtaactcgatgacaagttcagggaccttcggtgtactttttccttctggcttccccgccggccagacgaactgcttcgccgtggaagtgtgcctagcccagtcacggcccaagtagagcccaaaccaactgttctctctctctctctctctctctctcacaacaatttcgctgacgtaaatcatcagatatttccatttcattgacaaagcatcttttggagtagttaatttcaaaggatatggtcataaaatctctacatttttttctgtaaaataaaattcacttgttccaaattgattcctaaattgtccggtctaaaatcaactctctatagataagggaagaccaaatcgtatcaaatcataacgatattaatatatctcggatacaatttcatactatatccgaacatgaaaataatgttctcagtttctttttattttcttttttttttcaaggaagagagagcttcattgataggtaacaaagttattacaatcgttgagaacaaagccttgtacgcaagtaggaacatgttcccgccaaactgcacaatacttcgttttgctagccagtggtgctaactcatgagctaccctgttgcctcatcttacctcatcttacaacatgacaaatcttcacctctgaaagcaactcctttgtacattgcacatcaatgataatatgacatcatttagatcgattctctttatgagaatttagtgcataactacggataaacaatctgtttctagcactactggcatatgaacccattcagtggccagagctaaacctccacgacaagccaatagtttcaattcttctgctgatgctccatgtcgaatgtacttccaggatgataacaagactgagccgaagttatcacgaataattatgccaatacctgcactgcctgagcctgcacaaaatacaaaatgttctcaatttcttatacatgaaagaattatatttaaaaaaatcagccatcagctgggaatcaaaagcaagggtgagcagatcactccccaaaacatgagagcactgcaacatattactacctccttttcattatttatcatattataagtagttttgttttttttcctagtcaaactttttaaatttaatcaagtttacagaaaaatataataatattttcaacacaaaacaaacttactaccaaaacatattaaataatatataaaatgttagttttaatgaaacattgttgctaaatttttttataagcttcatcaaaatgacttataattaatatataacggagagagtacgcattatactatttcagatctttttaactagtagcatagacttcaactcagaaatcagaatacatacaagagaattcaactgggaagcagcttccaattttccgttcaagggtatcttctcgtcgtcaactctagctgaactctcccaatatggaaacattcagcaaacagaattgctgaattggcccatgttttcacgagcacaaaatttccttctttttgtccctgaaattgcgcagagaataaaaaaattaagcaaagacattgagaagaagatgctaaacacagaaactgagcacatagcacgaccttacacaggaatcatgggatcaacctgtccattgtatttgtagaaccccagatacaaagctaataacatcccaaagaatgtacagtctacaaaattacatctaatgagcctaacgtatcttctgtaaatgacaaacagtaggcagtcgagaactagccatcactctagcaatctagtagcatacactaatattgtacacgtacagacagtatggttaaaaaggccatgtcctgtttatgggtatttacccgattatcgatctgatttctagaaaaaatacatacccgattgtttcagaaaaaaaaaaactccacaagaaccatgctcctgatgttcaaaggagcacatggctacattgcatcctacggcaagggtacaaactgtaagcaatgaccggtgaatgttctgtagtgctctaagagtaggtttagatgcgaaaatgcacagacctcatgataagttggcccgattaaaatggaatatgcaaatgaatttcatgccagggtggctgagctgcacaggcatgaatggccagccgtggccagctggccaacagcgtcggtgcgcggtgtgcccaatggccatgccgaagtcttgatcaatgcagataattcactgaagaaaactggaagagcttgctgcagaatcagttggatgcagtagactggtctgggttgaccactcaatcatatcattttcaagaagtatttcgtcagctatatctgcaaaaggacatgagttagtatgttgcggtaatattattgcaacaaatcaatttctaaacttatcctcatcaaaattcaagtcgtgatgggttaccttcagtatcttccatcgatttaccagcatagaagcatgacggcagcacggcatacttctcccactcaacaccatgttgccattcaaactgctcctctagcaatggatggcatccgctcaaatacaaaaa

SEQ ID NO: 63441 - DNA, 1252 bp, Oryza sativa
attcctgcagccccataatcgacagaagaccaatatactagttctggcaactgtgtcaattctagtgtttccagggagggaaaaccagcaatcccatagaaagatgtgtctatacattctaatgcatccattctatcaatatgaagtttcttgagagatggtatctggcctaaaggaggaaggaacttccaacatgtgcagttgtgaatgctgatgtgtcgcaatctagatagccactcggactccagccaagacggagatgaacaacctgggtatccatcaacagtcaattcctcaaggccagggtgaggtattaaagaattaagcacattctgttcatctgacttgctatctgcattacaagagccccattgcagcttcaacctagatatttgactcttgttgactagctgagcattagttgcttcatccttgtttttcacattctcgagagatgtaattgtaaggaacccctggagttcattcatgtcctttagcacctctagtccctgcatttttgtgtttccaacacagaattttccagctgcccaaagatatggcatattccccacagaagctaaatcaacaaaaaggtccttatgaacatcaatatgaaaaatacagctgaggttatccagattttttgggaagataataggtcttgtatccataaagcatgaatgtgggtgtacagataacattcgtaaatgatgaagactacagagtgaatcagatagtggatggttagtatttgggagagttaagcatcgaaggtgtatcatgtgatttaagtcaggtgaatgtcttaagcagcaaccagtcaaatccaatagtctcaagcccttcaactccttgaaaagatctgcatccacacaaactcgtgggcaaaaacacctgactttattccagattattagtgtgcggagcctttgcaacttacagacgcaaagtaggtcaactctttcagccagtatggacagatgtcgaactgctggcgggatctcttcaggttcatcaacatctaatctgtagcactcaccattggatgtgtggacagcaagatcgttcatgaggtcatgcataacgtaatgtactgtacctccatactgaagcgcctggaaaaatgatctagataacaactcatcaaaataacttcttccagtgcttttaagacttccataggtgtgcctaccatcctgaataaattcatgagctatccacatgttcaccaatacatcaggctcgaaataat

SEQ ID NO: 63442 - DNA, 738 bp, Oryza sativa
aacaatcggttcactagttcatctcgctccttctgacgaccgaccacaaactcatcaattgaaaatgagctgtaatacgccattggagtggttcaggcaacatgtgtgaactagagttttctggtccaatcactctgacaagcatgtcagcacattcctttaccctactcaagcttttaagcatctttcttaacttggatctaaacttgtcatggccaaccaaacgcttagcaatggaaatagaactggagcctaagcttctaagatttcgcttttcagcattttctttcagaagcatgtagtcaaattcatccaagatgtcctcagcatcatagacagcatctttcagctggtggagcaaagcttgctgattgaaatcaagtgttctccgcctttctgcagtgcccaccaccaataaagtttcagttaaaatagtctcgagctttttaaggccatcatccaagttggactgccatctgtactgggttgatatatatgattggaccttctcaaacataagcttgatgacaggagaaaccacccatccaactccagtggctagtggtatagtggccatgttgctcaatatagtgtttaaggctcttcagtttctccgtgtagctttcaactgatctacctatcatgtattggtcagatcaattatccaaagagaaaaacataacgtgaacatgtagaagtggaacatattggtgctggttcatatagttgatagcacaa

SEQ ID NO: 63443 - DNA, 707 bp, Oryza sativa
aatggcgaggaggcgaatgcgagaggaagaaagggagggggggaggcttgggtttataggaggcggaaaggtcggtttgggagagaggaaccgacattgggcggtcaagccggcgagctggcgctccggctagcggccaaaacgacgacaggaggtgacgccggcgagaggggaaaaagggggaaaaaggggaaaatgagggagagaaagggggctcgccccttgcctctttgggaaaaggcggagggagcgggggcgacgcggcagggggaggaggggcgctgcctccgtcccttggcggcttgcgcgcggagtggcgggggccgggcgatgacgacggcgatgacggcgggcagattggagcggagcggcgacacgggcgacaggcgcggcaggcgctgacgacggcggcgatcaggcggtcggccaccacggcacgcgcgcgcggcctgcaacgggcggcgtccgcgcgggcgcgctcatgcgaacacggcgcgcgggaagcggcaacgagggaccggagagggaggacttggctcggcgcgggcggcttacgcgcacgcgcgcgggcagagcggaggggcgcagggcgcggctctcgcgctcgcgcgcggcgcgcgagggtggggcgctcggcgcggcgacgcgcgctcgcgcgcgcggcgcggggcggagcggagggagagagggggggagcgggggagatg

SEQ ID NO: 63444 - DNA, 5344 bp, Oryza sativa
tctcgttctctctctctccctcttctccgctctgtccgggtgccgcgccgcgtgcgcgtgagccgcgccgagccgagccctccctctccgctccctcgctgccgcttcccgcgcgccgttgttcgcgtgcgcgcgcccgcgtggacatcgcccgtgccgcgcctgcgccgtctgcgccgcccggccccgctgccctgccgcgcagctgctcggccccgcaagccagcacgcgtgcccaagccgtgccgctcaaatcgccgcgccgcccgttgcttcccgcgcgcgcgtgccgtggtggccgaccgcctggtcgccgccgccgtcagcctctgccgcgcctgccgcccgtgtcgtcgccccgctccaaaccaccccgccgtcatcgccgtcgtcatcgcccggcccccgccactccgcgcgcaagctgccaagggacggaggcagagctccttctccctctgccgcgtcgcccccgctccctcctccttttcccgaagaggcaagggggcaagcccccttttctctccctcttttcccctttttcctcctgccggcgtcatcctcctccctcctccctgtcgccgctttggccacgaccgccgagcgctagccctctcctttgaccgccctaagtcggttcccaaaccgacattgccatcctataaacccaagcttccccctttcctttcctctcccattcgcctccacgccattgccgccgcctcccgtgctctgttcgccgtcgccgttcgtcgttgcgcttgtcggaggagccggcacgagcaaggacgcggaaggggactccgagcgcgccctctccttcctcttccccggcccgaggccggagagattactcccgcgccgtcggcctctcgtcactgcgcccgcccgcacggtagagcatctccccgttctccctcctcgctccatctcctccccttagactcgggtagtagcacgagtagcctccccgtagctagccggcgccgccccgaccgttgccgccgctcgccgtgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcggcccctcgtgacctcgtcgccgtttcccccttctcccgccgccggttgccgccgccgcaattcgccgccgtcgggcatcctccggcgaatccgagccgttggctcgtctccccttgtcctgtgcaaccacccggtgtgctcgctttcgcctgtatcgccgtggttcgctccaccgctcgccgctgtcgtccgccgtccgttccggccggcgtcgtcgtctacctcccgccggcccgcgtggcagccacgtaggcgccacgtcggcgtcagctcggccaaaaccgggtcgagtcgaccccggttagccgctccctccccgtgcgcgcggtccaccgcgagccatgaggctgcgcgtgggcccgccgcatccgcgtcctccgcgaaccgcgcgcatgcaccgcgtctctcccccatcctagcaccgcgccgcgtgctccctccgcacggtgagccgagccgctgacaagcgggtcccactcgggaccatgcgaggtgagcccggtccaccggctctctctctcctcccctcccgcgcgcgcgtgccttgggccgccttgggccggccggcccatttagctcggccgagccgccccttttctctcgggccgcgccctagccgcccgagggaagtctaattcccctccctcttttcttttcttttcttttctttttcaaaaaggatttaatcaaatccttttcctgtagaccaaaaatccaataatcttacaaaatcaatatcttcccaaccggcaatccgttagactccgttcaactaccaaaattactcaaatctcgagatctatctaatggcacgcttaggggtcattaatagggctttattttcgccgtttgttgagttgtcccgtttcgcgtgtagcttcggagcccgaagacccgcagtgcgaggatttcgaggatcaagctccagatctcgagcaaggcaagccacctttgaacatcttgagcctatattgaaatttaattatgttgcttgaaaaatattatgcattgataggatcgcacttaatctgttgtcccgtctgcaaggcagattggcggacctacctaatttgttgcatttgatccttcatttgataattgttatatcatgtccccttgtaaccatctagttgcgtctcgatattcgtgcaccctgtgcgagtatcgacggacgccttcaaacttaaaatctgaaaaacttcttgggtaaaacatgggttttacaaaagtcttggaaaacccgacacctgggtcggtgcttgtgaactaaatgaatttccaaaaccgtggaccggggaacgtaccgggtgtacggtttcccgctctcgcacttaaggaccgtttccttggaatttcatccgaacataagacaagtacgaccacatgggtggaatgggacacccctggctgagtaactagcttatcagggaagccttgatgccgagagacatgtggattcgccggggtggtgtcggggaggacccttgggcttcctggcacagtatggtctgggacctaacctgttgttggtctgggacccctctcgttggcatatggtaaacctgtgtcggctttggaaatgccttgtcatgaaagcttggaggtctcccgacgtggctgattcccacgggctgggtgatccgggttagtaatgtcgtgtgggtaaagtgtaccccctctgcagaggttattaaactgttcgaacagccgtgcccacagtcatgggcggatgtgaggtgattcctagcgtagttttgtttgactactgcttgtgaaattgctgttgtggaaaggggttcgatgtttgaaaaatctgcagctgacgggatcagctaggcccgggtggccgtttgaaagttgttggcccgggtggccgtttgagagttgttggccgggtgccaatcttgatcaattctaaagactgatacattgcacaaactccgactggacgagacgcactgtctcatccgtgtcgtttgagaagcactcacttagttgttttcagaaaggagttcaaataaaatcaattgtaaaaacaacagcctttctttgaagcctgcattaaacacttatttcccatggcttgctgagtactcccgtactcacccttgctctatataaataatcccccccagttgctgaagaagttgaagcggaacctgctgatgaggagttcttccaggagcaagccggctacgatgagttttagggtttcggcctagttcccaagtcgcgcctgtattggttggtccaagtcctggcttccgtttcccttttgtaatgcagttgtgagctcgggatctgtccgcagtccaacatgactgtacctctactctataataaagagacctctgttgctgtgatattccgtctccctgtgataccagcactgtttccagggactggtatcgattaacaggttaatttagagcgtcacgggctagttccggtcgggactagttcggggcgtgacagtaggtccgccaatctgccttgcagacgggacaaagagattaagtgcgatcctatcaatgcataatatttttcaagcaacataattaaattcaaatataggctcaaggtgttcaaaggtggcttgccttgcttgagatcttgagcttgatcctcgaaatcctcgcactgcgggtcttcgggctccgaaactacacgcaaaacgggacaactcaacaaacggagaaaataaagccctattaatgacctctaagcgtgccattagatagatctcgagatttgaggaattttggaagttgatcggagtcaaacggatttacggttgggaagatattgaatttctaagattattggatttttggtctaaaggaaaaaggatttatttaaatcctttttgaaaaagaaaagaaaagaaaagaaggagggggaaaattagacttccctcgggcggcgagggcgcggcccgagagaaaagaggcggctcggccgagctaaatgggccggccggcccaaaaggcggcccaaagcgcgcgcgcgggcggggaggggagagagagccggtgggccgggtccatcccgcgtggtcccgggtgggacccgcttgtcggcgactcggctcaccgtgcggagcgagcacgcggcgcgcgctagggttcggggagggagacgcggtgcacgcgcgcggttcgcggaggatgcggtgcggcgggcccccgcgcagcctcacggctcaccgcggaccatgcgcacggggggggggggggggggaaacggagggagcggctggccgggtcagccgatctggtcgcggccgaggtggcgcctacgtggcagccacgtgggccggcgggaggtagacgacgacgccggccagaacggacggcggacgacagcggcgagcggcggagcgaaccacggcgatacaggcgaaagcgagcacaccgggtggttgcgcgagacgaggggagacgagccaacggctcggattcgccggagggagtgcgtcggcggcggattgcggcggcggcaaccggcggggagggaagaggggaacggcgacgaggtcacgaggggccgattcccggcggcgagagcatccacgcggctacgggaatccgtcccttgtgccggattaggaggaaacgcatcgagggaggccggcgacgagaggcgcttccgagctcgggcggcgacggcggcgagcacacggcgagcgacggcagcagtcggggcggcgccggctagctacggggaggctactcgtgctactacccgagtctaaggggaggagatggaacgaggagggagaacggggagatgcgctaccgtgcgggacggggcgtagtgacgatgggccgacggcacgggagtgatctctccggcctcgggccggggaagaggaagaagagggcgcgcccggagtccccttccgcgcccttgctcgtgcgggctcctccgacacgcgcgacggcgaaaggcggcagcgaacagagcacgggaggcggcgacaatggagtggaggcgagagacgaaaacgagggagattggaggagggaggagcttgggtttataggggcggcaatgtcggtttgggagaggggaaccgacattggacggtcaagcctgcgagctggcgcccggctagcggcccatcacgacgacaggaggtgacgccggcgagagggaaaaagggagaaaaggaagggagaaagggagcttgtccctt

SEQ ID NO: 63445 - DNA, 9887 bp, Oryza sativa
ggagggggagatgggccgagagaaattcggcccatcgaacccgagggaggtaaaatagacttttgcggaggaattgatttgggaaggatttggattcgggattgaactcggcgatagatcggggatttgagatctgagatggcacggacactagacaacaagcaaagaaacaaatttcacaattaggatttttaagagataattttcccgctaggcgccacgacggaacgggcgctacaatttagcatgagcactagcttcactagatatccactatgtccaattaatgctcactgctattgaatccacctttccgaggcccaaccaccaacggagccgatgactctgagcacctctaccaaccattttgttgcctccaagcagtagcggacgcatatatcagttcaaaaccacagtgggtcgaatgatgctaaacaatcaatgagtgtaagactctgtttagatgggctaaaactttaagagcaatagaacaaaacacatatcatatttatatttcaatcgcatactgtctcaatcattgtttgcgacatgcatacgttgtgaagagacggactaatatgttatacgttcacaccttgttatacctaattttgatggtccatgactactgtaagggggtagggggtctcgagggtgtggcgacacaggtcgtagctgtgttggtcgacccaccctgactaatgggtagattggtccctgcctctaagatcctcctccctacatgtgctgcatgtgaggctccaaatatggaccactggctcctgtacaacacacaacatcgctccgccttcatcacaaggacaaaggcgttgaattccagctatccctcaagctatacaaatggaaataatcctactagggcatggtttagttcccaacttgttctttaaacttacaactttttcatcacatcaaaacttttctacacacacaaacttccaacttttccgtcacatcgttccaatttcaatcaaacttctaattttggcgtgaattaaacacaccctaggaagagatccaaccatgggagggacccaactaaactaaaactagcctattagataagtttttttttgaggtggggggatttgatagtgaggtcaataaaagtatatacatgtttggtggaacgatttcatttataattttgtactgggacggatttcattccgtacacgatctcaattagtaaaaaaagaatcttcaaaaggcctcatgatataaattagaaattaaattatgatctcgtctataaataaatcactccacaaatatatatacaacgccaacttttagaaaaaaaaactggttggaatatgattacatattttaggccttcttgaaacataattttttatacaatgtttataggaaatagtttagttcccatagtccaaaggacgtctcacatgcaaatgcatcccccccccctttcatgtgctgagcaagctcctcgcacgcattaaacacaataatttattttgtaattctcttataatttttcatggctattttaaaagcatgcagaaatgattaataatggttgaagcagcagagatttaaattgctgaagcttgccagcaaatctcccaagtcatcccaaacttcctggagatccaacgtaagcaacgtgtcagaaaactcaaacatatgcatggtctaaaatattacttcaacatcggtattgttgagaagcatgtgcaaattcagtaaaacacggccaccaacatgatatacttgtcaattcaactaaggtttattttcgccatattctccagtcaaatggtcgaatgcctgctctaagcatgagtgttacactcatgcaactggtcaaagtgttcgcactagcactcaacgtacatatactctgtacgccacctgcacgacacggccaacacagtcatgtgcgcttaggctgaagatttgtacaaatgcatgtatagacgataaatgcagaaatggaattcaatcaaagtgtaattaggatatcagcaacgacatcgcccaagaaatttctctataagtatatatatcaccatatttatgtggttgggttcttcctgggagatggattttcaaaaaaaaaaaaaaatcataactggcatacaagagaaaccagtggacatcctcttgaggaacaaaattacttttccgtgctggttcttaaggggccatcatcgtttccgtttctacccagagaagtacgttcttccggcaacaactataacacattgtcatcaaatttcattcaaaacaattcgtcgatttccttgaattggaagtgagattaatggagatgctagctcgacacgaatcaccttttggtccttattgaagttgaagtgctcgcctccaagagctataggtgcatcacataaagtcatgaactgcgtacatacgcagggagtctgagtggctgaacaagacaacaagcatgagcatttcctgacagaagatcttcgagtggatgataagttttgactgtaaagttcagatggagctagctagctagctactctagctgcttgcactcacaatctcacatggtactggtaggaggaggcaatagcgatatgataatacgaatgcctctttgactaccagttggaccagcaacaggctacgacccttttctttttctcatcaggcaccatggatctccatcggttaaagttacttggagactgagcgatgcaagtctcgcaaaactcaccagagagacaagcaacaatatgcacaagatggattctaatcgatctctcgggtgcatgatgactagtagttgtacgaactggaactgctcaactgcatcgaccacctaaaagcaacacgattgtcgttaaaccaggctgggctattaggctactccaacagagcgcgacagcgcatgacatactgagctgtcaagttttggaacttacggcttcaagagcgacaggtgtttcctgcatcaagctttgatgcttggtagatatagagcaacatgcctgtagacctgcagatgttgcaactcatgtgacatggacaagtagctgggctctaggcagcatctgctctcctgtggattactactaccctacgtaccaccctattaggcgacactggatacattgccatcgatctctatgtatacgttgccgccgaatgcgacgaagctgccaggctacgcgtgcaactctcatcactgtgaagttgcattcattcaggcttgcaggaagctcgtgcagtggcaatatgcaggcataactgtatgtatggcagaaaaaaaagcttttactcagggaaatgagacatgctatgccagcagagactgtctgtgtaactagctacatcctcatggctgacagtgtgaaaacatttcgatgcgttattccggccaggttgtccaactatcaaaacacgcgacaagttgtgcaaatcgtggcgtatatagtacaatactattctctctgtgggacatccacctagccagataagtatcagtatgactgtatgtgcaggttggaggagtggccaatgcaccctcacgcacacgaagggacgttgtacactagctcgtttactgtacgagcaagttctcatgccacgctagacaagcacatgcatgctttcccctcgatcccgaacggcgggatacttgcttgggtctgctgcgagattcgtcaaagtaaacctcggatgcatgcgtgtacgagtacgatggaatctgattttgtacgtaccaaccgcagaaaacaaatgcaatctgtgggcgcccttgcatgccatggccccacggcctaagcaaaccgctggattttgagcagtagagaaagctgtgtgctcgttgcattcgagtttttcttggtctcccgtcgcaagatggatttagaactttttagacgatcaggcgagccgtgccgcctgaaactacctgggcttgactgtgccgagtgcccagaagatgtgtttcctgccctgtcccgctgcatcagccgtatcgcggtgcaaggtttcgccgggcgcgcgcggcgcggcgtcgactggtcgaggcgcatgcgcaaacccagcaaaatttgggcgggtggtggacacggcatccgcacaccgcgcggtcacacgcgcgacctgcaagtcagttggcccatgacaccctgtgcttccgcgacgcgctcgatcgggaggtcgggagcaggatggtgtgtcgcgcgagaaggtttgcttccacaattgagcccacgaggcacgcgggtagagttcttttcgtggggcgccgttcgcgtgtgacacgcacgcacggagtcccacagggagaggggtacaaactggaccgaaactcgcaaggggatgaacaaaaaaaaacagggcctagtaggcctggagcaaagaagaaaaaggttcaatgagcctggagctgttgtatgtcaactgcgaaaaagaaaaagggcctagtgcagttttattgtccaatgcacaaaaagaagtggatgttgctgcccaggatcgaactggagaccttcagtgtgtaagactgacgtgataaccactacaccacagcaaccgacttgtttgcaagtatcacaaacgactacaagtaattgaaggctactgtaacgtttcatctctcagatttcgcattattgaaggttactgtaggtgctttatgtttttataagaaagaatagtgtcctaggacgctttatctaagacgaagaaaagcatgcgaagcttaaatagaacaatattttgaatccaaacttgaaaatataaatagaaagagaaggaccatgatgaatatatgaaatattccctccgtttttttaatagatgacgccgttgactttttcgcacatgtttaaccattcgtcttattcaaaaaatttatgcaaatgtataagatataaatcacacttaaagtactatgagtgataaaacaactcataacacaataaattataattacataaattttttgaataaaacgaatgtttaaacatgtgcgaaaaagtcaacagcgtcatctattaaaaaacggaggtagtacattaataaccaagggctgcatagttgcatagggtccgaatgctagataaaggaggtgctctagcttcagatgccttagattttccaccctttgttccaataatactttttgacacagtctgaaactgaagacacacgagctgtttatttcatagttacaatatagatatcatacgcaacaagttattgggttcacaatttctttattattacaacagtggaatatccaataggtatattaagtctgaggaactagttggatgtgatagccttgagggaacatgatctctgatatgcgcagtacttcccctccttcaatctccgtccaactaaacggagagttcacccggcaaaagaaaagaaacagagttcaacatgtatgtcagtgagtttttctaagactatatcagtgagcatagcaggcaacaaacgaacatcaacatgcgtatgtacctatactcggtcaccaagatgtggaggaagagtgcaatgaaaagcttgctaaactctgccccgagacacagcctgacgcctcctccaaatggcatgtaatttttcagcatcgagcttctcttctcctcctgtatttgccatttgcttcagtgagtcagatagaaacattgtggtaaaacacaacacaagtgaagaccaatttaacaacaattcatccttgaatactaatagatcaatattgaaatgtgtcttccactaaccctccacctccatggatcaaatttaagtggatcctcgaacaattttgggtttaggtgaactgccatggggcttatcatgactaaccacccggatggaattgtatatcctgtgtaaaaaccaaatattataataaccatttgtatggcctgatgtgattctcatgagtaaatactatgctatatgcacaatatattatcttattgtttgtgttagaagtttacctttcacttgcacatctgttaatgttttcctgaaaactccaggtgtgacgttactaattcgagtaatttcattcataaccttcaggtaaaacaagctcaaatgagttaacaaaagcaattgccgaaatcatcactatggcaccaatgatgcttcaaacataagcggacaacaacgtgaaatcacctgagtactgaatttcaaggacctgtactcctcccatgtgaacccggaattcacaccttctcgcttctttagaattgtcccgtgctcctcctagaatgatgtgttaattttagaattcatccaatatttcattatttgtctcgaacataaactacccgcattaaaaaaaatacagaccttgagctcttcaacaacttttggattgtcggttaggtacttaaaagctacagtcaaggttgatgacagtgttgcaaagctcgtaaacaagagcgcagcaagtgcgtctatagcaaagttttcatcgatcattggcttttcgctctgtagctcttcaacaatgaggtctacaaggtcaccatacttctttccaggtgcacttagcctctctttcattatatcagtaagtgtgttccgcacatttctcctacccttcattagggaacaaaaaaatcaggacaactgaaacaagtaatctagaagaccagtgtcctagttaatattcaggacatgtatttctaatgaagtagatgagtataccctgattaagctatttggacaagtaggaaagaaacccgcgcagatacacaggaaacttatttattattcataaaaagaatgttaaagaagtcatatctcaccgtatttactataagaactttaaattatcttataacaataaaagaaaaaatatctctaccataaaatagaccataaacattgatatcttaaatgataataacatttcttatattcaaacattttgtcctggttatatgtaaactcacatattaccactacttattacttgttttcaaagcaggatgcatttttaatagatgaaactatatatgtaaaaaaaaaacacctagtacatcattaatatagaaaaaaatatctctcacctatgtctaaatctttgtgcaaatatttaaaaatacaacaactaccaattaatgggataaacccattaaaatgtgtataaataccgctctaacggatgaaaccgagggctttttttctctgatgccttgaaacatgagtctcgcatcaatggagttgtacccctcgagattagcgtggattataattttaacgcctaactcaccattggcacactgataaaagattgcattgttaagtaccctggttacatcttattggggccactcaacttaagcatatgcatgcccttactatacttacgtcggcgtagaaaatttcaatgcaatcccccctggcccccggcccccggcccccgcccacacacacacacataatgcatttgtcatccacctagtaaactctaatacattgattgttttaaaaatagaaaatgaagaaaaatgaaaaatgccttatatttgaaaagtgagggactacataaattcaaattgtgaatagctggttcttggatggttttgttggtattgattctgtaactataattttgtagatgagtttgctacctgggtctaaattcagtgcccgtttgattacacgcgtgttgtgtttcatccaaatcttcttgtgacttgtgagatgggtcgctgtaatggatcgactgcatgtgctgtcacgcttgatgtggagaatgctgaacatgatttataattttgcagggtaggctaagatacattttttttgccgggtattccttttttttctggcgttttctctctcccacatacacgagatctagagggatatgaggaattagttccatagatctaatctaatgcatggttgaataagatggatccaccaatttaagtgtaaatcaatggtttagatattttttagaacttttctaatttattagacacgcgtgacgtcttagtagcgtttgtaggagtttcacatgatggcatgagagcatttatagtaaatttaatggacttttagtatataatagaggatacaaatacctgcatggatcggtagaatgatgtccctggaaaatatattgggaaggaaaccatcccctgaaagaagtcctgaaagttctttctcaattctcttgagttggtgacatcgagtccgatcaacttcttggcaactaggtcaaagatcatctgcaaaatacaattcatagtaaaacaataggaccattttgtgagacagttaaccggagataatctaattacagtgcgcactttgcgttcttaattatctaccatttattcatattagacatctatagatccaacaacattagaaatgccttaaccgaaacatatatccatgtagcgtcgcatagttttgcataaatgcagttgttaacttacgtctgacacgccgtcctgtacctcgacgctgggtttcccagtccatgatgcgaagctctccctcatagagttttctagctcaggaaggagtgattctttcaggttttcaaggccaaagagcttggccgcgacaccccggataaacttgtgaatggttccgttgtatgtggtgaggctcttcttgccaaagatattaattgcagtttctggataccaactttggaacaatttaccctcttgttgaaatatgaatcggttcacctctgggtcaagggaaatgatcactggccgtccaactaagctagtcttgaatagaggcccatacctgatgatcaagcgcaaaaccagcatggcatagaacttagatttgttcatatttatagaaagtgtgttgttcgtatcaacaacgtgcatatgtttgttgcatatttaagtagaacactggtactaaaaagttatcactaacctctccagtctttgcttgtagtagcttggcatgtctattgatgggcttgctctgaagaactggaaggtctcaccaataatagggaagcccatggagccaggaggaagcctcccaatgcatggaggattcatccatttgtatacccagtgagctaaccatcctatgatgagtgtgacaccacatagagctgcatatgaatacgatcctagcaagagctcagacttttccatgtcctagctaactagtgagcaagtatggaacaaggcttctagcttgcactgctgcccacgcagaggggaggtatctagatctttatatagcaattgtcacgtgtactattagttgactagtagaattttacttcatgcaagttgcaggtatctatgaagaaaatatattccttcccatggattgattgctctcctttagtgattggataattgagattgctctatacataatatgtcattgatcgagtttgtcaatgatttctactccatgccgttagacagaatactttttcacgagagcctcattacggtgccctctactagtaataaaaaacaatatgaaccgttgtagcgcccgttccgtcgtggcgcctagcgggaaaactatctcttaaaaactctatttgcgaaatctgtttctttgcttgttttctagtgtccgtgccatctcagatctcaaatccccgatctatcgccgagttcaatcccgaatccaaatccttcccaaatcaattcctccgcaaaagtctattttgcctccccgggttcgatgggccgaatctctctcggcccatctccccctccctccccggcgctctctctctctctctctctccctccctcctccgctctgcccgcgcgccgcgcgcgcgtgtgcaagagccgcgccgagcgccactccctcgctctgcccgcgcgtacgcaagagccgcgtggtccccgcccgtgccgcgcctgcgccgt

SEQ ID NO: 63446 - DNA, 13963 bp, Oryza sativa
ggcctcgccactccgcgcgcaagccgccaagggacggaggcagagcccctcctccttatgccgcgtagcccccgctcccctcctccttttctcaaagaagcaaggggcgagccccctttctctccctcctttttccccttttcctcccgctggcgttatcctccctccgccctgtcgccgattggacgcgagcgccgagcgccagctcgcgccttgaccgcccaagtcggttccaaaccgacattgccgcccttaaagcccaggcgccctccctctcttctcctcccatcgccattgttgccaccgccttccgagctctgtctcgcctccgccgttcatcgccaagcgccgggagagccggtgcgttcgaggacgcggaaggggactccgggcgctcgtcttcctcctcttccccggcccgaggccggagagattactcccgcgccgtcggcctctcgtcacagcgcccctcctcatctcggtagtgcctccctccgttcttcctcctcgctccatctcccccccttagttttcggtggtagcacgagtagcctccccgtagctagccggcgccgccccgaccattgctgtcgctcgccgtgtgctcgccgccgtcgccgcccgagctccgtagcacccgctcgtcgccagcctcgctcggcgtagctctgcccaatccgacgctagcaacggattcccgtagccgcgtagatgctctcaccgccgggaattggcccctcgtgacctcgtcgccgtttcccccttttctctccgccggttaccgccgccgaaatccgccgccgatgggctccctccggcgaatccaagccgttggctcgctccctctcattctccctcgtcatcccggtgtacgccccgtcgcccctcatcgtcgcaaggcgtcccggagaaaccgccgccgcccgccgtccattcgtggccgacgccttcgtcttcctccggccagcccgcgtggcagccacgtaggcgccacgtaggtgccacgtcggcgccagctcggtcgagatcgggtcgggccgaccccggtcagcccctcccgtgcgcgcgttccaccgcgagccgtgaggctgcgcgtgggcccgccgcatcctttccactgcgaaccgcgcgcgtgcaccgcgtccctcccccacctacgcgcgtgcgccgtgtgctcgctccgcacggtgaaccgtgtcaccgacaagcgggtcccacccgggaccgcgcgcggtgagcccggtccactggctctctctctcctccctcccgcgcgcgcgcccgacttgggctggccggcccatttagctcggccggaccgctccaattctcttgggccgcgccctagccgcccgagaaaagtctattttccctccctcttttcttttcttttcttttctttttcaaaaaggatttaattaaatcctttttcctttagaccaaaaatccaataatcttagaaattcaatatcttcccaacctaaatccgtttgactccgttcaacttccaaaactcctcaaatctcgagatctatctaatggcacgcttaggggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagtctatatttgattttaattatgttgcttgaaaaatattatgcattgataggatcgcacttaatctgtttgtcccgtctgcaaggcagattggcggacctacctagtttgttgcatttgatccttcctttgttaattgttataccatgttcccttgtaaccacccagttgcgcctcggaaatcgtgcactatgcagagtatcgacggtcgccttcaaacttaaaatctgaaaaacttcttgggtaaaacttgggttttacaaaagacttggaaaacccgacacctgggtcggtacttgcgaactaaatgaattttccaaaaccgcggaccgggaaacgtaccgggtgtacggtttcccgctcttgcacttaaggaccgtttccttggaatttcatccaaacataagaccagtacgaccacatgggtggaatgggacacccctggctgagtaactagcttatcaggggagccttgatgccgagagacatgtggattcaccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaggtgtaccccctctgcagaggttaacaaactgttcgaacagccgtgcccacggtcatgggcggatgtgaggtgattcctagcgtagtgttgtttgactactgccttgtgaaattgctgttgtggaaaggggttcgatgtttggaaaatctgcagctgatgggatcagctaggcccgggtggccgtttgaaagttgttggcccgggtggccgttgaaagctgttggccgggtgccaatcttgatcaattttaaagactgatacattgcacatactccaaccggacgagacgcactgtctcaaccgtgtcgtttgagaagcactcacttagttgttttcagaaaagagttcaaataaaatcaattgcaaaaacaacagcctttccttgaagcctgcattaaacacttatttcccatggcttgctaagtactcctatactcacccttgctctatataaataatcccccccagttgctgaagaagatgtagcggatcccgctgacgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtctgcagcccgacttgattgtactcctactctataataaagagacctctgttgctgtgatattctgtcttcctgtgataccagcactgtttcctggtactggtatcgattaacaggttaatttggagcgtcacgggctagttccggtcggtactagttcggggcgtgacaaccgttgatctcatttgatcgaagggttcagatctatttatactactaccccagttaacggtagtacaaacgtggagggacattattgtcaaaaataataggtgggtataatcgccatttaacagtgagtatacttttttcctcctttttagctttttcgatgaaatatgagtgatgttggcgcaataaatggtcatagatggaattaaccgggaaaaaacataaatgacaaagtaacctctagtcatcgtgttagtaaattgctaatctatcctaataatactagtagtataacaggtagagagcatctgagcatcgctatttccaaaaacgtgcaaaatatatttatagacataaaggggtggtgatgactcctttttgaagagaaggggttaggggtggcaactaattggcccaacccttacaatatacgagtaggagtcggtaaaagaattctggctaaggataacctggttcattaggggttggaaaagctgaaatgcattctacttttggtatgaaatccattacctggtagagtcgatgtttttttttctactaaggaatttattgatggttaggatgacagcaattctgcgggtgttttgcaaaatttcaaccattattatttgatgcaacctatataagatggctgtatttattcttccccaattaacttgattttttttctaggggttgttttaattagtgtaggcttcgcaaataaatatgtaggtaggtagataagattgggaatacaccgattgctacaaacgaggccatgtttaggtcaggagtgaaaagtttttgcatgtcacatcagatatacagacatatatttgaagtattaaacgtagtctaataacaaaataaattacagatttcgcctgtaaactgcgagacgaatttattaagcttaattaatccgtcattagcaaatatttactgtagcaccacattgtcaaatcatgacgcaattaggctttaaaaatttgtctcataatttacacgcaatctgtgtaattagtttttttctatatttaatactccatgcatttgtccaaacattcaatgtgacgggatgaaaagtttttgtttgggaactaaacagagcctaaatcagcatgaagaatacaagtatcgaaaaggaatgcatagtcaactatgaattcgagtttcatgcagtgtgactttttagaatttagaatgtctcattttccttaattaccagctcgattttgatattttcttttcatgagaaatcacgatatttatgcttttccttaccaattataatatgtgtatagattgacctttgattcagttcgagctaaaattattattgtttaatcttttttggggagagggggactattttcatagcttcttttccaagggtacaagcgcacaataacttgcacaaaagctatcacattaaagaaaaattccttgacgtcgtctagacagccctggctgaatcctcccagacttttctcccagacttttggtgcaagcgcgctctctagacgcatgtcctcttgtgttagcgtcctagcttacgcaagttggccatgtcggagggtctagaggggagagcggttccatccttctctctcacctctctctctctcaatcccaaagatgttgctagagttagggtttggtttcagttgttagggataggttcgggcgacctcggctgtagttcatttgttggcctagcggcggccggtcacgcttagcgatggctggtttggtgctagccttctcccgggtttgtgtttgatgttgtcggtgcgtggagaaatctttgtattttttttcctggttacgacctcccagggttgtaatcttatattttttccctgctctatcaatatgaacttcgcactgtctggtgcgagtcgttcaaaaaaattccttgatgattgttgcaaaggatgctttgcccttgtaaatgatgccttatttgcccgcggtgagtcactgacatgttattaagagtgagggccaaataaggggttgagttaacttttaggggtgaataaagattttattccttcaagtaacatttttctgggtgaaaaccatatctttcttagattggcgatggcggtatccttgatgtcgtgacctccatggtggcatcgttttcggagtctcgtccctgtgatgctgtcgtaggcctagcggcgattagccatacttagcgggggtcatttttggtgctaggctccactctcagttgtttgtgcttgtgtggttagcacgcggtgtttggtcatgcactttggtgcattgtggtgttttttcttgtaacttttctccttcttaatatattcgaatagcctccttcagccttcttggtgaaaaaaaagcaacattttttcagcattttggcattcaatcgttcaaattaactgcaatcaggagcagatctagcgtgggtgctcgagggactcgagtcccctagtccccaacccctacccggctaaatcactattgataaaaggagagatgggaggaggaggaagaacagagaggggaggaagagtaagggacattgaaggaggaagaaaaagataagtctctctccaattttgttctagatctgcccctaactctgattgaattattgacttgagagttcggaaatagacatgcaacggtaccactgttttcgaaggatgcattcacctaacaacccgtttgaattggataatgattctgtgcaggaatttgacaaactttggtcatgttatatagtacttgctacaggaatttgacgaactatttttcgagcaatacggaccgctatcttttgatccaattgcaggtcatctcaattgctttggatcaactgtccatgcatttatttcttgcagctgacgaacgtctcaatcgcagcccattaagtaattactactacatccgtcatattataaatgcggttatggtttccatgtccaacgtttaaccgtccgttttatttgaaaaatttataattttttttaaaaaatagtcacacataaaatattattcatgttttatcatctaataacaacaaaaatattaatcatatttttttaaataaaatgaatggtcaaatattagacacgaaaagtcataattgaacttatattaaaacagagaaagtagtagagagccccgtgtcaaaaatataaataagtaaacagcccatgcgtccaataataaatgtacatctctcaacataaagtcgttttggaattctagacattgtttatgttttcttctatgcctgtcattctcaaaaaacaagaatgctatccctctcacaaataaaatttgtcgtctttttcaagatagtatacatgaagggcatgagagttattttctcaagtcttgtgcataagcctaaaattgacttatatttggaaccatttgagcatgttttctttatattgttgatactggccattgtaaatagcatttgtagtattttcggatgctgatggagttaggccttgttaatgtctctggataactttgatccgatagccatcaggaaattctagtcctggagttcggactaccctgcttgctcccagcggtatccacctgaaaaagaaaagcgcaattatttcatctccttcgctctcgtttgcgagaccaaaaatttcagccatcgctgttccgaaatgttacttcaattggttggcacatcacagagatatgggatgacaaggatttggacttccccaaatatgccctcaagttggactgcgaaagagaaaaacactacctgtattttgtcacaaggaaatggaggaaaatagccaattgtagcttgctgaagtctgctccaacgcagaaccgtagtcctccgccgaatgccatgaagtgttttgatccacggtttatctctggtttatcctgcatgttacactcaagctgattaaaattttcttttagtggaaagctaactaaatatacccgaatgaatagatatttttgtgtctgtatagggggagacgggcttggccggggtacgtgttactccatccgtttcaagttacaagactttctaacattatccatatatatatatatatatatatgtctagattcattaacatagatatgaatgtgggcaatgctataaagtcttataatatgaaacggagaaagtagatctttcatgagtttattttttgttttttttaacttgtgggagatatgtttcataaaaaaaatgagtggaaaatcaggattatcaaaccttaaaccttgaagggatgaaggtgagaggatccggataaatatatggatttaagtgcactgctggtggacagaccatcactccccatcctgctggaattgtgtatcctgtcaccaatggatgtcacttaggaaaagacaatggtattcatatgctttttttaaaagtaaatttcacaaaactatagatactttggtcaaattatcacaattaagtaatgtatcacagaactacaaatttaactataaatttatcacaaaactacagatttaaggctaagtatcacaaaactacatattgaataataaaattatcacaaaactacatattttagggtttaaattcttagcactagtgttatgttggacttataattgttcaagttttgtgattaaattgtcattaaatatgtagttttgtgataattttgttactaaatacgtagttttgtgatatttcaccataaatctatagttttgtgataaatttagtactaaatctgtagttttgtgataaatttagtactaaatctgtagttttgtgacacgtcatgttaaatctgtagttttctgataatttgatcaaaatacttgtagttttgtgaaatttactcttttttaaccggatgcatgatgtactgactcgttagcaaggtttcaacatgtgacatagtaatctggagatggattctaatatatcgctcaataaacatgcgagttcaaaagtgacttttgtagtttgtaaaaaaataacaaaattaattgtgaatatagatatactatttaaattttgatttgctatttttattacaacttgtaaaaatcaaatttgaacttgtatatttgtagagtgccatattatacatgaatctatcttatcaaaaaatttgatttttttttcataacaatttaattagcatgcaacaaatcggtggatatctagctaagtgatcaaaactgtttcaactgaccacgttaaaaaaagctcaaactaatttttttagcaaattttgcctgaatatcacatgttttcatcgataactagcatggtggcccccgcagattgcgcggctagcattattatattttctctcatataatactacatatattttctcaatttgttattaaaatatattagaatgacaacatattttaaattttatattaactttaccaaactactaatttgtaatattcatattttattgtatatacatgatagttactaatatcaaattttagttatttctgaattgtatttctatatggactctatactcgcctttcaatatttcttttttttaattccgaatttttgttatttgcaaattgtattttttatatagactctaggctattcttttaatattatttatctttaattctgaattttcattatttctaatagtatttctatgtggactctaaactcatctttcaatattctttatttttttaatttcgaatttcaattacttcaaaattgtatttctatatggactttaggctcttcttcccatgtgttttaaatttcgaattttagttatttgtaaattatattgctatatggactctaaactctatttgtaattttattatttttattcccaattttagttagttctaaattcctatatggactctatgctcttctactgttccttattttttaattccgaatttttattatttcttaattgtatttctatatggactatatactcttcttctaatattccttatatttaattctaaatttcagttatttctaaattgtatttctatatggactctatactcttctttctgtattttttttaattttgaattttagttatttctaaactgtatttctatatggactctaacctgatttttattttttttattttttatttcgaattacaattagttctaaattgtatactggcatgaactctaatctactcttccaatatgcggatttgctcatattgttttcttgcccaggcattgctgcagaagagtgaaatgaaaaacttattccttattttttaattctgaatttcagctatttctaaactgtatttttatatagactctaacctaattttaattttcttttttttaattccgaatttccattagttctaaattgtataccggcatggactctagtctattctttcaatattcctttttattaatttcgaatttcaggtatttctaaattgtatttctacgtggactctgtttttctttttctccgattaatatgagaatttctatgccgtgagagcgaacgtggaggctcatttttctattactttaaataagttggagtaatagatagattgggttattcaatgactggtcgcatttgtaagccttgctagctcatcaatcatactcctacctcattattaaatagcagcatcaagatatgattttggacccatgatcaacagattgtggggggctcaccattgaaccgtatgtctttaagtgcctttctgaagatgacaggagcgatgttggccaaacggaccgtctcgtttatgacctacataataggagcatgtgcgcgtatgattggtttagcaacgcacgttttgatacaaaacatgcatggggtgctataattggatccaatgcaatcagtagcataaactgttgcacagcaaattctgaaccctatctgatcgatatttatctagcagttttgtgcgagctagtactagtaactaacctgagatgtgaatgccatggatttgtactccttccatgtgattctatctagctcgctgcctgcctcacggtccttcagaatcgtttcatgctccacctgcgtacgtacatatccgtgtatgtcagtacatagtcataaacgtgtatgtcagtatatcacatcttgatttttgcgtatagtataggagcactcaccgtgagctcctccaggacgagagggtggtcggcgagcagcttgacggccagggtgagcgccagcgacgtcgtgtggaagctggcgaagaggagcacgaacatcaggtcgagcgccatcttctctgtcatgaccggcttttccttcgtgatctcctggatcacataatccaggaagtcgccgtgctgctgcgcttctcctcctcgctgcaatcctgtcgattgcttcctctcctccagaacttgctctagcaccaccatcgcgcgcctccgcccctgacaagagtctcaaaaccaagagaccatgtctgaaactttgcgaagaacgactaattagtgcaatatcgtgacgacataagttttacctgcatgcatgagtagtaagctgtccctggcagatacagcgggaaggagatgagccctcgaacgaagtcgaagaagctcttccgcaaaatctttgacctcgacggctccaggccgagcagcttgcttgcagcaagatcgaacaccatctgcgcaagtgcatgcactcgaacggaacatacatcacaatgagacagtacaagaaaccaacattctaaaatctgggtagaaaccgcgtacgtacagtggagacggcttctttgagctcgacggccggcaaggtggaccaggtgcagagggagctggagacggcgcgctcgacgtcgcggatgatgccttccttgaggctctcggggccgaagtacctgagcaccatgttcttgaggtacctgaacatggcgccctgctgctccccgacgttgtccttccccaggatctccacgaacgagtccgggtaccagctctggaacagctgcccctcctgctggaacaccatgtggttcagctcctcgtcggccgacaccaccaccgggtgccccaccaggctggtcttgaatatcggcccatatctgaacttgcagcccaaactagtaaaaaaacagcaaaagaaacccagcccgttctctggcccattaacaaaggcgtacctagccagcctgtgccggatgaagggagggatgtccaaggaggcgtcggaggagaagaactggaacgtctcgccaacgagcgggaggcccatggagcccggcgggagttggccgccgcagcgagggttcctccacctgcgcgcctggtgccgcagcagcagcagcagcacgagcgcagctgcgccgcccacgagccccacgtaggcgtacatctgcacgcgtgtaatatgcgctagtggcagtatctgcttctgttgatctacatgtgccgtcgtcgaaagcaaagcacatttggctgtaggacgatcggtatgtaaggagtagaggggggggggtcacggctttgaccgtggtttggtgaagccatcaacgtaaaggttgtgaaaaactagtggttgctcagcctgtcgttgttggtggatcgaatgttcgatggctgctgctactaggatgggccggcctgatccttcccgttagatcttaagattctggcccatctacagagatttcggcttcccaaaatccgcacaatgcccatcgtcacacggcctacgaaatcctttgctctctccgggtttccgtggcacaactgggaaggcaaacccggcgtctctccgccccccaatccgcatggacgagctgctgcttcgctcgtctgctgattgcggaggccggaaggatcacccgcgtagcgtggtcaggtactgttggcgaactcccgcaggtgttcgacgaaataccgatcaaaacagagcgagcgagaagatgatgtttgtgctgcgaaaaaacttgcagcgtttttagttgcattaggaaactttaaatagcaaattacatgtccacaactctctactggatcacgtcatcccacgaccgaagttgccgccatgcgttcctaccctcccgccacttcgccatgcctcccgagtagaccgcgccatcccacgatcggaaacacgcaaagcgcacgcactccctaagaaaacggaaagggctcccgcatgaacgcagcatgcgtcggagcgatacacacgccatgatccccagcaaaaccggaaccacgcgcttgactgataacttggagcagaaaacgggagatggcgccatggattatcacaacaggtacttcctcctcaggtcaaagcctcaaggccacatttggtttagggttgcaaattttggtacggggtagtcggtaggtccgagcattgaacggcagtgttctgaatgtatatatcgggtgaaagtaaatacggagaataggccaaggactcaccgacgagcgggcaccgaaaaaggggttgctcctcaatgctgcgggtggctttttccttgcttgtgctgggcaccaagccaccaaccgaagcagagagcagaggataatcccagctctcgtactgcaagcacgtggactccgccgtggctcatccaaatgtcaggtttctcggaacagatcagtgctcggattatcctgcctccaatcatgtggctaccctgcacgccttgcgtagggtcgttggggatagcactgagcagctgggatggatgtccccaacgcaaaactatccgcagtggagtactgaggttgttgcaaagctttcttttcggtccgcactgagatgaactttgtcaaatacctgaatccatttattacagtaaagaaacactacatggaaatgagctttcagctttgtcaaaaccaaaacaagtactacctgaattcatttcttcgtccgttaacagtaaaattgcctgataaagagccacggttttcattcaaaggtatatatacccacacacaggataatggaacccgacgtattgtctgacagaagatatcagcagcggaagtacttgctgcaccaatccccaaaggtatgggcttaatttttaggcagttataagagtacaagctaattaatcagtaccattaccagccatacttcttgttacagtatatcctgttcatacttcttgttggacatgaaaatttactgtattatttgctctggcctatggcattaccacaaactaaatgtcaattattttttctccgtgcatgtccttgacagaagattcttaaccactaccactagcatcctatatagactgattgccattgctagctcaacagctaacaagtaaccactgttgcgagctaaccagtaaccagtagccctcctattgtatacagagatgccactgttaagagctctgttattgcagcgttaggtgagattgacactttggttagctgtaaggtggtatgcatcactgttcttccggtggataatgggggatatctcagatgaatccttgtgacagggggacctcgtggtctgtcaagtgtcctcatcatttcaatacatgcaccgatcgcccaaaagtgaattgtttcttctgctcctcctgtcggggaccagtgcgttctgttgccgtcgcattgcatgcatgccaatggtgatgaactctttaattagccgttagtccattacttgcaagatctgaaactagacagctaacgttatcttctccataatacagggagaattttgcccttaaaa

SEQ ID NO: 63447 - DNA, 9411 bp, Oryza sativa
atttacttttaagggcaaaattcagagacattcacgatgttttttttaaaaaaaaatggtactcgttataagtaatacatgaaaattatggcatgacagtgacaaaatggtgtcaataattatgcaaatatattccagatgctgattgaagtggttaggacttaaaagtctttaggcccttttctcaacttggctgactctgtgtcagatttttggatgttttgcgtggcttgtcttccactaccacttccaattccagcaccgacgctgacgtcggcacaaaacaacgaaggcgtgtagacgcggaatataccagtacaaccgttttgtctcattttaaggcattgcagtcggtgctagcgtgcctaatgttcagctacactgtaactaattttgtaattttgacattattcacctggagttagtgtagacgaatgcatatggtacgctcagtgtgggccaccaaattttcagctgaatccagagtcaaacctcacaggcatagtagttgagttcagcactccagtagcatgtgcgagcaaacgtaaaggcagttcagacaatttgcgtctagccatgtaaacattccacggtagttctactgttctagggagagtaggcgtactatggtggtacactggtactccgtactaaaatgcctgatgacagcgcatgaagaatgctactgaccgtagaaaccagacctacgagtaatgtaagaattatatcagaatggtaatctactagtaaaaagtaatggcaaacaccgtgcattggaacaaaaaggattgacaccataattgtagcttctatttacccacctggaatactttggttgtcctttaatgtaaaaaactttgcagggtttccttctcagcacctcttttacacctaaacatcgagggctgaactccatatgtgaactattccacccaaagaatgaaatggaaaaagaaacttcaaatccacaaggcaaatggtaagccgattacgatatttgcccaatatgtcaattttttctaacactttatttcacgttattgctattccttttcttccccgagtgtccagtatgtctttacaacaaggaggagcttctcccggacgagcgggccatcttcgtgatcaacgatttggctgttccatctcataccgtcggtaatgctctttattttcaccaacatatcaacatcatctcttataatcactgtaccctcaggcctcagtattctgtccatttccagcagaatgttgtccatctggcatctgcaagagacgaaaactgcgtcagtccagtaccagggtaaacagtctccaagagtgactgttaacgatacctattagatttctcaaatacaggcataaagaataatgtgcagttactactgcataggagtacagatttatactccacggacaagaacagaagtcactgttgctgtgatggactgaattttactgcagcttatgattacctgtccttgtatagcgtgaacactgaatcggcatgaatgaggtcgtaggtccgagggtacgtggacatgccctcacacctgcagtaagcacggatagaagtcacacaccaacaaaaacatgagcacacacaccaacaaaacatgaccgtcatcatattcagtctcaaagagaggggcagtgcttgcagagttgcggtacaagaactcaccagtcttggtagcttccgatgagcccacgctcgtatataaccccaagagttgttgaattgccaacagttgggaccatattcatgacccacacagggtcatccaccaatgccgcagcgaagccgccaaagcgcgcattcatatcaagcaagttgcggtaccgtcctttctgtccaaattgacttatcacggacttgtagtgcccgaccctcttctgccatagtttggtgtcttccacgaacatttcatcagtgacaccctcaatgctaccactggcaattctgggtggcactgcagtgagcctctctggccatttcttcaactggccacccgcaatctcttttatgtcactaacctctgggagaggagttatgcaagcctccatcttatcgtacctataatcgatcacatgaatatgatttatcctgaactgtgaacgtgagttaacttcaagatggacaataaagatataattagtgttgtaattaccatgcagcatctggatttttatttgagcagaagggtggggacttgacgactttgcgggaggccttgcagtgaatgtggttagtaggtttctgccagatggcaatgtcaccaacctccttgagcgtgatcttcttccagcaaagactcttggccactgcctcaatcgcttgctgctctgcattcaggtcctccttggttctctgccaccccttccagtgcttcttccagttgattggaggtccagacaaaatccaataccctcctggccgcagaatgcgatccacctcagccaagtacagcccatctgcatttcaaattgcacctgagttatcaaaggattaacagagcattgccaacacatttaattttggacaaaatgttgccataccgtagagctgccagggaatgaggcagcgggagcaatgtgccatgtcaaaggcacgagctggataggtgagccggttggatgaaagaacaccgatcatcgccggcacaccacgttccagtgcaaattgaacctgtgcctcgtgagagtcacgtggcgcgaaggacatggccaggatgttgcgtgacagcaagtatgcgccccagctcgctacctgcaacaagcggcagagtgcaacacattaggaatccataactctaggcgtctggttataatatacaaagggtaacttgcccctctacacatgagaaaaactcagtttccacatatctagcaatacaaatagatcaaaatgacaactattggcacagcttgctgtagacgtgaaaattccattatgtgtgacattgtcactgtgtaaaaaggcactacatatcttccaagttttcaacgatattagtgcacagtgcacacaacagaacctctcctatccgcagccgacatggagaatttgatcaaagaatgcactatgcgcacggaatgctacaagcagtcaagtactagtaacttcagttcagtgcttcagttcagcctctaaacgaaacggtatgtcggattggtcacgttactctacagtctgacctgcctaatcacagaatgaaacgaacaaatgctcctctgatccgggtcggagcagaagctcgtttagggtcagacccgtttgcccgggcagaagggcccagaggagcagtgtgggactggaaacttccgacacgcgcaaagcaaaatcccattccggcgttgccgagatttccgcctcatgttctagtgcatcaacaaactggagtataactaaacccccaaattttgctacgaatgtacgaaacactacttaaaatcgagctaattatgcgcgaatgtcatctatcttaagcaaatagggtgtgcttatgtatgaagtggcctaccccacaaccggtgtcgagggcggtgcggatggatccatcgtggagggggatgatcttgccgatgtcgtcgatgtacgcgccggcgccgtgggggaacatggtgccgccgccggggaaccggaacttttcgccttcgacgcggatccagttctgcaccgccttctcgacggtgagctccttgtgcggcacgttggcgaaccacgcgacgtcgcggctggtcggccacgggaacgggttgcggtacccctggggcgccggcacgaggcaccggagccgctcgccctccgacgggcagtgccgctcccggtacacgagccggtcccgcgggaaccgcagcgagcgctcgacgtcctcgcacggcgtgtactcggagtacttggccgggcacgcctcgtacgtgcggtgcacctggcccgacgccacctccatcccctccgcggtatggtgcgccgcgaagtcgagcggcgcggacgacgaggagtcgccgccgccgccgccgccgccaaggagcgtcggggtgggggagacgcaggagacggaggcggtggtggcgatggagacggaggaggcgacgccgccggccggggaggcggagaagccgccgtggtgccagatgccgatgaggtaggacaccgtgcagagcaccgcgacggccgcgaggtggaacagggacgggcggcggccgcccgcggacggcatgtgcagcttcgtggcggtcgcgcccaccgccatggctggctggcggcttctgctgctcccgctgcgcgctctcctctctcccctcgcctcttgtgggattggggcgattcgcctttctgcaccactgccccccttgctggctgcttaaagcgcttgccgcctaggaaggattaggggcgtggggatcgattgattaggtggaggtgaagacggggggaggccgtgaaagggagccgcacatgcatccggttttggtttaatcgtgaagagagagcgtttattactccggagcggctggtttattactcttgggaggatgcaaatggttgcgctttgggaacacgacactacgccaccctacgctgctatcgctggcggcgcgtgtgctgcgtgtgcatatcgcggcgtggcagcagtttcagcaagcattaactcggtggtgttactgtatattttctgttgatacgatcctggttggcgctattaaaagtgtaaatgctgagtgcacgagcccactctgtaaggttccctctgaattgtagaagtgaaaaaaaagggaggaacaagaaaagtacagggattatgatagaaattcaacagcaagatgtatgaaaaatacataaataatcgtttgattatttataggaaaaatataaaaatcggatgaaagagatagattcaaagaaaattttccatgaggttgaagctattgctaagttttcttcaaaattttgataggattgtatattctatagaaatttcaaaggatacgataggattcactccattgtttcaaatgttttcatagaaaatattttctatagaattgaaatcctctaaaatttatatattctttctacaaatcaaatggccccttattcgacatttgctcgaaaaaaaagacaaaatatgtttatgacgatatattttcatccataaacaaccatcgtaagtgaaaagggaagaagttaacaaaactataatcgtacagttaatcactcaactgtaggtccatacatagtggtttaatagtttgctatcatgttcaagatttatgttatatctgcgaaaaaaccgtgaaaaacaaactaatcgatcaaaaataatctgtatgtcggtctcgtgtgtatggatcgttgttgacatgcagattattgatgctcttaccttgttttccatatccaagtttaaaaatgaagttattttgaacggagataagtagtataatgacatggcagtactagagcaagagtttgagcacaatttattccttttctttctagagacacatccaattatatactcctactacaagtaacgcaatgacactgaatttcttctataataatatgtataaataatggtttagatatttattgtctacccccgtcctataatatagcaacctaggactggataggatattttatagtacaacgaatctgaacacactcatgttcaggttgctgtattatgggacggagtgagtatagagaatatagagttttttttttcacatcatgtctaacagaatatagagaacccacattaaccatccgtttagctgtttcaaatagatttatataattactttttattctataaacaacacatacaaatagtgaagtagatggttattttaacttgtctattagactacatgttaattaacatacaacaatcttttctgtgttctctcttttctgtacaacatcgcaccattattcatgtcgtaagattgttttcatcaatcaattaatttgcccttgctcgtattattttttaaaaaaaaaaacgaaccgcacaagacagtgcgcgtttcatgtattgataaagcaggagaaaaatacaatctatagtcctggaagaccacagaccagaaaaaagaaaatacaaccacaccgtgcgtctacaacaagacccactgcaagagcgaaacagaaggtcttcgagacgacacctccaagaaggaaacgacaccaaaggtgccactgtcgtctgtcccgggaggccaggacaaggttttcacctgaagaaagtaattaggagagataagaaatacaaaaacaccccaagaggaaaacggcacccacaggcgttgttgttgccggcccggaggcagagctttcgcccaaaatttcgtccctcccaagaactaaactcctgcacgctctgtagccaccaccaacgaaaaccttcgacgcacggccaccgcaccggcgccacgccgccagtcgatcatcatggggaagctcgaacctcgacacacaccggctccatccacgcagatgggttggatggggagagggtgagagagaagaatggatgccctctccccccccactagcccgctcgacatggacaacttttgtcgacaaaggcgtcgtcacaagaggacataagtctggaaatgtgcccgtcgaaggatcgtggctcctccctgacagagaaaccgccaactcagccacgaatctgttgcccatgtcacctcgggccgccggaccgtttcgccggcgccttgccaccctccacaccgtgctgatgaccccctccgccacagtgcacccgccgtccaatggcgcggcactaggacgtccaacgaagcacgatgctcacgccccaaaaccggtggaggggaccggttcttgccggagggaagccagacgcccagcactcgccaaagttgccagcataggaaggttcgcgccgcacggagaccataaggtcaccatcgtcgccacatctccaccgtccaccgtggcctggcaagcgtgccgctcgtcgatggctgcccaccacagcttgggctccgccaacaccaccactcagtattgactttaaggaacctacagtagcttgtcatgcaatgatttataatatttgtcatcctattctaccacaatttggtagagtgatttttcataggtaaagaattaaaccaaccctgtaattcttttgtcgtggaggtttggattgcgtggaacatgggctagagcctaagcctttcgataaagtattatcctcctacccaaaccttgtttcttctaggtctagtagtaacctgtagtactaacaacgaagtattattttagaaggacattcatcccaaacacgtttagaggtgcagtaatttcgagcaggcggaatgttggtctctcagtcaattagggaaaatgcgcagaatcataatccactgctctgtgagcactctactcttcctcacaagaacaaacaagatcacaagtttcatcgatggatcaacaagatcgcatcgcctccgccgccttaaccgctgatatattgatctttctcagatgagtttcatcatacagaggagtttgtttatatatctctctctctcgttcggcaacaacgccagctcacaactgccagctatgcattagctattacatggcccaatccggcccaacgaatctagtatttgggatacggagtcttgcagcccgtttgcgcggcccaccatcttgcggttgctgttgctcgtccgaaacgtcagtagctgggctgctgacaagcccctccccttggaaactgacttgaccccaagtcagggcagctgggaacctttgcctgagattagcttcatcttcccaggtcgcttcatctgcagcagaatcagaccaacgaaccagcaactgaggaataatacggttacctttcttatggagcctagtatccagaacttggactggaaactgaatactggaagttggaccaggtagctgactctgaacaggatgcttgaacccacaagagcctttcaattgagagacatgaaagacaggatgaacagcacagtccaatggcaactgtaacttgtatgccacttgaccaaccttggcaatgatttggtatggcccataatacttaaaagatagtttgtgattagctctcttggcaactgaagattgcacataaggctgcaacttaaggaaaacccaatcacctacctaaaactcctgaaaactcctttttttatcagcttgatatttcataacctgtcgggctctattcagatgttgcttaagcagttgagccatcaacttcctttcagataaccattgagctaaatcaggtatactgcaagcatcttctctgatgccgaaatgagtaggaggatagccatacaaaacctcaaaaaggtgacttatacagtgaagaatgataagagcagttataccaaaactcagcaagatgtagccattcagaccatttagagggagtagcatggacaaaacagcgaaggaagatttccagacactagttaaccctctcggtctgtccatctgtttgaggatggtaggctgaactgagatgtaacttagtgcatgtcggagaatgaactcctccacaagggaaccgtgaggcccccctttgtgagttcggccgggggcagcggatgagattcgagggcttggtgagcggagctgtgtgatcttgagggggttagcccccccccccaagacgatgagacaaaagagatttatacaggttcgggccgctaagaagcgtaataccctactcctgtgcatgattgattgaatgtagaacacaagtgcttggggttgcgagacccaagcgccagttcgcccccctccctccccccctcccccctccaccactaggcctggacctccttttatacctcaagtggttaccacatggacccaacaacctaacctagctccggtggagaagtattataatctttgcattaaatgcatgtcttgtctctgtggttgggaagccaagcacacgtcgtcttgatgatggggcctatcaaatcttgccgcctgacacgaggggtacccctgtcagtcaccatttaatgggtgaagacttctgggctcctattacaccgggaaacaggagccgtgcggtgaccagagcgggaggaccgacttcggcttggataagaggataagaacctctcaccatcactatttgatgggacatgtcaggctgcacgccgcctgacacacgagcagcgcacaggcgcactagccagtctcatcggtcattcgaccggtcacagaccggttgagtgcactgcacgccgcattaaatgcggcatggcgcgaccgctcgggacgccataaatgcgggtaggtgggcacctggaggcggacacctaacccaccgtacgtggtgacctagagagggggtc

SEQ ID NO: 63448 - DNA, 4659 bp, Oryza sativa
tgaaattatagcttgtggcaacccatgcagcttataaacattaagcatgaagactttggcaacatccatggcagaaaaaggatgagatagggtcataaagtgggcatacttagagaacttgtcaaccactaccaaaatacagtcctgcttgttagaacgaggcaaaccttcaataaaatccatggatataatctgccaagctccatcaggaacgggtaaaggttgcagcagtcctggatatttagctctgtctggcttggattgcaaacagattgaacaagcattcaactgttgttggatggtatccttcatatgaggccaagagaaaagagatttgattctgtggtaggtaacaggaaatcctaagtgtccccccatgggactgtcatgcaaggcagagatgatttgctgttgcattgaagaattattgccaacccacactcttcccttgtgtttcaagagccccttgtgcagcttatactgagggtgagaagcaggattaacggccaattctgtcagaagcttaactgaaacaggatcttggtcatatccctagattatgtcttgcaaccacacaggagaacattcagatagagccaagaattctgacacttcggcaggaacattccttgaaagggcatcagcagctacattgtgcttgccctttctatagacaattttatattgcaacccaagcaatttagtgaaagccttatgttgccagggagtgttaagcctttgttcagcaaggtgcatgagactatggtggtctgtcaagatcaggaactcttggaattgtaagtaagggcgccaatgatcaactaccatcataatagccaaacattctttttcataggtggaaaggccttgtgttcttggtcctagaggcttgctcacataagctattgggtgctgattttgggaaaggactgctccaatgcctaggtcactggcatcggtttccaaagtgaaaggttgctggaaatcagggagagctaacacaggagcagaaaccaaagattgtttgagcaattggaatgcttgttctacttctgcagtccaattgaaaggagcatccttctttagcaattgtgtaagaggtttgctaatagcaccaaaattcttaataaatttcctataatagcctgccaatcccaggaatcctctcagctttttaatagtagtaggtctgacccaatcgacaatactctggattttagaaggatcttttgcaactccagccccactgataatatggcccaaataggatatatgttcctgggcaaatgcacatttactgagtttaaccttccactgatgattagataacagctgcaggacttgtctcaaatgagtaagatgagtaggcagatcaggactgtatatgaggatgtcatcaaaaaacactagggcacatttcctcaacactggactcaaggtgtcattcatagcaccttggaaagtgccaggggctcctgtaaggccaaaagacatcaccttatattcatagtgtccactgtgggtttgaaaagctgttttgtgctcctccccttcagccattctgatttgatgataaccagctcgaagatctaacttggaaaaatatctagcaccagccaactcatctaagagctcatcaataactggcatggggtaagttcctttctgagtgatattgttaagctgtctgtaatcaatacagactctccaagaaccaaccttctttttaaccaagagtgcaggtgaagaaaatgcactgctgctgtgctgaatgactccattttggagcatttcttgaacctgtctctctatttcatccttatgtccaggtgtatgcctataaggtctgataaacactggtttggagtttgggaataagggtatcctgtgatcacaataccgtttaggaggtagcccttttggttcttgaaaaacttcttggaactcagtcagtaagggctgcacaatctcaggaatagagggagatagctgattagtagatttatccaattgaacaaggtacatgattccaccagacttagccaatccatgtaactggcccggagttatagggagacagctgagagtactagacagtgttccctacaacctgaccattgagtcattcaactgaaattctagccacttgtgtacccaatccaccctcattgggctaaaccgttcaagccaatccatttcaagtatcacatcgtaggcacccaatgctaaaagtctaaagttgctcttgaaatgtattccttgagttaaccaatcacagtcaattatgtgcagtgagcaagtgaggaacccaccatcagcaaccttaactctagctagtactggcatagccttaacccctgataatttgagaccaatctgttgatacacaaacgagtgagtactgccagaatctatcagcataagaacttcaatgccctgaacccatcctcttaacctgattgagtgattggagtcagtaccattaatagcttgctatgatatagccattaaggtgtcagattcaggtggttctgaaacagcctgctcagactgagatgaaccttgtaagacgtccagcaactcttggaccacatgtaactgaatggaggaagcacatttgtgatctctgccccacttctccccatagacaaaacaaagtcccttggatctcctataagacttgagagctgacaatctatcatattcccttgaatgattgcttaattcagttcctctcctatcatttgaaatgattggaggccctcctttagtggttggtggcagaggcaatggcatagcacctttgactgactgtttctggtatccatcagattttttagattctttggcttatcaccctccaatgcttcttcctgtaaaagagcaagagtacaagcaacattcaaatctccaagtctttgaagcagaatagcagacctaatcgcatgccttagcccctcaacaaatttagtgacaaagtagactggtttcaaagatgggtcataagccatcatttgatgcatgatgcaatcaaactgctctacataatcagctactgatcctgtttgacaaattttaatccattgtctaataagggcttgctgcctatctttgttaaacctagtacaaattttttcacatagttcagaccaagtaaccccttctagttgagacctaactgcttgcagccaaaaggcagcattaccagtgaaattgagtgttgctaccttaacccaattacccggatgtatgccatagacatcaaaataagcctcacaattagacttccacatgattgggttatctccatcaaattttgggcaagtcatgggggctaccccaccagtcataccaactgacaaagcagactgaaacgaattcatggcagaagcatccaaatggaaaggaattggagagacattgtgagacgcatacgtaccattggccgggattggctttggggtaaaaccctcagcctcctcacgattcaaaatttgaacgcggtggccatctagaccggttgagccatttggtcgaacacctggtgagtccagggttcccgctggagttgtttgctctgttttgttggctgaagagctctccagttgatttacttgcatttgcagcagatccacggtggattggagtacatccaccttcttctccacagctgggatccaagattccaccgcctccttgaacaaccgcatctcctacgcctgcctcttctccccttcctcctcttgcgctcagttttctccatcttctttagaaggagatcaagttttgcttcgttctccatgattttagcggactacttcgtcacaaaacgtggtttctccagggcttcagatcttgtctcacctcaccccgaattcggccaactcgagcaaggcaagttaccttttcacggatctacccgagggtaatccaatccttgcccaagaatttcacggccaaatcaagggaaaaagaggattgacgaagctctgataccaagttgtgagcactctactcttcctcacaagaacgaacaagatcacaagtttcatcgatggatcaacaagatcgcatcacctccgccgccttcgccgccgatatattgatctttctcatatgagtttcatcatacagaggagtttgtttatatatctctctcgttcggcaacaacgccagctcacaactgccagctatgcattagctattacatggcccaatccggcccaatgaatctagtatttgggatacggagtcttgcaacccgtttgcgcggcccaccatcttgcggttgctgttgctcgtccgaaacgtcagtagctgggctgctgacatgctcacgtgtaaataccaataatgcaaactcctatcaaatcatggttaattcgcaaaattttatttttactatacctcactctcagaaatcaaatgacacttgtaaaaattaaaccttcggaattcaaatcattaatttttctttcaaaccgaataaaccctaaatttaccgggggaaaataagcccgggcccacgccagccgccacccatacggtgcacgggcagacaacctgcaaccgaccaaccggactcgcacggccgatagatcaacctcgaaccagaccgcgcgcggcaggtctctcgctggcacgtgggccagggaaga

SEQ ID NO: 63449 - DNA, 3878 bp, Oryza sativa
ccacccccacaggtggtcgacggtgaatgaacggtcctaccgcatggatgatgcctcgcgcctggccgcccgcagtaaacgccacacatgctgcgcggtgcctactcccctcccgtaccccgtactcctgatgccaactatgcaccgtcttttgactcggacataacgcatatagtatgttactgtactactgctgctgctgtctcgtggtacaccggtgcgaccgcctccatcctgtagcactagcacaaagagcagtggctacccagggcaacagggtactggactagtggaggagtggggttaatacagtcagcaaaggctgtattaggcccttcttgaccgctcgatgagttgaaaaccgggcacgtaacctgttcacaactgtccatcaggaggcgtgcctgtccctcactagaatcattgttgtagcatgggaagcggtaggatcttatcctcaagaccttgacggcgtgacgaatgcctaatctgatccgactgaagtctggatattcaaatcttgtgagcttcttattgtaacaataggataaacggccaagttgcggtgtggtatagagtacggcatcttaacaaatgctagtcggcgagatcaatgtcagcatgctccaatcaattggcggagatttttgtgggccgtacctttgtgtgagactgaagcaaccaacagaatggactactctgtgttcggataccccttttcccaaccatttttcatcgttttttcacgcgcacgttttttaaacagttaaacggtgtattttttgcaaaaaaattttatacgaaagttgcttaaaaaaattaatctatttttttaaaaaaatagcaaatacttaattaatcacgtgctaatggaccactccgttttccgtgatcactgttcttggtgggaacttgtcctagcgaatacttagggcttgtttagttcccaaacaaaacttttcacactgtcatatcgaatgttaggacacgtgcatagagtattaaatgtagataaaaaacaattgcacagctcgttgggaaattgcgagacgaatcttttaagcctaattgcgtcatggtttgacaatatggtgctacagtaaacatttgctaataacgtattaattaggtttaataaattcgtctcacagtttactgatgaaatttgtaatttattttgttattatactacgcttaatattttaaatatatatcagtaaatctgatgtaacatgcagtggtaaaattttttaccaaataaccaggcccttactaaaactatcaaaggcaaagcaacgacaaaagcaatactaattaggaggtgacacgccaacatctcgtcaaagaaccgagctgtatcaatttttcgcgccatcaacattatggttttcctctgtttatttataagctagcattggcacttttcaagtgctactatactgctatacatggttggataagtatagtacaactagtatatacttttataaataaaagaggaaacatatattcggtcattcgggtgccattgttcttttcaggatatataccatcctagggcaaggccaatgtatgatgtatatacacatattaaggtgggacccatgaatagttagcatttcttatggtatgatgcacaatgtatatggtctttaacatgggtctcactataaaataaaaaaattaagatggctgccaacttctttgagatagtagtagggagagagaggatgtgtaggagaaaaaaatacttgtttattcactatggctagttgtaagcttgagttgcatcataagaatttttttcctattgctaacttacacaatacacaatgtataaggtgtgtctcgagaatatatttattccttaaggttaactttttagcacattttggttgcccttaacacatactccacataagggggacgtaattggcaatatgtacatatggagtgtgggaatcggctgttttgacttgttagctagccgtattaagagtacttaatagcagttggtccatcgcccaagctgatccagttaatcgctaatctctatgctcccctctgataaggatgccatatgtctgacactcgttttctagtacggggtaccaggaaaactctgttcagagtatggtttggaggcacatgggttggccaggttggtctgcggcacccaccagccaaaatcagtagtaccactactcagttcttggatctggagaattttctttactggaagatggtgtgcactgtaacttcagaactccggcatccagcggttacaagtgtaccactgtagtactgtagtgctagtagttctagcgctgctagcatgggggcaactcagccaactgccatgacaactttccactcgaaaagacgaggaaactaacccacatgccaaagcatgcacgtggttcatagagccctaaaacagagtaatcctggtttattttagtggcccctttttgcagcaaaccgacggcctccctcatgcttcttctctatagcttgggcaaagtgtagttaccagtagtagaagtcctctctgtcccgctctctctgtttctgtaacgataatactataaaatggcaggagtcatccgtgatcgatgccacgacttggtttagtccgagccacatgccaaatacaacggtctaatctaggagtagtagtacttagcatcatcagctggaggaatggaaaaattggaccaagacatagtgggtcgggctgcttcaaagtatgcaaccaatcaccaaagtatggcgatcgatatgtatcattatctacacgaaggtcaaaccgttgcacagctcgcgaagttcagaagacatcaagacaacttgcgatcgatatatgtatcggcggcttcgagacgagccgtgcgtgtgtagcgtgcatggacgccgtctgttccaggcagcagctagctagcggatgaggcatggctcccgcgagacggcgagaagacgatctgaccggtggtcgctgtgccaaccacagcgaggctgcggcgcattgccatgccgccatcgtcagaactcagaagttcccttttctaccgtgctatgggatcgagtacccaccagtctgctacacgacatgcgtgcggagccgtggtgtatggagtaggcgctagcatagcaggagcagcatcaggccggtggagacggagacaaacaaatgcttccccacgcaggacggaacgaagcctgtgcgtaccttcattgcccggcaaagaacagaacatccgaagttctcaacatgggatatattgctatcttgcttggtcttcggtggattcgtatcatcgtatgcgctgcaacggcagatcaacaatccatctacacaccgtccaccattgcggtggagatataaacacactgtagaacatttcgggtgaagaaggccaaaagtggtgctaaagctacaataaaattcagtgtgaaatctgaagccatgggaggcccaaaaccccctgtctcagccaatatcgtgcagtccgtttgttcagtttggtgcctgggaagtgggaacagagggaagcagagagtgtgaacgtgaaattcagaatcgggtgaagctgcattctacaatgggcctttaaatttaactggaccaaaggcctcgtgggctttaaattcaaaaggaggcttaagctcggggttaagggcctttaaatttaactggaccaaaggtcgctgttataagctggccttcaaaaggcccactaatcattagttgttgggggaaaaagtgcaccgaaggtccctcaacttgtcatcgaattacaaaatcgtcctccaaccacaaaaccggatacaacgcatcctccaacttacaaaaccagtacaaattaggtccctcggcg

SEQ ID NO: 63450 - DNA, 7464 bp, Oryza sativa
  unsure (1)..(7464): unsure at all n locations
gcacttcaatagtcgccagggcaaccggccggtggggcaggcgggaatccggcggccggcgacaggtgatgaggcggcggcggcgcagcacggcctcccgcgcccgccctccctcgccgccggggaggagctgggcancggcggcggccctatccctgcccggagccgccgccgccgccgaggccgagcggcgcagagtcgtctatggcagtggctcccagcggctgtgggcgcgggggtatgcggcgaaggaggtggtattcggcgtcggagcccgggcctcccttctcaagcgttgcagccgccgccacctcccttctctcgtgtcgtcgccgtcgtccatccatgcatctcccacccccactatctctcgccctctcataaccctctcctaacccgagccgccgtcgccgcagccgcacgtcgtctcctccgctcgcgagctcctcttccagccggcgagagatcggagcacgtgggggcgcggccatgatgttggagacgaacaacctgctgctgtccctcgtcaggagatcttcaccgcctgcgccgtcacaccgccactgacttcctccggcgagcccaccggaggcagctcaccgtgttcctccgtcggcaacggtggtggcggcgtggggggaggccctcctgctcccatatcgttgccgccgccatctcgtcgcccgtcgctggccgccggagtcccacctcccgcctcccccactggcctcctcttcatccgatggttgccttgcccgatgagagaaaagaagaggagagaaaaaagaaaaagagggtaggggaataagaggtntgcatgtgggacacatgtgggtcccacgttgagtcagctgccacgtcggacaaaaccggagtcaaaaccgccgagggacttagtttgcactggttttgtaggttaggggacgcgttgtatccggttttatggtttaaggacgattttgtaattcgatgacaagttgagggaccttcggtgtactttttccttgttggggagagatgtgtctaagacgggaggaagaaatctactggaccgggccaaattgacagatactcaatggaatattggttgtctgtatacattcgaaaaacttacctccctcgacaatggaccgaatctaattctactgtaaaaacaggtatatattgtctccttcaactatcaaaatcagctcactttatctttacgagtggtttttatttgacgtagcacttgacttggtcttctaacatggtgctctaacatggtgcttaattagcaattcaaccggaaaaaacccatagggtccagtggtccacatatcgataatattgttgccatctcacacctctatttgctctcttccctctcaatagtggagggatctacagtggtaggcctccttggatcgtgatagtagcaacactagcatgaactcgaggaagagtagggggttatttgtggagtgcagagcaggccacacttcgtcgggtggagcaagcagcaagcgacgagcgatgagacggcgtggaggttggcccctatctcggcttccttctcaactccaaccattagaccctaccaccaagatagccttcatagctccatagatggagggtattcgagaacaatgaaggagaagacgttagcgatggtttcgggcttgcctagcgcgaggatgatgcggcaaagtagggcttcgtgggtttaccagctgtcaccaatgacttgtgctgttgccggcactagcacgttggtgagaaaaacagactcccgtcgaggtggtcgagcctgagctccaacacatccccaagccttgttgtctgcatggagccatcacaatcaccgtctcctacgacctcgggtcttttaaggagaaagggataagatggcaataatgtttttttttactgatatacgagtctcttttaattttgtcatggctaaattacttggcagatgaatcgaatcaatgtggcacgtcaaacaaaactatggactatgatttgacgtaagcatcatgtagcacataacatcttcaaaatcacttgtggtaaaatgagatgattttggtagctgaaaggctatatacatagttttgtcagcccatagttaagggaggtaaaatggacttttcttcatatccgttttattgctgcggcagtgcgggattacggaatggggtttgatgggagttgcgtcataatcatgaacttatcaatggcttaaaccgatttaaaattgtcgtaaaacatgggagcaccgagcacatccttctctcctgctttccatgatatttgaccgccacaaacaaattacaggcgatctaaaccgtccgttcaacctccaatacggatggcccgacgcgaccgacgccccacggcccacggcaccttctcgaccctgacgcgtggaccctctaggctactactactcatcaccgcgggccccgcgaaccagccccacacgacggacgccaccacgctcgcggtggactcggtccaccaagaccgcaggcacaggcgccggcggcgcacacaacaccggaccggagcaccggaggcgggatcaaggtgaaaggccacttgtttgtgtggactgtggactgtggtctgtacctccacggctccacctcactcgtcgcagctcgagagttcgcccaagtctccccccgatccgtgcagagatcctcgtgcgtccgaggtaagcacacccccccccacccccaactcccagttcctaagccctcgtagattcgccattccaactcagttttcgcgcacgaaatgttcgtcttctttcttcgtcctaggtgagctttattgcagattcgccggttcagtttcgtttgcggctagaaatgttcgtgttctggggcagtaggatgggtgtcgggtgcttgatccgtggttcatgaggagggttttggagtgtgagaagatccgagacaccgcactgaattactgatcccattctgtgcgtgtgagcgagggagagggagggagggagactgggagaggaggggttagttttaatgtagccgttgaatgattgtgcctgatttgttaggtgagcatggaggtgatgcatgataccactgggaagaaggaagtggttgtctgttatatgaacgcccctctaccgtacatgattgaagagaattacgggggatgcttctttgaagacgacgttgatcttgcacaggttctccaggaccaggttgggtgcgaccgcctgctaccttcttgtttgattgttcctatgctactgatttgtttcttgttttgttcctgttctccttgttgcatagaaatcttaacatcatgtgttccaccccatggaaaattgtgtgtttggacaacacaatgtacaatgttatggaaatgcagccaaacacttcatggattaggttgttaatttgtcttttgttttgttgtagtattattgaaagtagacctgaaaggtgaaacatctttggctctcgtggtgccataataatgtgtaaagaatagcctcttgatgacatttacattgtaaaacttctagctcatccctcattgttacatggtgctaattaccattatcacaaaatattttgtacagtactagttatttgtcgaaggtttttcagtaggattgtgatgtttctcttttatagtacaactgcacaagtcaacagtgcatgatacatatgaaaaatatgatcctcatttgcttgatatgcttgcaccttgttcaggaaatagtctatcaattaatacaaggaaattatggtactggttcatccaaaactcattcaaatcctagttctagttatagccatggatgtgaattgggtgaacggaaaccatcaggagttgcaagttatgaagcgcaactagttgttgatgaagctttagctcgagagctgcaacagatggaggaccaactagcaagtgcatcaattgatgaccataacataatagaacatggttagttgtttactggtactcttctatatagtacaggacaactggtgagtgtctttcctctcgtaaatgctaatacgtggttcaaaaatatctgttcaggaagaaagccaatagcttcttcaacatctagcggtggtaatgcttctgcaagcagacctcctcaggtagtgatggaggatggcattgatccagataacatgacttacgaggtgaattccttcaaaccattgttttgccagtattttctctactgtttcgtaaggggacgtgccattgtcaactggtcttctactccatgaactttcatttcaaagtacctgtatagtctatggtaactactgttgtgtcatagaaaattcaagtatacaaaaattggacgtctccattttacacacattgctctaaccatgtttactatataaaaattgtaaagttgttctttaacagcttattgcttttaacaaatgcaaataaatgggataattgaagctattttcttttattttgttgaattttgtttgtatttcaggaactgcaacaattaggggaagctataggtactgaaagcaaagggttgccggaagatgtgatagcgctcttgcctacttcaacatacaaaattaggatattctcaagaaaggaaaagcatgacgagtatgtccctgtcctgattagatatttcagtgaaaatgtgatgtgcagttatcaacaggttattaataaacattttctatgcaacactctcatttacttattattattgtagaaggatatttggttagtacttttctgatcttaagttgcatccttcatcattgtgctagcaaaggaagctcctagagtactcgttatctatggctgcatgttcatgttgagttatattgcttgagtatgaaagtatttttaatacccacttctttgaatgtttacaaaaacagatgtgtgatatgctgtatgacttacaagaaccgagataggctgactaaattgccctgtgagcatcagtaccatcaaacttgtgtcaccaaatggttgaagatcaacaaggtaggccaaccatgcttttcaatctttccaatgtttagtagtgataagtgtatatgtgtatttattgtagttaccgtgaatatgaccttgattactttgctcaccgtaaaattgttctgcttttcgaaattccatcttattacctggtcaggctagatttaggctgagttcaaatctacgggtttgtcacccgtcctccctagcatgcaaaatggagcggcggattagtgcatgatcaattaagtattagccaaaaaaacttgaaaaatggattatgaattttaagcaactttcctatagttcttttttttttgcaaagaacacactgttaagtagttcgggaagcatgcgcgtggaaaatgagggagtatagaagttgcaagaagggagtatagaacacacccttagatagaatgacaatagtaatgtactgacaagaagacttaaataggtaatgagatgggtaagttatgaggaaagctacccaagaaaagagcttgtaatctcgtgtgttcatagatttacaaaatttttgagaccatgtttgcatccagaatgtattgatactgatcagccttgtgacacatttgtcaggtatgccctgtttgcaacaaggaggtttatgggtcgggcaagtgaaacattacggattcatctttcatgaaaaaggaggcaaacatgacggattcatctcacgccagttcaacaggcttaagaagtatcattgttcactggctgtgcactcattagcatgcatcatggtggcaggaaaggcaatgcattgtattgctaatgatcggaagattgtcagcgagttaccgaggaatgtctcagcaagataaataagatagatgcttctgttctgtttttaagctttatggagtcttcgagtaactgagactcttatttcagctttcaggcctggtgctttacacacactgtattgtaacatatcataggatgtatatcagtatgtgtatactgaagattagttgcatgctagcatctctgtattgcttgtactcttatcttttatggtatcaaatttggctgctggagtcagacttgtatggtcttcttgatgaatggtcaatggtcaattccctgacttctgagccaaccagctggaactatggactgctatcgtctagccagagagtgtttggtcttgtttccaagtggccaatctatgcttggataattctttataatggaacattggactattctacatccattaacgaaatataaccttctaaacaggactaaatgatgttggcataaaggctttgtacaagggaagcagcttatgaagagacaaatttgtgggagcttctgaaatgagcatgaaaatgacaaattcgacgggaacaaggacacaaaatggcaaaagtcgccatgaaactgcatgcgtggtgctcgtcagagcggaaattcgacgcacacaacggcacaaacgcgataggatatcgttaaaccccaaaacttgaccatcacaggtggcgcgtcgaagtactcgtttgaccagacaactacacaagttcatctggattagctttgtttattaaagtgtaaatttcacttcgggccatcttttattaccgatgtttcgttttgtaccaccctttaagcaatattttcattttggactgggtaaacctgcctttgtttcactttggaccacccgactctcttctcaagcatataaacgatctcgattacatcgtcccctactcgtcaatgaactgccacagctatatgtaagactatttcttcgacatattataagttggatgtagatggataaaaaagtaagggtggtccaaagtgaaataaaggtaaaaatacccagttcaaagtgaaaacattagtcctaagatggtacaaagtgaaacatcgataataaaaggtggccaaagtaaaattaactctttattaaaccaatcctgacgctgctctgcccgaactgtcacgcccactgctggtttcagataggaatcctatcctgacgacgaagcttgtcattttccagacatcccctcgaatcatagcatataagcacatcataatcaattcatcaaactcgacagggatttgtagttgtttagaagggatttgagaggattttattagggtctgaaaagcaattgtttcggaatgagaagtacttaaccgacgaagtgagcagtactagtggactactaggcgtagtgtctacgaagtggataggtttgcaatgggctgggccccaagctaggttgctgactcggatccacgcccatgggccccgatggaaaatgtttcatattgctaggcccaaatcgcacgggggcccaaaggttagcgcagcctggtcccggctgattagacaccggcacatgggccccaagtagttaatcattgatgtgagattttctggttgttaagaggaaaatccggagagaagag

SEQ ID NO: 63451 - DNA, 7210 bp, Oryza sativa
tatccgtgggagaaaaataaaagaaaggggtacacaagtctgcatgcaccaaacattttgatggcaacttggcaaccggtggaaacttggcagaatgccgccaattgtggccggcatgatgatacttcacgcgtgtacgttgctcggtgctccaaaccttatcggttcccacggcgaagaatgcccgtagtctcgtcatacactcgtactcccgcggagataaacactctctgtagttagctgaatattttgtgccatgtgtcgccacaaccctgaatcctgatttgataaagatgacaagaaaacgatacaatctccctgtgctgatgctgcgctgcatggatcgaaaagggcaacctctctgtactgatagggatcgatacggcatcgatccagccgaagatatttagcacctccatttcgcgcaattatcagtgacaaccgacaactctattgattatatttttcttttccaaggaaatcttagggtgtgtttgaggagaaggggattgaaggattgggtagatacgtaaaacgagatgagctattagctcacgattaattaagtattaactattttaaattttaaaaataaattaatatgattttttaaagcaacttttctatagaatttttttttaaaaaacaccatttagtagtttaaaaaatgtgtacgcggaaaacgaaacaaacaaactcactctctaccctctcgaacgctgccttagtatctttgccctttctgaccacaaaagggagggtgctttagtgcgagtagaaaactgcagttcatgcaggtgaagatgacgacgtggatatcttcatctttctcgatcggttgttgctttcggagtttcagtacttgtccatcgatgtttcttacccgttttctcatccttcgatgatagttcaatcttcaaccgatatagtagtatatctgatctaatctactccaaaagggctgaatacttatctgatctaccggcagagcacgcgattatttacgttgggaaggagttttccaagaaagagaacaatttaacgatcagagcacattagtcattagacattttcaagctgtcaaacatggtgcggtggtcagtgtagccagtataaaatggacatgaaaactttgtttttttttttttgcgttacatgaagatttttatctctcctaatgcattgcgcattagcagccaactgggaatatttcatatgaaaaaaacacctgtcagaatcacataaggacacgaaatatatactgcaccaccgaaactgattgcattgctacacacctaacctgaaagacctgttccccaactccaggcacattcagaaggctttcataaagaagaaatagaaaacaaattaccgtaaatccaatctgaatcacaggcggtatctaaacagtagcacttacagaacaatatcaaacttgaccttaacttattttgtctgaaactagcaacccaaaaggcgcatatattttacacagtcatcaccaggtcagcaaacagaacctcctagtagctcttatgtcttcaggcttccgctataacttgagaagactggccctccaaagccttctcttttctcctccaattcgacaaatttgacgctattccgcattttattcagatccattccccctcgttcgcagctttccgcgtgaaggtacgagcattttagagcaggtcagggatttttttttattttttttacgcttgatttgatgcctaaaatggccaagaatctgggccttgattcggagacgagtttctgattaattcgaattggctgctccggataaggtgaccggttgtttagctccggaagtccggatgaagtattcctcgctgcaaatcggttgaattgaagcggaattagcggttgtccaaccgctaacgcccggacagagaagaaaaggtatccgcttgggaaggctaatccggaagcaatcgcggcgatccgtcgtcgttgaatcgcttcgagagttttggcatttcttcagcgtggcatgggggcgggggcgtcgagcatgatgggaccggaggggtacggccggggatgggggcagacgtcgctgggcgacatgccggagagctgcgtcgcggcggtgctgctctacctcgacccgccggagatctgcaaggtcgcccgcctcaaccgggcgttccggggcgccgcatccgcggactgcgtctgggcggccaagctccccgccaactaccggtacctcgccgccctcgccgccgctgccgacgacgacagcggcggcgacggcgccacggaggggaatggcagtcgctgctcctccgcagccatgatcaagaaggagatatacgcacgcctgtgccggcccaccccattcgatgggggcaccaaggtaagctaatttatcctctgtaataatgactctcattgagaactgagtttagcacctgccttatatcctgtgctttctgctcttgttgttggcaatacatctatgttcttatttaggttgaagagaggacatcgaggttcttattgataggaataatagcattccttatgtggaagagagggacatcgagtagaaagtagatttgattgtgaattaacaattagtaattgttgagtgagatttgttactttatggtgatattagaattaggatgacttgattgttgagaatctcaaacatcttatttgatatatcggagcgctagtaggatagatcggagcactagtagtaaaatatgaaataatcatatggaagttgaggaattttttttcatgtgtatttggtttgccttgcttgtctatgttggatgatgcttgttcttgcttttcttgtatgtcgtgtttcaatgatctaattgaaaaatatatttgtgtgtaggaattttggatggagaagaacaagggtggtctttgcatatccatttcctcaaaggctatggcaatcacaggcatagatgataggagatattggagtcacctctccacagaggagtccaggtacttccctcatggcttaaaacctcggtgtgaagttcctttagaagttaagattaaattccatgaaactattagtttcgagacctattcaagttttggttttcataggatatttgactagaaagaatgggaataatatcgaatacctctcactgcatggtttattttcctaaatatcctactgtatggaggtcagaaaatttcacttagctctggatacgtgcttattggtgtattggaaactctcgataattatgactctcaccatgctctctttaacttagtgtcaactgctctttatctttgttatcatggccataaatttatttcccctttgtcggaaaatctttcttatgctgatacatgctttcatctcgcacctgtccaacaagagaactcctcttctttttctcaattcaaaaagagcttgttttccataaggtccatcaaagtaataagtacaaacaaactgagaaggctaatctgttagcaagcttattgtctaaactgctagtaacaccctgtgccggttcattcaaaaaacaagaaaaaaaaaagaaactgaactgctagtaacagctcacatctttgctagctattccgcttgagggtatgcttggcatgtgttggtgcttggcaaggtgctagggtccaatagctgaaaactggagccttattttctgtaggcagtgtactctaccaaatatacagagctcgtgcgtacataaggccccaaatggcgcatgattcatttttgttgatcaatcgtgctgatatatgtcatcctttgggtcatttctgttgtagaaaattcatgttgtacaaaatcatctagcagttccgtactaccattgtctccagtccgataatttctgatgcaaattgtatcttcaaaatttaggtccttctatttcattcatcacctatacggtttgatgccaaatgatttctttgataattttgcatagttagtcctctcagatacctccactgggtatatctttttagtcttcactgatgttgccaaataacaagtgactaaaccaatatatttttcaccatacagattccaccatgtcgcgtatcttcagcaaatatggtggcttgaggtggctggggaaattgatttctgcttccctgctggttcatacagtcttttctttcggctccagttgggccgaccgcacaagtacatgggccgccgagtctatggctatgagtcaatccacggctggaacattaaaccgacaaggtttcagctttcaacttcagatgatcagcaagctacgtcgcaatattatctgaatgagccaggaaactggatcctttaccatgtcggggactttgtcgtatcaagttcagatcagttaaccaaccttaagttctccatgatgcagattgattgtacccatacaaaaggcggtctatgcgttgattctgtttttatatatcccaagggtcatcgacatgaggactgcacaatctgcaagtaaattttggaaagccactggatcccgttctcctttttccaggtcattcctgtccaaaagctcaatgtatatatccaaacttcccacagaaaaaatttttgtatgggcgtgaagtcttgatcgatattctttgtagtgttagctaaatcagcaggaagattatagatgtaggtagtgagttaggcatgagtgcttctgtgcttggagttttatctgtagaaagagcagttccatttgttcatcatttgtgtagtgatgtttaggtgataaagtctttcgccgatgttttttgagatttgtacaatttccccctttcttgtacagattatgtcgtatttttacttgtaaataatatgtcagattaaaatgtttatagtttgttctactacttattctacttaactgtgtcttggtggataatttgaggctttgaactgaacatactggtttgctggaatattttattagggggaaagaaggtaagagaaaacaaggacattagttcactttagtctctcaatttatcatcaagtctgaaattcatccatcaactgaaataccaggtataacttatcccctaattcacaatacaatgtcaactttgatccctcgaaagttggtactatagtagccggttttggctgatgtggtgagtggggcccacgtgggccccatatgtttgcgggtaaccgttgtctgcgtcattgtcctcctaccttgcagcatcatcatcacctctctttgggtagatgcgccatcagatttgttggcatctacataagatgatgtggcgtcggacctgcgtgatggtctttcccataaatatgaggtcgcggttacggcctgcgtgtacggggagtcaaggggaaaaccacggctttggttgatggactctgacgatgacgacaacggctctggtggggggccaacggctgtagtgccgcagagtttccaccaccactccataagcgcccgatacaagcttaggatttggcgtcggcaatcctcttggcgatcttgcggaggcagtagttggagctatcatggaatgggttcgacgagttgatgcacttcggccacgatatcccccccccctccccgccgccgccattgtgccctgtgctcaggcttcgagattcggtggaaccctaaaagaaaaggattagcttcgcgtgcgattagggattgagaagctacggtgatggcaatggcgacgatggcaaggtgatgtggtgggcttttccctccttcgcgagctcttcgtgccgggccaccatggccctttcctcgctggccaccccgctccacgcttgagaatatgagagatgggaaagagagggaagaggatggagaagagttggctgctgacacgtgggcacatgtggttcccacaaaccacgtcagccaaaaccgtccattatattgtcgagggaccaaagttgagacggtgttgtgagttgggagatgagctatacctgatatttctgtttagggatgagtttcagacttggtgagtggtgacaacttgagagacctaaagtgaacttattcagaaaacaatagaaaagcgtttcaagaggaaccctatgggcctttgggtgctgggctatgctcagttgggatctagcgggccaactcttgcgtcggaggagtcttgttcactaagaagtgtaatgggcctagcggctctgggtttccaagcttagagttgttgtcgaacacaaaagttgcgcgtagtttttgcttttctacactctaatccttttcttgtctaaataaaagaataaactttgaataatctggcccctttacctcttggacgtatatatagcacatcaagctgcaaacctaaccgttctacaagagattatgctatgcgctttataagtgcgtaagattatcaggttgacaaggccattgaagctgggaaagcgaaagcaaggctcgttagtggtaactcgatcagcacaaggaaattaaagacaagtatggaagcatctcagtggccaaaacaaccttagatgcagtagttttctggcaagcaaagctagctttacactgacgcgggatttacgtggtcgacggcatcgcgctcgtgttgtcgtggggaaacgggaactcgccgagattaccgggccatcagaacgtgcggcaataataatcagacttcgtcttccgcctgatagagtaggactcgtttgtcctggagcggcacacttttctttttctttttgccaagctagctagtgctgcctcctcttgtgcaatgcctttttacaccgggtgccagatgggaacgtacgtgaccatgggacacgactggtagtagctagctacctgtatcattaggagggaggagtagttgttacccaccgagctagctagggagaggagggcgaacctgctcgctctcagtgctgagctcaatcagcaaccgtgttttgactgaactggtatgcaccttgaatgcatttttggcggcaatgatgcatggcagtgcgatgatggctttgctgtgttgaagtcgttggaacactatgatggggtgccctggcacagggcatgccatgccaatgccattgccaggggcagggggctgatactgatatactgggctggctggctggctggctctgacggccccggcgcctccctgtctctggccggcctcacgagcggtggacgttaaatcgccccctgcctctgccttccctcta

SEQ ID NO: 63452 - DNA, 1084 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaac

SEQ ID NO: 63453 - DNA, 4333 bp, Oryza sativa
acctatattcttctgtgaagtgttgatcagaaatctgcttgtatatgctgaaccatgtaaccctctgctctcttacctggtcaagtagccagttcctgtcttaaaaaaaaaggcctgtcccatttgcaagttaagactaaaaaaaaaatcagcatgtcccatcagcaagttaagactcaaagacagatcacttgaagaatgaatcatttcactagctcaatgaattcttgtgataaatatgcgtgaaagatgaaacatatatactccctccgtccctaaaaaaccaaccaacttctggtggacgtagacagccataacttggttttttttaagggatggagggagtacttgacaattaaattgtataaggatttaacgcaatcccttatgcgacttgcaataatagttgatcttgcgggatgataaatggatgcagcaaccagcgatagagcaaactgaacaaccattttcacaatacatacattctataacatcaatcagaagtatgcagggagagccacaaaatgtcaagaattacaccacacttctatgcacctaactcatcgctgaagaacaaaaatagatttcagaaaagaaagaccaccttgattaatctattttcttgctaacctgataggtactgaacacccgtcacccatccccaaaagctcaaaatcaggggactgagattgtaaaggaagtgttcaaaacacgggtagaaattgaattataactaagttaatggtagcttccaaaatgttttagtagccacaagaattttctctgtaccacctgattcaggctcactgtcatgcacctgaacagtccaccgaatcgactgagcaacctgcgctgccttgtcaatcacatctggggagtctcgtacaacagcaattccttctggacgcagaatgcgatccatctccaacatgacatcaaacaggtcacatctaagaaagaaatggaatcaggtagagctctttttacagttaagtcggcatatggtacacgtcccatcaaaacaaagataaaggtcagtaaacgtgttgcatactgtattgtgtgggactggggagcgacaaatttacttttagaaactttcaatcctctaaacgatattaatagttaaaaactcctgcataattcaactactaattcatttacatgataaatcataaaatgtgctaagaacaggcaataagggctgatggagatatatactgcttgggccgaacatcttaaattggtgatgataattttaacatgatgtttcttggttatcattctactctgacttttcagcaatgaattagaccactccaaaagatgtagggagaacagaacaagttaagaatacaagatcatgagacaatgatagctaagtttatgggtggtgtacctgctcttgccagaaattgggtctcttatcaaagagttgattctatcagcatgaatgagatcataggtacgaggataagttgagaaaggctcacacctggaaccaaaggcatatcataataattatattaatcagcatgcaagcattaaactattaatctattccatgaacaaatcctcaatatattgattcgacagacgaatacatgtttcttggggaaaaggtcttgaaaatttatggatagtgcaacaataaatattgcaggaaagtaccataaaagccacagaatgcatgagatctattaagatatacaaatatccaatatatccaatgaatatcaatactactcaaaactcaaacaaacagttcattgtgagtggtagaacaggtctgagcatatgtaaattgcctgatatctttggtatttaacttacaaacaaaaatgaatttgaaagaagttgcaaaataactacaatcaataagctgcaaaggagtatgaacatgctctttttaaaaaaaaaatagatgaacatagtagtttatattgagaaaagttgggattacaataaaacatatcagcagaaagatattgcaaatttctgtaatagtaagtccttaccagtcatgataaactccaataaggcccctgtcatatattactccaagtgtcaatggtttttgagcaggaacaacattcataacccatacaggatcagagacagcagcagctgccaatcctccaaggtatgcattcatgtccatcacattacgaattttggcagtcccaagcttcacgcccagtgatttcttataaaatgatacccttttgacccacttctgagtatctagttcaaacaagtttgctccgttgtccattagagaggctctagcagaaggtttggataacctatctggccacttcagaatggaaccaacagctatttcatctgccaaagaaactttactgacacatttcttcaacttgaaatacctgcatggtaaaccatacaagcaaacatatgaaaaatgtacaagagactttctcgtatgcttttttttttaaaaaaagtacatatatttgtaggcacaacaaatataattggcgcagacaagtattaccatgcttgatctggatcatcatcagtgctacacaagtcaatgttaaatccattttggttaggtagacatgaagcttcagtaggtttcttccaaattgcagtgttaccatctacagtgatcaacttgtaacaaaaagccagtgccatttcttgaagttcagcccattctttctcttgcttcttccactggactgggggtcctgatataatcaagtaacctcctggcctaagtagacggtcgacttcaatcaaatagctcccatctgccagtatatacaggtaagagacagcatttccacgaaccatatcaaacactgaagaaatggtttacttactgtaggccataaaaggtatcaaacaccgggagcaatgaacgaaatcaaaagactgtgcaggaaatggaaggcgcctcgtgcccagcatcaaaagaaatgcaggaattcctctctccagagcaaattgtatttgagatttatgtgaatctcttggggcaaaagagagtgtcaagatattctctttaagcaaaaacccaccaaaactagccaccttcagagaggaaagatcttaataccataccatttctttaaaagtaaaacataaattgattcatgtgaagatttagcttattaccccacatcccatatcaagacccgtcctcaggagaccactttttagcggaacatactgggcaagcttttcaatatattgttcagctccatcgggaaacatagttccgcctccaggaaaaataaagtatgagccttcctgcttcatccacccctgatgaccttttctttctgcaatcttaccataaggcatattatcatgccatatctgcatagagaataattaaatgaaataagtctccaactctccatagaaagttggaacgattagtctacatcctgttgagacatgcaatcagaacaaaattactcttcatttaatttataccatccagtccaattacgcattattagtgggtaaggtcaatctaaattttccaggggctagacatgaaactttgaagcaattgatctgatggaccaaatgccaacattttctgcttgccaaaaattacttctaagcaaacgaaacacaactaaccaacacctgttgtacaaatgtagtgacctatacatcattcagtaaactccacaagttgcaatcgtgtatctgcaaacccatatggaacatgcatataatcagaaagccacgtgcatctaaccattgacagcataagatgcagaagccggtcatacactagcaccaagctgcaattccataaccaacagaagcaaccataagcacacctaaccgcacacggatcagatcaaattaccccctcacgcttctccaaaatacatggaaaccgagtcagtaagcttagaccacagtaggcagtcacttcaggtgctatttttctactatggcttagtggaagcaagcgccaatgcggcaatgcctacagcacacgcaccttgtggaggctctcgggccagggcactgggacgcggtagccccgcggaggcgggacgaggcacacgggcgcctcgccgcgcgcggggcagtggcgctcgcggtagtagttcatctcgcggctgaggcgggagctgcggcggggatcctcgcaggggaggaggtccacctccgaggctgcgcatggtggcaccgtcgcgccggcgagtgcggaggaggatgcggagaggggctcgccgcggcgcggcgtgaagacgagcgcgaggaagatgaccacggcgaggaggaacaccgcccagacggcgtcgaggaacgaccactgccactgcccgccgcc

SEQ ID NO: 63454 - DNA, 34109 bp, Oryza sativa
gccattgaggttgttttgattcgatttcgagtgttttttgtgctttgcgtattttctccattcggtgatttcacgggaggttggcccgtgagatctgtaactgcagagatggcattgggcaaactttacaggttctccttttctttcattagtttatcaaaaccatcatacaaattttagtcatttcggatttttgtactttttcaataaaatctcagggttttgaatcacaaaattctttaaatacacagaaacaggataaaaaaatagattgtctcaaccgatattacatgatttcaacatagattagcactagagataatgttttggatggttcgatggaatcgaaacatacaattttgtatactatataggagttagaggaagaaaaattaacttgctaaataaaagtaacggttttgctatcctatatttacccccttttttaaaggtgggagggaggggggatcacctatagtgataagattcatgtcaggtttctcctcctatagatgtggtgatcgaaaacggtccaactagtaagggtataaggtttggcattggggtcaatatcggagggggtgagaatagaaaagaggggagatgtttgcgggttgagaaggattgttgtggaaagcagtagcctggtacgcgggatgcgatgcagctgtgacattgctgaagccatagagatcaatagctatgcaacgagttgttgttggcaacaggagtcataggttcctaatgagttaggaagtgcacgtgaaaacaacgagacagggcactcgttactatcctgcttagggtggagaatggttgggggcgagaggcaagcatgtgagccagcgcacgccgttgggaggatgaagagggaggaaaaataatagggttaccgatcacgcacaaaatttatcgtgatttcgaccattcaaaaaataacgagatgatggtggagtttttatcaaatgtggatatgcaatttcaaaaataaaagaagatgtattagtgatgtctaccctttgagtaaaatatacgctaatcatctagtacatgttttaatgtgatcaagcggagtatatatctctactacttaaaaataagaggtgcttccatcgtccgtaaaaaaaaccgagaaaaaaaccgggtcaaaaaagaaaaaaactaaattggtccgatccaaaaaccgggtgaaaaaaccgaaaaagaaaagaaaaaccaaatgtaaaaaaaacggggcaaaaaaagaaaaataaacaaaatctgtccgatcaaaaaaccagaagaaaaaataaaaaagagtccaactcccgtcaaaacaaaataaatagcgaaaatatataaaaaaaaagtcgactccttctcagaaaaaaaagtccgactctagatccgattcccccttaaaaatagaaaacaaaacacaccacttctcttggtctcggtttgagtccagattccagggagactcctgtcagtttcaatctataccgtgatattccatacatcttggcgaaaaaaaattgatgtgccgggttaaagatctgtttgcaaaaacggaacctaccagtcgagagcattccatttttatatgattttaatttttgggtttgtacttctctatttgagtccctgtaatttttatatttacatttgagtccctgtaatttttatatttacatttgagtccctataatcttgcaataagatactataatcttgcaataagatatatgaggtcgttttttagaaaaaataataaaagggagagaacaagggcataaaggtgcataaaaagaaaaaagaaaaacttcaaaaaaagaaaaaaaaaggaaaaaaaaagaaaaacaacaacaataaaattttgtttcccctaagtggcaaaaaaaaccgtagatccgattcctttaaaaacggaaaaataaagtttgattcctgtacaggcgaaaaaaaatctgaaaaaacatctaaaaaagttttgtccgattccctaagaaagtggcgaaaaaattggttcgtacaaaataaaaaatgcatgcgagaaaaaagggaaagggtgaaacaaattccgatttctaatcagtatatatctcttctctatctctaatctaatctaactatttaaaaagagaaaatgcacgagaaaaataaaaacagttcaaaaaaaatgcgtgagaaaaagcacagacgatgctaaaaaggttttccatcttcaataaaaaaacgtgtgagaaatattatttccatcgtcggtaattttttaaaaaaaaacatgcaaggaaaaaactgtaagaaaaaatgcgccatttctaaaaaatgatttgaaaaaaccgcgcaagaaaaaaacaccgtctattaaaaaacaaatcgctttgaaaaaactgtcagaaaaaaagctaaattgatggatgcttgagtcggataagatacatcgattttttgccatctattacacggcttttatttcgtcatatattgtcctgtattggaaaaaaaaagcaaaaaatgaacattaaaaaacaagcaaaaaacgcgtgagaaaaaaaaagcaaaaaagagagaaaaatatgagaatagaaaagcaaaaaagagagaaaaatatggttttcgtcgtcagtaaaaaaaataaaaaaaatatgctaggaagaaactgttagaaagaacattgccatttctgaaaaatggtttgagaaaatcacacaacaaaaaatacaccgtttataaaaaaacaagccgctcattaaaatacaaacattatctttgacatgattatacatgaaaaacgtatattattattagaatttattcacccgttgcaacgcacgggcatttttgctattataataaaagaaacgccaaataatcgttgtggttcgtagtcggtccatatatgctcagtgaggcccatatatcctatttctggcccagcttgactacgtgactgggcattacaactgccacatgggccctcggcccttcgtcccgtcgaattcataacgctaaaggcccattaaccacctgttttctctcgctcctcttccctagaaaaacacatgcgtgcactggtgcacacagggcgacttctgcatgttgtacgcacgttatgttgaccgagtaagacataggtcaaccgtattgactggagtagtataggagtagtagaattattgccacgagtaccccatgtagaacgaatcttgtgtttgactagtgccacatgtatgtctgacatctccatgactccatccacactcgcgttgaccgcctagccgtgttccgtgtgacaacatttagttttgctgggaccagattatggcaataatggagacatggagtacattctgttgtggatgccgcgatgctgaatcacttgtgtcagcccgaaaacttgtttatgacgaacacccctgagataaaaggagtaaaaaggactaccatttggtctggatagtacagtaatgcactattgccgtgtactacaccaactcgttttacatgataaatcggcagaaagctgtccggcattgtcctaccaagtcccaggcaaagtgtggacgagtagaccttcaagcttcagcaccgtattctagtcacggccatcacgtgacattgtgaacgctttgaatagccacccgtaatactactactcaaggtaatacgatcactagtatactgcaaattgtgccaacgacaactgtcgtcgacacatgcatcgaatagtttagaacctgttttgtaccatgaattttacagatctcttctggcgattaaaaaaaaaagggctgttgcttgcgaagtccgcatgcgagacgacaaggaggactcgaacgaggattttgaagtaaaaagggtgtaagttaactgtctcatcttttcgcttatacttatacttatttaataaaatttaaatctttaactttaaatttaatgttaactagcatggtggcaaacacagtttgcgcggctagcatcattatattttctctcatctaataacatatatgttttctcattatattattcaaatatattaaaatgacaacataattttaaattttgcgataactttacaaaactactaatgtgtaatattcatattgtattttatatacgtgttagttattaattttttttaatatcaaattttagttatttgtaaattaaatatattcctatataactatagactcgtcttttaatattttttttaattccaaattttttgtaaattgtatttctatatagactctatgctcttgttccaatattatttatttttatttcttaatttttattatttctaattgtatttctatgtggactctaaactcatctttcaatattctttaatttttaatttcgaatttcagttacttctaaattgtatttctatattgacttaaaactcttcttcctatgattttcttaattttaaattttagttatttgtaaattgtatttttatacggactctaaactatacttttaattttattatgtttattccaaattttagttagttttaaattcctatatggactatatactctactttccttattttttaattccgaatttttatattttttaattgtatttctacacggactctatactctacttctaatattccttatttttaatttcgaatttctattatttcctaattgtatttctatatggactctatactctaattctaatattccttatttttaattccgaatttcagttatttcctaattgtatttctatatggactctatactctacttctaatattccttatttttaatttcgaatttcagttatttcctaattgtatttctatatggactctatactctacttctaatattccttatttttaattccgaatttcagttatttctaaattgtatttctatatggactctagtctcgtcttttaatattccttatttttaattccgaatttcagctatttctaaattgtatttctatatggactctagtctcctcttctaatattccttattttttaattccgaatttcaactatttctaaattgtatttctatatggactctgtattttctttttctttgattaatgtgagaatttctaggccatgagagcgaacgtggaggctcctttttctattcctttaataatataatagctttttagggttttttccatcaaagggcttgttcagattgatgccatttcaaaccatatcatttttggcaaagttatcaaatatgtgtatccatttagtttcttaccaaactcgataaataaatatgaaatcctgctaaaacttggtaatattgtcaaattgtccaaattttagtattaccaatatttagtaaaatttattttggatacaatctgaacataaccaaagtttatttttcagactttgcttttacatggctaagaacatgtatataaaaattttatttttattttccgtttgtaaatatagtttagcttattcccgtgataagccaagcaacggggccgtagatgaacttaccctcgccacatcaaatcaaaccatggaaatattggcatcttgaggctgccggctactgtagatggtcgacaagtcaattccatcacgttaggattccctcgccgtaccacctgggatttatatatatacgtcgtcgtacgtagcacatgtcaataggataagataaaaaggcggttactagcatgtcctacaaactgttgacgtacacgtactggtactacccttcctcctccgtacaaaatccatccatctgccctggtagatggattaggctatgtgggtgggtgccgtcgcttcctactctagtcaggtgttagctagagccagccgatcatgtgccgggtgtacgtgctagaccgcccggccccctcgcggcctacgtgccgtgccgccctgggcggcgccgagcggccacagttctcttccgcgtcgctttccgctggtgcattgcatccacgatcgccactcgcttcgcccgtggacgtacgtacgtccgttgatttggccccggggatgacgcaggctacttgctggacggcgagtccaccaccggtttccgtcgggccggctcgggcggccggactcgtgttgtgagtcaataattgtagtacttgccggctcgcggctctactgaatcgactgtttgacacacagatcagatcaacgagtggcgtagttagaggacgtacgcaaaaggacaagataaaaaggggaataacagagccagccgcagagggcagaaaagaaaacgcgccaaggcacgctaatgcaattggcgcccagcaagtggatgccgtgcccatgggtaaaattggcaaggcggatcgatcccattcatagagagcacagaacaccaccacaaggaaggcccttctcaagacaggcactcaaaactaaaccggaagaaattgcgcccactgccctgcgcagcgcatgcataacgcagtgtgtggcagacacatggaacgagacgcatgacgcagaggcaatggccactttcttggcatctggcatgcgacaaagcaccgcatcgcaggcgcagcatcctttgggttctctcctacgcctccccctcgcacatgctgccctggcgctctccccgcacggagcacagacacacaatgcgcatcgaggccaaaacccggtgtgctgcgtcgaagcaaccgggccgttcggctcccgcgcgctcgcggaaggagcgggacacgcgcgggcgacaacaacggcgagctgggcaaaaggacccgcgtggcgccgtgggcagtgtcgcgtagcccagggcatggacgtgtgtacgcgcgatccaccgatcggtcggggtagattcgatctctcccagatcgccctcgctgcggctgcatgccttcatggcgtcgcatgcatgcatccacaccgaattcctcgaagcgttccgctaatccgggcgggcgcgctagacgggatggcgctgcctgccgtggcccatgtgcacacgggttcgcgatctcggtcgcacgttcagggcgcaaaacggcacgctctggagacccatgctgctcaccgacgtttgcctgctccacagtgctgtagttttgtgatttttcctctagaagcttcacttcatttcctttctcatctactatacatatacattggtggaatgggccctattgggctgaaatacacacgcctacactcaacactccctctcaagatgggcgataaatatctatcatgcccatcttgccacacgaagaagtgcactctctagcacctaatgccttcgttaaactatcagctacttgttcaccagagtttacaaagcctaagtttaaggttccctcatccattctctctttaataaagaagcgatctatttccacatgcttcgttcgatcatgctggactggattgttagcaatatttatggctgatttgttgtcacaccacaacttcatggaagtgcttgtcgacagcttcaattcagccaaaatatttttcaaccataacaattcactcaagctcatcgacattgacttgtattccgcctcagcagtcgagcgagacacaactgattgtttcttgctcctccaagataccaaattgccaccaataaatatacagtagcctgatgttgacctcctatcatcaagacaactgccccaatctgcatcacaatatccctccacatctaggtgtccattcttcttgaaccatatgcctttacctgggcttgccttcaaatatctcaaaattctatacacaacatccatgtgaccacttctaggatcatgcatgtatcggctcaccacactcacagcataagttatatcaggtcttgtgtgacacaaatatatcaaccttcccacaagtctttgatatctctctttattaactggatctccagattcagcacataacttatgattttgttcaattggtgtagaagctggccgacatccaagcatacctgtatcactgagcagatccaatacatactttcgctatgaaagaactattcctctaggagatcttgcaatttcaatacccaaaaaatattttaattggcccagatccttgacctcaaactccttgcttagattttctttcaacctagatatcttcaagcaatcatctccagtgataatcatgtcatcaacatacacaacaagaatagttttaagacctctattatggcgatagaaaactgtgtggtctccattgcactgtttataacccataccacacattgcacgtctaaaacgatcaaaccatgctcttggtgattgtttaaggccatataaagattttttcagtctcaacactttaccttcagtttgtgaggtagcaaatccaggtggaatttccatatacacctcctcttgaagatctccatgtaagaatgcattcttgacatctaactgatgcaatggccaatcaaaattagctgcacaagagataagagttcttaccgtgcttatctttgctactggtgcaaaagtttcatcataatcaattccatatgtttgactatatcccttagccacaagccttgccttgtatctttccacatttccatcaggattttgctttactgtataaacccatttacagttaaccactttcttccctttagggaatggtacaaggtcccatgttttgttcttttcaagagcctctagctcctctagcatagcttgatgccaccttgggtcttgctttgcttccctccaatcatttggaatttccactgaatttagtgatgtcacaaaggccttatatgtggatgacaaagaagcataagagacataattggctatgttattcttatcatcattcacaccttgagcttcaaaaccatacctttgtggaggtttacctgcattgcttcttaccccctttcttatagcaataggaagattagtttcttctccccctgtttcaaactcctctccttccgtatccgatgaaatctgtatagtatcacactgatcagatggtttatcccatccataggagactcatgttgccccattgtttgcgcctccaaagaccttgttttcctcctagtataaacttgtagattttcttcttcacgtggccttctccaattttgctcatgaatgggttcactaacaggatatgggattgagccaaccacaaatttcatgcttcttgattgtgtgtcttcttcagtacctgatgagccattctccccctcttgtccatcctcatcaataatgggattgtcaagatcaacaaacaaggaactcaaatctgttctttctccatagaacggaacagactctctaaaagtaacatccatactaacaaaagttcgccgctcagatggactccaacatttatatcccttttgcccagaagagtaacctataaaaatacacttgacggctcgaggatccaattttccaacggatggctatgatctctgacaaaacaagtacacccaaacacttttggaggaacaatgaattcattcttcccaaacaccatttcatatggagtcttcatcccaagtattcgtgatggcatgcgattgatgagatatgttgctgttatgactgcctcactccatagaaactttggtacattcatcgtatacatgagtgaacgagttacctccagaatatgtcgatttttcctctcagctactccgttctgtggaggtgtgtcagcacaagaagtttgatgtactattccttctgctgagagaaaactcctaaattcatcattcacatattctcccccattatcgctcctaataactttaacacaagtgtttaattgattcctaacccaagcatagaaattcttgaaacatttcaatacttcactcttgtgtctcatgagatatatccaagtcattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgcttttgtccaccttactcatctcatcaggaaataccttagacatagtatcaaaggacatatgtcccaattgacaatgttttagaatcaatttagcctcctcttcacttgtgctagctaacaaagcactacatagtgctttgtccgtccctcttctatccagataccacaacccattatgcctaacgccggttccaagctttcttccaattcttctctcctcaattagacaattctctcagtcaatagtaattcgacaatccatatgatcaaccaacgagcttacggatactaggttaacaggaaaagagggagcatataaaactgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggagtctaatatccaagttgagttaggtacctgcataggatgtgcgagattaacaaagttgccaagcactgttgttttctccttcactttctgaattcttccccttatttcttcaacttcttcagccaatttctcaagtattttgctcaattccttaaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacgcagcagcaagccaagctctcgtactcagtttcttccccaaatcagaacaacagcaacagcaaaccaagcttccgcttcacctccaaatcctcaccttctcaagtagcagcagcaccagcaacagcaccaccaaagtcaccaccactggaatggacaacaatagccaatagcaccaaatccttctctgttgatcctacagccaacagctgcgcgtctctcagccgctgtgctccctacagcttgtgctacaccaaatccttgcgcagctcaaccagcgagtgtgcgccctgctcctccttcacgctgctcgcgtcgagaacctctgcagcagccgtcgccgcctccgccgtcgacactgccgctccgcctccgctgtccgacgtcgccgctccgcctcagccgtcgacgtcgccgcagaacccctctggtcacagcgccgccgccgactagggttcacgtcggcgaggtcaccggtgacccaactctgataccatgtagatttgtgatttttcctctagaagcttcacttcatttcctttctcatctactatacatatacattggtggaatgggccctattaggctgaaatacacacgcctacattcaacaagtgcccgccgcaacacagcgagtcggcgatacccatacaaaaacgtggcggtgtaaacaatatgcgacactgttccctcctcgtgcgctctgatgctgccactggaattcgctagtgtcattaggcatttaggcttaccatgtgagcgacgaactgtaataaactttgaccgaattcataaacaggaattgtgggggtactgctgctacttcaaaataagtattcccaacaaccagattaggaatggactagtagtggatgacaccaacgcaataatcaacgaatgtgatcactgatcacaccatcattacgagccagtagggtatcatatatcaagattccagtgtcaaataaacaacaggtccagagaaaggtgacaatagacgaaaaggggcaatcacgaatcaatgaacagtctttgcattcattgcaaggcgccaaggccttgaacgtcaaaggaaagagacagatggttggagccttggagctttcattatgcttctcctccatcatagcactacaacgagtcaagtaaacatacagcatttcctatatatcatccatgcatgccagattatgcgtggtccccgtcgtctgccgttgctcataagcatcagtcttcgtactaaactactactcgtgcgttgtgtctcatttctatccaccgtgcatggatgcttggaattatttgtacaaaccaccaaatccagagtaattaggaggtacggaaatttatttctggcgcagggcaagcacatccagccccagagacagcttcgaggatggtaccatgtaccattaactatgctagtgtatacaagcatagctaagattactgtagaagatggcaacgaaaatgttggagttgtgaccaccctcaacaactctcgcaggccggacgagcaaggccacaggcagagtttgcaacaggagcatctctataatgctttggtttttgtttggtactgcagtacatttgtctctcaggatggtgcagcgcttcgtaacttttttttttcttcagctactgtgatcattgatcaaaatcttcagcttgttacgtgacattaatctcgccggctggatggatcaatatgctaccagtacggggtgcacattgaccccatctggagatcagataaccggacattttcttcccaccaatcgctatctccctttccacaagaacatggttctgacccagacatcaaccgctaatctttattacagatcgtactactaaccgatatgctactactctaccagtatgttctaaacctgtctcgtgtgaagcaaatgctataggagactaaaattaaggatagacgaacctggtcagggaccaatcctttgacacgggattagcattagcggtaggccctgatcgagctagattctctgccagtttggcctccatttgtgcttctatgaactatgatcagccgagccgaaagccggaataggagtatatgtgggcgcaaggaaggaggaggaatgcaaaattaattgcgtgttggtgccttgccgtcctccgggggccatgcatccatccgttcccgacggaatggcgactatttttggcattgaaaggagcaaatacagcgacgaaacgtcgcctcaccggcgcggcatgcacgcccaccgacacaactgcaccacccatctcggaacgccaagcacaaaacccccctccctgctcgcctcccaaaacgctcgcaaaggcttcgaaaccatactctactcggctaattccaggtggtgacagtttggaattttggcggtgtcatttcgtcatcgacacgcagttgatagtacctgtggctgcggttaacgatgacttgaatttgcttaagcaagtttcccttttcacggagcatctcgtaattgtgcaatggaccaatggttaatggttatcgtttactaagagcatccgcaatggttatttataggctctatacaagagatccatgtcagcatatttttctacttgaaagagattaaatgaagagagagagcaaagctatctactaacctgaagatagtctatagagaaaaacgaggcaatggattagagagctatagatatccatgtagacatactattgatgtggattactattaatttagtttattactgagatgtatatgttttatatagagtatcttattttaccattgcaggtgctctaatacaccggtggttagtacgggccaaaggcaactgattgcaccagcctatcacaggcgtgaacagatccaatggctagaggacagctacggccattaaaacaagtctcacagctcaccaggtaggtccgaggcttggacaaacatgccaaatggaccaccaatggacaatgcaggctacctttcgctaatatgcagacgaaatggtgaataggatgatcagcttgtggtactaaccatcatttttcttaccatggcatgtagaagtactagcgatgagcaacgcaccaaattgcccaatcatattgcacccacggccagaggcgacagtagctacagcatacagaacagtgtgcacttgcgcgccgacagttatagtactaattctagctatagtagtaaatcaattcatgggtccagttgtagccagcagatttctagagcaagaaatgggtaattagctgctgatctcctatgccgtaattagtgggctaatatgtatggattcattcacccgcttctgctctcgtgtgttgtttagcttgcaagatgcattatcgctaatcaatacaacgaggtcagattaaaacccgtgcaggagtatcagagcgtacggagtacggagtagatcgacaccctgtcaccataggagtattaccgaagcacaagactggaattgtcaggaaggttaaggacgcatagatacttcaccaaacagctaccagcaacttacacttcataactagttaaaaacaagaaagaaaatctgtgacggtaacagcacccataaaaagctcaagcctaacaacgaccaattgctaaattcactcggtccttgctaaacacagtttgacacacttgtcgctttcattcacttgtcccggttgatcgcgagaatccggcatatgatcagtacttgacgggcatgcctagccgatccaacctgcccgatccagggtaggccttgttggtgaacttgctatgcaaggaggccgttgtcctctgtgccaccggcgcgcacgatccgggtccgaacgcgtgcgccgacgccttccggagggagctggacttctcgtactgcggcctctgcttcggcgcgctctgggagcgtgccttggcgcggaacgactcggtgttcgccatgtagttcgggtagtcggagtagccgccgaacaggctgcgcgagcactcgctcttggtcggcgtgaacgccctgctccgcgagctccccggccgcgacgtcgccgagaagaactgcgggctgtcgcagagctcggcgatgtcgacggccatgagcagcgggctgagcgcctcggccatgcccaccgacggcgggctgggcacggactgctgcgcggtcgtggagtccttggacggagactccggcatggtcgcgtagctccggctcttctgctcggatgtcatggacgagcatgacgagtggtggtgatggctgccgctgcgcctccgtgaggcgtgccgcccaggcttgccggtgtccacctcgagaatcttggcgttcttctcgtcatccaaataccgttcctccacccacttgtcaagccagttcctcccgcaagattctgacctctcccgggtcagtctctcacttcccggcgtcttcgacgagctcccctgcaacacaaatcgccatgccattaatctccaaggctgtcgcaatgtactacacataaaaatctgaacaaacaaacggagcaataccttcagagaaccagaacggccgtgcttaggcacgccctcgtgagtcgcctggtcgtacttctccggcgtcggtggcccctgcaatgcccaaccaccaccaagaaccatcatgagaagacgtcaacgacattaaaattgaaaaatacagaattgtgacataacattttttttaatctgaagtatctacaggtgaaaatacaggaatcatacagaatttttacttacgggatgggccgagacatgctgggagcggatagcgcgacacgcgcgcgcccgcctctggactcggacgagagcgtgcatgcaccggagcgtctccgccgcctgccgccgcacgatgttgccgcggacgagggcctgcagcttcaccaaccctcgcaacgccttcagtgcccgtctcgcctacgtacgcacgcgcgcaacgacaatcagagaggttaatcagcaggggacccccggtaacaacgggagcatgcaccgcaggccggaggttgacatgccaaccaccaccgccattactagagctgcttccaagaacagtaactcggtggtaacaaaatgcaaacggcagtgttcttgatgtgcaaaatggagttaaagcgccggagcccatgccttgcttggataaaagaagtctagggactaaggggcagtaaagacgcaggaatggcagagcagaagcacaaagaggcttctcttggctggagatgacaccacggcgtgttttttcctcacaagagtacatttgctaccggaaatttcttttggcgaagcgaaaaagaaagatgagatttttggaagaaagtgttctcctttttttggctttaaaattaaaagtggagtttccaccaacttaattctaaaacgtgaagttatcagaaaagattaggaactgacgagtcgagatgagaagctttaccaggtagccgcggaacgcggcctggatccgaacagccgcatactcctcccgcttggcggcggccggcgcgcatcgtccgctgctcgtcagccgcaccacggctgcggccgcctgggcagcggcgacggcagcctcggccaccgccgccgtcgccgccgccaccgcaatggcccgcttgctctgctcgtcgtccccctcatccgacgccgtgtacgcccgccgtggcgtcaccgccctctgcaccgccgccgacggcggtggcggcggcggcggatgggccggggacttctcacggaacgacttcccgaacccccagcgcttcttctccctcgccggcttcgggtcgccggagccggagttgggcttcttgccgccgccgagcagcccgcgcagccacctggacgcccaccccatctcctaggccttcagctcggccgttcccatggcttaacctcggctccgcttccagcacttcgccggagcggcaaaatggaagagcgggagatgaaaccgaaacagtgaaacgcgcgcacgcttacaccgagaaaagaagaagcggagcaaggtcggagaggaagagcctagtggaaggttagaggggattgtcttatagaggaagcacaagaggtggggccatttttgcaaatagtttatccgttttaggggccgcttgtgctaatatttttcggcgaagcgatcgtaaaactgtaaaatgtccttgttttgagggaggtatggggaaagtggtaggtgttgatcttctgctccgccggccgcctagccgtttgactatttattgttttgatcagacggccattccgggctccggcaaaataaaacatgcaacttctttataactttgttttactagctttccagctattacttctcttcttacgggtcacaaattattattagagacacatttctcttaagctcataaataatgcttttttcatcctaaaatagaccccctcttttcagatttatagttataggaaatattccatctcattctaggttcttatattttgggacggatggagtaagagattttgaatagatatgacatattctacacattcatatttgtattagttggatacgtcccatccattcaagattctttatattttgagaaaaaaaagaaaatatgttttagaataatctctataaaagttttttaataaataggagtactttttacttgactgagtaaatcaggatgtgtacttcaattgtttacttagctcaactaatatagtatttgatatgtaagtgttttgcgtgttcaaaaccaaaacctattacgactttacgagtttatgtccctctactaattctttttcctgtgctaatggaactatagattcgatgtaaagaaggcgggaaaaaaaggaatatgtttaaatacaaatactaattgcaacggttagttgtattagcgccttgccttaaaattgaaattatgctaacgtcaaaagtggacatcgtctagataccattccataaaacaagtttcactaatttgtcactttcgaatgacggttacacgctagagtgctaactcggatgaaattgtccataggcttctcttgtcgtgacctattcctttccaactcgatatacttgctagtgatgatgacaaaaacaagaggagcctcatcacgctcgccctctatgcctacttgcaacccactgcaatggtcatcttgcttaacctccagtatattgctcttatgccatttccttcttgctctacaaccactgagccactatggtgggtgtgtcaacgtaggatagtcactaatcccctatagcttatctccaccagcaaccttcccatgatgtctgtctccaccgtggaccctagtggctccaaccctcgatatacattggggctcgagaaggttgcaacgatgtttaggttggagaaggccggtggtgcaagagtgaagagatatcgtcgtcatcacctgttggccatggcatgtcaccgccgtagttatttttctcgccacgtcggaggtttaaattaaagcagaggcaatgatatctcgtctattcaaaggacaaatatcgtttcattattgatgcacacatcgcttaagaaatcacattttaattgagttcatttgcgaaacgacatttaaacgaagctcactttcaatgatgtggcgtaattctaaatttctcgtcacaacgacatacacatccgaacaccaccactatacttgctattacaacaaatccagaaatcctttatgaaattcgtccattgtcccggacgagggttttccttggtgctatatttattgctcgctcattgtacggcagagtgaccattgcacaattcagactcttcttctcataagatccctgcaacattactgggaatactagcagtactgttcttccctgggggaagtcagatcgtcggggcagacatttcttcgacgccccgctgacagcagggaccaccgcaacagcagcaacccgccacctccgtgacgacgacgccctactcgtgcctcccagcgcatccgcagacacagccatccatcgtcatcctctccctcggcgccgttggatcgaatgcgacccttccttcccacaatccgcgcgacgcgcgtctcgcaagagaaggcgtccccctgtcccgcggtagtagtactgggcacgctgtccacggagctgtgcggttgtctcatgtgtgcggtgcacctggttgcctacgcacggctggctacccgggcctaccccccacactgtttttttctgtttgcaaagctgacgaaagggggagctcgctggctcgtagtactaccgcgcgggacgtgacggggccaaaagcgcacccaagcctagcaggaaaacctgttgttttgtgctctgtagcctggcctgtcacggaggggggtggcgtgagcacaagaaaggctaatcctacctcgcctcgccagattcacaggacggtcacgtggccggaccggcgggtcgacggattggtgcttgcgcggccttgcgctgcgcgctcggtagagtgtggggccgaagccgaacgggggaatcgccagtaggttgccaggattccaggacgctgttgcagcctttgcagcgacgaggtgcgtccaagatatgggcctattacattgttgggcattagcagcagcccaaatccatcatccatggaagcagcggttctccctgttatatgggcctgaatggtccagtatgatttccgcccgccatgaaaaggaataagttcactttgagtcccttaactagtgaccgaatcaaattcatatacttgaaccacaataccggatatcttgacccctcgactattaaaaccggtgcaatttaactcctatggtggttttgaagggtgatttgctgatgtagcgccaacatggcagcgttgacctagtctttatccaacgtggcgttaacgtggcacttatgtggtattagaatttttttaaaaaatatgtgggacccatttgtcattcacgaaaataattgtgggggcccacatgtcatcctctttctttgcttcctttcttcctcctccccccctctgaataggcacatttgtaatgcacggatcaaattaacccttaattatttgtcacttatagtctatgacacatggattcttatgtgtctataacatatggatccaatgaaaaatcattgattatcacatttaagagtggtaaatttaattatcttttattttacggtgatgtctaaccctgatatgaaacaaggctttaaggtggtgtttggatccatggactaaattttagtccctgtcacatcggatatttggatactgatttagagtattaaacatagactatttgcaaaactaattacataaatgagagctaattcacgagacaaattttttaaagcctaattaatttataattagagaatgtttattgtagcatcacataggttaatcatggattaattaggctcagtagattcatcttgtgaattagtccaggattatgaaatgaattttattattagtctatatttaatacatttaattagtatctaaacatttaatataacaggaattaaaaaattttagtcccatccaaataccccgcaagttctggactaaacttagtcaccggagaccgtctgaccgctgacgtctactttcggtcacagtacactgtaataacaggtcaataatcacagtgacgttgccatgaccggaaagtccaaacttgttttcgtgctaaggtcccgtttagttaaaaaacttttcacaagacatcacataaaatctttagacacatgtatgaagcattaaatataaataaaaaatactaattgcacagtttgcatgcaaatcaagagacaaatcttttgagtctaattagtccataattagccataagtgctacaataatccacatatactaatgacgacttaattaggctcaaaagattcgtcttccagacgagtgatgaaattagttttttcatttgtgtccaaaaatcactttcaacattcgatcaaacattcgatgtggctctcaaaaatttttatttccccaactaagcaggccctaacagagcccaagtcatcaccattcagaaaaaaaaaacacagagaatcgagttgactacaggtcacacgacgcaaatatgcaatcatggtgacagacgatgggggatacgattaaagttggctttgccctttttacgtggaccgtgtcgcggtcacgaaagacggacgccatcattcgggatgatctgcccggacccctggatgacttgagcgatccttgttggtctgcgtagcgccatatccttttttgttgatcctcgtttactcccaaaagctctcacggccggcacaagcgacagcctaatcgaaggcaactcacgtcgcaatgagcgtcttctgtgagcacttcatctggtccttgtgcctttttctttccccgcggtccaggttgccaaaaggcacgctcgcgggcgcggtggcttcacaaaagcaacggggtgacggcgggttgatgagagccggaccggcccgaggagcgcaggcgtaggtgccggtgatgcttacgtccacacagctcagctgtctccctgcctgctggctttgccgctaccggcaaggcggcaacggcaaccgagcccccggccccgcgccggcgccgcccgtatcgcacgggccgcacatccgccgtgacaacgacagcgaccttttctctgtccgctcttcccttgtcgctcggcgtgccccgttccaccacagtgtagtgttgtagctagataaaaaaaaaccgagattagaagggagagaagtctttcgaaacatttctctactgttataaaaaaataaaaatatttttatcggtactttggtacgtcatctatatatatgagacggtttttaagctcattcacttttgaaaatacatattcttatttgagttagtttttaaatttgttggctttgggaaatataaaatgatctctttaaaaacctcgcatgttaacttgagacgatcaaacttctaactgcagctcatgattagattttctaataaaaattatatccaaacgaattacttgagatgatcgaactcctaactgcagcttatgattttctaaaaaaaatatatccaagcgaattcccacagtgaatttcaccttaactaaccgtacaacaataataagattaaaatagccttcacttgttgcaacgtacgggcatttttttctagtttttttttaaaaatatgaacatgttaaagattaaacataagacatctgattaaaaccacacacaacctgtcactgtattatcaggtgcatcgctttagctggactggatattactccggctggcaaagcaaaaggacacaattcagtttgttactctggctgggccgattcagtttgttactctggacgggccgggcctgaccaggccagtgcacagcaggactgcacatctgtctcctgctgaacctctttgttcggcccaagtactaggaaaggcgctcatcaggttcatgattcatctaagtcatctgaacataaaactgcaactgagcattatactaaccaacacaaaactagctgatctcacggcgttgatgctctgcatttgctcaacttctgcatcaaagcaaaactgtattgtgttgagcgcgcgccattcctgcgggcacagaccttctggaaacaaaggtgtcatctaccagctaaaagttcagacttcagagatacctcgagatccacgtcgcggcttaaccaggcatgccattcaaacctttgagctgacctgctggataccataatctctatcccttgattttgttcctgcgggggagatcttgtcgttgggatgtctacagaaagtttatcttcatcgtataataaaacaccccacttgtgtgtatcattctttatcaagtctctgaacattaccagtattaaactcggcttgggctatacgacgtcttgcaaatacagaaagctaaggttagatttgagtcgcaaaggatttcgttcagagcaacttggcctgtggggcttttggttgattacaaccagggacacacaaagatggcgcaattcgagactgttctgccaggggaacagctaggactgccaacttatgcagttccatgagattcctggtgtccgaaacacatcaattttaaatcttcagacaaatgctgggtttgcattattaagcgcgtctgttaacctgccatgagacatatcggcattgtgacagttactcctgctgctgccctgcaagtgagtctgaacaagcttgagaataattgaagccctaagtatggctcacaaacacttctatgtacataacgaatatattcttgcttcattagacatgtataggttgatttatatacggagtacaacacatggatagttgacttgactaaccacatgaaaaacgaactaccaaggtacaaaaaccccttttcacggactagaggtagcactcggtaacatgacattacttctatctgagatgtgtctattctatcactagactaagtatgtgtttccatccttttctgttgtccttaaataacctaaaactagcctaagttatgctcccccacaacaatctctcccatcatacatcggttcattcagactggccacttgttacagcccccaaacgcatcttggatccagtctatcaggtctagtcgaagccacaacttaaggtcgacgggtctacacaacccgagaggttgaccaagtgagtgatgaccactccatcttttaagttgtgctctctatcaccaattatcgacgtaggataaaaacccaacgacatctttgcacacacatttttgtgtttagtggcaaaaaccaaaccgccgaggtaaaaaaacgatcagttcttagggaagagctggatatgaaaaccatctggaaagctgagaccgggggttcggactatgtttcctcctttcactgtcctccaactgccatgagaaaaaaatggttattcacatgatgtccacaggatgagccaacgtgagaatgttatatttaggttgagaaatggtacctgtattttgtaactaaagagtgtatgaatgttgccatcaaaaccttgctgagatcagttccaacgcagaaccgaagcccaccaccgaaggccatgaaatgcttcgttcctccagtgatctctggttttccctgttcagacaagggctagtttagagccatatattatttcaatgcagatattccttactaatgtggaaaatgcatgtgatgctcccattctctccctttcctcgttatgctacccattactcattttccacaacttcaatgcaaacagttgctttttttatagggtaatggaaacacttgtttattgaaactcttggttctcactttgtttatttctttatacccaatcacctaggagagctcactgaacctgaaatcagcttgttactgcatctatagatccatgtcatagacaggcaagacagcttgcctttttacagattgcattgctctttatgcaatttatcatcctttttgttttacaagggactggtgaaatagcacatggttcacctaccggattgagatactgtcggattacaaatttattaccacaagccccaatgatagctaacaattttctgtgcacttaagtagtacttgacagatgagatagcttcatggtacttgttttttcataggttacactgtacttctcttggcatttgaccttgttgttaaactactgagcaggaagtttctctgttggttctggtattaaacccctgaccgatcaagctggtacttgagatcagaaccttgcaaccttatactaatcacagtgctaataattgggaagttgcagttaattaaagtattcttctttcataatttccgttttaatgtcgaggcttgagaggagaatatatgcaagttcggtgagcagatcagataattacagttcctacttcctagatgaggagagagctcttttttttttaataaaaaaggtagacgcctaaaataaactgaaggaccaaagctcaaggctggagctgccgctcaacctggcaagatggaaccctaacctacgtgtaaacttagaatgtacatgcagaaactgctaattactgaaagttcatattaagaagactaacctgccacctccatggattgaaggccaacggatcttcatatatctcagggtttaagtgcactgccggtgggcacaccatgataccccatcctgctggaattgtgtagcctgcacaaagttcagagttcagttttgtgctgcaacttgctgaagtgaacctttctaattaacaagagatgtcatgtgctagatagtattcgagatatgtgtacctttgatctcaacatcctgcaacgccttccgaaaaattcccggcacgatgtttgcgagtcttacaatctccattatgaccttcacataaagaacatggaagcgttagttttggcagttatggattcagaaatcgtacggaaatggcatctactacataacctgcagttgccaaaacaattaactgcggtaaaaattcaggttgccgagttctgattctcttcctcttttgctattttcaattgtaaaaataggagtttttcttaatcagccaagcctgttcaagaaagttcttacagttattattaactaagattatctatcattcttgaagattgggccttggttaaacaacaggggaacacgaactctgcacttgcagagttgcagtcttgttggcaacagctttgggctcccaagattcttgcactagttccagatcaatctcattgttccccaagtaaattcgagcgggggtattacagtacgtagcagtgcagattggtctagcgcacactagtcccgggttaggctcacctgagacgtgaacgtcatcgatttgtactcggcccacgtgacgccggaattggggtccttcctgttcctgatgattgcctcgtgctcctcctgcatgcccacgcgatcgacaaggtttaattctactttgctttaacttgtcgatcgattgatctgatcaatgacgagctagttgaactcatcacactcccgttgagtgaaatatgatcaacagcgagagtagagagtagactaacccttagtgcgtcgacgactttgggattctcggtgaggagcttgacgccgatggtgagcgccagcgcggtggtctcgaagctggcgaagaggaggacgaacatgaggtccagcgcgatggtctccgtcagcagcggcttctccctcctcagctcctggatcacgtggtcgaagaagtcctcgcatggccgctccggttcggccatcctctccttcatcatgcccctcagcaccttcatcgcgttcttcctcccctgtgtacgtatcaattcaaaaaaacaaatttaaaatcggaattcattttttttgagtatatatcagctagctgtgtaacagtgagaagcaggagtttctgaggtttatggagtgcatgtgcgcggctatacggccaagtacaccgatctgtctgtgcgtgtggtccttagtttagtggcgtttcgcatgtgcagacggcctagctagggtgcaatttgaagttgtacaaattatatcgtgttcaagagtatgggggcagttgccgagttgcgggcggctgcgggcgtgtgggcgccgtacctccatgcactcgtgataggccgtgccagggatgttcagtgggaaggatatcaacccgcaaatgaacgcgccgaagttcttcctcaggttcacctgcgacggcttggacgggtcgtagccgatcagcttcttggctgtgagatcaaatatcatctgaaatatatatacagaattaatcctcgtcaattacgcgcaatgcggctagctaggcagctagcacatgctgatgcatgctggttgatttggcgtccggtgtgtgcttacagtggagatgccttccttgagctcgacgctgggctgggaggcccaggaggcgaggctgccgcggcaggcggcgtccgtctcggcgaggagcacggacttgaggttctcctggccgtagagccggagcacgagcgtcttgaggtacttgtacatgaagccgtgcagggagccgacgttgtcgcggccgaagatctcggtgaaggtgtccgggtaccagctctcgaacagcttcccctcctgctggaacacgtagtagttcatctccgggtcggccgacaccaccaccggccgccccaccacgcttgtcttgaagatgctcccgtatctgcgcccaacgccaacgccaatgtcacggaccgaactcgatcgatcaacaacgtcaatacttccgcacgccattgccgcatgcgttcttggttctgaggtggaggtgtgtacctcttgatcctctccttgacgaagggggagaggtcgcaggtcgggttgggcgcgaagaactgcagcgtctcgccgatgacggggaggccgagcgagcccggcggcagcctgccgttcgacctggggtggctccacctgtacgcccagcggaggagcgcgacgacggctgccaatgccgcgcacaggagcgctatataggccatggaagaagccatggccgccccggaggcggcgagaaggttcgcgtcgtataatcttggggcgagagggatggtggtggcgaggcggagagaagctagctgaagatatggctgcatgtgcgtatgggggagagttgtgcgagaggagaggtggtttgctaatgctagctagagttgctagcaaaggccaaaggggaggaggcggaggggttatctgtgggtttgtgggtaaggatggaggggggtcagcttatataaccaccatgctgaaagtcatggccttaaaataaaaggagggagggaaaattgcatacatgcccaagattaaactctaattgcatgcagttaatatatttgctctttttttttggctaatagatttaccaaactttttctttactactggtaggcgtacgattgtaacatatgtgttgatgtatcgaagcacatatataattcaacaatcaaaaggaataggttagctagtcttctggttctaaagtaatgctcgattagcttgaaacggttagacttgaaaatgcaatattttgaacccacaagtaatatatgcgggtgtaactcaatttcaccaacatatatgattgagtttttcctttctagttttgtgcaactagtttttaatttctaaggggtgccaaattatttttttgctctttcaaaactacatatatggttaacatttttttaaacaaaattaacatatttttagattagtcccttgtttactttgcacgcccatgggaacttgatgtgttagaagtagggtgggtattcggtccgactgatcggttcggtctcttgttcatttaaaatttttgtacatctaaaaccgaacactaaattcattgcaaatagttaagaccgagtaattcagtatcattatttcgtttcgatctttggtcatggctaaaataattggtagctttgtacgattaaaaaaaacacaaaacacaattaaattttagcaacatttcctctcttaaaggacatgttttgatagtaaaatatcacaagatatattgtttgctattgcaaacaatatataacacatcaagtcatcaagatatcatcatagtaagtccaatttagcattaatatttacgtcacacatgatacttaaataggctttaatgatataattcgatctattcagtcatttccaccgtactaatttcagtagtaagaattacttatcaaaatattcggtttcagtcttggttagttcgatttcagtcattcttttttttttaaatcgaagccagtatttgctggtgttatattaagtaggatagaagttatttatagagtcacgaaatatgaaagagataaaaccgaaaagaaactgaaaaggaaggaaaataacaagacaagacatcctcgcatgtgttatattgggatattctcgtaatacctttggcgctgcacataatccacaccttgttctcatatgtgattttggtcactagttgagggaattgagcctactgattgtggaacactcgtttatttcgttcgcaccagattccccaagctaccatcatatgaattaattcaattgccttcgttttgtgtttttccccttgggatgtccccttattcaccggtcaaacagtggctcgtcaccatcgtgcacgtttggtgtcttgcatcccaactgttgtaagatcttctcccaaacttgttgtacaaaggtgcaatctttgaaaaggtgttcttgccggaacctagttagaagcatagaaggacatggctgtgatatcaacattttgagggataggcttgaaatattcatacatcgacgaggcagagtgggaaatggggatgctttgccagtccagtgatcaatttctctggcaaccctattggctgttgagagctggtcctgattggttaaggattatatagaaggggaaagggaatagcaaagtattgccggtgtgtctccagaccatggattattctgctgtccctatcaaccccagacgatgcctttgtttatgcaaaagcatggtgcgaagtgtaccatactgaattccatcggagtgtgagatttcagcctcaacttcaggtgagtctgtgtattgtacagtgtacataacactcttggagcagagtattactacctgacaagtactgcagctggcaaatactgcctcaacttcagaatattcagacccattatagggggaaaaaaagattcagatgcctaacatctgcaggctatctgaaatgtagtatacatgcaaagtacattgtactctaatcacctatcttgcactaatttcagagcttatagtcaagaatccgaacttggcgtgcaagaaactgaaccttttgttaagtaattcgtggcctgcgtgctcatcacagaaatgaactgattgaataactcacctgggacgccaaactgtgtagtgtgcttgcatggatgtgagtcaaaagcatagctttcaggatccatacaaaattctctcttcttcttagctgtgcaaatatgtgtcacaatctaagctctacaccttttggtaatcagtgacagtatactattccaccagctagccagacagtatatagattaagttgtttcccctagacaattatatcaagattgctagcctgaatccagcccagaaattggcactggagcgaaatacgtcagatcgatccgatttccgaatcttcctggaagcatcagaagaagcggtcctgaagcggtgcatttccgtgtcaaatagattcgacatggttggctgtccatttcgggaattttatacaggagtttaatttcttctgccattcgatgcctatgcagcaagtgcaacaagaagaaacaaagaacaggccatttcccagcagcactgtctgaacttttcgcgtcaagtcgtcaagattcatcagggagaacagccagatattcagacaccttttcatgtagttgctggagcgcttaagctggaacagccagagcaaaacgctcgctctggctttgtgtttccttcaccgcctctcatgatcgaattctttatgcagcggagctccttttgtggcccccgttggcttctcccatatcccaacattatgcatgcacctcgcaacatgcgtacgtgttcctggatgcatatgggtacagatcatttggctccgtatgggaagcagtacgaacagcgggggcgcgcacgtactacacaagtcacaagtggcccatgccgcgagtaacatgacaaacagcgaaacataagaaacggggtttcccactggcaattaaaaaaggaaaaatctgaagaataggatccaaatcatggagtagggtaagcggagcaaagagagaaaccaaaaaaatttgcccagaaattctgaacagttctccataggcggggctggttttcacaatttagaccatgatctaaagtgattccgcggctgcagcatgcagccacaacaatcactgccgaaattttttggaaaagtattggtctgttcggctgcaacatgcaacggttattgacaaccaattactgcttagttgctgccactaaagaactatcgtccggctactaggcagagttgcaacaagccgtggaataggctcatttttttttaagctagacacctagtgaagctttttaccgaaatggagttttgtaagcaatgctatgacatttgaaaccatgtatatgccatgactcatatgatttggtgccatgtagaaattaggacaccacataggataatccatgaagaggttaacattagcacacttttcaaattgttaagcagtgtgttttgtgcgaaagcttttatacatgaaagctgctttaaaaaactaaataaatctatttttaagtttgtaaaaattaaaacttaattgatcatccgctaatggttttcttgtcttatgtaccctaactttatcttcatctttcattagaaaagaacactacttacatatcacaatttgactttgtcgctaactcggagtaaatcaattgactgcttctaatcggatagggttttgaagacggggtttccaacttgaattgtaggtgacacattgagtgactacacattatactactccctccgttccttaatatagggcgcaactggttttttgatgtgtatcaaaatatagggcgctcatgcacatgcaagcaaatagcattaaaacaaaagtataaaatctggttgacttccgcacgcatacatgcaaaggctttcaatgcttcttcggtttttgcgttgcttatcctttcacatgccaaaataacaggttgtttgcagggaagaatgcaaagagctgcatgcatgcatgcaaagaccgatgcacacgggagaagcaaagcatcgcatgcgtcgctcgagaaaatcagttaagtcttcttggtattgccgtccagagcagttgcgctctatattaaggaacggagggagtatgtgcttgccatctttggtcaaatcgattgatgccggtgatccccttctctagtaccaaaatacggagtagatgtaaaagagacacggatttttatgtagaaaacacttaataagaccacgaatattgtcacgccccgaactagtaccgaccggaactagcccgtgacgctccaaattaacctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccatgacttggaccaaacatcacaggcgcgacttgggaactaggccgaaaccctaaaactcatcgaagctggcttgctcctggaagaactcctcatcagcgggatccgcttcatcttcttcagcaactgggggggggggagattatttatatagagcaagggtgagtacgggagtactcagcaagccaggggaaataagtgtttaatgcaggcctcaaagaaaggctggtgtttttgcaattgattttattcgaactcttttttgaaacaactaagtgagtgcttctcaaacgacacggatgagatagtgcgtctcgtccggtcggagtatgtgcaatgtatcagtcttttagaattgaaacaaggttggcacccggccaacagcttttcaacggccacccgggccaacaacttttcaaacggccacccgggcctagctgatcccatcagctacagatttttcaaacatcgaaccacttttctcaacagcaatttcacaagcagtagtcaaacaaaactacgctaggaatcaccccacatccgcccatgaccgtgggcacggctgttcgaacagtttgttaacctctgcagagggggtacactttacccacacgacattactaacccggatcacccagcccgtggaaatcagccacgtcgggggacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctggtaaactagtttcttagccaggggtgtcccattccacccatgtggtcgtacttgtcttatgtttggatgaaattccaaggaaacggtccttaagtgcaagagcgggaaaccgtacacccggtacgttccccggtccgcggttttggaaatttcatttagttcacaagcaccgacccaggtgtcgggttttccaaatcttttgtaaaacccaagttttacccaagatgtttatcatattttaagtttgagggcgaccgtcgatactcgcacagagtgctcgagtatcgaggcgcaactggatggttacaaggggacatggtataacaattagcaatggagggatcagatgcaacaagttaggtaggtccgccaaactgtcatgcggacggaacaagcagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccgaaactacacgcaaaacgggacaactcaacaaacggcgaaaataaagccctattaatgacctctaagcgtgccattagatagatctcgggatttgaggaattttgggagttgaacggagtcaatcggatttacggttgggaagatattgaatttctaagattattggatttttggtctaaaggaaaaggatttaattaaatcctttttggaaaagaaaagaaaagaaaagaaaggagggagggaaaacagacttttctcgggcggctagggcgcggcccgagagaaagagcggctcggccgagtttaacgggccggccggcccaagaaggcggcccagagcggcccaagatgcgcgcgcgcggaggaaggagagagagagccggtggacagggctcacctcgcgcggtcccgggtgggacccgcttgtcagcggctcggctcaccgtgcggagggagcacgcggcgcggcgctagggtggag

SEQ ID NO: 63455 - DNA, 7827 bp, Oryza sativa
ggggaagatgggccgagagggattcggcccatcgaacccgggggaggcaaactagacttttgcggagggatttgatttggaaggatttggattcggaattgaactcgacgatagatcggggattgagatcttgagatggcacggacactagacaacaagcaaagaaacaaatttcgcaattagggtttttaggagataattttcccgctaggcgccacgacggaacgggcgctacaaatatcaatcagcaataatcattattaaaaagttggttacaaatgaatgggaagaacaatatataagacgtcatcttttctatgcggtttatagaagatatataaagtacaaaagtccaagagtcctagggtgaaaaatcttgaagtctactaggaaactacttcaaatataatatgcagtactccttttttttaatagatgacttttaaatacgtgtttgaccattcgtcttattaaaaaaagcaaatgtataaggtataaattatacttaaagtagtttaagtgataagacaactcataacaaagtacattataattatgtaaattttttgaataagacgaattgtcaaatgtgtgacaaaaaaaaatctcttaaaagacggaggtaatattgacttggtgaaaaccagatcacgtaaaaacgcccttgttttagcacattatcattgcggcaaagcaaaatcaaggccgagtttagttccaaaatttttcttcgaactttcaacttttacatcacatcaaaactttcctacacacacaaactttcaacttttccgttacatcgttccaattttaacgtgaactaaacacaccccaaatacaaatacccattctaataagattctgtatagattcctatgcatcccacttggccaatttccaaagcgatacaaagtacgtgctttgcataattttttatacaactacgatgatgagctcattactcatactcaaaactaaaaagttcaacggcgagtgtgaatgtgtggctcagagcgaggtggaataaacataacatgtactagctacttcgtaccaagggaatgggagacagatcctgtgagagtgtgagatgcgtctcatcgtccatgcctctacttgtgcttccgctgccaataattctgttcagtgtttgggcgaatatttccagttcatttcgcgcagcagtgagccgtggtggacagcattgatacagcaccgaagtctgaaattccttcccttttcaagttgcatctgccagtagactttctcgtttcagaagcctcgtgagaggatagattaacagagtgttctgtagcatgagctagctgggcgtggcaggtcacgataatcgcagcgccccctaattccagtgtctaaatttatttaagcagatcgttcttcgcgtggtgtgttaatttaacttcagccgcaaaagggttgaaaaaaccgagcgcttagatccgtgcgcgcgggtgcgacttgaaaagcgaagacctgatctgctactcgatctcaaccaccgaatgattgtaagcaaaaacgcgcgaactgaaaagggcctcgacgacatgagatgcagagaagctagctctccttctgaactaaggaaaagatccagagagagaatatatatttggagcaaatcaatgccaggatctcaatgttttataattcatgcagctaggagcgtatgccactgtgtgatggagctaatttgtaggctacagcagcacaactgcacaagtgaacccagtaggcgtttcctcgttggattttgtcaagctactgttggattcatttttggacgatggagatatgttactgttggattcattcacatgcatgccttgttcacaaatccgtcgagaattttggctggtctcgcatcttggcaatttgcaagcaactcgtattcttgagttgtgtagctaaggaatttcaagcaggtaaactgcatgcatgcatttggccactccaaatgagggataggaagcacttctgaacaaatgatgaaagagatgatttcaactgcctgccagcaacaggaacgtggaattatttcattttctcccatacgtatggatcagagagagggagtaggctgttggtgttggagcccccaccgacagaagaatacaatcctcgtcagcaacgctgaaaacacgtcctgctgaagtagaccaagtacattaataattcccccccccccccaaagatagattaaaatgcagttcatcagcgaactttgcaaaccagagtttttggctagtccattaataagtacaaatgtacaatacaattttcttgatctcgcaacgagttcacacaaatcttccttcggaacagagcatgtcaaccatgaattttcggtgagtcggtttagtgaaccaatggatgacacctgctagacatgcacaacagtgacactgtgacagtgatgccacaaacgcgcagtcatcacacccatgtagcagaggtagatgtgttcatccaccatggcatatctggatttttcacattttagtccttttaaaaaacttatcctccaaataaactcctaaaaaaacttattctataaatgattcttttcgcggcgccaatgtcgttggcgccgtgattcaacatgacgacgccaatgacgttggcgccgtcccccccccacccctggatgaaagttaagtcacaaagaagaccagttggtaaatttttttaaaaggacttatttgtaataaaaaaggacccatttgtaaaaaaataaagtgaattgcatgttggtcttgttattatgaccaaagtttcaatttggaccatggcacatcccaacattttcagtttaaaccagagtcttttaccttggattgcagattagaccaccctatccatttccacatcccgttgtttccactcagccactgcttgctcctaaatcaagttgctgcctgctgccgatcgtctacttcggcactgacattgggtcaagccagcagatgagcacaacaccattaacctgaggtattgagagccgcggggaatggcgttgaagagatgagctctatctatgttgcccctaagcttgagctcgagctccatcagtggccacctttgccagctgcgtgcttgagctctacctccaccttccatgccccatgctcgagctccacttgcaccgctgtggcgcctcaacagccctgccctgaagctactcttttttctcccatgtgttgtgctcattgctcttgcaacaatagtggtagcaggatccggtctagtgcttgatctagtcatcaagctcctaatctagatgcttaagatcgagaaaaacaacagatgggcaactagactgcaaggcagactggaaacggaaagtggagggagcgatagtggggatgggaatgaccggtctggaggaggaagagagaaggggaagagggagagacaccaggtatagctgacatgtgggcctctagaccaaattgcatgctcaagtaactatgtctggttgaaagtgaaaatggttgataacacctagttcattgtgaaacatgggtaagaaaacatagtccaacatgcaattcactcaaaaaaatatttacaaatagatcctcggcgccagcgtcattggcactgaggacctatttgtaaatattttttatttataaataggtcccttttcaaaaaattacaatttagtcctcgacgccaatgtcattggcgccaccccccttcacatttgtaacttaactttcatcggggggctagggagacggcgccaacgtcattggcaccgtcatattggaccacggcgccaatgacattggcgccgcgaaaaggatgatttttagaataagtttttttaggtgcctatttgaagaataagtttttttaaaatggtcaaaatgtgaaaaatctagggcatatgccattcttttacgtgtgatattaccgtggatatatgtatgtttctatatttcaattgggacggcacgtaaatttccatttctcaaaagaaaaagataaggtgacaaactatgcttgtctttaccaacagaggggaacaactccaaagtctgcaaatattcccttggtccattattacccccatgcaagtggataactatactagcagcaggatgttaaactagtgacactagacaaggagaactcaggcccaaagctgataaacaaaatggccagcacgtacttccctgatctttgcttcgatcgcatggcacaagctgataaaacaattcgccatcaatcgccgtctgacattgtttcatctctcgccgcggttcctgatctccggccggtcagaggcagaaaggatctcacctttggatatggcaggggctgggggtcaaatgtgcagtttactataaccgggaatcgtttgggtttatagaccccaaatcctgcggatgcagatacaggctccaacctgtaaccacggcgtcgcgattaggatggctcaactgaaacggccacgtttcttagcatttcgtaggaacacgcactgttcccgcgttaaggtgacgcgcgcgtgatgaatccgggcgtctcgccgcgttgcagcatttgcctacgtgatttttgtatgccggcgttcggtgtgcattatctagtgacattcggcctccgaccctgctggatttggcgataacgaatagacatacgccgctgctgttcatgaattgtctaaaaccgtggaaaattcatatttcggtgagtatatattgtcggccgccatgtccgaaccattacgacgtgtttaattctgccatgatatattatattaggtatattccatatcttttcttaaaaatagatggttgatattgtacagatcctattctaaaacgatatgatactatgcgggtatcagatctagtaattacgaacaccaagtctaataccatgtggataccatgcctaatacccatggtagtgggtgcattatttgtagatggaccaatcaccccattcaccattggagatggcattggcttgggtttgggtttcttgtggaaagtcataaaagagatgcttgtggaagtagtcacatagaaacatcgaggtgcactctgccgcttctgagtatgcggtggagtagtgcatcttgccagcgttggtgacggaagtgttagcttagccactaccattgttgtctgtacttgagagggtacaatcttagacggctcctgcacggggcacaacgtgttgctcgatgcaatgtgaacttgtacgagcagtcaatggagaatgcgcacgctgaaggtgacgttgccgtcgagctccctgatggctttgccctcatacttgctatcgtgttcttgcatgtgatgactataaaggacaacaattatataactaacagaaaaaccattctggtaagcacaactgaactacataaactatcttctaggtgaaacctatagtagtataggatgaaaccaaggagttgtggcattgtcgcgactgttacatccttcagcctccacaaaggtttacactgctagataaaaccggcgatctcttcaattgtctctacggaaacaacataattccagatttatggttgaattgttgattttctagaagctctactggactaaacaaaagattgccacaaagttatacttcaaatctaaggagcactaacatcaatcttgttgactaaggttgcataagcggttggcgctcaacccgaatagagaccatgtcatggttactactctctccgttacaggttataagatgttttgattttggttaaagtcaaactgcttcaagtttgaccaagtttatagaaaaaaatagtaatattttcgaccaagataaatttattttaaaaatatatttaattattaatttaataaaactaatttggtaatgtaaatattactatatttcactataaatttagttaaatttgaaacagtttggctttgaccaaagtcaaaacatcttaaaacctgaaacggagggagtattatgaaagaaggaaatagaagacaccctccaaatctagtatacattaatcgtcaaaggatccagatggtggcgatgcatttaacatgtataaatgacggtggacaacatggaaagcagcaatcaacatgttggcaacagtgaccttcagatagcagtagttgagagccaagccatcttgaagggtttgccagtaaactagcccttcggctctccagtttagttgtttgccgacgctggatccttgagactccattggtacatttatgtcacgccccgaactagtaccgaccggaactggcccgtgacgctccaaattaacctgttaatcgataccagtcctaggaaacagtgctggtatcacaggaagacagaatatcacagcaacagaggtctctttattatagagtaggagtacagtcatgttgggctgcggacagatcccgagctcacaactgcattacaaaaggaaagcggaagccaagacttgggccaaacaacacaggcacgacttgagaactaggccgaaaccctaaaactcatcgtagccggcttgctcctggaagaactcctcatcagcaggatccgcttcatcttcttcagcaactggggggggggggttatttatatagagcaagggtgagtacgggagtactcagcaagccatgggaaataagtgtttaatgcaggcttcaaggaaaggctgttgttgttgcaattgattttatttgaactcttttctgaaaacaactaagtgagtgcttctcaaacgacacggttgagacagtgcgtctcgtccggtcggagtatgtgcaatgtatcagtctttaaaattgatcaagattggcacccggccaacagctttcaaacggccacccggaccaacaactttcaaacggccacccgggcctacaactttcaaacggccacccgggcctagctgatcccatcagctgcagattttccaaacatcgatcccctttccacaacagcaatttcacaaacagtaggcaaacaaaactacgctaggaatctcctcacatccacccatgaccgtgggcacggctgttcgaacagtttgttaacctctgcagagggggtacactttacccacacgacattactaacccggatcacccaacccgtggggatcagccacgtcgggagacctccaagctttcatgacaaggcatttcgaaagccgacacaggtttaccatatgccgacgagaggggtcccagaccgacaacaggttaggtcccagaccatactgtgctaggaagcccaggggtcctccccgacaccaccccgacgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtacacccggtacgttccctggtccgcggttttggaaaattcatttagttcgcaagcaccgacccaggtgtcgggttttccaagtcttttgtaaaacccatgttttacccaagatgtttttcagattttaagtttgaagacgaccgttgatactcgtgcagagtgcacgatttccgaggcgcaactgggtggttacaagggaacatggtataacaattaacagaggaaggatcaaatgcaacaagctaggtaggtgtagcgcccgttccgtcgtggcgcctagcgggaaaactatctcttaaaaaccctatttgcgaaatttgtttccttgcttgttgtctagtgtccgtgccatctcggatctcaaatccccgatctat

SEQ ID NO: 63456 - DNA, 3529 bp, Oryza sativa
tggatagtctggtgttatgaatccatgagtcttggttgtcaacactgttttgaagtttgttaaactgtctaaaaaaaaaacaaacttaatatttcattagcctgtatacccatctccctctgaagcacggagttctactcattttgtttcagaaagataaaatcaagtgtttgctcttctgcctggcgttttctaataaaagaatatttttcatgcaggcaaagccattaatcctctttgtaaaggtatcttttcatgcaacttgttcctccttatttgttttagtaattctcatgcttcatgttgctgaacctgttttttaaagaataaaatcaatgaaaatttagggtcctcccctcccgttccccaaaagggggatatttgttactttaacagaactacacattatctaaatgttcatcactctgtttttctgccagtagttagtactgatgccaagtacacctctttatttttgcagttaagcgagcttccatatcccattctgtatctctgtctttaagattgatgtgctttttttttataacatcgtggtttgaaattagttactctactgactttcagttgccgctccacaccccactgcaaatgtcagtacaaacaacagccttttggatcccttttcaagtgggaatggtactgtgctattagtgcaaaaacatgagcctgaatgttcaagtgttgtatcatcaatacaaggacagaatatggatctgaaagtgatggctacaatttgtttaaccaatttgatgttgtgcaagatttttctgatcattactatgcaaagaattcaccagggaaggtaagctgtgccgctttatgaactctatttctatcactagatccaactgtgaattaatttcctgtctttacttgtgaccactgaccagacctccaaagattgggtgaagacaatccaaaatgaatggaagcttctacagaaagatctacctggtcagtacatgcttttatatggcaaatcaatgtatgcatttttatcaaaccgccagtgcctagatggtgaatacatataatggtcctttcttataatagacctgctgttttatgccaattgtatctgatcacatgccaacagaatacgtttgagatatttctagacttaaagatagttggatgccctgtatgggctataccaatttgcttgtgtggtttgtagtcttggcatgactggtgctgagtcccaaactagctaatgacattgtctaggctttgatgtataaaatactatatttggtgccctatctattagtgtctggtgtgtgccacatatcttatacctataggccctcatttgtcaccctcttccatgtaatcttgtcgatagcagcatataacatgtatcccaaaatcatcctttcttaagtttggggaatgggacaaatcgaaattaactcctacatctatcaaatcatgttaccgaaaaggtatcacacgtatcattacatacactatcacttttgtgccttaaatctttcgtttagaggagctgtgcctgaaattatatgatgtcttcagtactagcaacttgcatctcagcatggtttcaatcatgcagaatctatctatgttagagcttatgaggataggattgatctgctgagggctgctattgttgggccagctggaactccctatcatgatggtctgttcttctttgatgttcgctttccttctgaatacccacaatctccaccggtatgtaaccacttcacagttcacacacgctttgcaccattattttcatgttactaccatcattaatataatctctttaaaatcatatccaacatgtacagaaagttcattaccattcgggtgggcttcggctaaatccaaacttgtatgagagtgggaaagtttgccttagcctgctgaacacctggtggggtactggatgcgagaagtggggcaagtcaaaatcaaccatactgcaggtgctggtttccatccagggtcttgtgttgaatgataaaccatactttaatgagccaggcaacaaaaattcggctaatacagctcctggagaaaagtactcgttggcttataatcagactgccttcctactatcctgcaggacaatgatgtattcacttcggaagcctccaaaggtaactacagaacccccatctctcgtcaagtttaaagtggtaatttcacaagtctctgtgctggaaaagatagtaatagaagaatttcagctgtcagggttatatcagtgcttctacagtcatccagataaagtgaactgctctctgtgcctatatgcttttaaatactgatatacagttaggaactactataacattagtcatgctgtaccaaccgtacttgtcactccgtgaaactctttagcaggcattcagttgccaggagagcgattttccggcttgagaattgtgttgtgttgcgtcatgaaattgccaacttaaaaatttatctgtgggcacatttaactaacaaagacacgcattgtgataatgtgttttggagttttgacagtatgttattgcaaataaacagctgaataagtgagcgcatcagcgcaagaacatttgattttgaaacatcatcagttcatcaccatatgtacctatgaagtcctataaacacaattcagttccatatacctcttgcagatcgattcgctctcacacacacctttcattcactgcagcattttgagtcccttgttgcacgccacttccatgagcgtgagcgcgtcatcctggatgcgtgcgacgcatacatatctggcgcagtcgttggatcatcctctgcgaagggcaccaagcatccccgcgacaacaacagatcgtttgcagatttcaagaagtcactggagaagtactctgaactgctcaggaaggacttggccgcgaaccgcacacacttcctgaaactgacaagagactcgccggctgccgcagatgagatcgttgagtgtaccagcagctagaatcgtcagagcatttgaccattgcagttcacctgcctaactcaaaagtgaaaatggtgtatagatcatagcactcgttacacatactgtgtaggttttttgtttggaggcaagatcgttcggattaattatgcaagaattcgggttgagttcagtgctagccattttgtttagtagctgtttctggtgatacaccaattggatgatcgaaacgtggtccaattctgccagcttaggctttgaacctgctgcattttaaatttttaatagaacctgttgcactagtttatatatgcctatatttacgtggtaacagacagagcagagcgtgttctatctttggttttgaagacgtccattttgatgacgtctttcaactccagacattatttatgctcgaaattgtaaagtaccgcaaatttggtttatgcggaggtttagccagggttccaaatatgaaatgtaatattcacagtagacatatcgatgctggtctggtttgtgagacctcttgaacaacaaatcgagcta

SEQ ID NO: 63457 - DNA, 1558 bp, Oryza sativa
tgtgtgtttcttttgggacgcaaagctctcgctcgcggggagcttactgtgtaagcaacatgccgcgttgattgcgccttcttttcccttgggaaaaagaggccgaatcgtcgtcttctttcgcttgctttttggcaaggatgctggattgctggccacctcacttcgaaataataaaaacaaagtaggagtagtaaggtagacggtaaaaaaaaaaaaagaaaagaaacttcgacgcacatctggccatgtgaaacaaagaagaaataaaagcaaaaaattccgttgccgggactcgaacccgggtctctcgggtgagagccgagtatcctaaccagctagactacaacggatgctggtatctattcctgcattatacaaattaaccatggcctgatctgatccaaaccataaacacgggtcgggccgtacatccagctgatgcattatgggctgcacgcacactcgtcacagtaggaaaaggttaaattgaggtccctcatcttgtcatcttgtcggtgagtttcaaaatcgtctctcaactataataccatatataacttatccctaatctttcaaggtatcagcgtcgtgttacgacccgacgcgccgaacacctgcaggatggacaccccgtcgtgcccgatggcacgtacccgtatgcctcgaattgccacaccccagaagtgtacgtcttctgctcgaaacaacaaataaaatataataatcacaaaattttcaagaaatcaaagacgatgaaattcacagcatggaatttagcccccattgttcctcgaaaaaaaaatagcccccattcgttttaaactgtggaggacggatggtagattattctggttttgttacaattatttaagggcacaaatgagtgaattaacattgaacatataaagtattccaagaaatctgtatatatagttttttctttagaaaaaaaatgccctacccaccgaataaggtgctgtcaaatttagaaatggctccaaaactaatctttaaccataaatctctcacatatataaaataaatttctcatatattataatgtttataagaaaaatcgtaatcataggaaattaaattaaaatgtcaacccaataatattaattgcatcaaataaaatttaatttataataaaataattattggccaaatgtttaaagcgttgaatattaaaatgcgcgcgccttgttcagtggaacgaatggaagcgcggaggaacgaaacggtctccatggcgcagttgtcggaagagttccatgcctagctggctgctagtcaatcggtgaaggggaaggctagggacacgttatatatgatactagctgaaaccccgcacattgctgcgaaaatttagtatgataacaataaaaaaataatgtgtaagatagctagataatatcagattaagtaaatcaatatggtttatgataatttaaatttaaatagtatgtagaatggtgattcaaacgtaaaaagtaaggtggtatgactttatagaagaagaaaagtagggagatagtttgtaccgtagattatt

SEQ ID NO: 63458 - DNA, 1000 bp, Oryza sativa
ttcatattgatgttaatgaatctagacatatatatctatatagattcattaacattaatatgaatgtggaaaatgctagaatgacttacattgtgaaacggaggaagtagttttttttcttttgtgtctcttttagatttaattgaacatgttgcttaaccccacgatcattcggcccactgaactcaaccgatcccatcccatgatcatgcttgctaagcgatagctgaggcggagcgttgtttctttttcttttcctttttttttaatcctctttcttctactactatctctctctttttaccttcaggaaggctcttcatttgaacggatggctacgatttgtcatttctgttttgtcgttttctgtatcggatggtcaccgttttgttcattacatggctcatccaagttgctgttttgttcattacatggttcatccaagttgctttgagagatttactttttcagttaggtagatttgatgatttattttactacaaaatattacgtaattatcgtttattttatggtgacttgatctatcatgaaatgatctttaagcatgacttctttttatatatatttgtacaaaaattttgaatgagacaaatgattaaacgttcataaaaaaaatcaacgacatcaatatattaaaaaacgaaggtagtatcaaatttggcacagtggagttgatttgtgagggtgtgacgctgccgagagagagtagagagtgtgtgctcagaattggctcactcacctgcttgtacttcttcatgcggcacccatcggcggtctcgatgatgaactccgtggagaacaggttggcgagcttgacaccgtagccaccgccgccgtcgttcgtcgccttgttctgatcatcctcttcgtcgtcgtcatggaggtggccgaagaacatctccggcgcgtagacgccgcgctcctcgtcgacgagctcgacggggacgacgccgcggccgttatagaagacggagacgct

SEQ ID NO: 63459 - DNA, 1428 bp, Oryza sativa
catcatcttttttcccccaaaaccttgataaaacctggagcggcctccaatccttcacaaaccaaacaaattgaagcattggagcccgatccggattggaggtggccgcggccatgttacggaccaccggagcggctgccggaatggcggattaccagtggccggccggtgtcggtgaagcggcggcggccggtgcatgattgcacatgcacgcacgcacacaccgatctggcaacgaacaagctaagcactcgccgagtcgccggcacgagcggatgggagtaatgcgataccacatcaccatttactcctattgccctattggcatcacatccataggttcaggcccctttgattcaaaagaaattcatatgaggctgtgtttagatccaaagtttggatccaaactttagtccttttccatcacatcaatctgtcatacacaacttttcagtcacatcatctccaatttcaaccaaaatccaaactttacgctgaactaaacacagcctgaatttcagagaattttattcctataggattttttcctatatagccctttgaatcaaaggaatggatcctatggaatcctatgaaattcctatggattgtcttttcctatgcaagttttgcaggaaatttaacatgaggtagaacctcatggaaagaatactttgagtctttatctctccttaaattcctgtgtttttcctgcggcccaatcaaacaatcattcatatgtttttcctgtgttttgatttcctctgttttacacttgcattcctgtcagaatcctatgtttttcctatttctccgttttttcattcctgtaattcaatggggcccttatccttttctatttgcttcggttgcacattttttttaattacacattaaagcgcacacatactcattcttatgaacatgcgtacataaaaccctatcgtgtctgatcacaattttgagttttccattgcgaattgtatgagttcccttcgtagtttaaaatcggtgtgtaaatgactaaatgcacaccaaatccagtcgacacacccaaaacttggcaatatgaaaatcaccgaaattacaaaaaaaaaaggtgaattccgaagcaaagagtggccagtgtgaaactaactcagcgaacactctcctcacagctataaattctatgcttcacttgtctcgcttttgctccacttacaccaacagagatttgcgagtagattttgcatggcccatgccacgctcggctcgcctgagccggcggcaaagcctcggctccggtgcgccgacggccgccaccgccgccgccttatcgtcgtcctgtgcatcgtcggcgtggcgctcgccgtcggcgtcgccgtggcggtggcgatcgccgtcttggggaggtcgaggatgacgtcgtcgtccggcggtggccgg

SEQ ID NO: 63460 - DNA, 935 bp, Oryza sativa
gagtaccgcaactccggccccggcgcggcggtcggcgggcgcgtaccatggccgggccaccgcgtcatcaagctgccggaggaggccatggagttcaccgtcgggaggttcatcggcggctactcctggctgccgcccaccggcgtcgccttcgtagccggcctgaccgtgtgaggcgactctcactgactcatggtagcttaagccaataagttgcatttgctaattgggagataggtggtagtaaaagtaggtgtaatttttcaagtatgatgtaatcatctacacatgctaactgattcaggaaaattatgattaatgattagtttgtaggcttgaatttggattgagaaatgagaattctgaattgggcacaaaaacaccatgaatgtgaatgaataaacctgtgaaatattatacaataacgatattttttgcaatgttggtgtaatgagaaaataaattgtttgtccaactacttggtccctgcaagcaatgagagtgcagatgaaaatagtgtactagctagtaccctggaaataaaatatgccaaccaaaaagctccttttggttgtcacttaggctgctcacaatatcacagtgagaatatatgcttttctttgcattggatttccaggaaatagtacctgctagatgggtgtggggcttaccactagaagatcgaaagaaccaaaagctagcataaagagagaatatcagagagtggcttataattgatgggctattgccactaaattcctggcacaaattcttagctaaaatatcgtgtatttgtgctccttatcttgtatgtaggggaataattgtgtatttgtgttcgacaatcttcagctattttttcccggcaaagcagtagcattgtatcgttatcaacaatgacaactgataaaatctaaacataaacaattggatcc

SEQ ID NO: 63461 - DNA, 1726 bp, Oryza sativa
attaacgttataatgcattttagttttaaggaatgtttaagataaatactttccaattttattatgatgtatggatcaagtagtatgatgcatgaacttcattggcggatctaggaggaaaaaaattaatgatggtttcgtggggttctcatagtggcggttctcgaatattttttttttttgaagaaacccatgcatgaagccaaaaatgtcaaatgtgagagaagtacgaaatggtcagtatctaacctgtggaaaatatggtcacattaccattagtttgagggcggacatacgttcagatgccatttgttgcccaaaagaatcatatctgtaaaaacaaaaatttgaacagatacattccgatttgcctatgaatgaataaaaacactaatggacatgagctaagggcgtttacagtgcattgagttggcattcggcctcagcgtttcccaataaatatttcgtgttacgttcgcttctgtcgcacctacttgaagtccccgtatttaactttgatcactcgttcttcagcctaatcctgggtaagtaacgtggggagagagagagcatcatcctgtggaagtcataaccccgcttcctccactcctcaaccgcatggggatcagatgtattatgaatggcataagaaaacttaatgtacttttatcattttccatactcctttcgaaagacttgtggcgatgatgccgccaacaccactgacgagtggggccatgagagcagtacaaatgtgagtcctcttgctttgtgtgttgcagtcattgctcttcctctccggaaagaggaaattgggtgcttctaatcgggttgcaaccctttaatgctatattgctttgcttctttctcacctctattcaagttaaaaaaccatgaaaatttaagtttcatttgtacatttaagttaattacactgcacaatttgttagtaatgagaatttcattgccacgtgaaaaagggtttatgtctcactttaagaactatactatgtcccttttctttttgtctttttaagataaagaatcccatttcaaccaaatagaagcaaccatttttttctcaacaaaaagactcgttttttttccttatatataaatcattgcaatacacgggtatttgaccagtaaaataaaatacaaggcaaagcaaggaactcatgcattccaccataaaatataccactttctccgtttcacaatgtaagccattctatcatttcccacatatatattgatgttaatgaatctacatagatatataatattaacgtgggaaatgctagaatgacttacattgtgaaacgtagggaacatctgaattggaaacatatggaaatgcaagcttgctaaaagaaatgacaaatttgttatatgtaaattagaacaatctgaaaattactgaaggtggcatccggtattcagatcacgcctcctttaccgaccaaccaaacaggcaccaagaacagggtgcactgaatgacggagtctgaaataattaagtagtgttctgcatttcttcctcgcatttcctgcactgcttacagcgcattcgccccccaaaatttacaacttctgttatacgatttaccgtgtaaaaacagcatcctgattcctagacaggtttgctgctgaacagttctagataggcactgagctgcgtggtagtaactgaagaaatgtacacaaaaatgtggtcagtccttga

SEQ ID NO: 63462 - DNA, 962 bp, Oryza sativa
tgaaaacctgatgccgtctattgcttcatgaactagattctgggtatcatcatgagccactttgctactgactctagtagtctctggatcctccttaggcttggtggcattatcagtagcttcttctgtcatgtagaacacagcacatgattcgggagattcaatagttagtgtatattcccatgtctaacacatttcaaggtgcaaaactaacaacataaactttgactcactagatatcttccgtttcttgcaggcgtaaaaactcttgagaccgggtgctctgtcagttgggctgatgtttttatctctaattatatgcacctgaatgtaaggcatgaagaaacaagaggtaattgtattgttggattagggaagactgaacccacaagggaactcaagaaatgggtatgaatgaagattataaaggaacaatcaagtagtagtagtagatttggaagaaagttatcaagcatttcagaaacacttgccttgaattttgttgtgctcacaagctcaaagaccacaacatcgccaaccttgatatcatggttaatcgcaaaacctctccatccagcactgagtccctgcttaccacccaggtaatttgtgttatggttgttcccattctcatcttcgagcacaatgtcagtgtcatgctttgggagatacttgttgcagaagccagctggtagaccctgcagaggagaacaataatcagatgcagagaaaaccaaaaagaagtttctaggtggcttgtgcagaactagtgtcagccattttcataaacacaataactcaagcagtaagagctaacatgcaagaaatgtacataagttggatataacttgtatgtgtgagacttctcttcctaaaacaaaatttaatgaaaaagattagaagtttagaacatgttaatagggtagtaggaagttttaaataagatccataacacgctttaa

SEQ ID NO: 63463 - DNA, 1037 bp, Oryza sativa
ttggcaaagatttttgggaaggaccttaaccttggccggccttcagcaggcccaggaactggcgtgtcagaggcagatgaaaggtcgtgggaacaaaggactggtggtgggagctcattgctccccaatgtccaaagaggtttgcagaatttcacttggagtcaggctcggggcctgaattctcatcagcagaagtttggcaacggtatattgattgtgagcaatgaagccacaccgcgcaacaatggaggagttgacagctctactgcaacacagtttcagcttcagaaagcaccaccacttcagaaactaccacagctccagaaatcacatcagctagtaaagccacagcaactagtgagtcagcaacagttgcagcctcaagctcccaggcaaatagatttcagtgctgggaccagttccaaacctggtgttttgactaaaaaaccagctggtattgatggggatggtgcagaggtggatggcttgtgtaaagacgaaggtccgccacctgcattagaagaccggcggcctagaaagaggggaagaaagcctgcaaacgggagggaagagccactaaatcatgttgaggccgagcgccagaggagggagaagctcaaccagcgattctatgcactgagagccgttgtacccaatatatcaaaaatggacaaggcatccctccttggtgacgccataacatacatcactgacctacagaagaagctcaaagagatggaggtagagcgagaaaggcttatcgagtctggaatgatcgatccgagggatcggacgcctcgacctgaggtggacattcaggtggttcaggatgaggttctagtccgagtgatgagccccatggaaagccaccctgtcagggccatcttccaagctttcgaagaggcagaagtccatgcaggggagtcgaagatcacaagcaacaacggcacggccgtgcattctttcatcatcaagtgccctggcgccgaacagcaaacgagggagaaggtgattgccgccatgtctcgcgtgatgaa

SEQ ID NO: 63464 - DNA, 1154 bp, Oryza sativa
agagggagcattctgtgcagcagcagcagctcatccaactcttctgcttctgtggtgaccaaggagcaagaggcagttgctgctgcttcctcctctcaagaggaaggagtagcagtttctgagactgaatttgtcagctacagggatgaccccaacttcaggtaaatatatatgcttcatacttgtgtgtatacgtttgttttctgagatggagcttcatgtttcagaatctataattggcatgttattagcatcaatcagtggttcttggcttccattttaatgtcagaataaatccttggaatttatgtggaaatgggttcctgaatttgatataatggatattagatttgttttgttctccgtaccaacgaatggttccatggtctagcggttaggacattggactcttaatccccctattttttttcatcttattcatatatattggctagagtggctgtgtgtgtctctctatatatatatatatatatatatatatatatatatatatatatattggttggagtggcaagcactttttttccattcatctctacatatattggcttgagtaacaaattcatgatttgtaagccaaagctcttttttgtctttttgtaaaaaagaaacttctgaagattgccaaaaaaaaaaactactttatgtacatgtagtaagattcttgtatcaaagaagagagaaattcaaaaataccagctcaactttttcttgcaccttcttgacaatgccgtgtgcgtaactgcgtatgtatatgcaggggatgcagagggtgcgggcgggaggaggtggagaggggttgcaacggcgaggggcggatccagggcggcatagccaccgtccccggcttcgggtggtggcctatcaaggcgtaccggccgtgccccggcttcgtcgcctccggcggccggtaccggaggcaggggcagagcatggacgatgtggcttccggcagagggaagaaggtcccctccaacaacaaaaaaaatacaaaaggtattactactccctccgtttctttttttatgatgttggttatcatcgtacattttagaatggagggatttcttttttatgatgctggttgtcgtcgtacattttgggatggagggattttttgtttttttataatg

SEQ ID NO: 63465 - DNA, 3751 bp, Oryza sativa
caagtaggaggcagtgtgcatcaccaaggatggcttccagaattatttcagatttttaacattctctaggctggacaaggatgttcaaaacttcaaccccagcctgcaaaactctgtagctgacgtaatatcccagtgcctcatggcattcatgggttgcatattgctaccaggtgtaatagcgaaattgtatcgaaactttgaaagtactactatcctatgataagagtagcaatatcagattgttgatttactggcttgattactattgagccttgacactgcgacattattggtaatgctgttgctgaatgtattatgaacaacggcaaaaaacattagactggtactccctccgtcctaaaataaaatcatttttggcttcatctatttattccaaaataagtttatttttaagcaagtagaggataaatgcattaggaatagataaattgagaaataattacattgatatttgattgagggtatttttttaattttgtattggtatatgtgtaggatagatgaaaaataaacttattttgagacggaagatcattttcagaatgtatacaagtatacaaccaaactttaaaaatgctggacataaagtataggctaacgttattatgattagtcatttgaaaattgaatcaaacggcaacaccacgcatgcaattgtgttgatgccagataaaggtggtgacaccctagttatacatctatctctactacagctttggatcatcatcacttaaagatcagcaagagaaattgaaactggtaaattctcatcaaagttgggtttcttcattgatgataaagctgctttctacaccatgttcaaaacaaaaattccttgcatcatccagcaggaaagttctgaaaccacacgcatttcaacaaattaatggagaaggtacatcccgtttgcatgttccttcaattcttcgctacctgctctattatcttcctctaacaaagatgcagaagagctaattaaagggtattcttttgacaagatgcaaaagagctgatgaaagggttaaaaaaaaactaagagagtataatctgttgcaacttgcaactagcaaaatgacagactaacttagcaacatatggtatgccagtaacatcaagattgttttttttcctcgaatgccatcaagattgttgcacaatgcattctgacggcatgaagccatcaagccatcatctatcactggcaaactccaatctgaaggaaatgcctagagtcttatgctattaccgcaggtggggaggccttgatccaaatggattgcttccaggagtagctggtgaaggaattgtcggtgaagcctgcgatgctctctgaaaaagtgaagacatcagatccattgtcgtatcaccattttccattcttctgaattcaatatattttgggggaaaatagaaatttgaagaaaatacatatcataaatgatgggcacaaatgaagtataaattaaatgcaatttatcctcaaagaaacaatttgaacctggacctcatcctagaattcgccagtttccacacgggcaagttaaatagttagctgactgagattttaccctatccaagaagaatatatggacaataatttacagtattgctcttcaggtgtcttaacagaagtatagcttgtactagtatgttacaatattagatgctagttcatatgtaagttaacattgctaacataagccatagaatggatgtggatcctgctatgcactaatgcacatgctacttccattcaatcagccacaatttgatcaaacaaacgatcatcaattgactgcagcaacaaagttatacttcttatatcatcaaacaagttcttttcttcaaaatggaacatatactatctagaagacccctctggcctcccctttgctctcacaaggcagctacctgcatcctacatctagtttcaggaaaaacaaaaaccaagcttagcgtatcagatagaagacacgtctgacctcccatttgctctcaaagtgacaaggcagctacatgcatcctacaaacatctagttttggaaaaaaaatattaaaaaagctaagtgtattagattctctagcagacccctccagcagtccggcctcccctccgttgttagaagcaagcgacctatatgtgtacttgctacagtggcacttcatagaaatagagaattctattcattatctaactgtaactccggatgacaataaattactaataaattagtacagtcaagaaaataacagaataaattgtaagttcacctgtaacattcctggttgagtgatataagccatgaactgttcctttttcttgctgaacaaatccttaacttggttcaacaaatcttcttgtctttttatatcctcgagaagcctttccttttcccaattcttatgtttaacttgctcctccagttcagtgatagttacgggtaagtttgagaccccaagatttgcagttacaggaaattgtattcctaagcttgcccttcaaaagtaaggtcatgtataatcattaacaaaaagaagaggtggaattaagcttaatatgcttgttacagaacagtgcaaattagtgttaccagactttatgtagtaagcaaaccagggtaatgtatcacgcatatactcataaaatgaaaggacaattaaatatcaccgaaggacccacaatatgcagaacactaatgatcaaataaaagtatatgatgtgatgttaaaggataaatccatataattgcatacctattacctaggcagaatgagccattaggtcttagtatagacccatcaagagaaacagcaccatcatttatcaaaggaatagcatttcgcaattcagctctagtcttatagacttgcaactgagaaaacaggctgtaaaataaagtttccctaagaccgtggcccccagctgtgagacaactcaaatttgcctggtccaaatgtatcatatttactgcaaaaccaagaaaaccaggtgggaactctccactaggcaaccttggtttatgcaaaagaagtttcctctgaggatcatcgatcataaaatcaccagaaaatggcctgcaaagtgtaatagttataatgttgaagtgtccatccagcagagtccaacttataacggcacaatgaaaacacaccttatattttcaagacaaaagacagtgaatcttccatctaaaaattttccaattgtgcgacctagtccatgaatgccactggttttatcaaccataccttccttgtcatatgtttcaagaccctcgacaccatcataagtcttgcagacgacaccaagcatattgtccaatcccaagtactctgagagtaccctataacaaattcatggtacctcaaaagtaaacaaataattctgcccattaactttgcaccagttggtgcaataaatcttattatatgtcaaaacaaagagagaataatgacctgctgaggttgtcattatttatttttcccaaggtagctacgacaccaaggacatctttcatcagtggcagctttgatgcatgctgataatgacgaatcttcagttggcatataatcccagctgctgtctcgtcctgtttgagtatactttgaatagtgcgttgttcagcttcttcaacagatgtgtcattatttgcaattgccgccatcgatgaataataattgcctattttaactgagaaaagttccagggttcagcatataaataggg

SEQ ID NO: 63466 - DNA, 3173 bp, Oryza sativa
tggatcatttacctctttaagacagatcatcattcactctttccagcatattgaagacgtacaaatgagacagaataacctgatgtcctctgactatctgcatcagcaccatcattctgatcttgttgtgccccatcttgatccgttctggacagcaatgcaacaatactgtcaagcaatttgccccaagtttgggctgctgcaccatccaacagcagtgcagattcacagatcaacttcgttgatgcaactgatgtcagcttaacttcaacagtccctttgatgaatttaagattgggaatccaaaagcgctgaaggattgtcatgaaaatatttggctgaattgcatcgacagaactgacaagaacacctggtccatatttaaccaccaccaaggacatgaagaccacaagagaattcacaaacttcactgcctgccttgtctgtagtcgagtaaacaaagcactccatatctcatttatgtgaggattcatgatgtcaaaactcacattttccacaagtgtgttaagcatgtagaaggcagaatcttcagtactgctccgcgaaaggagactgcggaatatcactaagatattcggtagcctgccctcttggttaagctcatttggaattttccgaaggaatgctctcagcaaccgaaccaaggcagggacacacggtggacggtcccaggtagcattactgagcaggacaccaaacagctgcatgtagttctgcgagagaggtggtcggctcaaattgacaagttgtgcaaatatctggaaagcatatggccagaactctgagatgtcctcaaccaatatcctctgaagcaccgggaagaggcttgcctcaaacacaggaagtagtgctgggtcctgctcaccagcccgaccaatcactgctgccagggcttcaaacaagtaatggttaaaatcagggttcttggggttattgcacacttccataagaatacccacaaggcgagcagtaatctcatgaacaatttgcccagcaatattagcaatcccaagcactctcatcaggcacttcatcagataggggttctcatatgattcaggaaaacttagtgccttggacaggttctgaacaatcggctgggcatatgggttgatatcagcagcaacatagcgtggagccctggtaatcacatttgcacttggtactggtaccatatccttgatgatcagaaggttctcaataaaggtcgcagcatatgaatggacaacatttgactcgtgtatcaggaaccttattacacttggaagcagtgccagtgcagtggctttggggatttgatccttgaattccttcaagaacctcagcacagttgccttcagcattggttcagattcccaatcaggggcctgcagctcaggcacgatcacagatgtaaagaagctctccatatcaaccaccggtgtcccacctcctgtggcaccaggcttctgcataagagaaataacaaggtatattgcagcatccttctctttccagttgttcgtccgatcagctgcatatgcagccaacatctgctggacctgtgctgacacaagtgcagccacctgctcccggtagtttgccgcaagcccccgcagcaaccggcatgcagcccgcctcagtgtatccgcatcactcccctcggcatcacgcctaacatattccacccagttcccctcaaacagctcctcatcatcatcccgtaaccgcaggttaggaattacaacactatcgcatatctgcttcattgcatcagggctcccaaacagcgcgtggtgcacgctctcagcaaccgttgtcaaaaatcttattgcggtcaccgcaagctgcccgcgggatggtgagacagatggtgccatgaggaggccccagaccgcctcaacgaactccttcagatatcccctgaactcctcttcatacttctccatgtacagctgcaagttgtcacacacggcggcgcggagcgcatccggggcgccgtctgcctctatcgctggcgggtaggaggtggtgaggaacgcacggaactccgtcatccactcacgcatgtggtcctcgaagaactcgggcaggtcgatggagttgagcgaatagaagatctcgcagcataggcgaaggcactcaaacaccgggcgggattcaggcggggtgaccgtgggtgcggcagcctgaaggcggcgggaggtggagaggaagacctcgagtagggcagcggcgaagttctcgaggcagtacttgaggtcgaggcggatggtgttgctgtcgaaggcattgcggaagcgggagaagagggaggccgcggcggcgaggagggagttggtcgccgggatgtccccggcggagagggcggtgccgagggaggagacgatggaagggaggagcgactcccacctggcagggaagtcggaggccgcggcggcggcgagggcctcggagagctgcgcctggatgaggggcggcgcggtgaggaggagctggaggaggttcgccttgatgatggcccagtcggagggcgggaggtggtcggcgtcgtcgtcgccgccgccgtcgggggagggcttgggccagcggcggcggaggaggttcttgaactggacggaggcggcgagccgcgactgcgggtcgtggcgcggggaggaggcgaggccgaggagcgcgagcccgaaccccggcgagcacttggccgactcgatgctctgctcggcggcgcggcgcgcggcggcgtccggggagagcgactgcgcgaaccaccccgacagggtgtcgagcgtctccggcgccacctccattcccgccgccgcggcgatctagcagaaggcggctagggtttcgtggagatcgggagtggaggtagggtttttgaaatttctcgtggggaaggagagagagaggagagagaagaagaagaagaaaatgcttttgcttggtcggtcgatgcgaggaagagatggggaaagaggagagagctgagccgttggatttggccgcccttcttggagaaggaaaaaggctgggcctgtgggcccctgggatcctgggcccagcccaccaagcttgctagcccatctcagtgaggtcttgtgagttgtgacggctcaccgccactcgttggggacgcaccatcggaggcagcatcggcacggggattgatg

SEQ ID NO: 63467 - DNA, 1061 bp, Oryza sativa
tctattcatcatcagccatgccaaaatttaaattttaaagcttaattttgaagatgaatttgaagtttcttcatcaaagtttattttttagcattggcatttaagtcgctaagaacatatatataaaaattttcccaacaatttactgtattattattttgctaatatgccatatggcatattatccgtattatccttaggttctgcgaagacaaatggttgggaaatgtaaccctgcgagaacagtactcgttcctctacaacattgtcaggcacaaacatgcaactatcgaagatgtctttcaaaatggatatcccaattttcatggagaagggatcaaattggatcgaagttagtcacatggaacaccttatcaccacacatcgctaatattggtttaatttaggagcaagatgagtttccatggaagatgacccctaatggacagctccatatggagtctcattatcatctctagtttatagtgacatctcgaatataaatagacgcccttggaaactaaatatgccattgaaggttaagattttcctttggtaccttcatcgtaaagttgtgttaacccaagacaatctagctaaacataattagcaaggcgatcaaaactgttgtttatgtaataataaggatacaattaaacacattttctttgaatgcctcttagcccatttagtttggtccatcatttttgtggcgtcaagaattactccacccgatagtgtttcacaagtggtcactagttggctttcgggttttcaaaaagatatgtaaccatatgtcctgttaggggcgactgccacatgctagttgctttggttacgtaagaactatatagtttttgatagaaaagttatttatcacacatgcatgtcatatttgtaactatccattggatgcacacctaggttattcttaaaaagccgagctcgtgggatttggttattgcgacgtgtctacacttggagcgggtggtcaatgagtgttttaactagggacataggtggtgatctagtcttaggatgatggtccttgatgcttcttg

SEQ ID NO: 63468 - DNA, 976 bp, Oryza sativa
ggctagctaacacggatcgccatggcggcaacatactgattcgtaaggatgagaatgggcagattgagctgataccaattgatcatgggtattgtctgcctgaaagcgtaagtattttgttttgctttgaactgcattttttgtactgaaaattgaaatctatgatcacccatagtcactaatcgccataaagagttgctcactccatgtcaaaaatataagctgtataagtttcttacactgtcttcagtgcaaaactttgacctttaattccttgtatagtattaatatcaataactataaaattgacataacgtgaatgtactttcaaattcaaatcttatgatgccacatgcttgacgctaaacatatgtaccgctagttcaattattagtcaatgtttgcaaatgttggcttcctaaaattgcgggaggcttatatttcaggatagagggagtaattttcacgaccacacactatgtacacattttaatataatatccattgctaaattttttgtcctaatttggttactagcaatgattgttttctcatgttgtaaacaatgtttgaactattttagttttagtaattgatttgacttctaaacaatttatagtttgaagactgcacatttgattggctttactggccccaagcacgccagcctttcaatgttgaaaccctggactacataaagtcacttgacgaggaagaggatatcaagttgctcaagctcaatggttgtgaaccatcatctaagtgtgttcgtgtttttcgtctaagcaccatgatgttgaagaagggtgctgtgagaggtctaactccatatgagatcggtaacatgttgtgtagggagaacattacaaccaaatcaaagattgaagagattgttgaagaggcagagcatgttgttcttcctgggataggtgaaaaggcattcatggaagccatctcaggtatcatggatcgctat

SEQ ID NO: 63469 - DNA, 1081 bp, Oryza sativa
  unsure (1)..(1081): unsure at all n locations
aagaaggccacactaggaggctaggagaggcatcgccttaagtcggtggtgataatggacgatgacggaagatgacgatgtagtagtttggagcaaggcatacttgggctaggggagggtgggtaaggtggcactaggtgcccgggggatgtggcgcttgagttagcgatgatgatggactacaacaacggtggcgctgggacaaggcgagctagaggaagtgcgtgtgagtcacgtcttctcgcaaaggtgataaaggagagagaaagagaggatcagcatgggacccatgaatggccattgattatggctggcaattttgaacatcaaagggaggcatttggccaactggttggcaagtattttggaggttgattttttgatatttgctaaaatttagcttggagagccatctagtgagtctcttagtgttgctctaaggatttaatcaaggaacctacaataattctatagtgtaatgaaatctcaataccttgacgaataagatttacacacgttgggggtcttgtgctacacctaagataaaaacttgaatcaagtatttcccctccactagcatgatctctgctgagtggtttggatcttgacacttcactatataaagcatcgcttgtcgacccagactaaccataatactccctcttgccgcttcccccttcttccttcattgcctcccctatttcgtgcgatgccttcaaactccaccatatataccgacgagtcctatcggcttccttcgttactgccaatcctctctctagccctcatacttttcataggagactagcgacaataagattgttatgcccttgttacacatgtttaagtcgtttgtgctcgtcacctcaacctcccctgcctctagggggtggtggcgagggttgctagtgaagttgggcgtggtactatcatggaaaccaaatntttttccaactcgacgaaggtgagaaggggcacaaatcttcatgcacatggaaggtaactgttaatagcaagattttgttcttaaaaaactatatgtgtataggaaacgaaaacattagttgtgttagtgtcaagc

SEQ ID NO: 63470 - DNA, 4374 bp, Oryza sativa
  unsure (1)..(4374): unsure at all n locations
tttgcgacgcccacttcttctccaagctggatctccatttcgggtaccatcaggttcgcatgcacccggacgatgtcaacaagacggcattccgcacacaccaaggccatttcaagttcttgttcatgccattcggcttgacgaacgcgccggcgacattccaggcgctgatgaacatggtactcgccccattcttacgccggttcgtcctggtgttcttcaacgacatactgatctacagcgggacatgggccaacaccttcagcacattcgggcagtgctcagcgtcgttcgcgccaatcatctcatcctgaagcgctccaagtgccacttcggcgaacagcagatcaactacctcggccatgtggtgttcgcaaacagggtggccatggatgtgcagaaggtgtgcgcaatggcatactggtcgcaaccctctccgtgggagccgtccgcagcttcctcagcctggctggatactaccgtaagttcattcgcaactacggtgcgatcgcagcaccattgacggctatccttaagcgcgaagcattccacttagggatgaaaacagtcggaaacgatcggaaaatagcctcaaccatttctgtaaccatatttttctcggaaacgatatcggaaatatcgaaaaaccggaaacggaacaatacggacggaaacatatcggtacagatcggaagtcggtaacaaatacggaaatattaaactataaaaatatatatttaactttacataagtatgttatatgtatacataagtatagacatgccctataaatatcgatatatttagaatacggtaattaccacattataagaaacggtaatttccacgagaatacgataaatacggaaacgatcggtataacagcaaaaccatttccgttttcatttccatattttttgccatttccatttttgtttcggtcgattaccatttccatatggctcggccggtagaaagtcgaaaatgaacgtcggtcggccggtaattaccgttaccgttttcacccctaattccattggacgccagacgcagcacaagccttcaccgagctcaagcatgccctgtggatgggtcccgtgctgcaactacccgacttcatcatgtcgtttgtcgtcaaagacgatgcgtcggggtccaacattagagtcgttctacaccaagggacgggcccactagccttcttcagccgggcagtagcaccacgccatgccgggctcgccgcctacgagcaggagttgatcagccttgtccaagccatccgccattggcgcgcatacctctgggaacgggcgttcctcgtccgccccgaccactacagcctgaagtttctcttggatcaacgcctttccacaatctcgcaacatcggtggtggtaagcaagctcattggttttgactttactatagaatatcgaccgggtcgcacgaacgtcgtggcggacgccctgacccaccgcacgaaggacgccgagctcatcgccttggcaatctccgagctgacgttcatggcatttgacaacctccggagcgagtagggatggcaatttgggaggggagggaacgggggacatatttcacccgcgggtgacctctcctctcccgtacgcgcacccacatcacataggcggaggcagcggagcacagggcagcaggggcggcgcactgcgcaccggcaccatgcacccctcgccgtccgctccctctcccctcccctcctctctcttccagcctcccaagtcccacgaatcggcaccacgcactcctttggtctcgtcgtcccggtcgccctctccctctcccctgcggcctctcgactacctaatgcggggccctagtcgggttgcggggccctagaggggtcggggacggggcctgatttggcccacatctccagtcggggccaggggcgggggatgtagtcaggggtcgggggcgaggccgtttcagcccaactcggccccgccccgttgcgatccctaggcgtgaggtgaccacgaacgaggacctagccaagatcgccgctgacatttccagtggcacgctgggttggttgggctagccatgggctttccgtggcggccttatccttcgcaatgaccgtgtccgtgccgacgtcttccccgacactgcccgcgctgtcgccgccggccccaccaccggccacgaaggcgtcgagcgcacacttcacaggctgtgcacggacttcttcacgccccatgccaagcaagtcgtccaagaattcatgagcacatgttcaacctaccaacgcaacaagaccgaacaccttcatccggcgggcctgcttcagtcactgtcggtgcccacgcaagtctgggaggacatcgccatggacttcatcaaaggacttccccgcgtgcacggcaagacaaccatcttcactgtggttgaccgcctctccaagtacgcccacttcattctgctcggccacccctacacggtgacgatagtggcgcgtgtgttcttcaacaaggtggtccgcctccacgccatagttattaaaaccggaccggagaatgaaccggtcaagctctcggttcactggtctagcggttcaaccactggttaggccgatccaaccacgattcgatgtattataggatgcaaatgtcttagaccaacaaaagtgaacagatggtgtggtggctagcgcgtgcagcgctcaaccacatgacccaaggtcaaatctccccacaccaacgtccttttccaccgatttttggctgagtttgctcagcgggcctcacgtcagcccatcaccaaaagacagcccggtctgaccactccggtttaaagcccggtttacataaaaattgaccggttcaaacggttttctccggttcaattacacatccgatcttttaaggggaccagaccggctgaggccctagttccggtttttcccggtcggaccgtcggtccagtccggtcttcataactatgctccatgcatctcaagatccattgtcagcgattgctgatcgggaccatgttcaccagcacgatgtgaatgtaactattacacatggccgacatcaagctcaacgtgagttcagcttttcatccgcagtgcgacggccagtccaaggcagccatccgagtcattagcatgtacctcaggtgcctgaccnnnnnnnnnnnnnnnnnnnnnnnnnnatggcttccgtgggcagaatattgcttcaacacggtgttccagagctcgctgcgcacgacgccattccaggtctgtgtgtatgatcacggcacagcacgtgtgcgcgctgtcaatcaagccctcgtcgagcgggacgaattccttgaggaaatccgggaacacctcctccaagcacaggattattggaagctctactacgaagagaagcattgtgatgtcaccttctaggtctgtgactgggtctaggtgcgtctactccatcaccaagcagcatcccttcccggcttctgtccatagtggaaaaaaccagaccgggccggtggttcaaccaggaaaaaccgttaccagaggtctttctggttcggttaaaaaaaagtcaggacatgcatgtgacccgctttgaaccggctgaatcggacggtttttctatgaaccggccattaaaccatcaccgggcagactctcaaggcccatttagcctgcaaagagcgttttggttggcaaaaatcaaaggcccatttagcctgcaaagagcgttttggttggcaaaaatcagaggaaatatgcacctgtgggggttcgacctctggtctttaggatagaagcaagcggcgtagaccaccgagccatccaagcagttgtgatttagcaattacatacgttacacatatatgtattaaatcgcggtttgaccgtccggttcacggttggaccggcgaacccaaaggtcgaccgggtcacccaccggtccggtttttcctactatgcttttgtcgcaacaagttggcaccatgctactacggtccctaccaagtcgtcactcgcgtgggcgatgtggcatgtcgcctcaagttgccggccggtgccaagatacatgatgtattccacgttgaactcctcaaggtgttcaaggacacaccgctagaccagctgcctgcgttgtcggcgctctcgaacgaaagagtgctcccgcttccagctacggctgttcatggtcaattgacgcgccggagtatgccatgtgctcatccaatgggccggcaaaccggctgtcgatgcaacgtgggaagacgaagatgagttttgtcgcacctatcctacgttccagcttgaggacgagctgtttgcgaaggaggggagacatgtcatggtcggcatcacgtattcgaggaagcgaca

SEQ ID NO: 63471 - DNA, 1630 bp, Oryza sativa
caagttataaaataagtttagataaaggtagtagtattctttgtgcttctttcacatttatagtatagtggctaatcgaatattatatattttaaaacaaaaaaagtatacgggtttttttttcataaagaaatttttacataagatagctgttgtaccgataccaaagataggtaatctgcatgatatggaacgaaccgtatcctctgacattactcagtaatgtcacggtgtggcattacttcaatccacaccatccattctaaatcaacggccgtagattatttgacatgcaattaatcaaactaattagtaaattgtgcagctataattgtccctagatcagatattgcattttcaagaggcaaacatcgttgactggtggaagaatcggcacatgatgataattaggtttcacttagtacttgttagatgcagcgattagcacattatcctggaggaagtgaatcctgtgcatcaattttgtgctgccacatcctctgtcgtcggaacggggcaattcttaatctacaagccgatgggttaatgtttaatgaagatgaagagactgctttagtgttaaaaaaaaatccttcccacctattaagtacatacctacatagtacatactctgctagttagtttgattagttagatggagtaccaattaatctgtggccgttgatttagattggatggtgtggattgaagtaatgtcacgcggtgacattatacaatcagaggatacggttgggatatggaagggtttgtgttcggctgcaacacagctagcaagcacaataatttatgtctgtggcaacggatatactggctagttgtgttgtgtatactatatcaaacagtcgaatagaccctctaaaagaaaagagatgtagatatgtttatattttgatcttatcgatttatcattaccaattttttaagggcacaaaataaacaaaatccgaccattattttcgtgctaaaatatgatagttttggaagctttctttcttaaaagtatactaaaattttgtgaacttttaaaccaaacagagccccatactaccaaaattcgaaaaacttgaaattatgtcatcgtaaaaataggtttaacctaaatatcattatgtaaatgggctttactcttataccatttgcaaaaagagctgcacactagaaatgcccttggaccttcacttcttttctagttctggctgaacctcatcatccatgtcttctcctcggggggtgtaggctgttgtggccacctcatcccctcactgccatggttcctccttatgtcctccatgtgaagaccctcctctaccatgcttgttgtctggatccgtcctttagtccttgatgtttcactaccgtcctaggcactttctcgcactgccaccagctcaaggcccaatgctcaatcacaagtcccgccaacctcctttagcttccacgttgtcgtcctcatccagctctcgcgttgtgatctcttcaagcccatgcatcattgtcctcgtcaagctcctatgtagccacaacctcctcaagttcctggtctcacggaactccagtgttggctgtcctttctcatcatgctcatgtaccaactgtcctttgtggagct

SEQ ID NO: 63472 - DNA, 1078 bp, Oryza sativa
ttaaatggtcactttatgtgttaactgtgaattttatccaggtctataaagtactatagatgttaatatatttctctataaacttgatcgaatgagagaagttttgacttaggacaaaactaaaagaccttgaattatggaaaggagggggtatttctagcttatgtttcttttttctgttaatgctcattaacatctggtagcccctataataatcaagggttaattggatctatgccattataagaatcatgtatttaccatgatatcaagaatatatgttctttttgtacttgcagaattataatcttgcttttgttgttgctccacaggctataataattgattgtgatgaagatgatacggatgacgtgatggaggttgttcctttgaaagtaagggcagtgctgctttagttagcgggtggaattttgtcactcgagaagacatccccttgttttgtgcatgttgttcaaaaagtcataaaaaattgaaaacataagatagatcaatatgtaaaatatctcttcacaaacatgcaagttcaaattcgacctatacaagtagaaaaacaaaaacaataaatttgattacaaatagtgtgttttgttctatcgtgtcacatattgatctataatgtcaaatcttcttaaacttttttatgatgttttgggcgacatgcacaaaacaaggggatgtctcctcaagggacaaatagacttttccctttatatgattatctgtttacaatggtgtaagtttatatgatataaactacatgtgctctatttagagcatccctgtcaatgatgctacatcattgatagcactctatgtagcaacaatattttcaattgcacaaactcacaatatctgtcctccttgttatctcataacttcatttattaattctcatctcaaaaacaacttattgattaagtgttctgatttttcttggatttcttactgtgcaagatgctgatgccaaaggaggtggaaaatgagcaaagaacggttcctggcattcctcaaacatgcaatacccagaacactagcaatggacgcactaacaccactg

SEQ ID NO: 63473 - DNA, 1240 bp, Oryza sativa
ggtacagtagttcatcaggcttgcaagttcaggaatcttcagtttgctgattgcatatatctgaaggctgtttgcacaattttcttgctgataatgtttattcacgttggtaatctgtcttttttgcaagcagacacgcaaaaaaattcttattcgggatggggttttgtttcaccaaatgaatggcattcgtcacaactcttcatcttctctttgttttcccagcctggtgcacattctatcgtctcatctggcattgtctataagggtcaactaattagatgatgtcttgcaattcttttgtttgttcttcagcttgcattgggagtttaggtactaggaaacggttttctgcgtttagattgcttgctagtttcgatgtgtgttgggaaaaagagctcggaagcgagctgcatgctagcggtccatcatattcaggtgtagtttggccatcaccaatgtgcagtaaaagtttcacaatcacccaattaagcatgttgatgaagccactttgacaagcagcgaccaaacattgcgtacctgtgcaccgttcctaatttctgctgtctcttgtgtaaggaactaagccagcttagttggtcgatagctagtgtgggtgtacacctagaccaaaagttttatcaagttgaatttgggtgcctattttcttgttaaactagatgaatatcccgccgcgttgctgcgaaaaattacgttgcataatatgtacaaatgtaatttgattatcaaaatgaaaataatttgatacaattttgagtctaaaaataattaagattgcatgttttaagatagaagaaagaagagacaatttggaccatagctctatcatccaaaggctagaaataattaggggaatatagcttaatgagagaagagataaataatgtattaactacacttaataagaataaactatagtatataagattacaaagtcgatcctaatattttctttatcttcttaaaataaacacaatgaactcgcatgtttttgtcttttctgtttgaatgatgtatcacagaatgccctgcaaatttgctgacctttttacctgatacgtcactgatcggactttgaatcatcttttattattgttggaaggaaaaagtatatatgaggtcctcatcttgtcatcgaattacaaaatcatcctccaaccgcaaaatagatatatatcatccctaacttacaaaaccggatcactctaggtccttaggt

SEQ ID NO: 63474 - DNA, 978 bp, Oryza sativa
aagttagtgtctgtcagcaatgtacattttgattcagcattctcagctctggtttcagctttcaaatatttttcctttagatcatcaatcacctgctccatatcagacattgaagacttaaatatactgtgccgttcgacaatagcctcaatcgatgcttttgcatgcagtaactgagtttctgactccttaagcttctcctccagtaagccagccctatctgacccctgacttttgagggattttagctcctcatcgagttgtatattagcgtgagaaagttgtttgcactttgcttcagcattctgtgttctactttctgctctgaaaacagcatctttaatatcattaacaatattttcgaatgtgctcatctcatcttcgccgacttcattttctcctgttgatgcaattgtcaatggcaatccagacttagattccctcagccattcctctagcggctgaattttatcctgcaaagtcaagaactcagagtccggttgggcttgagtcggcatcacttccttttcactgtcttgtttcatcttctctagagtgctattagaaccattcgattctgtcaagctttgctctaactttgatttaaggtcaccttcccgacgaattgatgcacttaggtggaactgtattgtattaactttaccgataagttcctttgacgctccaagaaacaattcagatgcattttcagctgcaaacattctttcagagatcgcttcaacagattcctccaagaaatacgattcatgttctacatgatgcagcttaagcttgagctcttccacaacggactccgaatcatgtaacttctttccgagatccagttcacttgctattgactgatttaacagctgcagagtatttctttgttcctcggcaggcatggctgagcgagatgaaccatgaccattttcgtatccaccatcttcactagttcctgtacaaatgcaattgtca

SEQ ID NO: 63475 - DNA, 1163 bp, Oryza sativa
gattattactccctccgtttcaggttgtaatacgttttgactttagtcaaagtcaaactactttaagtttgaccaaatttgtagaaaaaagtagtaacattttagacccaagacaaatttattatgaaaatatattctgtcagggttatggataccatatacccaatagtaattgactaagctaggcggggccaaccatataccaagtcctatacgaaatcatacctcatatatagaaggagttccggataagggaggatgagtagagttccatatggaaactacaaggaatatttggattttatctatattggtctccctagttctacttggacaaggagatatctatgggtataagtacaagaccccataggaggagagaagggacaacatatcaacgcacaagccaagacaagccaaacatcgatatcagagataagcctaaataaaccctatctggtgcctgcggaggtcgacaagagggatctagcgccatctctgatctcggcgagtttatattcgaggaggaaaactatcctgtcgtcgactatgtgttggttatctatgccgccaagtcaacgacatctagatgggttatcccaaatattgtattggtgtgattatgatgaatatagagcaataccggcttcggccaacaggatgtaaggctattacctgtcagataaggggcccgaacctgtataaaaacccttgtctccgtctcttttacttcaatctcgcatataccctggtaccaacgatccatatactatgcaaaataccgttgtcgcggtctcaaacgtcgacatatgtgtccaaacatttgatgtgacgtttttggccaaaattttttggatctaaacaagacctaggcttaaaaatataactaattatatagattacgtgtaaattgcgagataaatcttttaagcttaattgctccatgatttgataatatggtgctacagtagacatttgctaatgacggattaattatgcttaataaattcatctcatatgctaattagcacacgtttactgtatcatcacataggctaattatagattaatcaggctcaataaattcgtctcgcaaattagtgtagggttatagaataagctttataattagtctatatttaatacttctaattagtgtctaa

SEQ ID NO: 63476 - DNA, 1788 bp, Oryza sativa
tgcaggtcgctgaagaatatcgtcttgttcctgatacattatacctgacagttaactacattgatcgttatctttctggcaatgagatcaatcgtcaaagactgcaattacttggagttgcttgtatgcttattgctgcgtaagatctgactagcaatttttttaaatgtgtttctcagtttgcatctgagttttgtgtactgattttggcttgttcctatatcagaaaatacgaggagatatgtgcacctcaagtagaagaattctgctatataactgacaacacatacttcagagatgaggtttgttttgcatatctgttaacattgctgtgtttatgtccatgactaacacatagattatcaggttttggaaatggaagcttctgtcctgaattacctgaagtttgaagtgactgcacctacagcaaaatgctttttgaggttctattctctttcatctcatcgatgtctatagtgctggaatgaatcgaactctaataactctcttattgcctacaacaggagatttgtccgtgttgcacaagtatcggatgaggtgctgctctcttaatcatctcctgcttgctgcaattccataatagttatatggtgcattgcattaacagcttttcatcgtgcaggatccagcattgcatcttgagttcctagccaattatgttgctgagctatcactgctggagtacaatctactttcttaccctccttcactagtagcggcatcggctattttcttggccaaattcatactgcagccaacaaagcacccttgggtaagtggtggcatcatcgtattgaactttccatacatcttttatatcagcattcaaataaaaaaattacaagagctaacatatgcttctcattgtaaatttgaagcagaattccacccttgctcactacacacaatacaagtcgtcagagttaagcgactgtgtaaaggcattgcaccgcctttttagcgttggtcccgggagtaaccttcctgcaatcagggagaagtatacccaacataaggtataaacggcatatcctccccatttcttcagttatctgtactgtttctaatgctgatcttctgtacctttgcctttgtctgcagtacaaatttgtggcgaagaagccctgcccgccctcaataccaaccgaattctttcgcgatgcaacatgctgaactagaaaaataaaccaaggattagttacagttgctgactgaattcttcctccagaggcatgctgattgcccccctgttctttcaggtggtttggctgagtgtagatctaagatcgatgctgcagctgtgtgtggtaacttttatggtactgatgttctttcttctttctcctcctgttcttttacctgtacctagtagatctatggttttcagtacattgtacatcttgtttgtaatggcatgattcttggaaatattagctgccaatctgacctgggcgtctcccaggttgatgtatgagggagtctctgttcgtgttgctcttgtgaaattcccaataagagcaccacattttttaatagtgctcattctgaataagttattgatcatgtccttgctatcaagtgctagcgttcttgatgtttttagtcaaaaggaatatttggacgaattgcttctcatcttctacacatatcggctttactttttcttttttcaacttgttctgttcttctgttgacagatactgcatgcagctgatgtgatcgacttgaacatggtgattcagcgagaagcttagtagatcattgtat

SEQ ID NO: 63477 - DNA, 1057 bp, Oryza sativa
aatttctccatattatactgtgcttctactggttctataaggaatttcaatatgatggccattaaatggaacccactattcagaaaaaaaaagtattctagaatgttttatgtaaggtgtttacacaatatgcagaacaaaactactgaaaattgatggtcacaaagcatgtctggtattagatgataaggtgcaccaacaaagcgaaaagcagaaaagaacggattgtggtgaaatgtgaaaaatatcctgataaattacattggaatactgccttatatcagtgatgtgcacttattctcttcttaatttatggtctcatcaaagtaaactttttttacttgtgtttcatatggatgcaatcaagtctcaaatcatgaggaagcaaaacaaagccttcctatgaaaacatactacaataaggtgctcaagggaaatgttttcagagaaataaggtgtagacaagaatgtattacctcagcctcgcgcaagtgcatgtagatatcagaagcaagagtagcacacaactgcggatcctcgtagttattgtcaacatcacaaatttggtcgatttccattggggaaggagcatccttcttccacttagtttctgcgaaacaaacaagggataagatcaatcaaccattccaatagaatgcaccatatagcacaaatttttctagctataactgtgcatttcagcaaccaaaacacaccttcgacatctctatcctctgagatacgcaggttttcgtttgctcttcgctgcaaggaacctagaactgaggaggaatccccattatcaatgtactcaaattctgggcttttcattgagtcacacgtcgacatcgtctcgtcaaccgaaactgaatctcctgaatgcataggggagacgaagctgctgcagggtacagtgacaggtgccagtgcagcagtcggcacaatgctaggcactttaggaggaagaacagactccttctgtgtggcgctctcatggcgggatatggccggagccggcttggcggaagccgatttcaccgccgaggcccgattcgtg

SEQ ID NO: 63478 - DNA, 936 bp, Oryza sativa
caactaatatgaaattaatatttcaataaattgtgaattaatattggacatgtgataaatcgtgactgctgtttattcatggaagtcttaagggagtctactcatttgctttctagaattgtgacactttacttttctcaaaattatacatcaacagtccgttgtttcctagaatgatcgatgggcaattgcaatttattttcaaaaaccgtaaaattgtattgcttagttccagcaactccacttcaaatttccttaccttcattgctctttgaggagaaaagggggggaatttgtgctcaagtagtcaacaactaagttggtccttttgcgatcaatttgacacagtaatgcttagaacatgtctacatcctttatttgttaaacatatgaattcctgccatacccccaaattatgttcaccaatgcacgtgagggatatgggaatctctcatgcgttactatgtcctatctatgtcatatcactggtggactgttaagcataacaaacacctgatctgcattaccagtttaccacttcacctgttttcacgtctgtgacaaggctttccttcaatggttttcaggcccttattcgcaagtatgcccttgttgccattgtgattggaatagtactgatgctcttttgggtcaagaacaagatatggtgactgagagtaacagtcaggcctcctgttacggtgctggaacttgagttctccgtgcaccccgaatcgattctggctcaacagatgctttgatggcttatcccgcatctgcccattcaagcgagtagtagtgtagctcttcttccgtgctttttgttttttgtttttttgttttttgcctattcctcccaacaaagatcatccaaactaaacccattgtagtataaaccctcgtcatcgacccagcctatcctgatggatgaagaag

SEQ ID NO: 63479 - DNA, 1010 bp, Oryza sativa
tcatcaatcctttctttttcttgatttgcaaaccctttgcaggcaattttaaacattacgaattctgagtgcataacaaaaataaaaactacattattccactgtatgtaaacaaattagtgaaatgaatgaaataacaggggcggatccaacttgggacatgggggttcagttgaaccccccaaacttttgggggaacaacaaacaaactcaaactgttacttgtattaaggttaaggctctggaattaaaagaagagcttcttccagatctacaagagaagctagggtttacgcaagcaaattccagacagaagcactcccggtgggagggagagattaatcatcagaaagaggatgtggatgctcaccaggatcccttgctcgccggatggagatcggcgcccctcccctcccctgttcagccgcgaagggcgcaagaagcggaggagacgacgagacgggagattttttttttctcttttacgcgaagggaagggggaagagatactcgagtactccacctttagctcagatttactatgttacccattatgtgtagcaggccaaatgggcggcccggcccatcacggcaaggggcccgctgatggcacggcaactgtaatgggccgtacggtgccagatcttgggcagaacggcccaaggaggtgttgggccgtgtcgggccggcacggctactgttgcatggaccggtggcccacccactagcacgataacgttattcgtgagaaactacagtcgcaagttttctatagtaggtaacacaattaggcaaaattgtgttttttttagatattggaatagaatccagcctttggtcaatgagctacaaccaattattacaccaattcatacaaataaaatcgcatggcaaaaaagttataaaaacacggtcctaaaaggtcaggaacacacaccaagtactaaaaaccaacgcaagaaaagatcacaaaattattgaattctatttgtgaatcttcatccaaagtt

SEQ ID NO: 63480 - DNA, 5887 bp, Oryza sativa
actcagggtagtactgtggtccataccgttgggtggggcttggggcttgagtgctcggtttgtgtcactgccccagctgatagcaaaaactttcagctccctgcattcgtgtctctgactcttttgttatgtgatacacgatggcaattttccgatttcgtttgggcacctttaagctccatatgcattaaagtgtcttggcctaacttatttttacaactgatgctaagcactgtatgaggcattggggttgtagatataatttctcccaaaatcaagagaacatagatgtagccatgggttatttgtatcataaaatggcattaacgaactacaattttgttgcattgagccatcttgaagttcaattagtctgtatctgtcatattgctgccatgatctattgttgatctgtcctaatccatttgtttggtatgctgaattagaacttgaaaaatgtgaaatctttatatggtaggagtgagtgcaggctgcctcagaaatgctatgcaaaattttccaaggttaaccatcaacattttgttgaattaaaaggcaatgatctcacaaccatgtaagatactaaaagagtaaatgtaatgattgctgagtggttgggatttggggaaaaaaaactataacagacgctaaattttttttgtgtatatccttgaaattgcaaaaatatgtttgtatcttagttgctcgatttagaggttgctcacttaacaaatgacacatattgcagtgtcattgtggaagctcttaaggtggatagtttgcagaagctttgttcatcactggagccaattcttcgtagagttgtgagtaaaagaactcatagcattggatgttagacatttcttttctatagagatcatacattatttctttgttgatcaatctaattcattatattctggaataggtaagcgaagaggtagagcgtgctttagccaagttgggtcctgccagaattcagggaaggtacaagatcactgtaaaacttgcttgttgtggtgatacttttggatgtgtctatgtgaatttcagttttttctacagttatggtttgagcacaacgaaaaacttaatacaataacattatacctattggaaacaggtcctctccaaaaagaattgaaggacctgatgggagaaatcttcagcttaaatttacaactagattatctctaccactgtttactggtggaaaagtagaaggtgagcagggggcagcaatacatgttgttctgctagatgcgaacactggggttgctgttacttcagggcctgaatcgtgtgcaaaactggatgttcttgtgcttgagggtgacttcaacaacgaggaagatgaggattggacggaagaggagtttgagagtcacattgtcaaggagcgtgaagggaagagacctcttttgacaggtgaccttcaggtgacccttaaagaaggtgttggaaccataggggagcttattttcactgataactccagctggataagaagcagaaaattcaggcttgggctgagggttgccccagggtcttttgaaggtattcgtgttagggaggcgaagacagaagcttttactgttaaggatcacagaggggaatgtatgtttgcaatgagttattgttttactcatactgctagatgatttgaatgttactcgttaaccatatttctattgtatcttgcagtgtacaaaaagcactatccacctgccctaaaggatgatgtttggagattagaaaagattggcaaggatggtgcattccacaagaagttaaatgcaagtgggatttatacagttgaagattttctccagcttcttgtcaaggatcagcagaggttacggagtgtaagttctacaattgttgttaataggttgtaattaatgtagtttaattgatgatcaaatacctcttttttcttttagattcttggcagtggaatgtcaaataagatgtgggaaagccttgttgagcatgcaaagacttgtgtcttaagtggaaagcactatgtatattatgctattgactcaagaaatgtcggtgcaatattcaataacatctatgagttcactggtttgattgctgacgaccagttcatttcagcagaaaatctcactgacaaccagaaggttggcatcttacttatctctttctttgttttaaagttaaaaatgcagtatcttataaatttataattttgaagtgttgtatagctgatttttggcatattaggcatgttgccacatgacactgtaaacttatgttgctgtgctgttggcagtaatgtatcaatgcacaggtctgcgtcctgcatgttcaccttgcattcagagccctatagtaatatacataaatctgtggtgcttcataactagtttttgatatcacgtttccagtggttgccacaatagaatatgcaatttgttataaattatgtgcctcttgaaggaaatgtcttcctgacaccgatatgtttcttttgaattcaactgttgtgtacccaagagctgaaaatataaataccctattgagtgcataacctggctgaactctattgcagatctatgcagatggattggttaagaaagcatatgaggattggatgcatgttgtagaatatgatggcaaggcactcctgagcttcaagcagaaaaagaaatctgtcacaacaagaagtgacacggctgcagcagcaacaaacagccctgtttcctatggttcatccaacacacacaaacaattgtctcaaccagcaaaagcagggcaaacttctacaggcactacaagtgaaggtaatatgatgttcagctcaaaatcccggtacatctatgtatgttgacaatttttatggtggtctctgctgttactatgttccctgttatgtttttgtttaggagctgcattttctttgttatgttgggctctatttatcttacctaatgcgagccaagtgatttcggtttgtctttttatccatatgctcgctgacccatccctggaacgtaatgttgctgagctcctacttaatttatttatatggaattatccatctcatctggagtcactctcttgtcttcaaatttcataatcactaattcactgcaatcttcctagtgagaatagaaagatgggtagaaagtggtctatgcaattatgacaagcacatgcagagtagggcagtaggcccattgagaatgctaaaactggaacatgacaaactgtagcagcactggaagatgtgcgtacggccgtacgtcatgactacaaactgctttaactactaccattcaatacttttgttttacttattggaactcagccattgttggttggaattgatgtatgcatttggaaacatgttgatgcttctgatcatgttcaggtcagattatctgtgaacatattattgccattactaatacattgcgctactgaattcctttggtcttttcagcagatggatctacaagtgcatacaatggaaatcaggcaggacgatatgcagtcaattctcaaagcatacctgcaaacgtcactacacaatatgagcggagttcactgacacctgaaagccagttcaatggttccgcactgcagaatcaagtttctaggggctccaatatactggcattgggaccaccacagcaacaacatcagcaaaattttgaattctcagcactaggtggccagtccatgcagcccaccggcttgaatcctttcgatgactggtcgcaaccgcaggagaaccggagtggggttgacgactacctgatggaggagatcaggatgcggagccacgagatattggagaacgaagagatgcaacagatgttgcggattttgagcatgggtggcgcgtcaaccaacctgacggaagacggcttcgcatttcctaactacatgccatcaactccccccaacttcaactttggggatgaccgtgcccgcccacctgggaaagccgtcgtcgggtggctcaagatcaaggcagctatgcgctggggcatctttgtcaggaagaaagctgccgagagaagagctcagcttgttgagctcgaggactagcaaacatcctaactgctggtctaacaaagctccattggtgttgctgctgctgctgttttaaggatctgaaaaatgggcttagcagctcctgtttggaggacgcttccttgaggccctgggttcttaattatggacacggattctcgtctactctttttttgtatagttgtttcatcattgtttgtttagtgtgatgcttagttgaatcctgtacgaaccttaaccagaactgtgtacatttaattgtttcaaaattcacacaagcattcgacactccgtttggttgtagtttagttttgaattataccaatataaaagcaggaaacatataatagaaacaatataaaagaaacacggattcatttttatttttttaaaaagaaggaaacatataatagaaacaatataaaagaaacacgtagtgcagtgggggtttgagttgagggacatatctatctttttccctcggtttcaggcatgtttcagccaacaattcctttacgtaatgccaaagttgcgcataccgtgcattacaggaaaacaaagggtcctgttctatatacagttgtggagaaatgacagtataccatcacaagcaactgaaaaacataccatcacattttatggtgcagttgtagtgccaacgctgacctatgacagcaacaaaaaaaaaacaaaaaaaaaaagtttccaagcatttatgtcttctcacatcgcaaccgcaaaatgctctatacaatctcgacaacaaactcctctctctgacatagtgaactaacacagtgaaggctcatttggctccattctactgtgtcaacagctaaaccatttgggttctgggtaaaattccatgaggtttctcaagctccagttatgaatgatgggaagtaatgctccaaaaccgccaggaaatctctcctgttgttttccatgttgaccggaacgccgagccggccaaccgcctcgaccagttcccccctcagtctctgcggcagcagctgccctcttgcactcgcgcatgcccggtacagcggcaggtacgcgatagcgagtgccatgggctccgggaggtcatgcaggcggatcggagacgcccctctcctcagaaccctggtgatgttcacaaaatgatcttccccagcctctactccttcagcaaatgcggcctgagaccactgctctttcagaaaatcaaccaggtcttggggaatatccatcgtactcgtggtcgcaatgctgtctgcaactgcatacgtagcggcggcatcgttgaggaagtttgaacggagaaggaaggaaacaccttcaaaagacccactaccctgtcccctcgcagctttgagaatctgtgggctgagggcttcgaggacatgccgggggatatgcgcaagcaggtaggtggcaactgcgaagtggccgcaagaggcagcggttgttacagcaaggcacatctcaatgtctgaaacatgccggttgacaaaccactggacaacctgcaagcaaccacgctcagaagcttttactaagggacaaaggaaagatgtggcatgcccttcatccaccaagcatgccatcgtttcaaatttgcagtagtgagaagcatagactagagcaagatcgacatcgacagccaagctgttctgatgagcaatctgcaaaaaataggcaaaagttatatagttgcataccatgcttctacaaaaattcttattcacacatgccaaggactatataataaagcagatagtaagaaagtatattctgctataatataatcagtactgaagagcaaagaacagcacaa

SEQ ID NO: 63481 - DNA, 2410 bp, Oryza sativa
aatgacaaaagcccttgtatggcaactgctgaactcccagaagaccatccaggttcaaataaagttgagaatagtgtaagtgggaagcaggccgcatcgaatgcctcagtgaaaatcttgccactgagattgtcaccagctatgtccaagaaggctttaaacgctgatagatggaactgtacctcttggtgagtgctgcagtttgctttgtaacactctgtatcttcagaacaacgatgcagatgaatgcactgcaatgcccattctataaacttctgcactttggcacctgcctcaatttgtaaacgttcaccaccaggacaatcttgtagacgatcatgtaatctaaatttgaaaaccaaaagaactaacatcaacaatgatggtaaacagaatatcgtggaagaaacagtatgcaatttgtggttacctctgagctatgatttccttgctatcacctaaagtaagcgccttgctttggcaggcaacgacacaagatgcgagcaatgaagtcctgaggattgccctggcaaaatccttcgcccctgattctacaatcttacctatcagatggttgagaccttgaagatcctgctccgtccgcaagaaccaaatggcatcaagagcaacggacaaaccataatccagcattaactgatggtctgctagagcaacaaggctttcagcgagaccccactgccgcgagaacaaaaccaactgcagcgaatgcccaaaatcaatctgtccatgctcatctatcctctggtttggcatgcaaccatttgattcttcaacagggccattgccatgaacatggctggcactgcattcctggtcatccttgagcacaaggctagcctggccatgctctgcacagtgtgccggagtgccatggcagctaagttcatcagcttctacttcagtgaacactgcattgtccaaaggcatcacctttgcagggatagctagttgcttgccatgctctaccattttctaatttgcttctccaatcaaaccattatattatgtcctagcaagaatattcggatactccctaaagatcaagcagaaaaacaccgatttaacaaccaatctattagcttgaagaatcacttaatccaagatgctaaacagggggacaaaaggatccaaaatttagcgtttactgcacatcacatataaccataaaactaataaacttctagtggaggctggaaatacgaacaaaaagatttcaaggattagagctacagataaatcaaaatccgattgacaagcaatttgtggggggtcaccatatgagatcaaatgttgcatttggtatttggtaagatcatcagaccacacggataccgacgaagcaacagccaaccaagagatgatatccccacaggtacgaaaacttgaaaatttgtatttccagaagagttttaataagaaaacaaactcgaaagaccaactctcaactaggaacccaacctttttaactcagaaaatttcggattcctactcggcctttacaaggggctcttatgaattcaagcaataaataaatatctacctccagatcgaatttcctaataatctcaatatgtggaaactaaattcaatctaaaattcctttaaaagtagaagctcaacctaacaaccctcttaagattttcagatgattaacaagaataaaaaaactcaggactatgcactattggatggatcaagacccttcacctgggcgttccaaaaccgcgcctcaccgcgctcgccgccatcgagacgacgggcggaggcgccggtgccggcgcgacccggggaatcggcggccgggcaggaccgcgggtgaagtggaatcccgggccgccgccgccgccgccgccgcgtggaatcggggaaaggatttggctcggattttgggggagaaacggaggaggagggggaggagggttgggtgggtgcgccgcacgtgcggcgagcggaggaagaagaagacgacgcacgcgagggagaggggggaggggagacgagacgatctccaattctgcagcgagagagagagagagagagatcggacggccctggtcgatttccacgggaatcggacggcggcggtggccaagtgggttgcggagacgcggcagtacattcggatgcgatcgtttctttctgagatgcttatacccaactactacgtccgtcctaaaataaataagtgtagccgtgaatatccgtgtccaacgtttgactgttcatcttatttaaaaaaattatgaatttttttttaaaaaattagtcacacataaagtattattcatgttttattatcatctaataacaacaaaaatactaatcataaaaaaatttcaaatagacgaaacaatcaaatgttggatatgaacagtataaaactacactt

SEQ ID NO: 63482 - DNA, 5610 bp, Oryza sativa
atattggcctcaatagttcatgtagtacaatgtttatgagttgtttccaagttaatagtcattttagataggtattatcatttataatagatcgtggaataacatacatgcataagcaaaatcatttacaaacaacatgaaaactaatgtggaaattgacatacttatcataattcccaccgaaagaaagaaaaaacaactagcaaaaatgttagtattggcattgtcatcaatatgcttagattagtcttgcagtcccttgctgaactgactttgttggtgggcttgtcatttgaacttcaccaacattcgattcgtcaaccggtgagtcaccaacattttgtgttcttgctgctcttgcattacgccttctagcattttgagcccaattggcaagtccttcgaccacattctcatcaaatattacttttttgaatgaagttcccatcttcaagttggacaaaagaaattagtaccataaaacattaagaaaaatagctagataagtatcgtgtaaaggatatgatgtcattaatatgtgagaagatcacaatttgaaaaggacaatttatatcattgatatagtttattaatgtttcattaccagctttcatgtccatcaagagaaatagtttactttctaggaaaattagttttaacatttaatctactaattgaagaatctaatcatattatcaaaatatgtttcttaaaaaactcacatgagagacaatagcgtagagagggagggtgctatagccgcatagaagttgactgatgacactgaaagcatagaaacaattgtgagttttccaactgaaaaaaaatgattttcctagaacaaaatctaaatatggcaataagtttcatctatacccacaatatgccactctttgtgaggatggcatgtgggcattagcccacctattgataggatatcgatggcatattgtaaacatcaatgaaactaaatgttgtacatcttactaggatagttatttttttttcttaccttatgaccaatcgagcaataacatatcctttatttcccataatgcatgatttgaatccatatgtaacctgaatgtgttgacagatttttagatttcatctcacctcacctcacacacttgataaaaaaaagatagtaggctaaataaacgtaggattcacaaattttataaatttgaatcaaatataaagtatcatgtgatagttttcaaatagctaaaatttgaaattttgaacgagtggaattttgtgcaaattgtattagacatgtaattagcttgcgtactatgctattaatcatgtaaatgtttactattatttaataaaaatagttaatatttttacaagctagcaatggacatctaaggatatgttttatgcatggaattcatttgccaggatatttccctaaaactttgagtcattttatgttgttcttaccagaagccaaaagaaaaatgcaatttcaaatgcattttggaacaagacaatgtggatcaacaagaggactatttttggtcggtggaaccaaaatagctcatctgatggggatactacgagctccccttcaatcgctgtatgtttttcagcaacctgatgggctagctcagtaataatgtgctccaatttagtcccaaccacaagtagcatctgaaaaaaaaacaaatctaatgtttatttttactaaaacaatcctgctttgtaaacatggaaaatcatatgtatgcctataatcaatatttctactaaacataggtagcaacataattcgtaggaatgcttgcatttaatctagggataacataaatgttaatgtgcggatgaattgttataataaatgttgtacttacaacaaatgggactgccgatatccagatatagacataccatcctagacatatccatatgtaacaaaagaatattgtcagttttttcacatagtacaaatatttaaagcataaaagaattgagcaaattacataaagaagcttgactagtgttttacacaaatgtaaaagatcaatggtttgagccatgatagaacaaaagaagatgcccgagtttgaaaagttttgtgtagaaaccacaccttgaacattaagcagcaagaatattatcaacatagcccaaaggtaccaactgcatttaattagcatatatgttaattagtttctacataaaattctatcgaaggattataaataactagtacttgtgtgcaacctaaatctttatccattagttacttacctaatgcctacaactttcttgaaatcatcctccagtgctctaatcatgtatttgtaaaagttgaatttaggattgcccctgcaatgtttctgttatataaaaaaaaattactgatgtaagacaatatgcctaaagaaacaaattagatatcccacttttcaaacgtaaaagttcgaattaccataatgaagccaagccgcatggttacatagtcctcctcagtaaccgacccatagaattgttttaagaacgagcgctatatgatggaaaataaattagtttgttctctatcacaattcacacaataatacatatcaaactatttctaaaaatctacttctaagtttttaatattgtttttgtgaattgtatgttagtgattcatacaccaaaaatttgtattgtatactaagttgtccattaattagtattggcattttaaaaaaaaatcttaccagccaaccaaatgttttccaccttttgccgtgtcctttaaaatgatttttgataaatgggaattcttgcacatgtttgatcatttggggacctgaaagtttcattccaataatccatctgtaagcaaatggtaatggatcgatctttacttgcccaatggagaatgttctttcatcataccattttcatcacttgcttggatcttgttctcccaatgttgccatttccttgtctagatgataatgcacaaaatgtttagcaaaagcatgacacctattaacaaaaagatgtaagaataacttgatttccaatacctgtgcgattcctagaagaactgtaacagcacttagaaccacatgggagaccgctaatacgaagataaatatgtgtaattgatgaatggcttcaactgaaagtattggaactaaaccctgtgtaatatagtaataattagtttcggcaagaaggtaacatgaatgtgcaaaatagatagaagataagcacaacaaaatgcagcatgatagtgtgttactaagatgagaggggagtagcatattgaaatgtgttgtggtttgctttcattttatacaatggaacacgaagtaaaagaagcataactacataaacttggtactccctccttcccaaattgatcattaaaaatacaattcaaaatttctcaaattaatcatcatataaccgcatggatacggatttcatcagaatttaattaatgcaacatgggagaatgtgtgaatgctaagttgtactaattggtaggatgttttaatcgatgcatgcattgtgagagaatgtgtgtatgatgtcttgattgatgtgatttaaattatccttggtcttggtgcataaacatatatatatattatgatcattttgagaaggagggagtactaattaaaaaaaaataacaatatgtatgatggatgcaccatggtacttgttctaagttgtaacaacaatattgtgcacagctcggcgtcctacaaacaatagagtaaaaaaggacacctctagttctcgttccttgtgtttggttaacgaacttgaaacgctggacacgatgtatagatgcaaccctccctcgtttaccgtttacccattcttcatgataatttgttcggatattgtacttgaacgaaaaagaaaaagagaagaaaattttatccattcgctgatttgtgtaagtctcaacagtttcgagttaattaatttgtggcatttctaggaaagcggcatgatgagagtcaaacaaattaaaggcaaatcaaattaaatagtcctaactactactagtacctttttctcgcagtagtcagacttggcccctcctccggcgaggagcctcctcacgccggcggcggccaagtgcgcggtggtcttggccgtcttggcgccgctgaagtcgagcttgcacggctgcaggtggtccatgacgctcgccttcacgcatatcttctgcgtcagcccctggaacacgttcagcagcagcgagatgaaccccagcagcatcagctctgcacatcagccacggttaattttcagtcgatttcatccttaattcgcttgctagacaattcttgttttcttttctcatggagatgatgagattagttttgagctcaccttctttgaccttgaggagtccctcgtagagcggcttcttgcggctcttcttcaacctctgctcagagacggagacagagattatttatagctcgtgtcggatcgatcgccatggcggcattagctcgaacacactagctacgtacgacgaagagcagcgacgtatatataccttgcccaggcggtggagcaggcgctcgaagagcagcgagatgatgacgatgacgaagcagacggcggagacgatccacgtcggtgtgtgctccagcgttatcgccggcgcttcgccgccgcccgccgccgccttccctccccctccggccatggccgccgcgcaatcagcctctcacaggctcaccaacttcttctccttcttcccgcgagaatgtcaaactcaaactgggaagtaaatagtgcacggaggtggaggagaacgtgcacgccgccgcgtagagagtgcggggagagaaatttttatagcggagtgggagattgaccaagcgcgttggcgttggtggaggaagaagaagaagaaggagaagtggactgacgggttaattaggacaaattatagcggggaaatttaattaattaggtgcagcagaagcgatcaaaaactgttgcgacggcaaagagaactttggacacgctccttgtccttggaaccaagtagctgggtcagcagctcagcgtagcagctaaattcatgtgttcaacaaacaaccccccgtctgaattgggaatttcaacaaatggcagcttcatgttttctgggacggagggagtatctttttatgttattttgattttatgacaattattcaacaccgaattcatattaattagattctagtggttttaaacattgactcgatcgaccacacatcacagcaagagtacacatacacatggtcgcccaaaaagaaattaagaagcatctcgagggcttcgtgctacgatccatatatccaccgggacactagctagctaattgcaaaaacgtgggtcaccatctcttcatgaaggtgcagctagctagcgtcctgctaattgtcctttttaataaagcagctagttaaggttgaatgttattggggttggttagagtgtctacggtccttgtttgaattatttttctagtttatcatctctaacatcaccttgttgtgattattattaattattcgctttgtttttgttatcttccttttctgcccatgcatgtgagcattcagaagtcatcgagga

SEQ ID NO: 63483 - DNA, 4803 bp, Oryza sativa
acctaacagaacatgattgtatcagtgctccatggtaaaatctataaatatcttacagcattctataagctttatcatggtaagatatcataaataaatcacaagatgatgctaggtagaaaaacagtacatgattggattacctgaacaagctggtcctcgtttagagctgccaagctaacaaggataggaaaccgtccaataaattccggaataagtccatatgctattaggtcgccactctcaacctaagaaatgaacagtttaaacacctagatttaaggttttacacagtaatttcactgaattcacacatgcattctccttaaacaaaggagatttccaaaaaatgttaaactcggaattttggtgcttactgattccaacaaggatgatgtcacttgagcacttgagatgccacctgccctcatgttagcacggacaggtgccccaaagccaatagaagaatcttgccgcctgatttttaaaaattaaagcaggtgcaaatacattagatgacgatttgagaaaacattggagacaattgttccaataggtaagtctcaaagatcaatatgcaatacctctctgatatagttttctccaagtcaataaaagcaccaccacaaataaaaagaatgtcctttgtatctatctgtatggcatgaagaccattatacaattgaagttaatccatgtgtgcataccacaagcactgaacgagtagaaaaacaaactcaaggttttactgggcagttggtaatctgaaattgcactagtttagaccaggcatttatggtataaaggaacaatagtatgttcatataaagcagcatttgggatgagacctatccaggggatggatatttcagacaaaggaattgttctctattactattgtcagtcatggaacacccaaaactcttatcttgccgtatttttcttggggctatcattcagcagaagataaaaatgatatggtgtaattattccggcacaaaaaggctaaatattttatttttgaagattgtaatatataaactgtgacagtacctgtatattatcaccgcgaggatgcttccttgctcctttctcagggacattgacaatctaaatatatcaacatttcacaaaagtatcaaaagacgtccatgtaagttctgatttgcttagaagtaaaatatcccagaaagatcatatgatatatatttcagccaaataagcaaaatgatttccctttaaataggtcactagatggattaccataatttttttttaacttgatgacttgtaccatatgtgttcaatatcacaagaaaaagctcaaactgaaatatttccagcataaagcaaaggatcatgcatcagtactactgaacaggcgcgcacactactaatactatgttgtttcatttgccgggggatgctacctatgatgtactaatctgtatccaaagcacagagatcctagaggagtagagggtaagcaatatctgcttattaaggtttcactttatatattgtgattcagtatgccaaaagacacataagctaaccaggccataaggagatcaatgcaaatcacttactgtgccttccagcattttcaacaaagcctgctggacaccttcaccggagacatctctactaatgttaaggctctcagcctgcatgttgaacacgtcagctgattaatgtcaccaaggaagacatactgattcagctaacaaagacaaaccttctttgtgatcttatcaacttcatcgatgtacaccatcccttgttgtgctgcttgcacgttaaaatctgccacctgattgaaaatagagtatccaaaatcactttcaaaggcatggtgtaaagagaataagcaggtccaatttgtaagctaagaaccataccgccagtaacttgtatagtatagattctacatcttctcctacataccctgcctgcaggaaagcgcaggagttaagctttacttttggaactaagatgatattaaaaaaaggggaaaacaaactgatgaagattgcaaatgctagcaaatagaaatgaatgatcattcacaatatcactctgaacttaatccaaatgggctggtggctgtatatgatacttcttgttgctgtttaatgtaagggaaattccattagttttcactgaataactgaatttaatgaactgccattgaataattgtgtgttccttccatggcatcaggattcaatttcttccttctatgaaatctctgtcctctcagtctgattgctctctgttaaggttgcaaggccatttagcacctatgagcatgagactaacagacatgccctgcatgctgttctctcattttctctattgctgccaagccagacctacattagtctggtccaactcccatcatcatgtttcaaagcggcagctcatacttataaaagtgatgtacccaatgcaaaggtaatggaggtggttttattgcagctgtatgcaactaaatgaagtttgggtataaactttgagccaatagttggtcggctgtggaatttgttcactcatgttcttcaccccagtcaagaggtgttcatggaaggaatatgcagtcatccagtgggcaaatgttgaactcacagttacgtggtggcatataatggatctttccatagtttaatggcttcaccattttaacttttgcaagtaatgagctcaaatcataaagatgtgtgcttggacattatgcatttaaaagttagtaaagacttgcctgtgtcaatgttgttgcatcagcaattacaaatggcacattcacaaagcgagctaatgtcttagcaagtagagttttacctgtgaaacaaacaaagtatccaaaaaaacagtgctgagtgccctctctgttatagttgatctagtgttgtagaagaaataattgacagttcccattacatcaacattcaactttgaatttgggggcaaatgcttacctgagccagtaggccccattaatagaacattgcttttctctagttcaacaccatcgtcatcatcagcttctccatcaaaaccacccaaatctgctccagacctaattgttttagcttatataccacataattagtcactgaaagatattcatcgatcctaattgttcttgtgcaagaatagacgagcttcatcattccaagaacaagaagaacaactaaggtggtagaaagaaactgaccctttttgtaatgatttatggtatattcgtttataatgattgtacactgcaacagatagcacctgtagatttaacaggctgtgagagatcagcatatcaaaagtatagaggcgttactgttgattaatgcaacactaagcaaaagacttgaagttgacttatcatctgagtttgatgaacaagaacatatatcgaggtgaagcttttcgcaactcatgacaaatatatattaaattgagaaagaaagtgatatttagaaaataccaacacttgatttatcactctcattaacactatatgtactaaaattatgtacggaatctgaagtgtattaggttggacaatgaagaccaaggataagtgtgtggaaataagggtttatttgaatgcgaacaccatcagcagtccaaatcaatgttctatatacattttgtacaaaactacgtgtttgttatcagctatcaagtagacatgtagaagtgattcatccattgcaaattagaacaaatttgactaaagaaataaatcaagttctgaatcattccttgatagtgtcaaaacagtagaagctcacttgagcccctgatttaaaaaccagtttgcaaagatatcaattttatgagatagcttaacaggccaataagtaaatattgttccttactgaaagcaaagccccaaagcatcatcacaatcaacacagctagctcaataactttgttgctaaatctcgccgccatcgcgactcgtaaacaaccaaatgcggcgtaggagtgtctcaagcgaagaactagatacgatgtaattcaacaaagacctcacgtttttaattacacgaactaaccgattttaatcaggatgtgtaataataaccgagataagtgcactggaacaaattcaacaaaattggaagaaaatttcctcaccttcttggctctgtcctgcccaatcacatacttatcgagcccctgacatatctccttgggcgtaggcaaatccttcccgaggttcgacccgccccacccgtccttccccgcaccctcctcaccaccaccgccaccacctgctcctcctcctcctccgccgccgccaccgccaccgcctccggcgacgcggacgacgttgaggttggggtggaacggcgggccgggcggcacgtgcacggccacgccgccgccgtccccgtcgtcccgcgacgacgagctcccacggatggcctcccagaaggaagcgcccctggccctgacggcgtcgtgggggagcaggtcggcgcggacgcggccgatctcgacgaaggtgccctggagcggcgcgaggaggtgggggcggaagaagtaggcgctgcggcagttggggcagaggttgagcgcctggtacccaccgccgcccgcgcccgcgcccgcggcggcggaggaggacggcggcgcgcggtgggagaagaggatgtccatgtgcttggagcagcgcgggcagtgcgcctccgcgcggatgcgccgcggctcgtgctcgtcggacgacgacgacgaggaggaggtggggccctcccacttgcgccgttcctgcacgcgccggtgcggcggcgccaccac

SEQ ID NO: 63484 - DNA, 25581 bp, Oryza sativa
acaaggtattcagaaatgaagatctcagcatcacctcacaactattcgtcgtctgactaataatcatgtctgattaaacattttttaatactatgattatctctgattaaccaatgcttgaccagcaattccgccaacgtttcagcacttaatagaaaactgactcaaacatgcagaattgcagattaaccagagtatgtactgacaacaactccaacagacataataagacaactaggcactaggcactagaaataattgacataatagacataattgacttaatagagtaggcactaggcagcgacaactgacatagtaagactgtaatctgcacatggagactgtaaatcatgcaagcaatattccattcacaacagcaaaacataattcaggagttcacagaatgcgtcctgttagaagaagagccactcaactcaagacgtcaagaaactcagattctttctggtatttcagaaaagtgagagcttgagaatacagtttcgacttctgtgattgtaccctcaggcccgttctttctccaacaaaagttagatgaaaatttggatatttatgtcacatttttcaaactgctaaacaatatgcttcatgcaaaaaatttctttataaaagcagttgaatatcataaatatatttttcaagtttataataattacaacttaattaatcatacgttaatatcatctcgttttgcgtaaaacacttaacttaatcttcatcttcatctacggcataaaagaaagcctctccaatctcggcatcatgttcatttgactcgtccaattcaacctgcaaacggagaagaaaatggttgcaaatttcgaatttcactagtagcagcttgtatttcacattcactagtaccagagttgctttcagatctgaaagtggagttccaagtcgattatatggcagtccgggatcatcatccttgactctgctaaaaaacattctcctgcagatgcaaaaccgcgttaagagacagttctgtgattacctatggttatgtttagttcagcgtaaagtttagattttggttgaaattaaagatgatgtgactgaaaagttatgtgtgtatgacaggttgatgtgatgaaaaaagaccaaagtttagatccaaaatccaaactttggatctaaacatagccatagtaaaactagtatctatgaagaattcaaactccaaattcctattctgtctgtgattctgcatataactatgtccattgagatgctttattgcctagattacataagctatacatacgagaaatgcaaaattgtttccaaaggggaaattttttctgggtgagtagaaatagcttgtgtcacattaaggctgtgtttgatacttggggttgggaacccaactccaccgcacggaaaacggagcggtccattagcgtgtgattaattaagtattagttaattttttttgtcaaaaatggattaatttgtttttttaaagcaactttcgtatagaaactttttacaaaaaaacataccatttagcagtttgaaaagcgtgcacgtgaaaaacgagggaaaggggttgggaaacttgtggaaagaacagaggcctaagtcactcacattgatagaactaaaagatgggtactacagccaaccaccaccgcaccgcgttcagcgagtcatgatagatgctggaaactctgaagccaatccttcagagttcagaataggctgggtttagatcctaagtttggatccaaacttcattccttttccatcacatcaacatatcatacacacacaacttttcagtcacatcatctccaatttcaaccaaaatctaaattttacgctgaactaaacacagccataattatcagaatttggatggaacaccagcagagcctaacctggcttcaaactgtaaacaaccatacagtttggtggcatataatgattccaacagtaaacaaatgcacagatttatcacaccccagttgtggatcacgtatgcaatacgaacaaacgccaaaaacattactggcactactcaagccaactaacctgcagctaatcatcacagcttcaaaatgattaggttaacttgtactatgctttactcattccaatggtacactcgtacactatcataactaaacataaataggcaattctacaagcaaccattcttgaggagagaaacaaacaagcaccctaattttacaaaatttaagatatgccacccgtatcttaatgacatgtagcactcacatgagtcaatgacatatgggtcagggtggcatatcataaattttgcaaaatttgtatggcatggttcaaattttcccaacaaagacaaagccgaggtccacaagtatcgaattatacagatacgatccattaccaccaaagttctgcacttgctatcacgagagtactaggcagccaagatcaaccatgacggcccgtttagttcgcgaaaagaaaatttttggacatcggacgtttgaccggatgtcggaaggagttttcggacacaaatgaaaaaattaattttataactcgcatggaaaccgcgagacgaatcttttgagcctaattaatccgtcattagcaaatgtgggttactgtagcacttatggctaattatggactaattagactcgaaagattcgtctcgcgatttcccctctaattgtgcaattagttttttaatttatctatatttaatactctatgcatacgttcaaagattcaatgtgatgtttttgggaaaacgttcaaagattcaatgtgatgtttttgggaaaaagtttttggaaactaaacagggcaaaaaaaaaatggaggggaaaagaggctggtttttttttttttggtgagcggaaggctttcacctgctgcttgaggtcgtgacgcgcgcgcgtcagatagcaagcaaaaaaaaaataaaaaaaaatcctcccatttctctccctcctcctcagcctcaggtggtcgagaggactccacctctccgctgccgctatccccgcctcgcgccgcgccaccatgccgctcctcgccgccgccgcggcggtggcgccgccgttgtcttccttccactcgctctccctctcctcacgcggactccgggtcccctccccctgcgaggcccgcccgcgcgcgccgctccggcgcggggacctcgccatccgcatgggcggcggcccgcgcacgttccccggcggcgtctccaagtggcagtggaagcggatgcaggcgaggaaggccaagcagctgctcaaggcgcgcctcgcccgggagcgccagctctacgagatgcgcaagcgcgccgagctccgcgacgccgccgcgcacctcgagcgcccctgggaccccgacgcctccgactccgccgccgccgcggcggcggcgcccaacctgctctccgtcgcggcggacgaccagatgaaggcgctcgccgaccgcttccaccgccccggcggcgtcgacctctggaacgaccgcgacgggccgcgggtcttcgcggccccggacaccggcagggcctccgcgcgcttcttccccaagggatccgtccatagcgttcagccctacggtcttgtcaatggtggccttgagagcacactggctgctcgcggtaacccttccgatgcgacggaccggagtcaccgccaccgcctgcaaggtgttcgtgagaatgcggccaagaaggaaatgcgtggtgttggtggtgatcgtagcctgcggttgagtacatcgaaaggggtggagtgtgggagccagtgagtaacttggatggtggcgacgacgacgattctagcgacggtggatggaacgatgacattgttacctcggacttggaggacatgggggatgtcgatttgcgacccgagcaaagagcaatggttgggagagatagaaggaaagataatgtggcaaggtgggaagctacaacatctgtagccatcggtagcgatggtgttagggatcagcgtggcaatggcttctctttggaaccagaaggcacaagtgaatatcatcttggtcaaagctggcaagagagaaatagtgggagtagagggaaacgtcccgcagggagaaggaaggccttgaacaccgatggcggtagcgccattgggaaggatcgagtggtgggtggcagttcattctccgactctgaggtaacacgcaatggttttgaaccaaaatggagatccacgactagagggcgcacaacgaatgatgttaggaggtggaatccccccaacgaaggcggtaggaatgttcctagaaagggttggacggatgatgagtttggttcaaattcagacagtggaatggatcacaagttgatgccaaaatggaaaactcagaacaggttgaaccgaagcgaaaatggcagagatagaccggagctgaaatatatggctaataccaacaatggggagaggactaggaggtacatgaggggcagcgatggtgagggaagaagagatcggtttgttaatcgcttcgcctcagatttggaggagccagaatggaagccaagaagaaagagtggagcaggcaacgatggtgatggaagaagagatcggtttgttaatcgcttcgcctcagacttggaggagccaaaatggaagccaggaagaaagagtggagctaggatgaacattggcaacagagagtacatcgatgacatgaatgggagattcaggaggggtagcgatggagatggcatgaatgggagattcaggaggggtagcaatggagccgcgagattgttggatgctatggacagcaacagagaaatcggcagtgaggatgatagctacaggatgagcagaaatggaggacagcgcaggggagacgggtactcgctacgcccaacgtcagaattgcacaactctcggaggctgagggaatcaaatgaaatgtagttctttttttcttcttctgatagaaagatgaaatgtagtactagtattttacaatgatgataaacaaataacacacgccctgtgcagactaacttctaggagtacaacccattcatctgttcaatagcagtgtacagcacacgccacttgcttttgttcagattatgcgacgcaacgcagaaatcatcgccttgctgacttccatataaaaaaggccaaaccaacaaggctgatcaatcaagcgcatcgcggatttggtagtttttatctgaaagttatcttggttgcactgatcaggtagtgcaggtcataattcaaacaagggcatggaagaattcacataacttcagaattataagtgtcacttccaatttccaaatgctggattataagcacagaacattgatataaaagtacatgattcatgtctccctggttgcaaattacatgatggtcatgggcctcatggcagaccttatgaactcaaactggaaaagatcaacaacattggtgcttggtaaagattgctccaaccacttcacctgcagcacataatacacctgttaggcaattaatcacggaaataccagggagtgcaatagacataggacaacaaacagcgcagaactttgctttagctcctccgccgatgtgcttgagcaatgttggagggaactaatcatgcatgcaaaacatataaaaaaaaatacataaaaagcttaatcacaaaagaatacatcttcagaaaaccagattttgaagtgacttccttaattgatataaactatagattccacgatttccattaaggagaggtataaaaaactgctctaaacaaacccaaaacccaactctttgtgaaaaacgggtatagagagactgaatcatatttctatctttcgatcccgttgcaacatgggcatctaactacttatcataaaatgtaactatgcctttgttagaagttgcccctttcaaattaaaacactaatccgtatgaaatgatcaaatgaatctgccagaggataatcgacttatggaagtctgggaagacagtggcgtgtgacagcaaacaatgctaaagttagagtaacttcggcaaggatgttggctctcatttcaccacaatgcacagaaaaaggacacctcctaactatgtaactcaagtatctaacacaatgcaacaaaaatagtggtgcactgacaagttcttaagttcacattagaaggtgaaaaacataagattctgacaatgatcatgcagaaaagggaagaaaaaaaaggtgatactaaattatgtgaaacaagcttatttgcatcttaaagtgaattcaaccaggactgagaaaagaataatgtttgctccaacatagatggcaacatgtcatatagtacagaaacatgcttcacatgatagtctagttagggttatagtaaaacatatctacctagattaaagatgcaattttcaagtatcacagcttaagatgcagctaaaggggaaaggcatccagccatccagtcagttatcttaccaagtgctatccacatgtgttgacttgatgaccaaatcaatatacatttcgttggcacaacatgcctcttcttagggcaggtatatacttatacggcagaacgaatgctaagactagaaccaatgatgttcagacttcattggcacctagtatatacatttctcaagaattttgttctccaccgatcgtacgtgctaaatacattcttagtattcctatggatgaaatatttcaccatgtaattagacacctaatcttttgaaaaaaaaaaaagcaaacatgaattgtcatgggaagcaaacgaacaactagccagtccaaccccgcgccacagtttcaatatgcaaattactaatctgtttcacatgaaaaagctctacataatctccaatagatagatcaaggtgagcacttccgaacaaccctaacgcctccaaatcgatcccaaatctaacgaaacgaacccatttcagccggaggaagagaacaaggggagcttttacaccgggggggcgctcacctcggggaggcggcgcgggtctccgcgcgtggccgccgacgcgatctagtggtggtggtggtcgccggaggggcggtagaggcggttgtaggcggcctcgccgacgaggtagatcccgaaggcgacgatggcgatgccgagccccggcgtggcgtggcgcagctggttccccaccatcgggtgcctcctccagtcgtcccgccgccggaagaactcccccgtcgcgttcaaccccttccccgccatcgccgccgccgctctcctcctcctcctcctctctctctctctctcctcaacgcgcacagccacacacacacaccaacacgaaagcccaagtggtagtagtatgcgatgcgtggttccagcccgttttgaatcgggccttacaaagcccaaggaaataacacacgcagagtcagagaggaacagagagggggaatttttagtattttttgaacctttttttatttttaaattttacaaacataaatattttcaaaacttattttcaaaatatgaatcttttggccacacgtgacaaaataaaattgtcatgccacccacagcgggtgcgatagttttgtcgtcacgtcattcagatgagtgtgactattgttttaccacagttcggctggtgtgatcaacaggttcaattttctaaaaagaatagggttgaaaatgtttgttttaaaaattagaaatataaaagttcataaaataaaaaaaatcaagagatagatagagagagagagctcaagccgcaatggagccaattacatcgcatgtatcgatcaaaacaccgtgccaattacaccctagtatgcaggatcaaatgcatgaatggtatagaatttcaattccttcaattcaaagggggcctaaagcactgatagaaagtaatggtttgtattgtatagtgtatttctttgttgttctgctcacacatataatctatctacaaatatacaatgtttctgcctctctgttttttcttttcctttcgaacctgcttgaagaaagacatgcacttgacgatgggttcctgaacttgtccaagaagctggtgttgtcaagtcttgaactgtcgaacatcagcaaccaaaagtcccacaaaaaaaaaaaacaaataaaggagccaagacagggtagaaacctcatgaaaggggaggcagttatcatagaatcatacacactaacccataacttaatcactactgaacaccgagagtatccaactctctcatagaggttcacatcacactacgaccacagcagttagcctgcctgcctgctaaatacaatagctacttaccatgtcgggtacaacacaatgactgaaactaatacaacaaccggcctgcacgccgggtctgctgctgcacggcagcaggttgcgggtgaagcggttctccgcctcttcaccaattcctaacgattctaaaacatgtcaaccgggagcctcccgtggtcattctcggctcctcttgctgctgcagccagggcacttgtactgcttgatgtgctctgccttcgcaggggtgatccgaacgcacttgccatggaaccacttctcgcagacgtcgcagcagatccagaactcaccgttcgcgtaagtctctccgcaagcgccacacatgtaagcctggtcctcatcctctgtgccttccgggccgctgtcttcctcatcttttggctgaggtggctttgcaggcttgctgttagaattggattgcttcgatggctggaaaagaagggaaacgaaaaggttaaacgttgtgttgatatgggcgctagataatgcatgttagacatgcatatgatcacatgtacatactttagggttggacttgttgcttttgctgctgccgttggagacttttgtttgcttcttggcaattcccgtcacaacttcatatacagtgggaagaccattaatcatggtgaagagccgtctcctgaaattcaaatgccagttatggactattgtcattttctaccaaacaatataatgttgattgttgagtgacaatgcactggataatattactcagataattacacaaaagatgaaaaatcctcttgtaaactttgacaaatggaatcagaatgcctcatcacagttgatttctgtaaataagaaatgcatcgacagctgcaacgaaaactatgcaaacctggcttccttatcaaatccaaagcgagccccaaagtaaaatgctacagacagtagccatgcatcgctatgaactgcaaccagcgacaaccaatctttttcgatcattccatcacgagcaaagtttatgcccagtgctggttctggaagttcaggaggtacttcctcagctggaagggtcacgtcccaggtctcattgggcaatccataaaggcacaggttctctttctctgaaaaaataggagatcactatgtcattactatgacataaacaagggaagataacttcattcaacagactacttgtgatgtaatgtaccattcatcattatttcaatggacagtacagcacaaaatggctacatacagttgaagattaacccacacacgcttgaagcacatactggggctatgcctagggagtcgacaaaccaatttactcaaaacaaattattctcacgtaacccctaaaacattaaacccgtcttcaaacatcaacaggacagtaagttttggagctactgttgtttttcacctttaattgtagtaatgatgcaattacagtatactagcatattgacttacattttgggaataattaattatttgccactcttacggatggtgataaatgatttgccactggacccatatgtcatagacacatgagggctcacatgtcatagacagcgagcggcaaataattaattaccacatcttaaaagtggccaaaagttaaatgtcccaggatcatatgattacagtatacaattacaattaacttatattttggatcatgctagcagaagctgcttcaatggttccctagcaatgtaagtatgctgttgggcctgtagaatagggtgctttagtgttttaatgggccttgaaaattgtaatgattaatcagtcctgtatgatgtgggccaagcccatgaatacatgcctctacatgctaacataagttacagataggaccaggcgaccagcagtaactgaatttggatatacctttttgtccacttctgtcttcaattcatgaaatttctttactaaaaatatttacttcgaggaaatttcagaaaaccctgagttttgggtcatgggtctcacaaaacacagtttttaccatggaaaacaacttttgtttgctaataaaatgcagtgaggattacacaaggctggagaaagagtatggccaactagaataactcccatgaagccttttcctaaaaatgtgttaaaatttttcaaccagattcccaatcctacggtccaataaccagatcatagatttacatgatgatcgatctggaaaagagaatagttattagcacgatgtgatcaggatttgatttgcagcctctacactgagctgatacactagcttcaatcaaatgaaaatttaattatttaaagaccacatctgattgattgtggttcatatagagtattttgaatgcaatcatcatttaagcatgctctctgaggtcccagatgctgatagtgcaaaccgcaacaacaattgtactttaatttgctgaaacctgaaactaccccctaacaaactgacttaaatggacccaattacaccggcaagcgactgcaagataccagctaagaagaaaaagctttcaccgataaacactaaaaccgccataactaagacagattagttagggctacaactaaccaattattcgagcttttattcttttccccgaggaatcaattattccagctttaaggaactttaagaaacactggagcaaaccctaaaatcgcaaccatactaagctccgtccatccagaaaaagcaaaagcgactccagagcagccgcaaaaaagaccaaagcctcacatccccaaacacaaaaaatttagctcaaacacatgaacatcggggagctagcctcaccggggtcgcactgccggtagaacttctccacatctgcacaaccacacaaaaaaaagaacagcaaatccatcaaatcaatcaatcaatcaatcagcaaagagcatcccaaacaacaccgaagagagctacccaccggtggtgagcgccttgacgatgcccgcgcggcgcgcgcggaagtcgcggaagacgtcctccgcggaccgcgcgttgtggtgcaccgccgcccccgccgcgttcccggcggcggcagccgcagcaccagcgccgcctccctcgtccatccgccgggagctccttgctagggtttcaggcgagtgggagtggggggagcgagcgagagtggtggtggtggtggcctcgtagtggagagcgagagaggattagagaggaggggcaaaatcgcagccaggtccagacgaggacctaaacgcaaataaacaaaattacagggggctagcacgaaaacgaaatcccagtttccaccctgggtggggtggggcccacctgtcggggcggttgatgggctcttctagagttttgtctcgtggcccacggagaagagtcagagaccactcgtcttcttccttccgctcgctcgctcgctcgctgacgtgtacgcttcgcggcggaggcggcggcggcggcttccgatggcggaggcggcgggggcggcggtggcgccggcgaagctgggtctgtactcgtactggcggagctcgtgctcgcaccgcgtccgcatcgccctcaacctcaaaggtacgttgtgcccgcgccgcgcgattgccttcctctcgtcgtcatcttctatgcgtggttggctcatggccgggcagagtgagtgaacctggtgcgtgcgtgcgtgcgggtgattttgatgtctgtctcctgcaggattggagtacgagtacaaggcggtgaacctgctcaagggggagcactctgatccaggttaggtgctacgccacctgtctgtcaaactgctttcctccccctatctatacttgtgtacggttttgtgctgcgtctagagactgttcgtgcaattaccgccgcaaatttgtgcttggatgttgagaggtaagattctagcaggcgatcggcccgaaatccacaaggctaggctctgtgggggaagatgaataggaaggtgttcgatgaaatgcacaactgagaaaattgagatgaacatgagaggtttcggtgcagcatgtggaagcgcctcttttcgggattttcttgatgcaatataaagcaaagtgatatatgcagatcatggccttagtacccttgtaactggacgcatgatacgcacacgatgcgccatgatgtccacccattcgtggcacgcacccatgcacaactagctcagaatcgtaggggaggaaccaaaaaacaggaaactcaaaccgaaagatagaacacatgtgtggtagcctcaactattttcttttttgtttgtgggtggaagaattcatgaaggttaatcctatgaagttcgtcccggcattggtcgatggagatgctgtaattggtgattcttacgcgatagcattagtaagcattcagaattttgagatgcagtagtttatagcatcaaaattggccgcttcttgacttgtttctatgtgattgcagtatttggaggacaagtaccctgagcaccctcttttacctcaagaccttaaaatgaaggccttgaatctccaggtaatgatagattctgcactgctatgcgcaggatgatgacctcaattaaacattccatttgatatacaagtgctatttgtaatttgttgaggttgagcagcgttgatgttcagttagtgcctatttgagaaggtaagatcacatcagaacaataacaaaaagaggaaaggatcagcccacacatgtttcaggataataggaatactgagcacaaggatataagataggcttaggcataatccagaaaatatagcttactgtatgcactagattttttttcctcttaccgattgatcatgcctagtgtgacctttcatgacataatctaattttatggcagatagcaagcattgtatgctctggaattcaacctcttcacaatcttaccgtactggtaagaactgatttgcattcaatttcttactgccatgtaaggttctctgcctggtatttgattactcagtgcacctgtgttccatgtctatctggctgcattgtgcaaagatgcatttttgtgcctcagattaactctatattaaacagtttgtgcttctgtagtaaaattaatatagtacagctcaattagggaaaaaaatattgtataacagaataatttgcgggccacttgtttctttgcagaggttcattgagaagaaggttggtacaggggagagcatcccatggactcaacaacagatcgacagaggtttcgcaggttctcctcactgacgtatcctttattttattaatcaaatgactatattttgcagctttacttccaccatcaaatctgcttcaaaaaaaatgtgttatgcataactcagttgttttgcatgttgtgagaagctcactcatattcctccccttttcacattcctgcctatttagatttgcttttatgtcacaccatgctcacttcgttccccaatggtgtagctgctgagaacctagtaaaaggctgtgctgggaagtatgcaacaggagatgaagtccgattggtgtgtatgctgccctaacaattttatcctttcttgtatggagatcttctctaaggtttttttttttttcgtgtatcttgcttgcaaattgtgtcactttttccctaaaacagagtgaagttctcccatgtgaaaaaagaaaaaactgaagtgataaaataaaaatgcatcctcatattcactgtactcctcatgagaaccatagattgccatttactaactttccctttgtttatgtaatcatgtttgtgaacactccaaatattaacaagcactgttttggcttcagtaactgttgcatttccgttacacatgcaggcagacgtattcctcgcacctcagatttatgcagcagtgactcgttttcaaattaacatggtactgttcttgtgcttcttactctatccatgcatatgcctttatctattttgttaaatctaatgaaatatgttttcttggcagttaaattatcccactctcgcgaggctccatgaggagtatatgaaacatccagcatttcaagcagcactcccagacagacaaccagatgccccttcctctacctagaaaatacagtgtatgttcatctgaaaaatagattaaaagttgtacccaacttatcattggaagctgtaacaataagcacagaacttgttgcgaaaattgaaaataggtgtatatgtttttcaaagcttctgtccaaataaatgacccttaaaattgctagcctatggacaacttcatgttggcatcaatggtgccaacaacatgatacaacttgagagtgggaatacaagatgcacttgaaacgcattggtttgataatcttacagattatgtgtgatgcagcacgaagagaaagaatctcaataagggctcaacctgatgattatccttaaaaacaagtgtatttgattttttgcatacctgagttaaattatcacaagacactgcccattttagtttctgttgtacaagttaaaattttgaatagttttattgtgatcatagccttttctgacttttgcaacaaatttgagcaatgtccgatgggcaaatggcataaacaacaatgtccaaggtttgagaactaagaaccaattaggaaagacaggagggcttcctctcatgaaaccgccaaacttaatagagctacccaacgataaatagaaaaacaagagtcatcaagaatgttacttttcgagcaattgatagcttgaccacctatttatctttttgagcaccccatcctcgatgacatccaaacaagatgcctaacatatctaaaacctaaaccttttatatctcggctcgaaacataatcgagccaaaataaatatgaaactattgagttaagattgatagatggagtctcgaggtgtgtatttggctatgcttcatggattttcgggcaatgtgtgacgacattcaagaacttaaggctggtattagcaattgatgaaactttcttagtagagcaaggatgctcacttcctactattagccaatcttaatagagcaaagataataatagagctcacttcctactattagcccatcttaaagctaacacatataatagattagctacaaggttggctacaattttcttctcctctctctatctctcacttatacattaattgtatttgtattggagcttgtgttaagctagctcttgcatgagagccaacacccttaactttttattacatctctcctccatataagcttatagtaggcttatagcactattatacttgctcataggcaaattcaaagggtaccttgctcacaacaatagggaatagggattgatgccggattacaacttactcccttggcatttgttctggtagagaaggacaatacatccaagtaggagtagttcatcaatatgattacgttatgtttgattggccctaatagagaaatatcataatatctgtttacacccaaatttggcacctaggaataaaataggaaaattgccaaagtttggaaatctgccgattttccgctgagaaagctggtctgaccgtcgtatgttggccggtcagaccgccgacagtgggccggtcaaaccggcggtgtgtggccggtctgaccgccaaagtctgaagccgagtctgtttcgtcgggtctcgaggtttccttgctcgggaaggcatgtttcgggtttcctttggattctatcccgagtcgaacgtggaggagggcctgtagagggcaagaccaacccctatataagggacaaggccggtttaattgtaatctatcaatcaactatcaatcaatcgaatcgttcttttacttttgcttctagttttagtttagtttgtccatctttgtcgatttgcgttgtaaatcgtccgccgccgttgcgagaatgcgacacctctttgtaggtttgttctgaaaaccttccgttttgcccacaagacgggtagttatctatcgttctatctatatctgctccgctagccggtttagtttattaaaacccatcttggtttagcttttgcttgattgaggtggttggcgactctagaatcaccgcaaagctttaggtgctgcgatcgtgcttgtcaacttgtcacaaaaagttgccaacacgatttttggcggctccgctggggaaatcagctcaacgtcgtctcaacttcgacgccgccatgacgaaaatgaccaagccagaggtggaaccatccaatatcatgccaatctcattggaggatcttgatggggaagcacacaagatcatggaggagcacatcaaggcggtcacgcaggagatgctgatgagatcgtgcaccaagacctgtggttctcaagcctagaccgttgcctaaatctacttttgattcggtaggtgctgaagaggtaccaattcctatccaaaatctcgtggcaatacaatagattcatccattgttgcttcaaataataaattagatgcatcttttgaatctcgttttgatgcgcgaattgaagattttatgaggaataaattcggttcttttttagccgattttcagactaaagcctctaccagtactagcaaagcccttgttgatcaaatatacaacaaaaccgatgggggcgaatatgcaaacaaccggtgagggataagctgtgcattcagccggtccgaccgggccagatggccggtccgaccgcgcgtttaccgccggtcagaccggccagatggccggttagaccgggttctttcccggtctgaccgcgcctctggatgctggtcagaccgggccttggaccggtcagaccggcgcaattatcccgatacaggggattgatccaatgacaaataatgggcttttataccatattccagcacatgattcccctatatctactgttagtcctcaagttcccccacatatccctaatatttataatgatcttactagaagatatcctcccaatactaggtatggccaatataattatattgtgccgcaaccacaacctcttatgccaccaaacccaccaccaaatcagcataggcctgagaatatagaggaattgattagtggtattattagggataaattcgggattgaagctaggaatcatgctaaggtttaccaaaagccgtaacctgattactatgataacatcccatatcctcatggctatagagttcccgaatttaccaaatttagtggtgatgatagtaggaccacataagagcatgtaggtcaattcttagcgcaatgggatgaggctagtgattctaatgataatggtaatcatgatatgtatgttgctgagtggttatggactaacaaaaataagccttttgtttgttctaatttaatgccgactcctcgtaaagatcggcaaggtgaggttaagtatagttttaatgtagccaaatgtgataagatttttgattatcttttgcaagaaaagcaaataaggttacctaaaggccatgtcatacaatctcaataggaattaaaacgttgagcttattgtaaatgtcatgattctcattctcattctactaatgattgcaatgtgtttcgacgacaagtttaatcggccatagatgaaggacgattgaaatttacgatggttttaagatgaagcttgatcatgatccttttccggtgaatacaattaattttaatgataagaatgtgttgattcggctggagcaagctgaatctactaaggggaaagaagtggtcattggagagcctaggccaaagatgatggtgccaaagaatccggaggttggtgtttggaaggagaataggagtgaagtttcaagttctaaagctccaaagaagactaaggtgaccttcgatatgcttttgaataagtatgagaagcaaggaggtgaggaagttcacaatgaagggaaaagaccaaaatcacctcctagggagcgatttggtcattcaccaagagacggtcagaatcacctacatatcatcgttcacaaatcatgtcatgggggccttatattatgggacagaaggagtaataagtagtcagggcgttaacaattgtccttctgattagaggagtcctataatgccacataggctaaattaagtgactctagcgccgtgtttagttccaaaatttttcttcaaacttctaactttttcatcacatcaaaactttcctacatacacaaactttcaactttttcgtcacattattccaatttcaactaaacttccaattttggtgtgaactaaacacaaccctagggaggtgactacggatcggacgtccgatgttttagctaaaaatcggacgctcacctccacctccgccaacacatgcagacacaccagcaccaggtgcagcccactgcaagcgtaggaagccatgcatctatactagaaaacaaaagttaggttggtttaagttttttttagcaaactttaaactattttttctcttaaattacttctccaattcatgattcgattgcaccactaaattcgttgcaattaaatctttaaaataagaccaaacatgactataatccgatgaaaaaaatatttagctttattcatgaatttttcaaatgttgcacctattatatttaaatgtttcagtcagtattcatatggtgtttcactatttaatttgcaaatgttgcacgtggtgttcctagaatgttttagcaagtattttataatgtttcaataattatagtttagtgttcatatgtgatataaaaatatttcaacaatatcgggtttttacaaatatattgtatctgtgatatgttttatttgtttcactcattaggactcagtgtttcatataagtggttgctagtgttgcagcctgtatttttaaatgttgcatttctctaaaacattttatagagtgaactgaaacaaacttttattatgggtgaaacatcgtttgattttttatcaaaatataatcgtgtgatatcttgttgttaagatttaattgtaaggaatacaatgatgtaatcatattatagattggataattattttaggagaaaaaacatttaaaggcggagaaaagggtggagatgagtaaaaaaaattacgtgtggacatgtatgaatagacatgacatgacatgtgcagcataactgtgaatgagaaaagaaaagatgtatagagaagctattgactggtacactctgtagttcgtataggctgaaatatacaagcaggtgtccgacgcgtccgattgtttatccgttgatcggacgtctgactttaagtattttctcaaccctaggtgtagctttaattttatatttcagtccctgacactttttatttcagttcttttttttttcaatttaggtggaggtccaaagtttccacttaacaccctgtaatccaaaacaaaaaataaaaatcacttttccggccttcctccccccgagttcacatcgtctgcctttggagcaaacggcaaacattgccgttgcactcatccatgccacacatttttgtatcaacggctgtatggagtgaccccaccacagtgattaattaattaggggcatctaatcaatagaattagttgtttctctcctggaaaaaatcaacgatagaattagttatttctctcctggaaaaattcaacgaatacgccgtggctttggaaataactaattaggcattttttgcatggtcaagtacattgttcattgagttattcactttcatgcaatttcgcaggctaattcatgagtttaaccataccattaagcattctctctctatccaatctgttccatttatgttaaccataggaaatccatttcattatttgacattttgactaaatgttttataaaatataacatgtaacaagatgctacacacaccaacagtaaaaattaacccttattgggtggcaggaccagcagctaccttgaataactctattgatacatgcaagaatgtacggtatatttaattaaaagcatgtcatgtccatgacttttgacaaactagagaatgttgtaggaagaatgtatttgttgtgcagtgttacatgaagttaatttgacctttgctattcatctggcataagctgaaagttctcttccgcaagaaataaagcatctaaattgccaatatactccaacgttccatattatgcttcctttggctaccatttagatgacctatcaattttctattgacttataagcgcgtaggttgttctgatggcattgtgcgagtttgctctggtcatgtctgaatacttttatatgattctttattttttttttcaattctcacggggaaaaccatttgttataagagaatttatagaaattgtgttgtttgctgcttggaacaactcccccttagactttgctgcaaagcaaagtgcttttttccactgagattatgtcacaccctaaaaattcaaaatttataaattgttgtttaaatggaatttttagaatttattttacaagtcttgaaaagaagatctaattttaataaataaattccaatataaaaaggggccagataaaatttcattaaatactttgcttaattctataattcctagatttttctgggatttatttgagctaaggaagtatttttaataaatggaattgcatttaagaaataatttaaattgaaaaaggttttaaaagtttcttttggctttgggctgaaagtcggcccaaaaccgctctctctctctcctcggcccaagtcggcccagtccgcagccgcagccgcccgcgcgcgagcgcgttgtcgctgacaggtgggtctcgcctgtcaggcccgtcgtcttcctcggccgaaaccctagcgcgccgccgccgccgttcccttccaaatccggccgttcctttccttctccggccgaatcaatagaggggaaacgatctccgggatctcctccaccttttctcctttggaatcttcggctaaatcggtttggaaaccgatgggttcgaggtcgactcggatcggctttgagcccgatctttccttctcgtcgccggtcgccgtgggccttcgccgccgcctccgagcccctttaaaaggacccccgagctctcctctacccgtcgctcccttcgccttcgcctctcgtcgtcggaagagtcctagcgccgtgcgccctagctcagccgtcgccgccgtcgctccagccgtgcgccgccgtcgttccagccgtcgccgtcgctcgggaaggccaccgtcgggatcgccaagtcgccgccgtccttgtccgctgcttcgccgtcgtcggagactactggagcatcgtcgccgccgtcaacccgaagagctccgccgcttcttcttcgtcgccgtcaccgtccgttgggtttccgccgtcgttttggtcgccggtgagttcgccgtgtcgtccgcttcgtcctggtgccctccgtttgcgtcctcgtgccgccgttcgctggtgagcttgcgccgcccgagccgtccgagccgccgagccgccgccgccatagatgacgtcatcgctgacgttattggggccgtccgccgtgagccgccgtggacccgattgatctcggccgtccgttttagatggatcgatctcggccgtccgttcgcgtgaaccgccgcccgtgcgcccggtccaccgcaaaccctagccgctgacgcaataaatcctcttttccttttcaaaaacaattcattattgcgtcataattcaattaaaatcagtttaagtgttttaatccgatataatctttaaaaattcataactaattcatcttagctccgatttagttggttcaagtctctaatttttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggaatcaacctattctttgttatggccctattgttcttgtttaccttattccttgataccttgggttaatataatttgactggttgaaccttatatattggattggttcaactagatgttagatgtaattgcttagccctgcttagaaacactagttcacttttgggataacttatgaatcattataatttaataatggcttaatgatagttcacgatggttaatcgtgattggttaattaattacttgccaactaaaatttgataatggtgggttgtgagcacatggttttgagagtcgtgctcatgacaattaaggaccggttcacgagtttcggttgtgaaacattaatcgtgccaaccacaagccagcgtgggcaacggctttaccttttgtatagcatggttcattgcggagcaccagactgagaagtggcggagataagcccacgggggtcgctggggagtccattacctctggttttgagggggagattatgatccaggaacggtgcactgtagtggattgtgttgtgcgagaggtaatgtcacagctcctttccgaggtaccgtggtggtactaaggcacatggtgacatgatgtggggctgtgtcttgtgggtacagtggtacacctctgatcagagtaaaactattcgaatagccgtacccgcggttatgggcgggtcgagcaatgtctttcgtgattagtcccacacttctcaccatagtaaatgatgctttaattggtaataatttgtttaattcctggtttggagaatagatctgttcagccgggtgtggttgtcagaatggttgggcctatacaacagggtatgttgtatagtgttggtttaatattgtttaatacttaactgttttattaaattctccaatgtttgctaaatgctgcttttgcaaatgagcctatattatgccatcctttggtatccttgtgcacttgcatatttgctgcgtgacttgctgagtatgtcatatactcaccttgcaatcattcatcagaggaagagttcttcaatgaagctgatggtgtggaggattaggtgtagtcttggtcaagctgcctgtggagtggagccgtctgcgccgtttattttactttccgctgcttagatctttattgattgagaggaactatctacctctgtaataatattttattcgctattagagtaataattgtactctattatcaatttgttattgtgtgcctcggttgattcctggacgagggttcacacacatgtaagcgtttggaattttggatagaaattccgggcgtgacaagttggtatcagagcctccttgaccctaggttatgccaaatggttacctatagaagccctctaaaaatattggaaaagtagaactgttctcctccctttctcttttaattaaaccaaactaatggcacatgcacttcttaatctcttttaatggttctcattaaaaatttattccagtgttattagtactgtacatctattactgtactaatggctcattttaccagcaaaagttttacaatattgttttatttaatcttgctgcaataaaataaatttagcatgatgattttataactttcttttatttcttttaaaacctgttgttcaaaagtacaaaacttgtggccttgtttccaactgtttcaacttatcttgcaagtttggtttactttatttaattaccttttaccttgatcttctaaactttattcaaattaatcccaaaacttgtgctattaattggataaatgtcttaactccctcctttcacttgtctttagatgccgcgctacaagcctgagtacttgtttggtgttgagggttttgtccaggagttgcgtacaatgtcctttgtcattggattcgggactgcccctttttatgcccagattcctcatgatcgtcatgaagagaagtgccgagtcaaagtcaccttgaacagtaatagtgaagatatcccctcagtgatgttcgaagctggaggaagaaactacatccatgcaagtcaggaggtggcaaggatcgccataggagagctccgcgatcgttatagtgatcagttggccgatactgagtatcgctatcatcctcgtcaaccccagggaagtgaccgtggcagttaccttgagactgaaggaattgagaatgatgctaccacaaggcatttggttgagatgctgtgggctatggatgaaagtcgtgcggagattgtgttggcagctcaagatcgtgaagaccggaatcgtggtaagatttgcaagctagaagacaaagtggatcgtttggagaaggaactagccgcattgaagggagaagcgccaccgcagaaggccagaattcgtcttaccgcaaggaagagagctctatttgtccctcgctatcaattggcgccaaaggttcgtgtggtggagaaagaagttgccctaactcaagcagatcctccggtcatcatcataagtgatgatgaagaagaagaatccaaacgcaaccattccaagattgagtgggtagcaactcaagatgatgaagacgagccgaaagaaccttcaatcgacctccgatgctcggaagaattagagtgacttgttaagtcgttgttttagatcgttgtgttagtttgcttactttaagttgcttgtgtgtgtctcgcatgtgatttacatcagtggtgggatgtaagtgcatgattagatgctatagatagagttgagcttagtgtatatcaaagctgtgacaacattgtacatttcatatcgttctctgctttgcattttttttatataaaaagtgtctacaaaagagttattaagatattgcaatttacactacaatatatgtaattcttgaacttagtttgtttgcatgttcagtgtaatatataatgtggaaagatgctataatctttgggtgattgaacatgattagtgtgatatgatgtgggaaacgtgcgttgcacgtgcatgtttactagtgatttattaaagcttttgctaatgttttcacatgcttaaccacggcgtattcgttgaatttttccaggagagaaataactaattctatcggtgatttttttccaggagagaaacaactaattctattgattagatgcccctaattaatcactgtggtggggtcactccatacagccgttgttaaaaaatgtgtggcatggatgagtgcaacggcaggaaccccctcct

SEQ ID NO: 63485 - DNA, 11237 bp, Oryza sativa
tcccagattcccacggcggcgaaccacacatctccgtcctctcccacggctgcgaccacccctcctttgctccgacgaccagcggcgcggatctggctgtacagcacgacctcggatcccacggcggcgactccccctcctctctgtcctctccgacgacggcgcaaggcggtgcaccatccctcctctcctcccacccccaccggcacggatcgggaggcggcgtggccggcgagcgccgtccgactcggatcgaggggcgactccctcccccttccggccggtagcgccacccccctccatctatcctcctcgtcggggcggcggctcgacgacggcgaggggagcgttgcttcgcttcggggcacggcctccccaaggcggtttggcccctctcccgcagaagccgagacggaaatagacgcaacagtccgattcggatcggagccggggggaacccggtgctatatatgccccaccaccgtcgaccgccgcagacccagggtcgtcaagtttgaaggcaacatgatgcagcaagacagcaagaggaagaggtccgtgctgccggagacggctacgttggccccgggaagcaagaggaggaggaggaaatctgtaccatcccgtcatgcggccgcgatgctacctgacgagttgctgacggaggtgtgcctgcggttgcccgtcaaatccatccttcgcttccgggctgcctgccgctcctgggacgcaatgctgtcttccgaggaatttggtcaactctacgcagcgagagccgaggagatgtcgtcagctcctaagctgctattcgtctcacctacggcaaatttcaactccaccgcggtgtacaagtgctcaccatcgaagcccaccgatgacctgctgctcacgcttgatgatgttcgcggaaactatgtggaggtgacacccgcaccatgccatggtctctccctcctgtatgatggtattgccccagcttactatgttatgaatgcaaccacacgggcagtcacacggttgccgcctttccgagatgtggcttttgccactgctggtcttgggtgcgatgcccggacgaagaagtacaaggtagtgaggctttttgaagggaacttgcttgagaaggaatttttgaagtgtgagatatacacacttgggggcgatgaaggggatatttggaggcctgccgctggtggagtacctttccggttctacagttttgctcgttctgctatttccaatgcggtgatgaacaaactgcagccacttttcttcaatggatatctgcactggttgatcaacccattgcatcacgttaaactaccaagagcttctattttatcattttctctcactgatgaaaccttcagatggatccgatcaccaccctttgtggcatctggagtgcatttggtggagcttgatggtaatctgtgtatggtccgagaccttcgtgataggtcaactgctgtttgcaagttggaaatttggaagcttaaggactataactctggtgattggtctttggatcatcgaattgatttaacagggcagttgcctagggatttacttgagccacagatagtgaaagttatcggttccgctggtagttgcagatcaggtacgaagataatcatcgccacatccaagcacaaagtttgttcctatgatcctgtttctagaactctggaaaccattacctcaatctcggagacctgcacatcctatcaaaatgagaaatctgatattagattcagtttatttaaagaatgccttaccccagtgcataaaacaagggaagagattgccttcgcaactcccttgtctaaggctactaaggagatcctactccgactcccggctgaatcagtcttgaagttcaaaccagtctgtaagcaatggcttgggctgataaagagtgaaagatttatccgtgcatactttgcacacaagaacatggacaagaggccaaaaatcatgcttgtgggtaagggctctggaaaatcacttttcaactttgttcccttaagtaaatggcttcaagaggcatccaatcaaggcacactgtttcttgacacaaaggtggtttgctccaagccttgccgtggattgaatttgatgagcttcgtggaggaggactatctgttcaacccgtgtacaggttaccacagggtctactggaacagagagtggcatcagcaccaaccatggaaaatgcctacgggttgccgtgaacaagaagacaatccttttgcagttggcaataagaatgttggtttggggttcagccaggtgattcaggatcatgttgttgtggggattttctatgaccggaaagactacaactctcgtgagtattctttaacatgttctctatggagctgtggttctggatacttcgagcaactcccgcagccacctctgcctgtgaatgacatgccacctgtctctgtggatggagtgctgtactggatgagcgaaccaaggttgggtcagagttatgaacgagccattgtgtcttttgacattgccgctaagatatttgaagtcatcccttgcccttcaagcattgcaatgtgggaccccagaagtcgctgccatgcatttgtggtggagcttctaggaaagttgtgtgctgttctttcaaattcagttgcagatgagttagatatatggaagtgggatcatggtctatggactagagcatacacaatcaatttaaaattctggccagattactcacttgcaacgaatgttgtagtgcctatggcagttgaccttacagatggaaggattctgctgaatactgggaggaagcttggtttatataatccatttgatcaaacaattgaaaacttgcttgcacttgatcaggtgtcacttgccacacctaaagtgcagcaacagcgcactggaggtcatcttaagtgccacattaccagatgcgaagatgttcctaggaagttttctccgtggaaactatctatggctccatgtgagaactttgctacacctccaagtgcctcatcagggaagaatctgttgtcctccagacaccaatatgtgaaggcactaaatagtgtgagcccaaaggttatgcctgtggttcctatgttgtatgaggagagcctaacttattatccctttgctgcccgagcgagagtgttgtttagttgaagtggtacctttgtcaaatctaccatttcatgtgtcagataggtcctccatgtttggccataccatgtcaccaagtttttataatgtaatattttgatgtttatgtcacgtagctgtcagaattatagttgtgttgcataatttatttgacttgtatttcaagccaacttcttttgtagctttcagatcttaagcagaagggtgatgggtttgaaagcgcaactacggactcaaatgaatgttctttccttttcttttcccaatttctcacttatgtggcaacttttttctacactgatctagatcctctgactttgggttgtaaagtcacagacgtacagttctgctctatccgccgttcgttatcatccgacgatccaaaatcgtccttccaattcctttcttcttcctctgtttccttggccctgtttctgtgtagcttcacggctggccgccatggctgtcactcttggccaacaaagcacgcaatttctgccgctcaaaaggtgtaggcatgttgaaaattttcttttaaggctacagcttctgtcttaggcagattgctgttgcaacaagaaaaattgtatcccattattgttgaagcttctccctttgcacgatcttacccagggtataagaccaccgaatttgaacatcactttctcccgtatgggcatttattccatttgatggactctcatcggtacttcctccgtttcacaatataagttattctagcatttctcatattcatattgatgttaatgaatctaaataaatatatatgtctagattcattaacatcaatataaatgtgggaaatactagaatgacttagattgtgaaacggtgggaatacttaacaagctgacattttgacgacgcacctggtatcgtctccccatgtcatcagcaaactctactcgcgtggacggctatcgttccgtggatatgagatggatgatctctgttcacgcagtcacaccgctcgattcggaggccaataaggtggaggccggtgtagggacgtgggtcacgaggccgaaagattgccctgcagcgagcccctttccgttttctgcatcggccatgatgcgattgaagtttgctgcaagccgacaatggcagccggccatgaagctatgcaacgaagggagcaaggaacggaggaagaagaaagattttagaagaatgataatggacaacggagaggatccgctttctctctgtttctcctagattcctagttcctcgtttgctactactccctccatttcattatattattaaatcacttttttaagtaaaattttaatttaacttagaaaagtttaactaagtttatagaaaaatatagcaaagtttttaactcaaaagaaatatattattagaatatacttaatgttatatttaatgaaactagtttggtagtgtagatgttgttaaatttttcataaacttatcaaagccaaaagaaatttaattagaaaaaaaattaaaacgacttataatataaaatagagggactagcttttagttgcatgtatattacttttcatgtggtcacaaagttctcaaatttgtttccacgaatttgtgtgattcagtcgctaacgaaataatgtttgcagtagtgaagattaagattcgatacgcctgtctgctcactttatgcgaaaatcagggggatatgaagcaactcaaacgtacgacaatcgatttttaaaattcatatatgaactagtggtgcttcaatatctctactatctttacctatcttatcttaataataataataataataataatatataactaactaaaaaattactattttccaatagtcacatctttgcttcgttcgtcattgctttaggacgtgtcgtcgactcgtcgttcgtatcgctcacggaatccgatgtgctttgtgtatgtgtagcctgattctaccagactagtgtgtctccaagtttccagggtccaaagacttgtgttatctccaagctagtaagaaatatactactccccccgctcataatataaggattttaagtttttatttatattgtttgatcactcgtcttatttaaaatatttgtgtaaatataaaaatgaaaagttgtacttaaagtactttggataataaagtaagtcacaagaaaataaataataactccaaaattttttaaataagatgagtgatcaaacagtgcaagtaaaaactcaaaatcccttatattatgggatggagggagtactaatgtattctaccaaacttccgtacgtgagtatgtctccaaagtccaaagactaccacgtaagaaatctaatgtaatcaatcaaacagaaatattagtaattgatcacggtcttaatccgattttgtttccaagattcctacttttaatttttatatacactactacaaaatcgatttttcatacagccaaactccatttttgcaagcggttgggaagcctgcatgaaagaaaagaaaggtatgcaaaaatcggatttttcatatgagtagagcaatcacatgcgaaaatccgattttcgcatatggacgcttaagttatctgaccatgaaaatgaaaaatcacaaaaataaattctgaaaatcgattccccaaaccctaaacctaaaacactcatcgtcgtcgtcctcatcatcgccgtcgtcgttgtgcgcgtggggagcaacatccgcgctggagagggaggggcaccggatccacccctcccatcgttgccgctgccgccaccgtcgctggagcccgagccctcatccaccgccatccaagtctgagcccttccctgccgtcccccgtcggatcgtccaccaccgaaccccacgttgagctccccatcaatggatccacacccgtcgccctccccaccgccagcctcttccacccttccacccacatgccacagtcatcgtcgttgctaccgttaccgagccccaagccgccagatttgccgttattgagctccctgtcaccagatccgcaccttccggcattcccaccgctggcctctcccacccttccacctgcatgccgccgtttttgtcatcgatgttgtcgtcgagcatcacaccgccgagttccctatcgtaggatccacacctacggccctccctaccacggccattcccacctgtcgctcctgctctcatatactataagatttttagcaacaaaattatatccatatgaaagtaaatttaaatgccaatctaatggtatattttttaacaaataaattttatttcatattgtactaaatgttggttaaatgttgaatcttgaaatacgcgcgcgtcttatattatgggatggagggaatagtagttaacaacacattgaaataaaaaatgttgacaacaaaattagaacaatcgaattaaatatagtgacatcaattcaaaaatcaggcatcatataaataaacaacccccaaaaaaaaccacataagtaagagaaattttttttaaaaaaatacagatccaccgctgacctacgccttctttgagaaaggaggaaatggcacgggcgcctacaaaaggaggaggtagtgcccacgagcatcaggagtggaggctggagtagggaaggagacgacatcattgtcactggcttggagtagtagcggcggctggtggtggacgttgcagccctgttgttggcactggagtagaggaggcatcgagtggcggctggctacgacgcggccccgctgcggcggtgggtattgggcgccaacacgaacgatgacctcaaaaaagcaagacatgggagcgccacatcaaccaagaggtgtggatgggatgagagtggtagctacatgtttgacttgtcacttcgtgtggcctccatggtagtctagggtttacttcgcacccgggcctattgggctagatgaattagggtgtgtttagatcctaaaaacttttagctaaaaatatcacatcaaatatttagacacatgcatggagcattaaatatgaacgagaaaaaccaattatacagtttgcatgtaaattacgagatgaatcttttgagtctaattgcgccatgatttgataatgtgatgctacagtaaacatttgctaataacggattaattatgcttaataaatttgtctcgcagtttacagacagaatctataatttattttgttattagtctacgtttaatatttcaaatatttatccatacatataaaaaaaatttggccaagaactaaacacggccttaatgcttcttgttcttcgttgtgtccagtcatgactgcattaactaccattaattcatctacacaatttaaatatgactattaataaaaatacattgattatcaataataaaaccacttcggtagaaatataagtcggtattgagctcaacgtagctgtcgtgccaattgaaataatatgatatttcttgtatatgtataattaaatttttatttatccgatgcaatgtgcgggaatttagctagtctatttcctttcgtcacatggctctcttcggggctatttggatgacttccatagcttaccacaaaatatttggcaaagtgtggcatgccacacattatatgactaaaaatttgttggccacaattatgacaagctatggcaaaaaaaccacccaatgacaagtgggtcagcttgctaaaaaattatggcataactcacttgtggcatgaactaaatactagacttaattggtcaaacttaattgccacaactttagcaaatgttggtacccaactaaacagccctttcgtccggtgtccgatcgagtgtcccacttgtgcacgcgcccaccgcccacgcgtcagattgggagaacgttatggccgggcgcgcacaggaggccatgtctccagagcacagacccacgtagagcgattcgagattacggcgtacccgtgcagaagtaggaaggaaacgcgggatcgcatctgcgtcagttcagaccggtcacaaaccacagctttgctacccttgaatcaaacacgccaataaaatctccctgccttgcacgtatatctggaaaactcaattggatatcccctcatttttatacgtcgcttaaaaaatcataaaaacaatttgaaaacaattagtatgataaattaatatgtgatatgtcactttacaaacatgcaaattcaaattccacttatataagtagaaacaaaaacaataaattttactttgaatagaacacgtaattcacggtcaaatttgtttttttttcaaattgtgtaagttgaattttaattcgcatgtttgcaaaaaagatatatcatatattgttctattttgatattttttttaattttttttgataactttttgaacaacagagacacagcaacgaggggatgccctcctcgagggaaaaaaaatccacttccgatatatcggcctcctgggacaagattcttggagcatctccaggctcaagtgccaccctcgcagcgcgtacttctctttcccctccggtgctttgatcagcagctgccgtagcgccagtgtgccagcagcaaatcgcggcagcccggcccggtcggtcgtgcctcgtgaagttccctgctcttcaccatgccgccatgccggcagtgtttgagtcgagtcgaacctcggggacggaatactccagctcagagccctgcgtcgccccgcactagccgtcgcctcagcccgtcaacagtttgagctcgagcctcgaggctgtacccatggcgtctccgagactgggttgggggtggtgatcgaggtgagcagcgacgccgacgcaggggatcgggcgtgcaaacatggccgggtcggtggaagcctcggcctgcgatgtgaaggctaacgatgacatggtgtacagtggagggacactggaaggccaatgagcagaagcagaaagacgaggacacgaaagatcagaagcgagcgcatgttcttgaggttactcttgttaggtcagaccgtcagataaaaaatgtgttcttgattgtgtcgtggtttagatcgttgtttggattgtttgatagtacccaaccatagttggtgattcatatatattatatataccataggaaaacaaaacacatgaatgcacaagtataaaacagaagattagaaaatatgggaaactttatgtagatgagttgtttggaatacaagaattttatttaaactaacaagacaataagtttcagtttatggttttataaacttattgacctcattttccctttactttaatttgttttcctttcatttgtttggtactagaatataatagaatacagaaacacaggagttgttttcaaaggaattcgagggtccattcctttcttttgttttgtactagaatactaatagaatacagaaacatagaagttgcttccaaagaaattctagggtccattcctccattccgaacagccttataggaaaaaaaaaatatactatggtcctcagttctattgatttttctttggaaatcctccatcccaaacatgcccttaattattgatctgaaaatgttttgtcattgttttctttcctagctgtttcctcgatcaaattatttgatgtttattttgattttaaattttccccgttgcattgcatggacatcctttctagtatctctatctctatttttttaatctttacctattatataaaatttcaaggtgtttttgcctataaatttcgtacgtcgcccaactcattgcccacatataagcatatttttctgtccgatttcctttttcaccgcgcgtgtgtacgtcgtacctgttattttttcttcgtccgattctcttcccacgatttccaaatcgcgtggcgtctaggcccatgtcggcccttgtccagatccctcacaaaacctacgagtccgccgtctcctcgcttgcccgcctcatcggagcctccgtagaaaacaaattagagacctgttgaaacctctggattgtcgacgtgtggataaataactcttccaacggcttcccgatcggctccaggcgaacgtgttgttccgcttgaaccctgcctccctcgtcttgctcagctcctactctcctagggctcggagaagcgattccactctgcctgcgcttggttcgtcgcgttgcggctgatggagtgatggtgaacgagggttctattcactttgatgtcattttaaacaatactatttttttaagtaaatttgacaagaatatacatatgtttagtttcttaccaaattttggaaaatataccagaaatttggtaactacacagtaatgaccaaaatttagtagcatgtacgttggcaacaaagtaagcacatccaaaatagctatcttaccaaaatttgataatattgccaaccttactaaaattttggtattgccagaaattgataaggtttaaaatgacattaaagtgaacagggccgagaaggcggtgatgaagctcgccacccgccgttttcttcttcccaagactcaccagctgtcgatgctgatctagatactagcttcgtgaggttaattaatccattcaccgtcgtgggccgaccgagtctcccataacacgaattaagtttgcggcagcacccagcattccagcatgcactgcagagaatcagtcttagaggcaaaatgaatggcaaatagaaccaggagcacggcagccgctgataccctcatctctggtcgccatgaagcgtcattgatgctcttagcctcttaccatgcatgctcgtcctcggtggccagccacttgccgagccttccgatctcctccaccctcctccagtactgctctgcggatgttctatttagttcacatcaaaattaaaagtttgattgaaattggaatgttgtgatggaaagattagaaatttgtgtgtatagtaaagtttcgatgtgatgaaaaagttgtaagtttgaaaaaaaagttaggaactaaggatacattagtcccaggactaggactaaagtttagccccaagactaaaacattagtcctttttagggctgcaggaat

SEQ ID NO: 63486 - DNA, 803 bp, Oryza sativa
tgataggtgggaccatatattaatagtttagtaagcaaccattgtatgatttggctattaaagcaagtttaatagtatagccaactactagctccaattcatatatagccaatctagtagctcatttatacaatagttacatactccctccatttcataatataaggcacgaccactttttttcagatattccataatataaggcatgcatgcatataggccattaactatgaccctttcttcattaaattattacttttttaaatcctccactcttatgttctctaattctattggatgcatgcattgtatttattaggatgattaactacaagatgataataattattttcttggtctttgggttagagttggttatgccttatattttggaatggagggagtactaaactattaatacctggtaccacatgtcatacacacactgcgtcttggagtccgtgctacagcttgtaaatctgtaggccgccgctcttctctctcctcatttatctccttaaaatatatttgcagttgacttgtctgctattgtatctgctcttagattttctatgatgacgctctctctcgtggcccgatcttctggtgaggggataactcttgctttgatcgagtgtgacgtttgcgacgtggctaccaaccagaacaagtccaggatgccgtgcaatcgctacaccacaaacgatgtcgtaccaaccgtgacgcgcggttgatgatccctgcaatgcaaacgagagaacactgcaagaacaagataagatgcaatctaaatattgcgaata

SEQ ID NO: 63487 - DNA, 7504 bp, Oryza sativa
aatcggagttggcatgaaggcgctaggtccgtttgaagtaagtgctgtctccggaggatttgtttaatctgtttgtgcataatttttgttagttacagaccggtaggtgctatatgtatgtgtggatggatggatccaagctagcaagcaagccatttgacggaattgttgtgaaaaatactttcaccggtggacatctgattctggaacatcagaaaggcattattcccagtgtttagagtttagacctggtaattcgtttgagctgaattttcattttttttccctatacaaacattagtattgtacccgtgctttgctttgcaatctcaaaactcaaatatataatatatacaactattctgagttaaaaaaataactataatctactctaaattaggtcagaaggtattagtttgtgactagggttgtgtttagttccacaccaaaattaaaagtttgaagaagttgaaacgatgtggtggaaaagctggaagtttgtgtgtgtaggaaagttcgatgtgacggaaaagttagaagtttaaagaaaaaagatggaatctaaacagggcctaaattatagtgactgcaaacacacgcatggcctaaaatttgtgacgccatggtgatgcctgtttctggacgtgatgcaagaatgcgtggaaatcgaagttgatgaaaaaaccattgttgtggaagacggaatatgcttttcggacgaaaagggtaccgttcactgattaatcataatacaagattaataagaactatgtggaaattttatgttggcaaatatgacgttgccaagtacgtactttggacatttaaatggttacaacaatataaattgaatatattaatgttatcttttaattgaatacttataattaacatcaacttaaaatatagtttccaacagtcaattcaaacagcaaacaatggtatgtttggttatattcaataagtaaaacataacagaatataagaaatactaaacaaagtccaaaaacaactttggatcgtcatcaaatacacatgccacgaacaattaaacggaagatggtggattaattgctaaaattaaaattttaatgttcatgaaaaataaatgttgagcgtaccacgataataaacggttttgttactgcggacatatatatgtacatccgtttaatcggtcagtacgactgttctccacaaccctgccaaaaatatgtgctattcttcctaagattcgcatggactcgtaccactcttttaagttcctatcacatcgaatgtttggacactaattataaatattaaacatagagtattaataaaacccatctataattttagactgattcgcgagacgaatctatcgagcctaattaagccatgattagcctatgtgatgctacagtaaacattctctaattttggattaattaggcttaaaaaatttgtttcgcaaattagtttttatttatgtaattagttttgtaagtagtttatatttaatattctaaattagtgtctaaatacagagattaaaggtaagtccatagatccaaacaccacctcacactgtcacacaactactcaattaattttaacagctgcagctagaggcgacaagtgagggccctggcaggattcggtagaagtctgccaaagagaaatcagtggctcatgaaaagagagattgaagcagagctaagctagggcagttggtgtgaagtgagataaattaatccaatcatccctttaagatcaaaaggaacacgcgatttctcattgttcggcgaattattgttgggaaatggttatcagcggttttcaacctctctttctcacagcatgaacaaaacaacttaatagagcagaaaacccatacacaaatctatattcattttaaagactataattatgatggtgaatctaccatcacccgccacagatatagtatcatcgtccttcattcactttcacactgaccaatcaattgccacacctagctctttcacctagctcccgacgccctgatccgtgcagcttggaagatccaccgcgatgctgggaacataccaggacttgtcattgtcgatctgcgccattgcttgctactccatcaccatgggaaaatccacccatcaccctaggcagatctgccatcgaggctgcgctagagagcttgtcgatgtgccgcctcgatctacaccatgttgtctcaatgtgcacctatgctgccttgatccacaccatttggaggtccaccggtctacggtgccctgattctcactacccatagctctgtcggcccctatcacgctgatcagtgaggaggggagctcgagaccaccaccgtgaatgtctccgagtatgagcgccccacacgactagctagagtagcttctcttgctcgttcttggtggcgccgccagagagagggtgtttggagagaatttaaattcaaatctctccgcccagggaagtaaaataaaataatatgtgcggacgtgccagtgtactaagtaaaaaaaataaaatggacgaaggaaaatgcattttattataattctcaaagaattacaaaaaatacaaaatccttagtcaaatgcgctccatagcctataggcaaggtggatctgacttggcgattatgtggtcctagttttcggggtctcggaaaacacccgttagttactctcacgggttgaacccgcgagacacctccgattaagctgtgctagtcgtcgtcatcgatattagcttcatgttctcccatgcaaggtgcggatgtggtgagggtgtaagtgggcgccggcagtgttcgcggccttgtcggtccacgcgccattgtcggtgacgtcgtctcgatgtaaactccgcccacccatccatccaaccttgtcggtcatgatggcgttaacaccggtgatgccgccgaacacgtcagtggcagccgtgaaaagactatcggtaatgatgccggtggtagtgccgaactcgagagcatgaagaagtcatcagtatgtgtatgaatattgctaggagcaacaaagacaccagtggagatgccaagcttgtggtcactggcagttggggtagcatcgcccttctagtttccacggcaatggccgaccatcgtcatggtacaatggtcagtcgtctgatcactgcagtaaacacttagtattgagtagttttaggggatgttaggggcgtagcctagcctggaaacgatgagatgcgttccaggagtggggtggccctcttgtatatgcgccgacaatcggggccggactcaaatgatgttgagccacctccgatcgtaacggcttgactcgggagtgagccgatggttgccacaaagaagccgtcagtgtataggcgctgtggagtgacagagacaccggtagggatgccgagctcgtgatcactagacggtgaggtgaggattcatatgatgatgacgccgttggcggcgacgagttggaggacttcgccatcagcaaacaagcagtaaatggcgggtcatatatataaatataagggtttcgtcatcgaacggacgaggttggcgagcatgacgccgtcgtcgttggcatgaggatgactctagccgtgacgatgaacgcgaggttatcagcagccggcggcgacgccaagcacgttcttttttaacagccggcggctccaaacttgcacgttggcgacaaatgcatgattggcgctggcaacgacgacaaggccgggcttgccatcggcggagaaacaatcggcgtaggcgatgatgaccaagaacaggttcaccattggtgatatccgcgaggataaatgtatgctaatgattgatgacgaagacgagggttcttccggtttctggccgagatcgcatcacctcggcgtcaatgacaatcatgaaaacgccctggccgtgcaggtctgagagtatgaccggcgacggcgacgagtcatcaatcatcatcgatgacggtgtatatatataaatattttgtcatggagcggtcaaggccggcgagtatgacgccgtagctgttagtacgaggatgatcccgacgtgccgaagcgaaagcgtcgtggacggaaggcacgacgacctcggccagctgaagcgaagggatcatggctggactcggcaacggcgtgcgggcaccaagcaatagcgctccggcgttgtcctcgggccgctcgacaattgtaacatgaggaagattgtagcgccggcgacggtgaggtgttggccgcgtcgcgaggcagaggctgccgtcagcacagtaaggacgcctggcatctcgatgacgtcgcagcgccaggatgtgtcaccggcggccggagtttccgacgggatggagcagcacaacctcgggcgggatggtttgacagcttccacagcagcttgatatgacggcgatctccaccgaggtagcccatatttcattatcttggacggtgtctcaggaactcagacatgcagcaactgtgacacctcgtgtctctcgtcgccatctcgtgcatgcatgatgatctgaacagaaagagaagaaaaacaagaagaaaactaaggagctatacccatggtgatgactgagtacgggctccccagtgatcgtctcctccttagcgtgcctcctcagcgcacgcgcctcctcgccggacgccgaggtactgcggccaacatcaccggccgccgagctcacgcgttcccgccggacgccgagatactacggcaagcacatggatgaacgcagtgagccagtgtgatgagtcctcgcctccaacacaaagtcacaactcggtcacaacggacggaaaaaagaagattccggaatgacccatgggtgtctcatgcgccttggccttatctctcgtacgtgcttgggcccacatgagatactcacagccacagctgtgcccaagtttgaaaaaaatgtgaccccgtagttaatggctaccaagtttttaattatagatagataaataataatctgtacaattttttttagggaaacactgtaggggaagcccccacagttaatattaaattaaaaaaaggaatacaaataatttacaaaatatttatccactaagataaagcttgtctcttataaacttttaatctgtacaactttacagtgaaattaaaaccatatggcctgatcatcatcggcaattcggcgtacgtgtcacgtttcaaatacgatcaggccaggcggtgtactgctcgcctctgatctctctctcctttgcaaagcgatcgtatcagcgttttggctcatgcatgcatgtatacgttgcagcgcagagtgcgttcactactcgaaaagcaaaaggaaaaggcagccaaattttggtcatctctcggatccctcatctctatagtccaaaccggagttaagtgtgtgggaggtatagtagtacctgtgacgcctgtgtgattttaactgcgattaagttatgtattatgtggtagctcggtttttgtgatcagtaacctaggagtactaacctgtgagtagaaacagtttcgttaattagcacatgaatgtacctacatgcagcaaaatggagtagtaccctggaagaagagctgcacaggaggcggtcctcacacaaaaacacacacactctctctctctctgtgtgtaggggagaggttggtggtggactggtagtcaagcaaatgcatgcacacaccatatctgcctccgatgcgttgtgccgtagcggtttccgcgggaggaaggggaggggacagcggctggaggcagcagcgtacaccgcggcgaaaagcaaaagggagggatgggagcctgggaggtgatccgatcggccagggctggcactggcaaagtgacaagttgtgtgtgtgcgcgcgtgtgtgtgagagagagaggggttgtgacccaggcgtggcgctgcgtagtactccctccatcatataatatataagaatttttaagtttttcttaaacaaccactcgtcttatttaaaaaatttatactaatataaaaaacgaaaagttgtgcttaaaatactttgaataataaaataagtcaaaaaaataaataataatttcaaaattttttgaataagacgagtggtcaagcagtgcaagcaaaaactcaaaatctcttatattatgggacggaggaagtacccagatgccgcgcgagggccttgccagcgccgatcccgacccctgcgaccactaggccgaccgctgctgcgcccaagatggagaaggcggcgcgaccccagctactctgcggaggagccagaggacgactgctcagaaggccgcttctctagtgcatgccgccaccactcttgcgtctccgctagcctgccaccgctccgctcgccgcgggagagagggagggaggagggagaaggaggcgatgagggagaaaggacaggagggaggaggggagagaaagagagatgtaagggagagagaaggactcacatgttagtgggtcccatgatataatttttgaatgacaactggatccatgcatattttttaattccaatgtcacctaagcgccacgtcaatacctaagtgccattgtgctattggtggttcattaaaaatggatgcctccacattaatttaaatggaccttgacgctgagctataatgactcagcaaatccatgccaccttcgattagagtttagcatcaatgaagttggcgctaagacgttataggtcagcgccaaggtccttagcgttgagtcgacgacctatttttggttgaagttttttgcaaggaccagtttcaaaataagtttttgagaaagatcaatttgtccaaaaaaagggcacatttgaagtattgaacataggctaataataaaaaacatacatattccgcttgtaaattacgagacgaatttattaagcctaattaatttatcattagtaaatgtttactgtagcgccacattatcaaatcatagcgtaattaggctcaaaagatttgtctcacaatttaattacaaactatgcaattgatttttttcgcatttgatgtgatggaatttttgaaagtttgaatggaactcaaaacaacctatgctggaaagtagggctcccatcggatggcctattcagctaaagtaaaagccaaactttaaattttcaaacttaattttaacattgattttgagatattttcaacgtagtttctttttcaatatcagcttttaaatcatcaagaacacatatataaaagttatatctataaatttacttttattctctaatgagctaattacgaaaaaagccacacgatgagatgaggccctagctttccaatctcctcccttgttcagtcctggaggcctcgtcgatccattaatgaatggaggtgggccccatgggtagacctcgttgatccattaatgaatcgaggtgggccccatgggcaagggaagtatatgcatcgttgatccattaatgaaaggttcagattgaaagctaaagcagagg

SEQ ID NO: 63488 - DNA, 4467 bp, Oryza sativa
aaaaaattttcaaataagacggacggtcaaacgttgaacgtgaatagtgtaaaactgcacttattttgggacggagggagtacttttgtgccgtgtggaaggctgggaaacagttcctggcatcctgtcctgattcctgtgccctgttcgaccgggccccacccccgcaaaccaaaccttgtcttgtctgcgtctggttccaccaagcgcgcgcctcgccggtcgcagtgaggtcctgacgataaacgagattactccatccccatctagcattttctttaaaccgttaaacagtagtgtgttttatagaaaaaaaaatttcatgcataaattatcttaaaatattagatagtaataaaactcaattaattataagttattggtttctggcttccttattactcgtagaaatcggatcatgtaatatagagcaatctatgttagacatctccaacgtcgctacgccactcgcattggacaaaagagaacaagcgcaactgatcgatcaattgacgccttcttggtccacaccaacaaattattaacccacgaaaatgtccgtgggctgattttgttggtgtgagtcgagaaggaacacatcggtatgatgtattggttcgcctccgtccgatgccaaacaagtagagtagcaacgctgagcgtccctctgacgatggctagtttggatcatggactaaattttagtccctgtcacaccagagatttagacactaatttagagtataaaacataaactaattacaaaactagctacaaagatgaaggctaatttgcgagacgaatctattaagtctaattagtctatgatttgataatatagtgctacagtaaatatatgttaatcttaaattaattagacttaatagattcgaatcgcaaattagtctccatccgtgtaattagtttgtaagtagtctatgtttaatactctaaattagtgttaaaatatcttatgtgataggtttagtccctgtatcaaaataccaccatagatactcctacagtatacccctctacagtacatgagtacagtacagtatgtaccagttgtacatggctgcacataatcagacttgaacaaatgctattactgagcgttgagagagattttttttttcttctcatcgttgcaactagtgaagtgtatgcattctgtactagtacatcacactattacgattacgaatttttactgatgaaacaaaattaaaattgggcgcattgcgcatcttttttttcttttttcttttttttttttgccgtgtgcgtgtggtacagctgggctgcgcctgcgcgtgacaagcacgcggctcgcagcggcaaatcctcctctgctacagtctacagagagaggctgaaaggcaaagcgaaccacgtactcagggctaattgcaaggacagggacgggcccactgcagtgcaaacggctcggaggtggtagtggaatccacggcaacttctttccccaatactccgtatacgtactcacgtacagtactgtatgcatgtatatacacgcgcggcgcgcctgagggtattagtagtagagtactgtacgtggtagtagtacagtattatacaagtagtgcccagtgcccaccaccagtagtatactgtacacgtagtagtagctggggttgttggagtcgtcgggtccagttgcagtggtactacaagtttcagagtcgggttcgggttgtttcacgcagagcacaacggatcgatcggaggactataaaagcagatattcttcgtcgtcccctctcaccttcatcccaagtccgcccaaccctcccacccatcacaaccattcccctctcctcaagaaaaaccctatcgatgggtacgccacatcatcctacgctttggatgttcatcgacagcgtcatgcagcggcgtggctcgccgtcgccaccacctgccgcgcagctgagcgggggcgtgcgccgcggagggagctcaccgccgtcggcgacggcctccggatgcaaggggtcgggatcccgatccggggcgaggccttcccggctgtcccgtgaggaggtcgccgtcctctcgtcgccgaggccgaggcgatcccgcccgacagctggggatgacgcggacggctccttcgtcgggtcgaagcaccgcgatgtcaggagggcgtaccccgccaaaaggaagcagcgcgccgcgacgtcctcctcgtcgtcctcgtcgtctcctcctacggctacggagcggctccgcaaccgcgggcgtctcgttccctcgaaccgcgtcgacaaaaagatgcgccgcttcgtgggaacggtgaacaagttcgacgcgctccgccacgacaccgactcccacgacggcgacgacggcgacgacgacgtcgcgcttggcgcggggccgctcgaagccggcgacatcgccgcggcgaggactactccaagcccaccaccatctcacgccttctctaaggcgccaggtgcgcgctccctggagactcgcgcccgatcgcccacactgagtccgaccgcatcgccgtacacccctgttgctccagggtctcgcgctcgcccgtgcgagggccggcgaccgcgcccgccggtgttcgtcaccaggggttcccaacccagtggcccacgccatctgaatcttcacctcgttcgcatagttcgggcgtcgtccgtggcggagcaggctgcaggggcagccggcgcccgtggcggagcaggcgcaggcggcggccatggcggagcaggagcaggggcaggcggcgcccgtggcggcgcaggcgcaggcggcggccatggcggagcaggcgcaggggcaggcggcaggcggcggccgtggcggcgcaggcgcaggcggcggccatggcggagcaggcgcaggggcaggcggcgcccgtggcggcgcaggcgcaggcggcggccatggcggagcaggcgcaggggcaggcggcggccgtggcggagcaggcgcaggcgcagggggcggcgcacaagaaccaggcggcggcggcgcacgccgtgtcgtgtatccgtggaacgcccctgtgccacaggcattcccactggcgaggtgctctatctgcggcgctgtagcgctccggtattcgttttgttgtagccgcattctttgcgggacatgcggctgcccatgtgacccacccgccgtcgtcgtcctaccgccgcctgagttctttggatcagtttatctcctagtgattcaccagccagtgagtgggttcccatcgcctccgatgatattcacagcagcttggagccaggtggatgtatggactcactggattacttacgcattctgcccggcgtcgaggcttgtggatggatcacatttggtgccggctaaattctactctatgagaatccaaaacagatggatttcttcgatgcatgtctttgatggatatttgcctaggagcatgattaggggttgatggtctgggttcctgacttcctgctggtttactctagtaatagtacttagttttctcttcctgtaatctgtaatatgtaatgtgaaaacttattatctactaattaagagcttgagcacatggaattgcattgtgttggtttctgcacaattgctgtgtcttcttgcacatttgtaatgtgaacacttattatctcaaaaaaaattgcattgtgttagtttctgcatttctgatagtattattctccaccacaatgctagcgtgagatgctgcagaaattgagcgtccgtgtgttgcatgatgaagaccttgcttctcctttttcctccgtgataattaagaaaaaaagaaagctgccgcagcagcagcatggttgcctggatttttttttaagtacctcaaaatgaatgtgagacgtccatttgattcgatctaatggattagattcaatcctactacacctggtagtagatgtagtataattcgtggaggggtaacgttggaaatgtaatagatggcattgtgatgaatttgcaattggcttaggggtaagttcgtaatctagtccaggggtcaatatgcacaatcggttcacagctgcacggaggcgaggcgagatgctgcagacatgcagtgctgctgtgcgcgacggaggccgccgcacttcacgcgtttggcagtgccgtcaatttgatactgatgatgagatcctgtcaaaggactctgctagtactctcgcaaaaaaaaaaaaaggactctgctagtacacctgtttcaaccgtagcgtcaaggtttagcaacacctgcctggaagtccgaggacctttagtaccgtaccgaaccaaaagtgggatgatccatatcagaatctaagacaaggccggaaggtgatcaaaccgatgaagggttcaagaccgtcgtagccatgctgatgttggtcaatttcttgtcaattgttgtttttgtcggtcaaattgcagattgaaatagctgattaagaagacactaac

SEQ ID NO: 63489 - DNA, 4184 bp, Oryza sativa
acaaagcgaccttccctagagcaggccggtacaccatcatatcccaagaatgaagcggtgctgcggtgcacagggccacagggggtggagggatggcgccgtcgtacgtggccgtgggttcacgcgactacgcaaggaggggcggcgggtggcggccgcgcattgaggtgaggggcggcgccgccgtggcagtgggttcgcgcgaaaagaacgggaggcctcgcgaaaggcgaaggcagacgtcgggcgcgcgaggacgggctgcggccgtcgtgcgcaacgaacgggaacgagcgaatcactagccttcgtggaagcacctgaaataacgaaaatacccttccacggtgtagaagtaaaattctaaagtacccatcaggatcaatggttagatttggttcctactacactactaccagctcaagtagagggtactgtaaaataaaatgaccccttgtttgggctttgctaaaagaatagtaccacaccctctctacatgccaatgtaggggatgtttggatggtcacatagactaattataaactcattctataatctagactaattcgtaagacaaatctattttgaacctaattaatccatgattaagctatgtgatattacagtaaacatttacaattaattttattgttagactatatttaatattttaaattagtgtctaaacatctgacctgacatttactaaagtttgatccctgtatatccaaacaccaccgcaatgcatgcatgtttgttcagtgttcacaatcccagtagcatttttttttgtcttcttcttgtgtcgttgctaccttcctttttcatctcagagagagagagagagagagagactatttggatgtttgactgcatgtgcatcattatctgctgcacgtaccgtacgcgatgcagccggtgctccaaggcgccctcgacgctctcgtcgaaggttgacgtcgagagggagatggttgccgtcgcatcgatcgtgcgccatgagcacgacgtgcatgtggatcatggctactatatatacaaactttatacgtatcgtatataaagtttgtacatatatacgtacgtatacaaactttgtatgcgtatgtacgcatataaactttgcatacgtgtgtatataatgtttgcatatatacgtatataaaatttgtatacgtgtatatattacgtggagggtcattaaacttctttaagtgtgtcatgtaggtcactctattttcaaaatgaacatttgagttactaatgtgatataagtgagtcatttacccatctaactatccacacgagtgtgtggatactctgtacaaatttcatgccatgtaggattgaaaaaaaatgccctgagtgtgtttgaaaagccattttatactcttctcactcggctatcatgatttggttgtaccaagaccttaggtccagcttggtaaaccattatgatccagctaatttgtccaataatttgtcaatgacaggtatagggtattttgttttgatagtaaacttttaacttttctatcacatcgtttcaattttttcaaacttctaattttaacgtggaactaaacatagcttaatagtagtattgttaaaaataaaataccaatattgtgagggttccactcgatgtcaacaagaacacaaagcaaatcacaagaatacacaaaacctataggtaacttagatattactaggtgctttaagatatttaattaatattacgcttcaatccgaattgagtccccaccgtaacttaccaccgagttgccatatgatgatcagttgcctgagctctcagattctatatcgatgggaaagtatattcatcctggagggaatatcccctcggttcatgcatgtcatctatgttaaatatgtgatctaaattttaggcttacaatatattcgaattagtttcctactacgactctaagtctttatccactaggactcttagatttctaatgtatcctctgcgtttgtatcaactcctttatagtaatcattgccgatcagcgtctgtattttttcccgcaaggatttttcatgtaaaatttatgtctccgttgtgcatctaatcctattttttcccgaaggatttttcatgtaaaatttgtgtctctgttgtgcatctaatttcataacaagtgtatctgagcctttgagatccatctatcaatcccggccaccggcgtgattccacgatcgaagaaatcgatctcatctgatcggcggcagcaggcgcgtgttcgtcgcgccgtctcgtcaattccgaatttccgagtcatcgccgtcctcctgaccgcgcgaccgcgtgagaaaacgctggagcagcagcgcacgtcacgaaggaaaaagcagcagccgatgcacagccatcgcagaaggaggagcgcaagaaaagtaggagaaaagcaggaggccatctatcgcgcacggttcccaggaagattaggtcaggaagcccaccgttcctgccctgttcatgcgaattactacctctgtcaaaaaaaataagtgcagccatagatatacgtgctcagcgttttgaccatccgtcttatttgaaaaatttataaaaaatattaaaaaaattagtcacacataaaatattattcatattttatcatctaataacaataaaaatactaatcataatcctttttcaaataagacgaacggtcaaacgttagacatgaacagtgctaaaactacacttattttgggacggagggagtaaatttcacgttggtttttgcttcgtgcacacgaagttctaccgggaaatcaagtcctgtgcattgcttgctatggttctatttggtgaatcgcccacacgccagtttaccaggagattttatccggagatccaaatacttctttttatgcatctagagtgtttcacgtttctgctagggttccacaatttataccagcagattcaggattttatttccaaggcgagtttaaaggttgatctaccgctcctgaattgagatgcaatatactcattatggcaagtgaagatgcaagttggtgcatatattgaggatgaaaaggaagtgttgtcgtgcactagtctatcagttgcgcatacatatttcaggacacaagcgaagtcatcgagagggagcctgaagggtcctgtccagatcacgtggaggattacataaattcatgccagcagattcaggattttattcccatggcgagtttgaagtttgtgcatcgatttcgcgtctctgctgggttccacaatgtcataccagcagattcaggatttattcccaatggcgagtttgaagtatggtgtacctcttctggatcaagggtgttatggattatagtccaagtgactatttggcgcacatttattttatcattacgaggttgtttggagattgaagatttttatgctataagggaaattcgtctcaagatgaagattgttaaatatgtgatccgaattttgggcccacaatatattcggattagtttcctagtatgactagtctttatccactaggacttctagatttcttatatatatctcttgtaagccgcacggggagggtgcgacagcccaatgtatccactgcgtttgtaatcaactcctctatagtgatcattgccggtcggcgcccgtggtttcgctgacgtggcgctgacgtggtggtattgaccgggtctcctttacacgtggcgtttaggtggcatttagaattaaaaatatatgtgggacccatttgtcattgacaccgaaaatagattgtgggacccacgtatcccttccctctaccctccctctctctcccacggcgggcagagacggcggcgagtggtggagacggtggtgagccgcggaggcgcggcggtggcgcccaggctgagctccactgcggcgaagacggaggagaccacagcggtggcggcgggaggcacacgcggtggggtacggcgagctcggccgccgccgaccaggtctttgacgctgtaaccggcggacaggagggcaggcgggtgagggcagcggctcatggcagtgggaggacgaggggagccggcggcggtgcgagcggcggctgagggacgggggccggcgggcaggagccgccgccggcggcggcttgtggcagtgggaggacgtggggagccggctgcggga

SEQ ID NO: 63490 - DNA, 2858 bp, Oryza sativa
tctccctcatccctctccttgagtggttctgcctcgccgtggggccacgcggttttgaagtcgctgccgcggcctgcttctcccgcccgccgtcgttcctctcgtcctcccgcagccacgagccgccgccgccctcgcccgcttgccctcccgccgccgccgccgcttgctccccgcggacagccgtaggggagagggagaaagaaagagagaagggaggggaggaagaagaaagggagaagatggcatgtggggcccacatgtcagtgggcctcataattgtgtgtgtgaatgacaaacgggtcccacgtatagctttttaattgaaatgccacgtcagcccacagactaggtcaatacctccacgtcagcgaaaccaccctccaaaacggccgagggagtcaaattgcaccggttttcttagtttgggggtcaagatatccggttttgtggtttagggtcacggattagatttcaatcacttttgagggtcaccaagtgaacttattcctattagtttacatggatgagaattacacggtccattgaggcccatgatactgtggattaggttcgatgggccttgaggatcggcgtccctccagtaatccagcgaatggttcaaaattatgtaatgaaatttccgaaatttcgatcatatcggaccccttgatatgatattatttcggccgaagttttaaatttatattatttttgttgtgaatttggtaatattttgttcaaatgtaactaaaatttatttaaaattttggaaattttgaaccaaaattcggtatattgccaccgtccggtagaaactttcaaaccgaaagagtagggcctgtttggttgttgtccccgtgttcctgcagtggcctgacctgatagctagccgctttgattagcctgactcagagcatctccaacagcctctctaaattagactctccaaacacccatatagccaactctctaattgatttgtcaagccaaactcattcctcactccaacagcctctccatctaccctctctattatgagtctatgacattggaacccacacgtcagcctctactacaccttccacctctttctctcccttttcctctttctccccctcttcctcttctattgccattcttgagtgacgccgatgatggaagggctacgggcggccacatcggatgcggccaggcgcggggacggccgcggtggatacggccgggggcgcaggcggcggcgccggatgaggccgggcgcgggggcggccgtggcggatgcggctgggcggcgggggcagaggtggcggcgccagatgtggatgggaggttttcggagcccctcctcccaggcgccgacgagctcctcgtggtggccgacgtcgtccttgcgtcccagcgcctgctcgtggtgtccgataagctcctcgtagaaggagaggagaagcgcgagtagatggagcactgggaaggaggatagccagcctggtaggctagccaaatttggctagtggatgagctcggatggagagacagttcgcttggagagttgaatggagagtctgttggagtagtgtttttagttcatttgctaaatttttagcttggagagctgagtagagaggctgttggagttgctctcaagcgacgaaaatccaacgcccgtctctcatgcaagtgataagctactagtagcaagattaaggtgatgtgaaatctatgggtcccactattaattacattctttttcttgcttttcttttctttcttcccaccgattgatcatgtttgttgagttaatactatctgttaatattgtctattaaaagtaattattacagtatgacattgcattattcttctcaggcacatggttcaaaccaaacaactcatctcacaggctgcttggtcaggcaaatgtcttcaaactttcagcatagcttcatgtatgagttttcatcatgtcaccaaccaaacaggccaaacctggacacctggtccaccgtcttcctctggttccttggcgctgttgtcgggacgagagctacagcctacgccctacagcgccctcctccggttcagccagtacttccaccgcaacagcttcttcttcttcctatggatcatccttgtcaggtggtgacgacctgacagcacactgatcacggctaaacccgcacagcagcgcccgagtaaacgaacccgccaaaccccggcggcacggccacgccgcgccaccgcgccgcgccgccggcgtcctccatcacccacgccgcgtactgcttgccgtcctccaccttgccgaacacgaacacgaacatggcggcgccgtcgccgtcgcccgcgccgaccgccttcacgcacgccttcatgcctggcggcccgtccgccacgtccctccacgcgcccccgtcccactcccgcacgccgcccttcccggcgccgacggcccacaccttgccgccgaccgcggcaaggcacgtctccgcggtgttcggcgccatgtctccctcgctggaccaggcggttgcgtcgccggttgtggtggtggtgtagcgctcggcggtcttcttgaacgcgccctgggcgtcggtcgggtagccgctggcggcgagcacgcggcccgggtttgcgacgagctgcggctcgtcgcgctcctcggacatgtccgggagcgcgcgccatgcgtcggaggcgacgtcgtacgcgtaggcggagcggagcgcgttcttggactcgtcgtggccgccggcgacgtagacgacgccgccgctcccggtgcagccgaagaagccccgggagtccggcatcgccgcgccgcgccgccacacaccggcggggacgtccagcacgcggac

SEQ ID NO: 63491 - DNA, 6129 bp, Oryza sativa
tacatgcaaacagcagaaaataccaagagagattaatctgacatttagagatcaatctaataaacaacaataagttgaaaaggaaaaaaacccggcgaagtcggagattaaaaggaaaaaactcgccgagattgatctcttcgactgactccgagacggagcggaggaggcggaggtcgcagtcgcgggcggcgttggtgtccatcagcatgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacctctacctggcgcgccaactgtcgaaacatgaattcggcaataataaaagggggtagcgcacgagacctaaaagtggatggatgcggatacaaaggatttagacaggttcaggccctctcaatgagaggtaataccctactcctgtttggggatttgaatccgccgggtgtagtatagatctgacgatcaggttgtctcatgccccctagagggcttcctgcccaccttatataggatggggggcaggattacaagatagaaaccttaaccaacacggtatcggtttcctaaatctactttacaatattatcaaaccaggactttaggccgttccataatatacaaggaaacgtaatacccaagtcatgatctgttacatattccatacatatatgttatcccctattactagtcggataaccatgccgtgtggatatggggtacccataatctccacagtagcccctgagaccttcacagtcgaaaatataatcttctctcgaactagattactccaaagccgagtgcttcaattatcttcgccatggtctcccgagtacttttaccaaatctgaagactgtggagggctgaaaaataaagtcaggtgcatcgaatagatgcacctaataggtgtagcccccgactatgtggttaattgaaccaaccaaacatatagtcaaggaataaataatctaaccaaccgagtggttttgataattgtaatcaaccaagtgacttgatatcaatatatagcatatgcggtgtgaatccccgaataatatgatccaagtgatataccgactgcttggcaaaatatgatgcgtacaacctaaagttgacaacatctttgaaagttcacatagcaaaacagctataaagaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctggaaaaatgaccataatatataatcagcctaagccataatattggtcaataaaaatgcacacttacgtggcaaaaagcaatgatattgtatccaatcaattgcttgataaacccaaacagcacattgactatataaaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaaatgtagctcatatgaagagcttctgatctgagtggttatcccttatgagatactccaaaatagatgtaacaattgaatcccgactggcgcaagtattcagttgataacccttacggggaataataaatagtccagtctttgagcatagaaaatagacccatgatcacgaattcatattgcatatatccagagcaagtccaaattgaaggtatgatacttgtgtttgagctaataagcccctgagcatatagcttgtccttctgtcgtagtcacaattgtccattgatggtagctgacgcagttggcatagagacaagacgaccaacatagagataatattgcccaccagaggtggcaaaaatattggtggtagtgaagataatgataccaatcaaaagtgatgaagttgcacagccgtggaggcgaagaaaccagtcggcaacagtcaggtcagccatcaatgaagatgaaggtgcccagcgataaagttatgtagccatggcagcgaaataatcaatcggtgacagacgaggcagatcaaaggcgatgacgaaatccaccaatcatgaagatgaggaagatagtcggcgacgacaaacgtaaccgacagtaatgatgataagcatcaacagagatgatcaaatatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatctgcgtttgcatagtaggtcaaccgtgaaggcggaatagcaagttggcgaagtcttagtcatccattagcaacggcggaatgtcagagccgatgaagcagatgtgctggtgacgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcatcttgacataaagcttgtcaaattttgagccatgtatttgtgtagcccccgactctttgattagttgggaaacaactgaacatagagtcgagaattatagcttcttgttgtcgagtagtcatcacttgattgaagatatgtgttgaagatgtccaagtagaaatcctgaatattggagagccacttgttgtagtaaaataacacggcatcgcatgccgagatgtcgaggttcacaaagacgtcgtggttggtgaagtagcaaaacttgcgaagcagcagcaatagagtttgccggtgccgaagataataaatatgaagtcgctctaccatgatgacaaagttgcatcgccgtgatgaagtgaacacgagtcggcggcaacagaagcaaactggtagtgaagacgcgcagttgtgaagatgaaagcaccagtcggcggcggcataaccagtcggcgacggaagacgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataataagtcagccgtgcaggcggaagcaccagtcggcggcggacgaggcggccggtcggtgaagacgtagacgcccaacaacggcggcataaaggtcagccgtgcaggcggaaacaccagtcggcagcggcgaaggcaagccggtcgatgaagacgtagacgcccaacaacggcggcataaaggccagccgtgcaggcggaaacaccagtcggcagtggcgaaggcaagccggtcggtgaagacgtagacgcccaacaacgacggcataataggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgacggcggcataataggccagccgtgcaggcggaaacaccagtcggcggcggcgaaagcaagccggtcggtgaagacgtagacgcccaacaatggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagcagtttataaatacgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcctaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactactcaatggaagaccaattggtgtagtgaggcagaggaaaaggcaaaatatcatataaagaataaaacaaatgatgacttagctttgtaatattccctcggtgacagcaaaagtagccgatgtgggaacgaagcagtccatcaatggtgacaaaaacatcagtcggcgccagtggaaccaagccagtggtgtagatgatgaagcccattaacagcggcggagtgaccaatcaaccatataggcgaagacaccagtcggcggcgacggaggcaggccggcggtgaagtcgtagacgcccaacagcggcggcataataggccagccgtgtaggcagaaacaccagtcggcggcggcgaaggccagccggtcggcgaagacgtggacacccatgaacggtggtgtgaccaaccaactgtataggcgaggacaccagtcggcggcgacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggca

SEQ ID NO: 63492 - DNA, 1349 bp, Oryza sativa
gacgatcagggtgtttcatgccccctagagggcttcctgcccaccttatataggatggggggcaggattacaagatagaaaccttaaccaacacggtatcggtttcctaaatctactttacaatattatcaaaccaggactttaggccgttccataatatacaaggaaacgtaatacccaagtcatgatctgttacatattccatacatatatgttatcccctattactagtcggataaccatgccgtgtggatatggggtacccataatctccacacttctaaagaccacatttgaatctgagtgcatatagaaccatagacaatcggttgtgctagctactccctccgtttcaaaatgtttgacaccgttgactttttagcacatgtttaaccgttcgtcttattcaaaaacttttgtgaaatatgtaaagttatatgcctacataaaaatatatttaacaatgaattaaatgataggaaaagaattaataattacttaaattttttgaataagacgaacggtcaaacgtatgctaaaaagtcaacggcgtcaaacatttcgaaacgaagggagtattatctttgtcacaagataaaaactgaatctttttatttcttgcgggcataaaaataaatataaatctgagccttgaaggacgaagagaaacaaatgcatgccttcacgtatggaggcaaagatgcccaattgccccatcattcacggaaacaggtcaatgacagcgaaacggagagtcaagatcctcgagacttcaaagagatgtcttctagtactaatatatcaccatggacttgactcgaagagcatcattgccagcacgcactactgcgttatacatgtatcctgcattctctaacaggtaataagtactacatatatatcgtgcaagggtataatccgtttcaaaatattaaataaattctaaaactgaaaatggacattactaaaaaaaaagaagggagaatagctaatgtggtccctgaagtttcgcttcgggctcagtttagtccttgaggtttcaaaacgtccaaataggtcctccaaattaatcatttgggttaacatagtacttgaaaaaaaaaatgccacataaacatgccaagtcattcttgcatacaacaatgaccattctacccttaccatataaaaaagaaagaaaagaaaaaaaggaaacaacagatagagtaatggtccggcctttttgttcgttcctccctgttgtttccttttttttcctttatttttttcttttcttttttttatatggtaagggtagaatggtcatttcatttgtattgttgcatgcaagaatgagggctgcaggaatt

SEQ ID NO: 63493 - DNA, 11597 bp, Oryza sativa
attaaacgtagactattaataaaacccatccataatcttggactaattcatgagacgaatctattgagcctaattaatccatgattagtctatatgatgttacataaacattctctaattatggattaaataagcttaaaaaatttgtctcgcaaattagctttcatttatgtaattagttttgtaagtagtctatatttaatactctaaattagtgtctaaatatagagactaaagttaaatccctagatacaaacaccaccttactatgatggctcgtcacaaacacgcctctcaagctcttaaacgatgcatttttttttataaaagttttctactacctcggttttgaaatatatattcattaatttcacctaattcattaattaatggcaatcgtcaatctacaaattaatttttgtgtgtgttttacaattctgtgatcatatatattcataccaaatatttgtatttttttctgttaatgagtttttgtcaatcctgcgttacgggtggacgtaaacattttactgtgtccgtccttttacttccagcataaaaaaaaacatcaaccttactgcggagcactaaaaaacgtacttaacctgggtgactacacagttgcatcgcataacagagctatatatatctttattattgggatgaagttcacgcaagctgtagtacttaacctgcaactacatcgttcacactggttacccagtagtatcaatacgatgacatatgctgcgtggttcgatgccgatcactgtagcaaacctgcacggcaatgggcagattctgaagaatggattctagcgttcagagtttcacgccttgcctgagccacctgcgcccttcagtacctcgtaaaccgctgagaaatccaggtcccctagtcccaagcttcttgctttcttgaacgcctgcgattcagcaaaccacagtgatgagttcaagcaatcagttgctgtgttttcagctttcacaggttgcggtgaaaagggggaagaaaggcgtcgcacctcgttggaagcagctgccactggcatggagacagcgttctcgtctcctagggcaagtgccaacctcatatccttctgctggtgtttcaggggaaatgcagggttgtagctgccttgcagcatcgagggccctttcagcttgaacattggattcgcgatggcgccaaggtcctgaaagacaatgatttactcggtgttatttgatgctcaattgtgaaggaggtggctccggtagaatgaaattaaccatgtgccataccaggacatcaagaagtgtctgggggctcaaaccactgttatcagccagagagagtccctcagacaaagcattcatcatactgcagtaagaaacaacattacttgtattttatgagaggaaaaaacggcagtaaatgaatgacagtccagaaagatacaggagatatgtgcatgtgctaacaatagggagcttgcattcatcatactgcagcagatgtttataaataattaatagatagtcaccttcccatgatcatgttgaccaccagtttcatctttgctccatttccaatctctcccaaaaagaacgactttttcccaagtacatcaaatgcagggaccatatcatcatacaatacctgtagcagcagtataattacatcaaatgcggaacagatctatgacatagcactaaagcagtagtgatttgtatcttgctggttaaaattgttgaaaactggcatagtcgacacttgacaggtttaagtatcagattcggatcatcaatccatgtcgtgacttattagatgctaacatctaaaccaaatccagcctatataagctgagtatttctttggacttcaggcaaatgctgcaaaacaataataatatacaccgacacattttgtcgtttgcagaaaaaagataaaattgccacagtggtagacccatatataaactaaaagccattatgggcactataaattttgtaaatataatcacaaaaggtttatgatcattaggccataatcatcaaaagaactcaaccggatgcatcacttataccaaaaactaacaagcagaggaccaaaatatggtacaatcatttatacctagaaaaagaaagactgtttttgcgaagtgtcaccgataccactagtttacagtagtaattgcaaacaatcatcatagcatatggaattaccttgtcccctgcagcaagaatgaccaattggccatcttcagctggctttttgcttcctgaaactggagcttcaacaaaagccccacctttttgttttatagcctgcaaacatgtatttaagggaaatcgattataaacataccttggtagttatagagcacactcaattcggtcatgctgatgaaaacaaatataaataaaagacaccaccacagcaatccagtggaattaaaaatgtgctgaacttccatgctatgatgctaatgctttcttttggctgtttgcttgatgttgaaaactcagaaatatgcaaatatgttgacttgatcagttgatactgtcaacagtactgaattagtctcaaacttactgcacaagcacatactagttcaatggtcacatatgtgcggtatgctggagtccttatgtcataatcatgtgaggttctgattgaatggaaatctatgatgaagtggcatatctataaatgtgccgtgttatactcatactaccatgcatgtagtcatcagacaaaacataaaaggcacaatacatgagcggttgaccaccattcagaatgttatgccactattactggtggatttttatacatcggtgaataagattggatcatactgtgaccacaagtgcattaatgcagaaaaaaaaaagcaaatagcatgcataaacaaaatggaattgtgttcataaacaaaatcacctcttatgatatgcggtgatgcattaacgatttccaatatttaaagtagggctttccttactatttaaacaaataaaaaaaatcaaagcgccgaatgtttagcaaattaaattagctgttgagtatgtaaagtttgaactttaatattaacctgacaatctacaatactccttgatagatgttgacccttgttaggttattaattgtgaactacaagtatgcagtctagtactgggttccatgttatcttagtgaggtcaccggtagtattttaaaaatattgccgacagttttgtatgggaatggcttctttgctctaccaagatgagaaggctgaatgttaaaaatggcctcatttgcacatactcaggagcccattattcaccaagtggccatgctgtgttatgattcatgcaatactgttttctggggagcaagaaagtggctcaatttgttcatatttggtgacataaatcaaaccctggtagccaattgcatacagacggccaaagagatagatatgatatttggcttgtcattattcttccttctttctaactgcaaacgattaaaaatatgttctcttcctccatcgtccacttctgttaagtattcacatgttttcatggaatattccctcggattacgatataattcattctgtgcttggcagtgtaactaggatgaggtatacaaaataacttgttgccattcaatcaaggggacaaaatggctctcattaatgagaatggcagcattaaattagtaaggacataagaaaacacgaaaatgcctacaaggctagaagctctgcgcttttgcaatgatttatagtagagaataattgtctgttttagaacaacttacaaaagcaaaacgagtgagcactacagaaggtattgtcgtacatgatgtggcaagatagtgaaaaaaaagggaaatgccaacctcttaggtccatatctacacacaggaatacatggatgcaagacaaattgtcatggtggtgttcagttgaatatctttgcaaaccaggatggaaactgtacactaacagggtcatcgatatcaaggaatatgcttgcgagcaacatatattgcaggatctaataatgtgaaattaggtaaggtactcagacagtcaaacttgcaggattgtgaagatgtaactggccaatcgcactcaagaaattgcacggaggcaacaagaaccaccaaactaattactaatacacgattaataactcatcactcatacatacatgaattgaaataaaaataatgggggcagggcaaggcaaagccatcagggaggagaaatgtgtacctcgcttatcttgcaagaagtggcggcatcaacagtggacatgtccacataacccttcccttccccaatctgctcgagcacgccgtccttgtcgaatacaacctagatgaatttagcccccaaaaaaaaacaaaaaaaaatcagggaggacgccatcttgcaaacactaaggaagcaggggctagggcttaacagatagcgcggcgctggggtcggagagcatggcgatggtgtatctgcacttggcgacgacggccgccggcgtctcccccacggcggcgcccagcgcgacgagctcctggcactgcgcactcaaacacgcgtcagggacatcggattactcgaataaactcatcaccaatctgcggaggaggaaggatggatggaaagaaaaccttggagagagtccggttccagacggtgacgcggaagccgtggcggaggaggttggccgccattgccttccccatgatgcccagccccaggaaccccacctccatcgcccgcgcgcagctacctcctccctcctcgccttcgtcttcctcctctcgcctccacacacgcacgctgcacacttgtgttcttctcccccagtgttcttcctctctccaccaatctctcgattttctttatattttctccatggttttatttattttattgcgttttatttccacctttttgtcgcttctcttttgggtggaccggatgcatggaccaggagatctgggagccgtcggtggaggtgatggatggacaggatgcgtccacgcgtcggcgtcagatgatgggccgacgtgggccggcgcatcgcatccaaattaatcagccggccgcatcggctccggggcggcggaacaccacgcagcggatgaggggagatgtgtggccagtgggggtgtgacacgtgtgcacgctgggtaggttaacctcgtcgtgggctgacctaatatatgtggcccaaatacctcctcttgaactgtggcccatggctcttgtatcaactggaagcaggagaattgaactgcactgcactccatcaaatttgggtttttttttctttcctttttcagaagatcaaattcctgagttctaaaaaagatagttcgtatttcgtaatgggcttttatcagacggcaaccaggatctacattacccctttttagggcatttgaaccacggtaccgtagtaaacgatagaaaaaccagacaaaattttaccaaatttaaaatttttattcagatttatttaagcttggtgaagtttatcaggcccttactattatcgcaccctgatgataagctcaataatcggcagtaggaaaaacccatagttgagagatgcaaatggaatttctctgtttcaagaagaccgcgatacaagaaagataggaaacttattctcatagaagcttctgctatatgttgggctctatggttgagtaggaatgatatgatttttgacaaatcaccatctgtttcatatatgcaggtaactttcagggcaacacattggctcaggtcttggacattgctacaaaagtgtgatgaagagggcgagcgtttaaaagttgcatgtcgtaatcttgaggcaacgattatgcaaatgtttaccaattttggatggggattcacaaacagaattcaataattgtgtactccttatcctcggttggtaggtgtcttttttttgtgtgagaaactttttattttgtgtgctgctctgtaataattggctgtagctcgttgagcaaagatcgggatattctattccattatctaagaaaagaagaccgcgatagttcataccgtgatggttcgtcgtggactttaatcagacagcagccaagtttacgggcatgtttggatctctaccctaccaatttatcaataatactaaaatctaggcaaactttgatactgccaataaatgggtaaagtagagttatttagctcatgtttggattgggaccaatataaagccaaaatttgatattgtagtgaagaaactacttgaatttagccaaataaaacatgggtgctacctattggttggccttaatccaaactagcacatttactatttagattgccaaaaatattggtaagacacattttggtatcaatccaaattccaaaatggtcctagtagttttatgccagtaagcccggtaacaatggttatcacagtaaacagtaggaaaccagataaaatttactaaaattagaattttcgtttagattttattcaaacttagtagttctgaaatttataacaacaccgtgacttcaacactatacaattactaaaatgaaagttttgtgagaagtgcttctatgctccttgaaaaaaacctgcacggaaattaaagcacatcaatggttcggatcaaaaggtgattactagggtaaaccgtcattaccaaggggcaatttcgaccaggaagtgaaagcccacatccagcccaggccgatcgatccatcgatctgggaggtcgacacggcaacagggctagatggtgaagatcaccagatcagccgggcatgtgcgaggaatgggagggcgacgagctgtgagggctattgtcgacttgtcgtcgttgcgctcggcgttgagacagattatacagtatgatgagatataggaccagttctcgaagggcagtgtggtgtggaagcggcagaccagatggagaatggccgcatcctctacggcggcggccatccatgatgactcaaactcctgcatggtagaatacccgcttcttgtacctagtgaaacctagatagaaatcccaacgattctcctgttttttgattcagtgattttcgtcctttacaaaagctaatccttttggccgcttgacatagatgatgcagatcttatctgaatatcattccaggtgcgtcgcgagggaattgccgtcgcgaatcgatcgatgagagacggctgggtacggggtgggtatggatatgaacttttgcttccgggacgaaattgcccctcgctaatgaggtttaccctgttaatcgctttttaatccagaccattgatgtgctttaatttttgtgcaggtttttttattgaggagcatagaagcacttctcaagttttgttcttttgaaagaatagattttcttattgattcctcacttttctgtagtttttcctatacgagtaattccattccaatgatttcaccggtgacctattcagttggggctttatttatctgtgcaacccttcgacaaagaaagatattctgaaattagataactggttgtaagagaaaccctaatgacaactagctcaaaagagctatatgcaacagcaatataggttttgctctacacccaatttacatatgtaacactgcatcaatcaaaaccatgtaaaacgaactgctccgaaagtggagctagcggcgccattgagtcaagactgcaaaaagccctttctagtttccattaactttttactgaaatcatgttcacaataattggcagtaacgtacaccaactagggaacttgagcggaaaaccgaccagctcgggaggtggctctaccactgatctgaactactccgaaaatactcttcttccgcagttcatcaacacgcaataattccgatccgaacggttgatggtttacacgtacatcgaactcttgtagcttggtaccacgtgctagttgatctctaacaacgacgtgcatttctgaatccttgttctgaatttctgatctctgaccccggaagtttggtacccatgcaccttcttgccatgtttccctaatccactatgccaatgttggtgtggcagttagaacttggaagacagcatctcaaccaacccccacattctctccctcatttttggcacaaacagcatgtgcagcccagctctgtttcctctctgaaaaaaaaatggtgaaggggcatgactgaccatactggtcttcagaatactagtgctgattccccatatgaaacaagaacacagtatatatgagactatcatatagcagctggtatggctattatggattcctcctgtttttagtcagtcaagagtcaattttatactgctgcaatatgcaactggcagggcactagaaatgtgttttttttcaggtgttatgggatagatgcaccctcaccgggtagctctgtatagcttaggttgtttgatcccaacaatcgggtagctgccaacctcggtggttgagaccacgaccaattcaacttgactgttcatttgtttggcattctgatccggaaaccttatcgcttaatatatttcatttttaaaaatatttagggcttgttcggttcaaaggatttttcaaatcataggaatatgaaaaagtaaagaattttcaatccataggaattttttcaagaggttttacctcatgctaagaatcgtatgattctaagactacgatccttactaatttggtaggagctattcctatgaaacgaatgatgcttagagaaaaaaatcatatggtttcgatcgattcctacaataatcctttggaaatcctttgaaccgaactaggcattaggattggacatacttttagtgggattaatctagtctctacaaccaagatgtatctggctacttaaggttggacatatagaaaccatgtgaaaatctactatgaacaatactttttataatgttatattcttttctatgttttcaaatcaatggtatatacaataaaaatgtacaaaccattgattttactagggaaatttgcaaaaatcaccccatgaattataatattatgaaaagtagctatgtccagaatatttaaaaactaatggtcaaatatttaaatgccacatcgatgtccagaatatcatgttttttttaaccaaagtaaacaataaattgcaacgtggtcaagtgatgtggtgatgaactgcactaagttaatcagatagtattcagattgttcacatattggttgaatatgcacctggcttatgaaaattaaaccaggatttatttatcctgctggcatgtcactgttaatgacctggtggaaggcatgcatatacactgcatgcatgaggacgacaacattgatttcgcagacgatgctacaccaaaccatttttcttttcctcattattgaagcagttacctctcgatccaacctttacgtcagttaattacttaagccaacagatcactactagggctactaatcagccaactgggctactggagttgatacacacagcgcctcatcgtttggcatattcatatgtttttcagccaaaatttgaatttctaactttaaatttggagctgattttgaggttttttcatcgaagtttatttttagcctttgcttttagattgctaagaatacatatataaaagtttaattcatatattgattttcgtttgtaaatatgtcatttggcatattcagaaaatatgccaaacgatgaggctggcagacacacagccgatgatgtgtggctaagagcaggtacaataaaccagctagcataaacacatttcgaggagataaaagagaagatagaaaagcagcgaatatagatttatagtcaactgcagcacggactccatataatacgtgcatgacaggtaggaccatgtattaatagtgtagtacttcctccgtactcataaaggaagtcgtttaagaaaagcagcggactatggatttatagtcaactgcagcatggacttcatgtaatatgtgcatgacaggtaggaccatgtattaatagtgtagtacttcctccgtactcataaaggaagtcgtttaagacagcgacacggtctccaaaacacaactttgacttcttgtttctataaaaatatttattgaaaagtgatatatgtatacttttataaaagtattttcaagacaaatctattcatataatttttatattttcaaactaaacaacttgagagttatttatgatttatattccaaggtttgacctaaacattgtcctaaacgactttctttacgagtacggagggagtatatatttatggtaactattgtatgaattggctattaaattgattatagatgatttagagttaatagtttgttatgctattaaacttgctctaaataattaagctgatttagcaattgaattgttctgcatgacgagtagcagaggtgtgtttttgtctcgatgtgttcttcgctagtagcacctgggctctgaccgatcgacgacggcgacgcttcgatcgattccataacgaagcaggtaatgtttctttcgtcgagacgcggtgtaggatcgatttgatcgatgctgatctcttaactaataaggagtttagagatggaaaaaacgtgacaatacagatatagaatcggtcgatctctttctagcaatgcaaactttcaagtctgaaaccagttgcctggagaaaggtgtactgattgactgcttcccagtaaaaatgataaggccggaaataatcacaaagtagctagagcgctttaatttgcctgaccaagctcgagcaacttaattatagcggttaatttggtcaaccaatgtgtgtcagtgtgctcatgagattttgctccaattttgttgacctccgcaactttcgtccaacaaagctttttaagtaactctcctttctaaaaggcgcaattactttcttatatttcatagctaaatgctcatgcttttatacggaaggagggagtaatatgttatcatcttttttctacggatattcgtctttctctatcaatttaggattgatatttattaatattaagagattcaaggggtaacttgcaaaatttacgatgaatgtacgtaaagtggtagattcaccgccaccaccacttcatttttttaaatgagtatatatatacaagacacgtatacgagcatgcaattaagcatcacatccttaattttattttaaactatccacctctaagatttctaatctataatattatatttattaggatgatccaaacaagttgatgataataatagtttttggtttttatgttagcggtagttacgcttatattttgaaatgagggagtcgtgaggtagaatacagacataacttaaagtgccaccttaaaaagtacagcatagattcacatggtgatgtgaatgaaggaaggaaaaaagggcgaatgagctacccctcatacaatagataatatttacacaagctctaacaggggaaaagaaagaagccagtagattgagactaaacaaataaagtaaaattgttgtagtatattgaagcaggtgtaacagaagtagcgtgtgaataaaatta

SEQ ID NO: 63494 - DNA, 1188 bp, Oryza sativa
  unsure (1)..(1188): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataggatggacgattcacagggagtgtttaaagagatcattgacaaggacgttgttgcttacacttcgatgatcactggttattcagaaattgtggattcagttgcatggaatgcatttgatattgccattgatatgctgcagggcaacttggaagtaaaccgtgtgactatgataagcttactgcaaatagctgggaatttgggagcacttaaagagggcaaatcactccattgctattccataaggagagcacttgttgtctcagattatattctagagacctgcattgtgaacttgtatactcgatgtggagcttatcaatcagcagttgctactttacagaattcaaagggaactgcagcttcatggaatgctatgctttctggtcttactagagctggacagagttttgatgcaatccactatttgtctgtgatgctgcatgagcataaaataactccagattctgtcaccttcgcaaacgtgatttctgcttgtgttgaggtatgctatttcggctatgctgctagtattcatacctacttaataagaagatatatacctctggatgttgttttggcgactgctcttgttaaggtgtactccaaatgcaaaaaaatcacgatatcaagacatctctttaatcaactgattgttaaagatgcagtctcctataatgcaatgatgtacggttacctacataacggcatggccaatgaggccacctccttactcaattacatgatggcagaaggtattgttccagattttgcaactgttcttagtctgcttgctgcttttgctgatcaaagagatttagtgagagggaggtggatccatggatttgggattaggcatgggttttgttcggatggtgacgttgaaaatcatattctttatatgtactcagtttgcggaaaacctgcagcagcaagggttatatttgatttactggaacagaaaagcttggtttcatggacagggctgcaggaat

SEQ ID NO: 63495 - DNA, 1996 bp, Oryza sativa
tcactcagaagaatgctcaagggaactgggggcaggctccttgatagcgcatagacaattggaacctagaaaatgtcaacctgaatagaattttgcgcatatgaatataattatctaattatggaggatgtttctttctggagaatcaatcaatgcctacatgtatttttgtaatggttgatctgcctttatcatgactaaggaccaattagatcttagggatgggcatggattactccttgagtacacaccaagtgacccgcgttcatccttactagaattgtaaatatgcttgaggaactttcatggccattccagattggtgttgtctaagcattgtgtttgcactagtttgatagtttgaggacagtattttgatatcttgatgctgttaaattacatatatataatgcgttgacgatgctttgatcttcagatagcatgtgagaaaatattttcatttggctgttcccttccccagaatctattggaagaggacaaggacctagcaaagcagcaacaggagttacttgatggaatttacaagaagtactgcatactagacagtgacgtgatgaatgatatcaagaacctctctcgccgttatggagtcaacctggccggtgactgatcagttttgaccatccaagagacggactgcttcaaaaggtccagatcagtcccccaggcgagcaacatgcattggtgtgacccaataactgcatcttctatgtaaatattttttttgagaactttctatgcaaagattctgtagtgttactgttgttcccgcatcctgacccacccagcaacagtatgctcgttttgtgatgtgtataggagtaacttcttgcgctgcgcggagatgattcgctgctgtcggatgctgtctattatgcatgtctgaaattaacttgctgttgattaatcggaggttacattcataatgcctagtcttgccttgtttacattcattgtttcggttcagttgagagttcagagatgtcctgatggggttgcggatattgttgtatcaatctctcactgagcaagtttaataataggatataaccaaccacaaacttttgtgaaagaaagggagaaacaatgttagttctcgtactagcagtaaatgcactacttatataataagtaagagtaagacaaagagatagggaaaaaaaatagagacaaccttatagtaactaatactccctctatctacttttgatagtcgtattttatcttggcacacagaccaaggataagtaattctacttatcatccatttaaacatgttaccagtcattcctcgtaaacaagcgattcattaatatttacatttctcgatgcccatatagccaatcttgtgtggaagaatgaagagtcatgcattacaaccaagaaagtcattaagatgatagattgttgaattgaaatatgcctatcaaaaatatttttttcagatttagaaatatgactatcaaaagtagatggagggagtatgctatacatgttagctttagttttttgccgggatggccaacctaattttattaaggctgaaaggaattgttacaaattttacaaaattgacattaaactgtaggggggtggggggttgggggtagagaaaataaaacgaaaaacaaatagggccggctgacagggaggttctcagccaacttctctaaaaataccggcctccctccacaccaaatctcatctctaatttctctataaatctctgagcgtgacttttgctcaaagatcctagcattcctctctttccacacaaactaacataccatcatattagttttagtttgagcttgctaagggcaaccgcaatggttatctataggctatctacaagagatccatatcagcatatttttctacatggaagagattaaatgaagagagagagagagagtaaagctatctactaacctggagatagtctatagagaaaaacgaggcaatggattagaga

SEQ ID NO: 63496 - DNA, 1763 bp, Oryza sativa
aaataacactgtttactacccatgttcccagctcgaaatagctgagcattcctccagagtccatacaaatatggaatatggccttggcgagcacggacaagtaaaatatacaagcagctggtgtaataaacaagctgtgacacactgtggaagcagcctgtggacaaccaaggtacagccgtcgactgcactgttcctaggaaacgagaaggcaacggctttgcgctggagagagtcaccgtagtccgcggccaggggaacagggggcacgcatcctgtcgggcacccagccaaccagcgctccttctgcacgctcgcgtggtcgtattccagcgccaccaccgcgtggcagcttggcagcttccttccgcctaaaataagcgccacggggactcccgggcttggacctccagaaggtcgcgagatctcgaatccgcacggtcgcggccctcgctccgcgcgaaagcgcgtcgaagcagaccgcgactgcaagcgatcgaactcgataccgtacatggccacgtccggggatccaggaacttcgggttcgcaaacgcaaagcgtggaaactggaaacccaaaggatttgccatacggaacggaatccgatccagccgagcgcacgggcgcgctcgttcgccgtgccgagccgtgcgccgcgcggctagtagccgtggcttctcgttctccgcgcgcgtccgtggcaagcaagtcccacggaatcgggggcgagttgcaaggcttgcagctgtcgagccgtggagcgtacgtgcgttcatcaaagttggacaaggcccttttgcttgccaagtttcgagtcatcaccagttaagcatgccccaggtggccaggtatggaatggatcaaatgaggtagaaatagcaggagctgggatacgaacacatgcgtgtgatctggccatgacaactactcccttcaatagcatctcccaaatactcctttgatcacaaatttttgtaaattttatagaatgtattaaaatgcaatatgacgaaagttgtcaatgaaacaagtctgagtggtaggaccagcaccgcccatttcgaccataattgacggcacctctaagctgaagtcatgattctaaggatagaggggatgacatagtagtagggtagtagttgtagtacatacgcatgctacatgcaatgctggggtttttttcttaggttgtgttgagttcacactgaagtttgaaagtttggttgaaattgatacgatgtgatagaaaagttgtgtgtattaaaggttcgatgtgatgaaaagttgaaagtttagaaaaaaaaactttgtaactaaactgggccttagtcaggcttctcaccgtctaacgctgatcaattcaacgatatatgatttttcggatcctttttcgttgcaaccaacaaaccaaggacatgtttactttgatgccaaaaaaaccttactaaattttagcatttggcaggatttcttatatagttaccaaaatttggcaagaaactaaatgtagccacttttttttgtaactttaccaaaatttgataaggttgaaaatgatatcaaagtgaacaggcgtcaataattgtggatgtcagatcaagcagctctatacgtcccgattgcatttcgaagccaaggagataaaaccagtagtcctctacctgcctgacactggcacacaggttaggtggtcgtgtgatcgattagagaagcaaacgaagatatgccgatcctaagtcaaaagattcgggctgcaggaa

SEQ ID NO: 63497 - DNA, 1616 bp, Oryza sativa
atatcgaacgataacgtcgcagtccgcagcaaacacaagcatggtagttaatcattatatcagcttatcctagtgatgcaaaatccatgcctgacataatctggaatttacctgcattgatacctgacaaactcttgtataatactgcactcatatctgtgaagtaaaatttattagcgttggattccgccgttctggtatatttagaagcttcgaatccagaactgaccaccagttaaattattgccttccctatgttcttaggcacagcgccacagaatgtacactggagtgcttgcaagcatatgaaattatcagaaccagttcagatcatgaattttgtatgcttcactcacaaaaactccaaaacgaggattattgtatttgcgagagggtatggcaattgagggagatcttatttttaagaactcgagatgttgttaaaaaaaaactctagagcacttcgtcttgttggcaccttccttggttactctaggagatcgagtataactatagtaaaactggctacttggtagttgccccatgagacataaaaatcagacaatgttatacaattctttttgtacaactatcatcatacatttggccaaaattgacatacagtattatgttggagcatactaggtttttgtttagaccttataatttgctaggcaaaaaaggtgtacaatatcctaaagaaacaggagttggaattctcatcctacactagctgattctatcacttgatggacattctgtactgggtattccttgtctgactcacaatcatatggtctgtgtagacatggaactagtgtgtactcatcgcttcacccttatacatcattccttaagcatactgtactactatatgctatctcttcccttttcctttttctgaatctgaaaaactaaagccttcatctacctcttcctattaccctatacctagtcacctaggcctcaacatatcacttgtctttctcgaactagcttctgtgctatatagaaaggaaaagcgacaaaattcacgaacagtgatgttgtagtcctttttgtgcaatcttcatatttacagaacttaaccgctcgtcttctttgagcccggagaacatgcatttcacaaaataagctctaagggtgtttgggatgcaaaaatgcagagaattttactattctgaattataactaaccaactactaccttttgtactttgcgaattgtcttcttccacattctttacagatcgcaagtgccaactcactttgtcttcagtggactagtgaatttagaatcatggtataattgatcattgggcatatggtgttattacgttttcatttatgaattatcagggataactctaatggtttagccggtgtactgagaaaactaacccactttctaaaaaacatgaatattagagaatgatctaatatcaaataaatataaggagtgatactttgaacctaagccggctagcccaccatctcatggaactagctggaagactacaggtatttctcactaacccactttctcttttgtactataaacttggagatccgtactggaattaatctagtacaatattttacatattcttcacaatt

SEQ ID NO: 63498 - DNA, 756 bp, Oryza sativa
atgtgttatttccaaatagctctcaactagctcactctttgaatctttttgagctatttgggctattgagggagggctaaaaagtattacttggatccaaatagggcatataagggcctgtttacttcgtgaaatgaaaatttttggatgtcacatcggatgtttgaccggatgtcagaaggggtttttggacacgaatgaaaaaactaattttataacttgcttagaaaccgcgagacgaatcttttgaacctaattaatccaccattagcatatgtgggttactgtagcacttatggctaatcatggactaattagactcaaaagattcgtctcacgatttcccctctaattgtgcaagtagtttttcttttaatctatatttaatgctccatgcatatatccaaagattcgatatgatatttttaggaaaaactttttgggaactaaacggggcctaagttgagtgcatgcgaggagggtactgttcactttgtttcccaaacacataggtgtacattgtacagtgaagaagagtggccttcttcctcctgtcactctctactgtagtgggagccatgctgagctgcttttcacataaccatgcccaaattataatctgtctacagtagtacaaccaaatcatggagtcttggttgtggccccaaatcaccaaagcagaatatacggtcaacttttttgtaactttttttctcccatcttagatggttgccaagtaaagttggggctgcagga

SEQ ID NO: 63499 - DNA, 975 bp, Oryza sativa
gccatgcttcttgccctaccctccccaccagtgaccaaacccctcatgtcaaaatatataatgaacgacatacgctttgagaaagtccttttagcacctaggctagccaccgcaggtttggtgaggaaaacaataccatgagaagaaaatatagtacgcatcgcgaaaacgattatgctacagacgcgctaagcgcaactacatttagatgtagaaaaaccgcatctagacaacataaaaaaaaggaaaaacacctataatattattgtaataggatcttcgagatcgactcggaacaaagcgaaatgtgtgtgtattgtattcatcatacctgaaatcttaagatgctatcacattggaaaatatatatatatatatataatagttacaaatattaattttattatcgatgttgatgtttcgcgtacgattaaatctttattttcttttataaggcatttgccagcaaaaaatgtatttgaatttttcaaatacgtgcgctgctcacattatcgtattttggcattatctcccaatctccatcccaaacagtcccaacgcttaaaaaggcgatcgcatgacctcgatgttggaccgtacgtcagatcgtgtctgctgtagatttgtcatgtgtgccgtagattttggtaccaattcggacatgcaatgagtgcgtggtggcccggatcaaggctagtacatgcaagcgggtcagccatttatgtgcgacaagcgccaagtctcgagtgatcggtccattcagccgcgcccgcctgccaacagccggacactgccactctttgcaagcatcgcttcccaaagcctgtgtgcctgcgccccgtgcggaagtggagcagcagcgaattaaatttgaaaaatactgttcattcaattttatttttaaaaatatttaagatgtaatttatttttatagaaatatacagtcgatctcatacaaccgaaaataaaaataat

SEQ ID NO: 63500 - DNA, 2358 bp, Oryza sativa
cccgtgacatcaacgacggtatcgtggggcgaccgcacgaccgcgcgctgtcgcaggaatgacgagcggtctcgctcatgcagagagcgacaccatcccaaactccatttggttagtgactaatgatctaattaactatttaactaataataattaatgattacttaataattgctaatcataataattaatcactaattaaccattttgaaatctggtatcgttctttcatttcgcaagaccgcgcagtctcgcgcgataccgcccgcgaagtcgcaccacctcacattcgcataatgattgtgcaagatcaacggtataatttttttaaaaaataaatctcgaatatttctaaaaataaaatgaattaacaatatattttcaaatttaattcgggcagcaacgagccaactatcgatttaagcataggcgacctctggaatgtgtgcgccacagtggcacactgccctggcgttgcgcacttcacagttctgaagtatggggttcttcttcaaaacattttttatgttctatttactccctctcaaaatattgttatattaagataagatatgatccataaaacaaaaacaaatctaaacatactctccgtagtttttttttttacaaaggtagtatggcacaacctttgttggttttttttgggacggagggagtatgcgacaatctctccgttttcaaagcaatttccacttcttgccttcggtaattggaccgcggaaatagtatagagacgaagacttaatcgtctccagtcttcacccctactcaactctagcaccgttacaaaacttgcaatgccgaagttgacaaaaaacatgcagaaaaaacgaaacaatcaccggctatatacgtggttgtcagatatgcaacgatgccagccgctactataccgcgaagtgccgaagtatactcgcatcgcatggcaagcagagtcgcgaggcaatacagcacaggaaagacgggcggcgaagctgtacgtacccaagaagtcgacgccgttgtacccgttgctgaaccggccggtgggccgcgacgtggggaagtcaatgccgttgtgcgggaagtttgcccgcggcacggcggcgccggtcaggtagttgttgttgccgacatcggccgtggagtcgccgaacacgtatatcgccggcaccttcgccgccgccgccgcggtgatacagatggccacagcaacaagcgcaatcggcggtagcatctgtccagccatgccggactgcgaggtgcagtccgctggctctgggtgggggctgaacggcaaacctatcccttgtttgcttttgggaaagggaggggccgcgaccggagcggcaatggcgcactttaaagggcgacgatggcgagctgcgtacggccaacgccttttattgagaccggcaaggcgtggcacagcacttagaccaagtagtagtacaaagttctttacttggcttagctttggtaaagagagatgtgaatgtgacctggtcacctggctatcgcgcaaaacgttgctcctcctcctgggttggtcatgggggtctcctggtcgaccaggagacagtctactactctcgtactcctacacgggaagagtaactggatatacagcgaagaaagtcgatcgatcaaggtatcctactatcctggctcctacatgtacttgtgacaaaaccaagaagatccctcagtctacttgtccagcaaaccccgtcaaatttactcgccacgatctcatgctccctggtggtcctacaggcgaattatatcggcatgatgttctaagtgcctttggatactctgtctctcaagagtaattactgctacttttcacagaaaatcgatccccgggaggccgggactgagtgggggtaacttagcttgatcagaaccgattacttggatcaaccccgttgtccataggaacatattctaccaaccactcgatgcatttgtacaggcaggaaccttaacacgtctacaagccttgaagcatagagaaaggcagccggaatccaatgatacggtaattactttcgatgtttgcatttgataatgctccagtgggatgaataggcagccttatggctgggcacacaagtttgcgctggccgattcttctacgcttaaataagcacccaataattatatctttacgtttagttcttttcatactgtattgttcttaccatcacttacaactgaagctagcctgccagatgcacctttttttgcccaggcagaaaaagaagatcccatgcacagcatggctttttttcaatctttctcctgttgaaagcaacgaaaataaaacgacagcagtgggcagcgcaacctttt

SEQ ID NO: 63501 - DNA, 2205 bp, Oryza sativa
gcaccaaactaacacacgccaaacacttccaaattccaaccatggcctggtcttcacacacgccccaattaagcgctgctcttgtgctcgccggtgacggcggcggcggtcttgtcttcctcgccggagcccttgtggtaaccgggcagtttctccatgatcttgcccagtatacccttcttctccttcccatccgggctgctcacttcctctgtagccggcggtgggtgtgctggcgccggagtagtggcaggagcagccggtgaggcggccggcggcggcacagcagttgcgtcttccggcttcttgtggccgccgggcagcttctccttgatcttgtcgaggaagcccttcttctcctcctcgggtgcacgtggcagggtcgcctccgtcttggcgtgatcaccctcgatcttctccacggggacggcggtgtcgtggtggtgatcgccgtgagtcaccacgggagcaggagctggcgtgggcgcggccgtcaccacggatgcaggcggagccggcgcggggaagcccgtcgccgcgggcggaggagcatgctcaccggcatggtccttgtggccgggcagcttctccttgatcttctccttgagccccttcttcttcttcctcttgaccacctcgccgttgtcatcgatcacctcctcttcctcatcactcgactgttgcacacaacgattaaaggtcatgaaaccttctataattactaaaaagtctgtaactaattaaagctagatcatgcatgtgtgcacttaccgagctggagctggagctggatcggtgcagcttggagaggaggctctccttcttctcgccctcggcgtggtgctcctccttctttggctcttccacggagaccttctccatgccggtgacaagctcctcctcatgcttcttctcctccggctgatcgtccttcttcctgccaaggaggttgtcgaagaggcccctgtccttcacctccacctgctctgcagcctcgccaccctggtggctctccgtgttcctctcatcctccatgatcgatcgatggattcagctaaagcctctcgagaactaaagtaatcaaacaacagatcagcaagaactattcgctcttgacttgtttgagctgtgacgagtcgcttttgctttcggatgaagaaggtggcgaggcagatgccctccttatatagcggaggggatcgaaaggtgcggcgtttgtatcgtacgtacgcgtaggcgacgcgaggacaagaagcgtgggcgggaaatggcgacgagatggggggcaggcagaggcaggcagcgggtgagccagtggcgccgcgacgcgtgtcggcaatcgcgtggggcggccggctggttccgacgtggcggtgcctcgggacgggtggacgcatcgggagaggtcggcgccatgtggagccagacggccgtgtcaccgagggagaggaggcgtgggcggcgcgtccgcctctccgctccctctgcttcgaggcctcgacgcctacgcgacgagacacttggcttcgggcgtcgctgtccgtcaatttcctaatcgatttttggttaagtgatgagcggagcgatccatttaggaacagtaacgtaagcgtttcttgttcggatacgattcgtcttagtgcgcagcagtagcgatagattaacatcagtttttttccatcggattctcatccctttttcctctttatcggcatcatcgcggccaatttttcttctctcccagcagaggaaggaagagtctgtgatcgcttttgtgacgagttgggagcgggacacggctcgagagcgacggcaccgcgcgcgcggtgtctgattaggacgacgggagagatccagagacctggacggtgacatatggggtccgtagatcagggtcccactgatccgtctttcacagcctaacaaatcgggtcttggtttggttggtggatttggtcggacgggataagttatccctgttgatcacactgattaatttgccacccccagatcgagtcgtccggggcttctctaatttccagccagttcttttccttttatttttctttctttccttcgctttgatgatagctgatgatagctttcgtggggggaaatgtcggtggcatgtcggccttttgatttctttcgcccgtcctgtcctgcgaaacgcattggggccacactctagtctgtagtacgggt

SEQ ID NO: 63502 - DNA, 958 bp, Oryza sativa
ccaccacttctcccctcgctccacgacccttttcacaggctcaacactagcagcagccgccatcgccgcttagccgccttgtcgcctcgctgctgcgtcgtttgcgtcatgccgtcttgtatcctcgtcgatcctcgcccaggcgttgccctgcagcgactcgacggcagctgttaccgtcccatccatcgtcgccacaagcaagtgtcggcggcctgcctccgcctccccaagccgacaccatcccagccacaaccgctcccaatcggtgttgcatcgtcgtcgtcctagctggcaccggccgctagccccgccatcgccgcccctagccagcactacattgttgttgtcgtccctagccagcgtcggcggccagccccaaccgtcgctccgtcgtcaccgccaacatctatccctgcccgggtgcttcgagtctccgctcacccggcgggtccccagcggggctggggaagggtggggttttccaccgtctagcaatgcggggctggggcgggggataaatgcagagagcgggggccgatcaatcacctgttgctagctcctgctcaaaatacggagtgcaccaccggcagattggccgcagcaacacgaatgccacgggaagaagtattgacgaggtaggccgaaacaagtggttaggatttcaattccaaaagaaataagtttattttccctccctccctcccaaaaagaaataaaatcgacactagccaccaccctactcacgctgtcgctctccacctaccatgtcttctaggcgtcgactacctgttctccctctttcctcctgccgtcctgcgagcgccggccaagccacggccgccacctacccgtgatcttcaagggaaacgaggaatcctcatcgaggatggagacggggtggcatagagccccaggaagacggataaagaggggccacattcccactctgctgcaa

SEQ ID NO: 63503 - DNA, 1389 bp, Oryza sativa
cctgcagcccaacacgaggtaaaatccaatccgttgtaatggaacaagtgttgatgctaacagtaatcctgctaattctagaaaattttacttgctgttgaaatctgtactaccattggcattaactcatgtctgaagctccggccgaaatatgtaggccatcattccagcaatatacactactaggtgatattacaacaagctgggctggcttctatgacatagcagttgtcaatttactatctgaagaagaatccttcccttccctgatggagatttgcagaggaataggggaatagtcattcgcccatcaggatagtagacaatgggatggtttcacgttggccaaatttacaatgtacagtatgtaaatttacaatggtttcaggttggccaaatttacaatctactagcatactcatcatgcttgctcatgctgcacaatggccaacatctcacttgcaccagattgccctgctcgcatcctcatgctgataatgaaggcaatgagctgcagagtagatatactctattcttagtatggcataaaaagtgtgcactgaacatattcagttgaaatcttaccgtacaaaagccagcacacatgatactgaaacctttgaatttgaatggcgctgtttctgaaaggacccatgctgccgcaagaaagcaaaagctatggagtaaattaaaggaaacaagggttataaactaggatttatttacaaatgaaaaaaatacctgttagaggggtaaaaattagtggagctaatatgctggcaaacgagcttatgcccgatatacagccttgagcaattccctaagaggcaacaccaaagtaataggaataatgagcgaaacttagcagtcatgtcaactaatacaacacaggtcatcatttgaaatactcaaagacaatgatcagcaacaataggaaaaaccaacctgctcatttgatccaacactcttcgatacattggttcttatctagaaaaacagagaagaagatgattaatattgttctgaattgcttggaaggaaaaaagtttttaataaactgttgggaaaaatatggcttacagaagggtgaacaaaagcactcagaattataaacaccgcagataaatatggtacctgtagatgattaagacaacgttagcgaagatatgtgtaatggatgactgatattggtttagtgaatgctggaaacgcactattgcactgctgaaccagcaagcaactaaacctgattgcaaattagtgcaaaacaagagcgtagttctgtctatacatttggatatagccacaattgcattcttttgggtaagagtctaataagactacaagagaattattgccaagtccaaaggaagtacccagggctgcagg

SEQ ID NO: 63504 - DNA, 2646 bp, Oryza sativa
  unsure (1)..(2646): unsure at all n locations
acctgcagcagcaagggttatatttgatttactggaacagaaaagcttggtttcatggacagccatgatgaagggttgcttaccctatggacatggagatgaggtggttcaattatttcacttgatgcagaaacatggggagaaacctgattccatgtctcttgtaactgctgttcaagctgtctctgagcttggccatctaaatggtctaaaacaaatccattgttttgtttaccgttccctgttagagaaagataagattactgcaaattcattgataagtgcatatgccaaatgtggaagactggatttgtcagtaggtttgttctttagtttggaatacagaaacttggatacttggaatgcaattatcagtgcttatgcgatgcatggattctatattaatatgcttgaaatgtttaagcaaatggaagaagaaaacattcagcctgatgagttaacattctctactgtgcttactgcttgcagccatgctggtcttgtcaaggatggttggcgtatgttcaattccatgacctcagtatattcagttcttccacaggaagagcattatggttgcatggttgatttattgggtcgtgctgggcatctggaagatggatacaaatttataaagctatctaccttgaaggataaatccactatattttgtgttttgatctctgcttgcagaacgcatagaaatacacaactggcacttgctattagcaaagagctccttgagcatggaccacagaaaccaggtatttatgctctgatttcagaagtgtatgctcaggaagggcagtggaatgaatttaccaatacaagggccagagctaatttaagtgggttaaagaaacatcctggttctagtttcattgaattaatggagcaaggcatgtgttagcgaagagcctgcggacggcatgctactctttatagtgtgtaaactatacattatgaccctttttaacttcttactttacaaatgggcccatgagataactaatagcaaactaattgcaggaatggactcctccctttgcatgaagaacagaagcgcacaactgcccatctcgcatctctctcctctcaaatccttctcaaattggcctgaaatcaaaggtttttccgtgggacgtgtggacatcgtctaggaaggtactctcccttgattgtcctcattttgatatttccgtagttgactcgagcattggggtgaaaccctagcattgatttagattcattcattggattaattttatcggattgattaaacgcacagtcaatttgtgattgagtgtagcaggattcaggtagatcagtttgtatgaacttttggtttagttgaatttcatgcaatgactgggcacaaaaaccggttcactcagctgcaaaattaaggaattgcatcataaatttcagaatccttgcattggagggaaaagaacaagtaatccaacatgcttcatcctatataaggtgcccattcccttctactccctcatcccaaaatataagggattttagctagatatgacacatcctaccctatctagattcgtagtactaggatgtgtcacatctggtcaaaatcccttatattggagacggagggagtattgtattttctctccctggacgcacacttgaaacattaaagtttcaacttacagatgcctgactggaatcgagaactgatgcttgcatgcaagcagcaaaatcattgaagattgttcaggtagtgggtgcatggtcgtagtttttagctgaatcggtatttacattaacaatttattcaagctctcatttgttttttcacaattgatttcttgaactgacagctaatcgtttggtgtttcttcctcaccaatattcaaccattcaggccatcactttgctatcaggttacttagccgagagcaattgggcaatggttcaagaaatgggagagaagacaccacaatggttccttcgctatggccagttctccacgtgcagcaagtataactttaaaaagcacagcagccaggaatacatttgccgtatgtatcacttatttattaccgttcaccatanagttagtccattctggttttgttatgcccttaaaaacatttccttcaatcttaaagataatattgaggagattggaggtactaatgctgccacattggagataaacaactcttcaagttggggactgggattcttgggactggacagagaagaacatgtttgatcttgaggagcttgatcgcagtgacgtagtcagcaacctcgagtgtcatctgctatattctcatcgcccaacttaagatccaaggagaaggattgctctaaataatgtacttacaatattatctaaaagaatatatctagttattagggccgtatgcattgcttgatgcatatgtggagaattttttactctactatcttaaaaggtatgtatggatacttttgattagtttaggttggttatatgcatttagtgaggaatttactttttgtgatatgatggcttttgttttgtgacaaaccaattatcttttctcttgatcatctggcaaaccatgaaatcgtttgtcttgaacccaatctttatttttgaccaatggtcctttcctgagatctgctggg

SEQ ID NO: 63505 - DNA, 1475 bp, Oryza sativa
ataagccagctgcaaacatatttaaagaagataaataaagagagaagagcagtgggctacagatttgtagccagctgtagcacggactccaagacatagtgtgtgtatgacaggtgggaccaggtattaatattatagtatataactattgtataaatgagttattagattgactatagatgaattagagttagtagttggctatactattaaacttgctctaagagcacccgcaatgttaaagtaaggtgctatctataaaacatgtatctctcagcaatagactagattaatagtaaaccatctcaatagtatgtctacatgggtatctatagctctctaatacattgtctcgtttttctctgtatactatctccaggttagtagatagctttgttctctctcttcatttaatctctttcaagtaggaaaatatgttgatatggatctcttagagcctgtagataactatctctcttcatttaatctctttcaagtaggaaaatatgttgatatggatctcttagagcctatagataactattgtggatgccctaatcagtctccgctcactttcagatttttctgacagctgcacgaacaccttttcacccgtttaccgtgccactgcagaggttgaatgattgcatcacttcttttttttactgtgtgcaagtagctattctccaagacgtacgctagcgatatggtggttagtactcgtagtttaatcctttgatcgagttggcaccacgagtgcagagagtacttaagcgggatctttgcaaactctagtttattgcgcctttttttctccactccccaaaggcacataatcgtatccaccaacttggtactagaactctcgtctttttcatccttcctactagtagtactattttcaattctacgtgcaggccagagcactcgattcgttgatcacgcacgcgcgacaagcctcgacagtcgacaagtgcaccggcacacggtcgtacgatttccagtatgtctctctctgtatcttctcgcatctaggagtagagctataggccgtcgtaggatcgcgtagaacatgggctgctttggcatcaacgtgaccatgaggcccaagagcgctggcacggacgaagttaccagccaccacgtcgttttctctcctctgttcctttgcgcgcgcgtgcgggagcgcgtgcaggctcgtgtaccgtgcggattccgtcgccaagaggtttggtacatgacacgctggggcgtgtgtttggttggcatgttctcaaacccgcattgctgcttgagcgcaagcgccaaagtgtacacgcttgttctgttcgcgtacgctgcaatatccgtctctcggagaggaggcccagatattgtcttctctctcacttctcgattacaaggcccatccaaagatggatggcccaagaaaatattacgccttgccaactgaaaagcccataagagtttcaaaa

SEQ ID NO: 63506 - DNA, 1557 bp, Oryza sativa
acatgcgagtgatggatgatgtactgatgtgttttttagagtgcactccactctactttcggagctactgctcgctgattgggtcttttgtagcttgcagccctggaactctgtttactcgtggaatacggacaccgttggtcttgcttctgggaaaagctgggataatcttgcttggctctttctgcatttggtgctggaagtttgcttcttcagtgggggaaatagcttagcgcactcttgattactagggagattagatctatgtttggtagtagctgagcctcaacgacagttgaagtctcaaccctgaaccgaacagaactactgaagtgcaggggagtatcagagaaggatcggcatttttttgatgtactagtactagaaatatcggaagaactgtatccttcaagactgttgctcctatatattttactatggtccatatactaatttacatttctaagttctatcctcatttttcacgtatatgtttttcaaattataaaatttttctatagaaaagttacttttaaaataatattaatcggttttcaagtttttaaactaatacgcaagtaattatgcgttaattcatcatcaccctgttttctgtgcccaagggaaaattcccaacccctactcccgaacacaccctagattggtgataaattggttgtcgtcaatgccaataattttatctacaaagtgaaatatcgtatttactattcagaggggcacttttttttttcatcaatccaaaacagccctacattccaaactcaataaaacgcaactggaacggatgatgggcttggtgacccactgaaaattgcagagtccgtccaattgacgataggggatgtcgtgggctgtggcctgcctgtgattcttccaaacttaactcggaagccaatatgcgggcgtaaatttcactccgtattccgcctcgacccacctacgaacgtcagcctaagtttatttttggcccctcatttatgtcgctgagactgaaattcgtcctcaaatcgcagtacaacgtgcctctcaactccccaaaccagtggccccgagatggtacggatggttgtttctactgccgtggcgtggcgttgatatggcacttaaagtatataaaaaaacccgtgagactgataccaatgaatgttcggttaaaaaaaaaatggtacgtcctattgcggtttaaggatgaattttagactgacaataaattgtggggcaatagatgagccccatgggcaggcttgtcgaggtcagcttcaaactgtgttggaatatcgaccataagctggaataacgtcagttcacgtaccgtacatctgtatgagcagacgtttgtctactccggaacatacatgcgagcagcagacgccgtccttttcattcctgatcagtttgtttgtttgtttttttttaaaaaaaagaacttgttcattgttgatcaatttgttcgatcagctgttcgaagacaggccgcctcgtctacaagaggaatatcaaacccctgcaaacaattaattccttctccccacgcat

SEQ ID NO: 63507 - DNA, 851 bp, Oryza sativa
atcgacgaatctatacacaactacgtgcgtatagagacactcgtcctacttagtactcctgccgtacgtatttattgtacgtactcccttcagttggattaatttcatgagaaaagcgagagtccgatccgaatatattcatgtgggttgatatataagtttttcatttagcaactgaagacatgcttggaagtttgaaagcgcgcagggagtttcgcagcaaagttcactgcaaatgattagatcctaattcccagacaggaactaatttcaatttgtctgctacaacggatatgtcatgagtatacacggttgaaaaaatatttcaagattattattcgtgtagtacatgcagctagcatatacttatacttttgtgcatgcatggcaggcaaaactttttcttgcccgcaggctaatacagcgaacagtccacttgtaaagctgttgaaaaatccggaccaaacctgcaggggagcactagtgctagtctccgatcagaaattcgccaatagcatgtgatgtatgggcccaagctagctagcgtccatgcaaatagggtttgacacagataactatactacttattcacatctgagtatgcatcaatattaaaacgaccgaactaactaatcccattgaaaaaaaaatgattccacctattgcgtggcgtccctttctaatctttacacagacaggtgcctatgagctgtctaattcgtaaacctctctaaataaaactctagcttcagacacgcagaaatgtaattttaatatatctatatattctcgttctccactgctcattaggacagccagtttgcgagaactctagaaagggctgcaggaat

SEQ ID NO: 63508 - DNA, 1266 bp, Oryza sativa
tattccagattctaagctactcgacccaggtaaaacttggcaacggcaaaacaaccctcttttggaaagataagtggctatcccagcgcacatagagttcgctttcccagttttattctcttttgccctacacaaggattgcacggttgaatcgcaatacaggcacaattcctggcacatccagctccatccaaacctatcctaccaagcagagtcagagctgcatgaactgctgcaaatactgcaaaaccaccacccctacccagacaacacaaacgcaagagagttttcatacccggaacccaaagtctcaacagcaaatgcctatcggatgatgtccttccatgggtcactttggactccagcagattatatttggctccacaccatcccgcaaaattgcaaggttttcctctggctggcattcagagacagattaaacaccaaagccaatatggtcaacaaaaactggaacgaagaccccactgctctttgtgccctgcgctagaaacagctgaccacatcatcttaagatgcaagcaggccaatagcctttgggaaaaattgaatttactgcagctagccaacaactcagattctatctcaaccttcctccaggcaattatagcagaaatcaaactttgaaaggaattgagccaatttggtttgctgcttgcgcatatactctatggaaagcacgcaacaaccaggtgttcgaaagacaatttgacagtctacaacacattattcaacagatctcagacaccatgcacctctggagcctaaggaccaatgaaataaacagacaaaaaattcaatcctggtgctcacggctttcatagaagattgctcattgtacatatttatgtaaattctccctttttttctgttttggtctgttctgctttttgctctttttttctctctgataattcccgcacctaatatgtaatctgtaaacctcatttcttttaatgaaatgactataaggtagagcctgttctaccttcttccgtcaaaaaagacctatatcagggtagcatgcgccaaaaactaaaaacatcgcaatttcttcttctcggaaggaaaactcaccctagctcacttggtggaggtgtgggtgtacaccctaccacccaagttctacggttcggatcctcaaggcaaggcaaacttagtacttagagcataccgcaactcccaaatgacgcatacaacaacttccaaagcatgagcttttaacacgacagattaattcaccattat

SEQ ID NO: 63509 - DNA, 1108 bp, Oryza sativa
ggctcaaccccatcctcatcggcgccgcaccaagtcgcgccacattgctgtcatcggccaccagacgaggagcaaagtgagagagagagaggaagggagagaagaggggaaagagattgtcctacgtggcatcctgacatgtgggacccacgtgggtcacacgctgactcagccgccacataggacaaatccgacgtcaatactgtcctgggatctcgggtgaccggttttgtatagttaagggaccccgcatatctggttttgcggttcgaggacatttttgtatctttgtgacaagttgagggaccttccgtgtactttttccccagaattagccatttcttaacatcttgggctttactatttgggcttatactattcgagcccactgcacgaagaaaaattagacctccaaaaatcccattgggttgtgactgaagaaaccttttcgtttatcttttatagagagaaactgaagaaacaagctgcagacttgcagagtctctcctccatagcgaggagcaaacacatcatgatttgctgaaaatctttccaacaccgatgtaccttgattcagaagcagtatgatttcttgggttacagcacatgcgcacagatcaattgcatttccgcaccaccatgatctaatcctaacggattagagcgctgctggtttgtagtagcttgttgcgatccattctcgcacaaacctgcactgttgcagccagctgcatgcggactcgtgagcatgcatgctactccagctctcgtagcctcacacgcacctacagtcgcatccaccacctggtgatcggaaaagccaattgtttacatcatttttctactgggccaggtgttcgcttaagcatgcagatgcagctcgtgctttcgtttgaaagaacagaatctctggaaggctggtggtcagccaccaaccggctcctccatcatgatccgcggatcagaggcaggcatggatgcgtccggttaatttttagggaggttcatgtgctaatcttggcttctggatacggcacagagctgcatattcttgtgtagcagaagcagtataaaatgtgtttgggttgcccacatgcatgcacacatg

SEQ ID NO: 63510 - DNA, 864 bp, Oryza sativa
ataacactctctctgttttatattataacttgtttaatttttttaagttaaatttatttaagtttgaccaagtttttaaaaaatataataacatttccactacaaaataaatgttgtatcaaaatatattgaatattaaaatttaatgaaattaatttgatattgtagatgttactaatatcttctataaacttagtcaaacctaaataattttgactaaatataagctaaataacctacttcctccgtcccaaaatatagtaatttttaactatgaatctggacacgaatcccaaaatatagctaaaaattgttatattttaggacggagcagcataatatgaaacgtcggtaatcaacaactaaaaacatgatttaatagaagtagataggacagttctcacttatacattgtcgtgctattttttatagtcctaacatcacgtcaaccacgtcaaatgagtgatgtgcagggtttacagtaccaacggtagccggttgattaccacgaaaactattggctaagtaggatcgagagcataaaataggcagttttctgattaagtttaaataaattcaaattgaattttaattcgactatgagttttcacttctatcattgattttctttttgttgctatgaagttaccgtttcagcttttagccacgcgaatcatcgatattgctttgtcgtaggttttcatgaaaaccgagaattcttgtctcgacatcggtttggtgaacctttggtgatgagatcgttggctcaccatatttgcaagggggaaattgctgcatgccgcacggccaccgtgacatcatttgattaagagatccactttaatttggtgcggtacagtacat

SEQ ID NO: 63511 - DNA, 1677 bp, Oryza sativa
cggggacggccaggaacacggcagcagacaccgacgacggcacccttaatggcggtgagctcgacaatgccacggcatccgtgcctaaaaccatcaagccactaactcggtgatggcggagaatagaggggtggcagctaggtcgcatcctcatatctcccctacacattccttaagatcagtgcacagctcagtcactaccaagtaccagcggtgtcaacaaactcgtcgtaggcggcaacacatgttgaggctctttgtcggcctcgcccaaaggatgtggatgagagcgacacgagggagtgggctgtcgccgccgtcagaaagggaaggagctcgggaggaggcggccacagcttttagcggtcatggaggggtagatgttagtagggcgatgaggccgttaacaccgacgagaacctcgttgttcccacccacctcattgtggccaccgaggggaataacggggaacatatgagagagtggatagaggacgatgttaatgacatgtgggccctatatgctacgtaggtgcaacatcggctaaaagaaactcctatactgctttaggatttcttctacatcggtattgtaaattaggggttaagatttgtcttgtagtttagaactcgatggtaagatgagggatgtaaagtgacttactccgccccatagtgctgataggaattttcccaaaatatgcatttcttctttctcgtgtagaactgaacattactgtatattgatgacccaataaggaaatactccaaatataacgatacaatactcgatcatcttaaaatataacacacaattagacacacacaatcatttgaatatattattacattttaggacgaataaagtatataactaagcttgtattaggggtaccataatggtaacagtacagtaatcacaattcaagcatatttttttaaaaaataatttttaattattttttttaaaaaaggctatttttgagttgccacgcgcattaaccaaaattattgtcgatgtaagagcaagaataatagtgatagccccatcgtttggcctaaacaaccaaagaataagccaaaatttgaatttttgaagttgattttaaaatgcttttaacgtaatttttgttaatgttggcttttaagtcgctacgaacaaatctacaaaagttttacttataaattaattttaattttctaataagccaaataagccaatttggaccaaatgggcaactgatgagagcctaagtatgtatgaaggagagagaaatatattaaatgcttcaagataaataatgctctctacccttcatgataaatacatgaaatacataagtatgagaaagatataggagaaaaaaaaaaccaagtttatagctactaatattggtgtactaactttcacatgaactaatacaatgagctctatccaacagcaaacaacggacttcaacaaaggcggcaataaaccaatcggtgaagcagtgaccctgcccacagaaaggctcccgttttccatccatgggatcggtcacccaaaacccaccggatgacgacgcggccgcctcccctaccccgcgccacgccaatccatcccacccccaccgtgcccatcccaaccgaaaatattcccagcatattcccccgagatcccgcatcccccctcccggcc

SEQ ID NO: 63512 - DNA, 880 bp, Oryza sativa
caaccaagcataactatgtatactgatatagataagaaagcaaataaaaacatcctaacaatgaaatgagtcaaccatttcccaatgtccaatattgaccagaagcacaatgggatagcatagaacaagttctagctagaatgaaatggatggaagcaacaagaaacatatagaaagttataaagcatagtaaccatttaggatagtttcagcaaacaaacattgcagaagcatttctcaggcgtcataacttgccatgacactgcctccaaataagtaacatatatcaaatttataacattcttatccggaaaaaaataatgtccatccaaggaaacactgcctatgtaagcgctgaagcattacacaacttgactatttatgcccgtatatcaatgaaaaagagatgcagccttcaatccagtcttggttccataagcaatatttcaaagcctctctccagacacatacaacagacagaagtactgtgtcctacaagttcctttgggaaaagagtcactcactaatattatcacttggcaccgtcccttcatcaacactctcaactgcagcagcaatacttgcctcagttccagcattatccatgtagcgaaaatctggataatttctgctgttcaacgaatgcaaccagagagctacagctccctccttgtgctccattgcagcgatatgagggaatatatacttgagcttaaactcttcagcctcctcagaataaggttccatagaaaccgcctcatgtgaatccttccatttcttgttatatgaagtgaacatgcattcatctaagtacagcccaacctcaggcgcagtaggcacattaagattgacatccctgtaacagaaacggctgcaggaa

SEQ ID NO: 63513 - DNA, 920 bp, Oryza sativa
aggtaacgtgtacgacttggggccagaattaggaaaaagtacaccgaaggtccctcaacttgtcagcgaaataaaaaacatcctcaaatcacaaaaccagatatgcggggtcccttaactatacaaaaccggtcgcaataggtccctcggctgataccggttttatcctatgtggcgctttgaccacggtcatcggtggctgagtcaccgtgggactcacgtgggcctcacgtgtcagcttgtccaggtcagcctactctctctttcctctcttctctccctttctcctctctctctctatctctctcactcttctctctggggttctgggcaggccagcgtcgccagccaacaggtgggaaggagagcaaggcggcggcgggggaacaaggcggcgacgacgcaggagcaagggaggggcgttggcgccgttgtcgtcgccgagcaccaccaccacctgcagggggcatggacatcgcgtcgaggatgagcagtggtgaaagggggagatggaattcgagaggcgaggggcgcgcgcgcaccgaggtggttcttccgcttcctggtctcgtgacggcgatcccccgccgcgatctcctcgatctccagccggacgctgccatcgccgtctcctgtggcctccgcgacgccgacctctgctctcggcgccgccgctcttccccgaggaggaggagcccaccgacgagaacgcactcgccttctcctgccagatctcccgcttcagtggttgcggcggcgagatcggctcctcctcctcctttccttcctcggcggcggcgagatcggcttcacttcctcatcgacaactctaaggattcaagagcaaatgtaagaagcgtaaagaatgaggaaaaaatttggggataatttgaattcgaggtggcttctctgggctgcag

SEQ ID NO: 63514 - DNA, 2856 bp, Oryza sativa
gtcaaggacgccatgcacggcctcagcgtgagcttcagcggcttcaagtactccatcgggagctcccatgccgtggtgcaaagcatcatgaagcatccccaacgactcggtatctgaacattctacgcttcagtttcggatttctgaccaacgcaaggttcagagtttcgtgacacggcattggtgtgcaggattcaaggaggtcacgacggcttgctgcggctccggcaagttcaacggcgagtccgggtgcacgccgaacgccacgctgtgcgacaaccggcacgactacctcttctgggacctgctgcacccgacgcacgccacgtccaagatcgccgccgcggccatatacaacggctcggtccgcttcgctgcgccgataaatttcaggcagctggtggatgaccagcactagctagagcgtggcagtgtcaccgtgtaacgtagtactactaattgttgtacgtcgccgactatgtgtctgtttgtctggtgatattggtgcgtaggatatgctgggctgtgttcatcagtggcttgtgctttaggcggtggtgtagtttggatacacataccaaaatgtcatctccgttattattgttgcccttgttggtatttgcggtgtttgtgttcccaagtcgggaataatttgagcctggagcggatgagccaaggacatcgcactgcttacttggtgccaaatcggaatacaaactctaaacatgtaggtacatacacatatccggccatgccgttcttggtcccagttggtatgtcctcagcttgcgccagttgtgtatctgtcctgaagtcgccgtctcggctcttcaccactgccactccaggttaccgatctgcaggccaaatggaattcttcagagggtgaaaacaccagtttgtttgattgcgctagagaatgaacagcaatacagaatggacgtggacggcaattgaattaacaagttggtgctttggtgatcatattcgagaatcgacagtatatttctttctggtgcatattcttgtatatatatctacggtcacaaaggctgaagcatccatcacccgaagctgaggagagcagagagcagagagcaggtgtgccaatgggcagccatagtttctcatacgtgctggtggctttgtgcttgcttggggtcgcggcggaggcgacacagcttgcccccgcggtcttcgtgttcggcgactcgacggttgacgtgggcaacaacaactacctgaacatcaccaagcaggcccgagccaattaccccaagcacggcgtggacttcaccggctcgacgccgaccggccggttcagcaatggctacaacttggcagaccagctaggtgcgtacgatcccagatgaatatatggtgccctctatttagatgactaaccagcatgtgccgcgtggcacgcttcgatgatgaacagctcagcagctcggcttcccaatgagcccaccggcgtacctgtcgctgacagcgaagaccatcgtttcgcagatgtacaagggcatcaacttcgcatcaggcggatcaggcctcggtgacaaaaccggccaaggggtttgtttaacttgaacaaatcagtaacacacgttattattctgaaaattctgaaccatatgacacgtgacacgtatgaccgtgccgcccgggctgaaacgaacttgtttttttgaaggccggggatgtaatcccgatgttccagcaagtgcagtacttctcgaaggtggtggcgatgatgcagaagctgtcaggctcgagaacaaccaacactctcctctccaagtccatcttcctcatcagcaccggcagcaacgacatgttcgagtactccttgtccggcggcaacggcgacgaccgcgagtttctgctgggtttcgccgcggcgtacaggtcttacgtgagggcgttgtaccggctaggcgcgaggaagttcagcgtcgtcagcatcacgccgctgggctgcaccccgtcgcagcgggcccgccggctgtcggaggatggcacgcgcggatgctacggcccgatcaacaccctctcgctgcggtcctacccgacgctcgccgcgtcgctccgggacctcgccgacgagctgcccagcatggcctactccctcagcgactccttcgccatggtctccttcatcttcgccaacccgcgcacgaacgcctggagtaatcaaacggcccatggacacgttaatgtctttgtcttgatggtgtgagtctaccttgagcctgatcgatggattcttgatttgtccctgtaggtttcacggagctggagtccgggtgctgtgggtcggggccgtttggagcgctcgggtgcgacgagactgcgccgctgtgcaacaaccgcgacgaccacctgttctgggatgccaaccacccgacgcaggctgcgtcggccatcgccgcgcagacgctcttcaccggcaaccggactttcgtcagccctgtcaacgtcagggaattggctctgctgtgattgcgcccaaaaagaaatttcaagctattcggcagtttgcaaacgtaatgatgtgatttgatctcttccacctaataataaactatggccggatccatacgattgctcggttagaagttgaggtcgtttccaccacggtcgtgggcagagatgtacacgggagatctctctgttctcgtgtggttttgtatcagaattcagagatttctttatacacggaaaggattttaaattgacaagaaggcacttgtttgattacagggaaaaaaataaatctctctctctctctctaatttccttttctttcgctgaaccgaattttcgaaaaggaaaaattacaccgagggctgcagg

SEQ ID NO: 63515 - DNA, 723 bp, Oryza sativa
gagcgcgaactggcgtgggcggcgtggccagttcgacgatcgccggagcagtttgggggtttgggggcggcggcgcggcggcgttcgtcgcgcgtcggcggtgtcgtgggccagccgaaacgcgaggagagtagatgcgctgacgtggcgtcgatagctttcacggctccagctggaaagttcgggagtaacacggcgtgtttagcgagaaaatctcttgattttctttttaaagaccaagaagaaaaccattgggaactcgttgagcatacatcaattgcttcacgcgaacgagaatcacgccttccaccgcgcgagcgatattcaactgtggcatatatttaggatgtagtgatgtagtactaccgaattaattgcttagttaagggtcatttgcgaatatgatgttgcgaaaaatatactaaaacataatgagccgtttaatgcgttttcagggaacttttattatctcctttgaaacatgaaacgcatgataaaaaaacagagaaatagaaaataaaattgtaagtgtaaaatatagaactataaataaaatataggaaaaatttaggaataattgcttgattagacagcaagaaaacatatatgaattagaggagatcaaaggaaactttccttggggttcaatctcatatttaaaattcctccaaaatatatacagatagaggcatttcttagaaatattgtaggattcaatagggg

SEQ ID NO: 63516 - DNA, 1990 bp, Oryza sativa
cctgcagcccccataaaacatacagaaatataaaactagctgcaaccatgtcattaaactcatctcttcaattccagaagtaaccaataccaaaacacagcttgaaaacgtaatattacaggaaaacacatcaagattgattacagtccaatgactccattataaaatgcctccaatactacaggaacggcaagagcatgacaaatttatcaaacgtctagaacaaattgtgtgcttgtacttcatatccatctcaaacatcttcttgtactttcctgaaattgtaagcttcactcatccatggccgaacacgcacgcatacatcgaagtcccgcgacgatttggacaaggggaaaaaggcggtgtcgagaggaatggatgaggcgccgccgcgaaggggagaatggcaaaccgatggtttgccttctgcagctcttcccagagaaccaaggatgcgccgccgccgccgccgccgccgcgaacgggataccaccgccgccacctagggttctgctactctgccgcgcttccccaactcagccaaaccttgcaccgatccaaaaatccctccatttacgattatacccttccaccgtggctctctcgcgctaaccacaccaatgaccaacaacggtcaggattttagtatctcatggtactagtaccacgtggtacaaaaagaaggaccgaaacaacactctaaactgtaactatggattacttttaaatttttcatcatgtaaataattactacctctatttcaggttataagatgttttaactttagttaaagtcaaactgattcaagcttgactaaacttgtaaaaaaaatattttcaacctaagataaatttattataaaaatatatttaattatcgatttaatgaaactacttatttataaatttagtcgaatttaaagtagtttgattttaatcaaagtcaaagcgtgttgtaacctacaacggagagggtatccctttaattattcttttacattcgtccaatcctatcacagtagttaaagtgctaatctcctttctacctgaccgggctcacctggctctgacgaagcatatacctccttttcatttgccatgatacttgataaatactcccgactggtgtgcgtgcccgactgcccgcatgcctatccttctttttggtctgccttaactgcttgcaagttcgtgttgtcctctcgttgaactctacaaacgcgaagctaacaagtaacaactcacgacgtaacgcgcgagcctagtttacgtgatagacgacgccacgagaggccaaaaaaacggaggacagaaaatacatctgaaaacaccaggcgcgtcgcgcagtgcatgggcacatcactgtcgacggcaagccgccaaaaccgaacagccgaacacgcacacctactactacgatttccgcggaaacacgccacgcgacagccggcgcgtgtctggtactctggtttggcccatacaactgtaccgtcctccccttgcgcatgcagagcgccatggccgctcgcgctgccgcgtcaccggccggtatgaaacgagacgaaggcgcaatctagcagcgcacgtactgtacatccttgcagttgccggagggaggctgcatagccggccgaggcgtaaagtagctggcaccgtggtgtgaactgaaatctcagggcctcgtcgcggtcgttggattgacctgctacgagccagctcaggccgtgcgcgtttactgaacagtaaatatacagacgaaaaaaaaaattgcagcagcttttcgttgcctgcaggtcgtctctcttgcgtatgaccgcacttatctgtctgtcgcgagatttcgcacgtacacgtatcgttcttctttaccggtattgatgcggtgagcatatctaggaacatatgcgaggtaggaactgtgctttttttaggtctcaagtcaagctactagggagtagaaagggagcacacacacatgatgctcggttga

SEQ ID NO: 63517 - DNA, 969 bp, Oryza sativa
gatcagtcagcaccacagtgccactgccacccacaaatcaccacaaccttgagatccatcaccaagatgctaaacttttcccgtcgccgttacccaatacaaaaatggccactagccacagcagttcacgttctcaccacacagcctttttagtgccctgattatataatcttcctcgttaatcacagtttctaaatcttagttaccgaatgctaattccacttacaatcatttttatttctttacaaaatgctaattgcgacacgcactcccgaatccccgccgctagtctcgcccacagaagattcgaacacatacagaattacacggaccacaatcgtttggttaccactaatcacatattctaattgatcctgttcctgatcatgtaccgaacacctgccatgccatgccacgtacgtggagtggccaccaaaccccgcgccgctcgttgccgccggcgcgagtggctgtgccggtacacggaagacgcggcttccgtgcgcgccccgatgcgggggtggcggaaaggaggacaagcgttggcagctagctgcgcgcctccacgttgttccggaacgttccatcgcatcgttaactgaaacgagaggcagtattaatcccctagttaaactctggctaagtatagcagagacgccggccgagaggagtggggggagagggaggaggaggaggagagtggctactagtactagctatctttggagtgggcgtttcttggccggcggcgatggagcaggtgcggcggaagagtagcctgaggtcgcatggctcaggcaagtcctcgccgcgggtgggatcgggggtgttcgatgagcggtccggactggcggccgatcgtgacggcggcgaggaaggggaggtggtcgtgaggatcgacggggaggggccttgccgcgagccgttcgcgttccccggccaggatggcggtggggcgggggctgcagg

SEQ ID NO: 63518 - DNA, 775 bp, Oryza sativa
ccgcctcgtcaagacgctgctgctcaaggtgctggcatcctccttccatgtcaacacatactttgaccggattcaggaggcattgttcaaccagtttgtcatcgagacgctctccgggccgcccctagttgacgaaaaccaattccttgctgagatgcatgagcttcaacgcgcaggagcaaccatcccagctgagctccgttccactgtaccaaccaagaatctttcagggcaaaggagtattcggatgtccggggtgattcctaagggagaagggagcaagcagctgtcaaaagagaaaggagagcaccagattgaggaggggatcaccattgacaagcttcataaactcaaccagaaaaatatctcagcttggaacatgaaaaggttgatgaggattgttcggtttgggacgctcacgacaatggatgagcagatacagcaggcaacgggtgagggggatgagtcagcgacacagattcgtagtgaatatgaagccaagattgctgccaagaagatctttcacaatgtggcgaagcctggctccaagtaagtgtcttcattgtcagtagtatagtatggttagattccctaatctcctgcaagtgccatcattgctagttcttacaatatagataatcagacaagcaactgcaatttatctgtaatgtaggaactgttagttcgtgcggtggtcgtgcggacagtcagtgttatttcattggagatgctagtatgctaatatttcatcctatatatctttagtattaagtta

SEQ ID NO: 63519 - DNA, 748 bp, Oryza sativa
tgctccaagagatgatcaaagttctcaaggacctcgacatagaatacaggatgctgccactcgacgtgaacgtgcgaaacgcgccccctatccagtccacgaggatgccaacgacatggaactattcctgattactgaatcggtgaatgcaccagatcattcagctatgagattacagagaggaggaaatgcctttgatcgagtttgagctgcaagatcctggtggcaactagcaagtgttctgcgctgcaagagcttggtaacaactagcaagtagtggatagcatgtaaaaactagcaatggttgttattgttagtgtgcttgaagccatcatcacttggtagttggtgcagtatgtaattactggtgctgtgtagttgatggataacgtagatacagagataaagagttttcattccaaatggtgaaagcagtaataaaaagttcaatgggtgaactcctatttctgattccgacggctagcccaggcaaccaacgacccttgccgtgaagctgcgaggccaatggcctgctgcgtcgttcgtcgagtctgatactctggtttttgtatctgatactctggtggagatgtagatcggcgccggctctggtggtgcgcatgaagcaccggccaccggctggtttctgtttaaatggttgcgccttccatcgcgtgctagaatagagggggcagccatggctgcatccatgttgggtccgggtgcaagtaattcaggggctgcagga

SEQ ID NO: 63520 - DNA, 754 bp, Oryza sativa
gcaacaacacacactttgcaacccgtcgaagaacggccacgccacaaacaaccgcaacacaccatagccccatcggagatcacccgatcggcgtgattggcggaagcatcgatcgatcgaccgagctcctcgcacgggctccgcccctgccgatcgcgctggaaaaaagcctgcagaagtgcagatccccgtctcccgatctcatctcatccaccacgaaatccacgatccctccacctctacggctctacagcgactccacgtgacctgacccaacccaaccaacgatcgggagccagccgcctcaaccgcgcaacagctagccagcgacgactataacggcagccgtatccttcgcaggtagaacagtatgaaaatcaccggtgattgagcagtataccaaaaagatccactctttgttagtatctgaacgatctttgattctttatcctgaagctaatgctttggctcccatgtgaatactagcagtatgctagtagtacgatgatgatgatgatgaaacaaaggaaatggagctctctaaacatgccagtactatgattatcaaaagcctaaaaaagggccccatttttatgtacagatgtctttcaaagtagcaaaattcgatcgagtttgcgtttctagtgatgtttggttgggaattcatcagaagcttgtgctcagaatgttgagcagtgagactgtggtgttcaccagagcgcggaacaccttctcgccgatgctctccacgtcc

SEQ ID NO: 63521 - DNA, 1110 bp, Oryza sativa
tcctgcagcccgggcctaatcgccgtattttccgtttgttcagttgtactgtattggtagtttgtcctttactcctttttgtgtggtagtatacattctttctgttgtcgtaattgtacaggtcacatgttctcgttaaatatacgtattcgttattcaggatgcgtatctcaataactttgaaatatgtatttggatgatcgatctatcatagtgaggttttcattaccacgtaggcgagcaagaggcaatgcatgctgccctcgcagaagatgccggcgaggaccttaacgacgtagtacacgtagaagtacaccttggagcggttgcaggccagtataactgccagaaaaaaaagtggaaaacatatgaaaatgtgcacagatgcattatgcagtttcatcaagctagggtgacccaagtcatgctgcaaagagcatacacaacggcagaatggccacggtcaccggcagtgtcatcagcgccttcctgccgtatttgtccgacaaattccccacgatgggagtcaccacaagagcccccatccctgtgatctgcgcaaattagccaaaagccgttccattttcacaaatcccacccgcaaaatgtgacttaaataatccgaaacgcgcgatactcacggcgctctggaagccgctgaggtagatggcgacggagcactcgtcgcggccggggcagacggcgtccatcgtcacgtcggtgatcgccgggatgaccatgtaggaggcgaagtggaacatgaacgccgccacgaacaagtgccccagcacagccaagtccttcatcctggcgtctctaccaaatcgacagcttaagagaaacacggttaatttgcatgccaaaactccgggtctacgttttatactcgcatgcacggcacgcaaggacaagaaaaatatacatatcgccaatgcaacgcttccaagtaagagaagcagaaaaaccgaagcatcgatcagtcgctcttgcttagggtgatcacccacttgatctcgtcactaaaagtgaccctgcatttttgccaggtttgcacagttatattgcgccttgtgaacatacttttacgtgcccaattccccaaacaagcca

SEQ ID NO: 63522 - DNA, 1098 bp, Oryza sativa
gatcgatgggcggccactgccgaagccatcgggctggcgtccacggaaacagcagtgatcgcgcccacgagccccatgtgagcctgtgcgacgcgcgcgcatgtacgcccggttctttcatagcctttcggctctgtctcacggttatttcaacaagctttcggccttcactcacatcctgcagctgctactgatttactgaagtgatcggtgacgatggaatgctcatgcatgctacattgctaacgacgcttcgatcgagttaattctttatgtttgcacgtacgtatacgcttggacgaagtttgttatgttcaccgcctcaccggttcacgtggttgatcggttcgtgattacgtacagaccgaaaggagggagaggagtcacgttaatttttttagggtaaagagagagctttattaatgcttaaataaagggttacacttctaatttaataaatctagaattcttgcgaaagcacacaacctccactccgcgcaggacctagaacacattgccatttatgctaaaacatgtgctaccctatttgcttatctctttatcgatttaataaatctagaattcttgcgggagcacacaacctccactccgcgcaggacctagaacacattaccatttgtgctaaaacatgtgctaccctatttgcttctctctttatcgatttaataaatctagaattcttgcgggagcacacaacctccactccgcgcaggacttggaacacattaccatttgtgctaaaacatgtgctaccctatttgcttctctctttatcttgtgcacttgcacttgctgaaggcattgcatcactcctttaatctcttcaatcgtcgtcgcccaggccgatttcaactgatcatgcctcattaaatctttaacaatttctgcattgtccatctccagcacgttaattatattggcattgatttgtacgtgtacgtactacgtactatctacctgctcgtgtgacagcaacatgcataatgcattggtagctaactaggctccaaaatgcagcagataatttatgaatgtactaggctaaccgaatacgtgcacgtatgccaaaattgacag

SEQ ID NO: 63523 - DNA, 1015 bp, Oryza sativa
ccacaactgtctccaactccaaccgtgtaccacccccactctccctgacaggtgggccatccatcgactcctaccccaacctgcccccacgctaacaaaaaataaaagtacgtccacttctgtggttaagttcttcttaatgtacatgacaataaaaagggcgaagtttttttaattaacactcaaaaaaacaatcatgagacagggactaatcaagatggcgaagttgaatagagaaatgggcgcctcacatggccgtccctctcgcggagacgggggccgggatcattggatcgatcggaagggaggccctttgcaagtaacgtgttgtcactcctcacgactcgatgactcgtggagtctacgaacatttggttaggatggcacaattgacacagacattgttagctacagcagcgcccctggcatgttctccttactgttttcgccacattgccggtggaacactgtagcactgccattaattcgaccgtcaggtattacgcatatgcagacacgtagtagtattaattatccacgtgatcggttagcatatgttagcgtacataaagttgaactatccggagtatgtatacagagcagaggtaaacagaggaatggaatcggatgaatccgttataatattgagaagaggttttgtcagaaattttcagcatatatcgcagataatattagtgtccttttcagggctctcgagccgaatccttgcgtgtttagatgatgaaacaagtctccccatgacacatagttgtagtgatagaacagtcgagcgaacgtcgttgatacgaatttttaatttaaactgtatacatcaaaaacatctcaaactaactgactagatcatagtcctaagtcctaaccgtcagttaacagacataatcagatcgaactccccccccccccctgcccccaccagaattaggacggcaatgcacatcaagcgttcaactacacttccgttcacccgacgatcatctgatggcgaatttattcg

SEQ ID NO: 63524 - DNA, 816 bp, Oryza sativa
ccatcgacaagcgcaacttcctaaaaatgtcatcgtacaagcctatttctcccagaaataccataatagtcaaacggttgttaacaactcttcgttaagttgtatgaaaagacattcttaccctccagacaaccatttgctcacacaatatcattttgtattgtttgctcacacaatattattttgcattgatccatatttatgttagcttccaaattcacggacatcattattttgctatcaatcaaattatttcataatgcccctgtgtcgttgcctgccacctcctcgcagcccgtcacgccgacgcctgggaccgtcgggcggacgcctgcggccgacgcgccactgcctgggagccccacgccgccacctgggaaccccgcgtcgcagcctcgccgtcgtcgcccatcaagagagttaaatcgggttaggtttaggtttttatcttttcataatttttttcctttaccggtggattgggatagaataatttggagtgagagcaatttggttattattgtaaaaaaaaattctaatagtgtggactaaacggtatgttgactgtgatggtatttctaggagaaataggtttgtacgatggtatttttaaaaagttatgtttgtcgatgctatttctagaattaaaatgcttgtcgatgatatttcatgaattttctcatctttataagttggtgccattaactcttggcaagcgaggtgctactgaagtaactgaaactgagcttttgctgctgcccggctgcttactttgctctgctgccttgctgctgttgctgcctagcaccgctgcta

SEQ ID NO: 63525 - DNA, 826 bp, Oryza sativa
gggcccactcatcgagtactcaagttgccaccgcctcactcctcggcggtggcctacttgtgttccttcgtcgtggctcgagcgaaacttctagagccacacaccccactctgattaatctcgtcgacgcctcactcctcatagcagccaactcactctcctccgtcgtggcttgggcagagcaacctctagagcctacgtcctcctctgactaccctcaccatcgccaccgccactagaccttgggtcccttagctcatcatctactgcctctctttcggcgctaaggtgctgatggatgaccatgactagcacctgctagagctcctcctcaaccgacgctacggtttttatatttttctaagagcggcaaatccaagctagacacctgccccatgttgactcaatgggtcaatcacggttagtttgttacttcagcaaaaagtacttcccaatccaatcagtttgcaccagtttttgaagacagggatgtattatattcgattgtatgattgagagagaagatttaatcaacaacaaaaatgagggaaaaaaatagagctattccgagtgaaaatgtagtcatgtactttacattaaccaacgagccgattctctaaggccatttttgggtgaagctcatgaaaaaggtatgcttggacataacactggtaaagaaatcatctttggtcggtcggccagatttcacaatagtcccggttgtattaaaaaccgggactatttagtcccggtttaaaagctcaaaggtactttttggtctttagtcccggttagtattaccaaccgagactaagggctgcaggaa

SEQ ID NO: 63526 - DNA, 4088 bp, Oryza sativa
  unsure (1)..(4088): unsure at all n locations
ccactacttcgaacctgatgctacggtatttttagtggcttctcattcatatcgttcatatacaggctagttagggatagctggtgctggcgtgcggcgctccatattgcatacatcaagagacaagattagattgcactaattttcgttcagactagctacagatttccataacctggcaagtacactgtattgttgttactgcatattaaggtaggtaactccaacataattgttcactcaaggaaattaaaggtttaatctcagttgtttgctatctgtttttttttttgcagatggaggcaataaatagattggatgtgcgagataactcagatatttattcaaatgatgatataacttctccagtaatagaggatgacaacaccagtacaccaaaaaaaatatcaagaattccactcaatgtaagtacactggcaatttaaaaattatgactgaggtgctttaaaatgcttattgcaatgtatatgtgattttgcagtgctccgtttttacaccagagtgtgatgataagataaggcctgcggtagggatgacatttgaagatattgcctctgttgaaaaattttacaagtcatatgcacaccaagttgggttctcagtgcgtattgggcagcaaaagaagttggatggcgtggttcagtgcaagcactttgtgtgctcaaggcaaggatggaaacatgtgaatgataaggagattgttgatccatcgaagaaaaaaaagattaaattgaaagaaactagatgtggatgtgatgcacacatttacgtgaagctatgttctgataacaagtacacgatagcttccttggttgagcaccatagtcatggacttgtatcgccagataagctgcatttgataagatcaaatcgtgaagttagtgagagggcaaaaactacactcttcacatgcagcagagcaagcataggaacctcccaggcatataggctccttcacgtgagtgatgggggatttcagaatgttggatgcactaagagagacttgcagaattactatcgggacctaagaaagaaaattaagaatgcggatgctcaaatgtttgtggcccagctatgtagaaaaaatgaggtcaattcatcctttttttatgattttgatgtggatgaacatggcagattgaagtatgtgttttgggcagatgctacaagcaggaagaactatagtcactttggcgatatcgtatcatttgattctacgtacaccactaaccagtatgacatgatttttgcaccatttactggggtaaatcatcacttgcaaagtgtgttttatggtgctgcattcttagcaaatgagaagattccagcatatgtttggttgtttaagaccttcctaagagcaatgggagggaaagccctacactcatcataactgacgaagatgccagcatgaaagcagctattgaaaaagtttttccaaccacggtgcataggttgtgtatgtggcatatcatggaaaaatgtcagacaagatcggaccactatggagagaagactgcgatttaagggaaatgatgaagtcatgtgtttggagatcagaaactgctactgagttcgaatcacagtggaaatctatcattttggactttcacttggaggacaatgagtggctgtcaaataggtttgacattcgtaaatcatggattccagcatatttcatggacatatctttggctggcattctcaaaacaacttcaaggtcagagagtgcaaattcgtttttcaaccgtttcattcatcgcaagcttgctcttgttgagttttggctcaggtttgtcacatctttagaatgccaacgccaagaggagttgaaggcagataacacaagcatccatacaacatacaaacctgtaactccttgggcaatggagacacaaggtagcattatgttcacgcatgaggtttttgacaaacttcgagaagagattatagccgccagagatctttgttgtgttaaagacattgcacaatgtgatgggttgaaaattgttaccattagtgatggatctcacaagctcagggtagtccgttgcaatacaacgacaatgatagcgaactgttcgtgcaagctatttgagtccgatgggatcccgtgtcatcatattattctagttttgagaggtgaaaatcaaaatgagttaccaactgcatacatcatgaagagatgggagaaaagagtgaaaaggtaatgtgtgcatatactctttgcttgaatcttttagttttagtcagttcatgaaaaaaattgtacagtgcatacactcactatttttttttgaaactggtttcctaaccacatcgttatcgtagggagaannnnnnnnnnnnnnnnnnnnnnnnnnnagaagagaagccaattgactcctcggaggcggcaatgagaaagaaaatatcaattgcacgcaacaaatttgaagatctcatacaaaaggctaagcactcagatgaaggcattgacttcttaacatctagtgtgttcaacctgaggcacccttggaccaaatggtgtctaatgtcaagcatactagacatgaggagtgagtcttttcttggttgcacaattcctactgaaattgatatacaccgaccaactgatattcattcgagggggagaagcaaaagaattagaagaagcaaggatgccaatactggtaagaagcagggtggcaaggaacggacaccacggatctgcaagatttgcaaacaaatggtgtttcaagatttgcacaggatatgctgcctttgtttgcaaatcatgaaacttgtcctagtgccatatatatccaaacgggttttactcgttctatatgctgatgtgacatgtcatggagatgcctacgtatcggtgagatcccaatttcagtgacatattgatagttttttttagaaaattcttttatccccctctttttaattttttaaaaaacaacttcccccatcacttttctttaattttattttttctatatggctaacatgtagtcactaccatggtatgtcacgtcagcacacggattgagtcagaactcgtttggacctatgagaccccaggataagtttggggggctgaaaaatatattttgtgattctaaaatgataaatatggttgtatgcaaaataactctggacaaaattgcacttctttttttttcataacacttggtttatggggaatttcggaagtacaaattgtgtttgtgccttcaagtaaagtattatctatttgatcacagtggattgatggttgcgcatcctatatacttatatagttcatccccactaagtgcacttaatgctatttctctcttctctcataaagccacatcattctaattatttttagcctttggatggtatatatatggtacaaatagtctcttctttcttctatcataaaaccatacaatttcaatcgtttttttcttcaaaattcatatgtatcaattatataaaatatgttcaccttgcattatatttgcaatcatgtgtaaattatataaaacataggaagtcattttattttcttttacaaaatataatatagcttatttgtacatactatacaacttaatttcccgcagcaacacggcggggtaatcatctattatttggagaaatttgggtcttaataaagaaatccttggtggaataattaatcctgacatattggtccattgagccacctgataaaaaacaaagtttattactcaagttcatttacatatgtttggtttgtgggtggggtgggttggatcaaattcatcactgtttttagggtggggtgataccgtctatccgtaaggcacgagagagttgatgatcctatgttttatattgcagctcatatgccagcaaggaagaaaagtgagttggattggtatgtcaactttttagggataaggccaatccgaatcttagatgggtacaattccatcttacttatttttaaaccaaataccctgataaataaataggttcgacccaacccaatcccgtcccttaaccaaaagcatgctttgattgacccatccaacatcaaattcttt

SEQ ID NO: 63527 - DNA, 2430 bp, Oryza sativa
  unsure (1)..(2430): unsure at all n locations
ccatcatcctatttaactttcccgcgagtagccttgtagaactccagcagcccagtgtactgtaattgatcgatcgtatatggccgtgttntagttcgtgtgccaaatttttatttaagcatacggatacacatttacagtattaaacatagattaatagaaaacaaattatagattccacctgtaaactgtgaaacaaatttattaaacctaattaatctatcattagtaaatatttactgtcacccgaccaccaactcggccaccgtcaccggcggccgccggctcaacattttcgagggccctaggcgaacttcacactatatgcccttaagaagttaagagtattttttttaacttgtaatatatactctataaaccacaaatactatagtaacataaataaacatttctaacgtggtaaataataaatcaagcagtttacaagttgcaatatagtaatttgtttcgataaaataatatcgatagtatgattgacaacttaaaaaaacatagtagaaacaaagtactatgacctaaaatcagtgagggaaaaatctatataatcaagggcctaggcctaatgaaaactaatccaccatataccttaatttaattagcttatggacttatggtgcactgaatggttgtatacttatattgatcccttgaacggttgaaccagaatggtagaaccctaagtccctaatctaggtaatttaatggggaacaaaaaataaattaaaagaacagttcaattcgaatcagtgaagagaatcgatggattggatcatcacctgatctagtgagaaggatcaatggattggatcatcaattctaatcagtgagaaggatcaattctaagctattgggctaaatacctatatagggtatatacctggatcggagcctccattttggctgggccctaggccatcgcccttatggccctgctccagagccggccgtccggcggggtgccagggacggtgcaattcagcctgccgccgcagtcgccggacttggagctggcctgggcaaagaccgtgttgccactgccgctgagggagcatccggtgctcgccagatggtgacgccgggggaacacgttgacggcccacacgagccctggggtgaggtgagccattagccgccgacgattgggagggcgcccgcgcgcaccgtgaaggtgcagttgttgacgatggtaacggtagcgccgcaggccaatggctggaggatgagcggcatcgagaaggtaaccggtgaagttggagactccatgctgtgaactaccagtgcgagctcaagcgtagtgctagcgtttgttgttatggattggccgtgattgtgcaagcgtttaaacagtgtatgtgctgaccaagagctggaacatggatatggatcatatgccgtggacctgaggttgttaccgttttttttttttgacaatttggtccttttaaaaaacttattttgaaaactaaccctcgccaaaaacttcaaccaaaaatagactgtgggctcagcgccagttccgttggcgctgagttccaacgggtcagcgccagtgactttggcgctgaacccttgcccacgtggatcaccagtcgatccgattgccgacgtggcgtagggtcagcgccaatgcatttggcactgacctccgtatagctcttaagtatgtgtagtatgcattggcgctgacctccgtatagctcttaactatgtgtagtatattttcaaatcaagtagtaatgtgtagcgcagtggtgaagcccatcccttggctagttggtgacctgggttcgaaacttgagctttgcaccttttttttcgcatttatatgggcaacagagaaataccaaaaaagagtgcagacatgggggatcgaacttaaaatctggtgaaaaccaaacaagcatttcaaccactgcactatcaatagatcctggtaatgaatagcacactgtctacttattatgtaccacgtccacaatcaactctgctagcgtggcaaattttagcgtcgtactggcgctgagacgttggaccatagcaccaacgggattgacgctaagtccacggtctatttttagttgaagtttttgacgagggttagttttgaaataagttttcttaaagtaccaaattgtcaaaaaacggtggttgttaagagtgattatacgtatgaaaggtaaagttggtcgtagcatcacaaattagaataaaaaattgatactctctccattcctaaatatttgacaccgttgattttttagcacatgttcgaccgttcgtcttatttaaaaactatatatgtataaatataagtatatttaacaatgaattaaatgatagaaaaagaattaataattacttaaaatttttgaataaaacgagcagtctatttaaaaaaatcaacagcat

SEQ ID NO: 63528 - DNA, 4777 bp, Oryza sativa
cctgcagcccgaagcagcacgacgccggcgccgctactcgcggtgatggagatcggcgcgacggcgtaggcggcgggcgaaggagacggaacgggtgctggaggaggggaggccaggggacagggggctgggtcgcaacgcaaggaggcaagaggcctattacgctgctgggtcagtggggtgttgttacaggtttgggctttttggtggctcggtctccatctgttccatctcctcccaaccccagcccggttgaaacaaaaaaacaactagggtgtgtttggaactttggggagaatactaccaatcgaacgtccgatatatcaaaaaaaacatcggtcggtcaaaatgttgcagctgaccaacaagtgaaacattaatttatatatggtgaaacaaaaaaacagcaactaaaacatttaaaaaatttatgaaacacagtgaagatacacgttgaaacatattgctatcacttatgaaacaataagagttaatagattgaaacatatatttttctttcatcaaaatttaatcgtgtgatattttattataaagatttaattacaacgaatacaacggtgtaatcgaatcatagattggataagtagtttagaagaaaaatcattttaaagaccgataaaatgcatgcatgcaagcattgatggagggtagtagcaattatttttgataattttatgaaacacaataaaaacaggtgctgaaacatatggatataacgtatgaaacatgaagtattaatagtttgaaacttatatttttctttaatcagaatataataatgtgatatcttgttataacgatttaattccaacaaatataatggtgtaatcggattttagatcggataaatagtttaggagaaaaaatcatttgaattttgaagacaaaccccgatacgtctctctcattctaaatgacctttccatgggtctcacaccccatgcacacttggaaacacatgcttgcatgaagcgggttcgatttttctcttttgctcggacgacacatgggaagcaatttccgaactttggataatgggatggtaaaatcttttcccaccttctaaaatggtaatttttaatcttaaccatccattcttcatatctcatctcaaccccccactcatatccctatcccaatctcacccctcttactccattatctaaggctgcaggtaaaatggttgatacctgtcgtcgggcaagcatgagaaggacagaaagttggctgccagtatggattttcagtatgttccgttgttcggtaaggcaaactcaacttgctactttgttgggcttgccttagtgaacgatttggatgattgcatgagagacgtttgctctcgaaggagagcggagttgactctcccgagcaagctatctttttcttgcccctccgggataggttgccaccggaagtgatgattttctttttatggatttgctagatttttgtcgatagaaaatagggagaaagactcttgatttttcggtcgtcggatttgcattaagattcgtgctagcgtgtggagggaaaaattcgtgtgaaaatttacttgtgcacttgcacaggatcaaactcaggacctcgtttccgcaaaccatgctagccacttgagttgccataagattttgaaagatttagacaagttacattacatacattctagttacactgtaattatatttgaaagattttagagaaattttctttcgaaagttctatagtaacttcttttatgattccaaacgactggtcttgtcacgccaggctagcatcaaccgttcaacctagccttggatgacttgaatggcagcctagccaagcccaaactctgtattgtgatggatattgtctgtatagcccagagttttcataacacaagggagagatcacactaagcttccccttttcgggtttgcagcccagctcgtgaggcaaggtcacgctgctgctgtaggatcgtaaatgatctttcccacctcaaaagctagccaatgagggatgggctcccccacttatatattaagtttcttgtccttctataaccaatgtggactattcaataatctccccccttcatatattggtgtccctcagccgttcaccaccccttcaccgtttccttatggtctctcaggtatacgttggtgtccctcggcctttcaccgtccattcactgtttctctacggtccctcaggtatacaggctccacaagcatccacggtccatcatgccttcgcacactttgccactcaggttagagatattgaactaaccagactcagatagcaattgtagaatcgtaaatggtctttcccacctcaaaaattaaccaatgaggtgagagactcccccacttatatactaggtcacttgccctttcacaaccaatataagactattcaatagttgcagcgagctgaatttgtggaaacaaaacggctgttcgtaaattgtgcacaaatttttatgacaccaaattctaccgttattaaaattatgcgtaatcttttacaagacattaccccagccctgtgtgttactagtcgcttttgcataaagtttcagaaagccctaggtcaaaggtgtagcacgaagatctgcagtggttttacctcaggtagttttactcattgtggagaacgttgtcggcgcctcggaggttcaggctgcgaggataaaattttctctttacgtacataaaattttccagttttctaattctcttaacgtacttcagttgcagtattttctcttttaccattggttatgaacatacttcagttgcagtattctgtctcaaatgactacagtatatagattaggacttaggtgtagtgatgattctctaattctctactaatcctattgacctactgcatgtaaactgcaagtctacagcatagggtcgttgaagctacttgcaagggtcgtcaggttaattaacctgtagggggagctttggaagatgcagcagtggcaggttcgtcaaatgtcaacgcgagtaacccttacgctgcccattttacaagtcccaaatgttcttgttcgcagcagtcccgggccatcagctacctctctcgagaaaagcagtacagatctttcgatctcccacacacgcctggttgcataaatctatgcgttttcaacttcacccctcctgggatatcgcaagcacgagggagatctaaccatcagatgaagtttctgaattctacgttttgttttgttgttttgattttctttaccagagcgagatcgctgtgctgcaattgccgtcgtctgtcagcttattagttcagtccaggcattatcgggagcgtgaagcggaagcaatggttagttgttgcagcaagaggatgagcgatgaattatgcatggcttctatgtcaatagaaaagtacaaaaggcaaaagcagattaaatgctgaattattgttcttcccttgccgagcagacagaccggtggttcgtggagtgaccaagcctgaaagttctgtcaaaacaagagggttggtggtttaaacatggaccgttgttgaaaaatagattcagatttcactatcaatcttttatgcatcgtggggtcatgacgggacagcgtccaaatttcgaacatgatgagcaaatatgattcacaggactggccaaatattatgcattaatagctataatcaagaatggctttggtgtatttcagagtggcacccactgcctttcaaggagataaggactaagatgtgctaatccctccaactatacatatgtaaatcattttagtcatactttgtcgtctctgttctgttcctgttatacattttctgaatgcccacgttatcatcagcaaatatctcgcaatctttctcatttccggcatacattagaagagagagtaaataaagcgtggaaatatacaaaattgcatgccaatttaaccttataacttagttcatgtgttcgagaaactaagatcagtatacttgaaaaactggtgaaaataattggtcgtagcttgttgagtaaagaccggattttgttccattataaaaaaaattgaaccagtaaatatgaaaagcattgcaagttttgtctaaatgagactgcaagaatcatgatcttacgttaaaagtttaggccggatgcaaatttacatgagattacaacaaacacgacgtcacggcaaacagctaagctcatctttttatagcccaaaaaaactttatagcttgacgaaaaataattctggagaaaacgacccgtacgtacagcggtaaagggaacagctaatcagctaccacacaacacagaatggcaaagccagctagtggataacagaacaaacaagagaagatctgtttgtttaatgtgacgaccatctggccatgtgcaaatggaatctcagcactgtggttctcgtatgctcacctcctaactaatactttccataattttccatgctcaccacaaaggcaaaagaacaaaaaaagcaggaacagattagttaatgctactagctggagtagtaagcactaagcacggacagtaaactgtcaattcttcaaaattaaccattttacatcagctgcagtggcagtaaaaacttttacagtgccacaaacaaaaaggagaagaaattcagccactcgctgaatcactctcacagtcactcaaacaccatcaggagcagttgcattgcagtccaaacaccacctcccctctcttccatccaaaattttacagtgaaaaaaaaat

SEQ ID NO: 63529 - DNA, 1008 bp, Oryza sativa
ctctttcttatatcaggggcagtgtgcgatgcatatccaatcgccatgtttggagggggaagtaacatggggagagagcgatggattggccgctagctagctctcgtagcagccatttctttgggtgcaaaccactgcataaacaaataagcaataattaataacacaaaccatactaaacaatgccttgaaccaattgatatcaaatgtaccatcgtacatagctttcttcacatggacaaagctagatcttgcgctgtatttcgcgtgcggttgctggccagggttggccaccccgggcccacatgccagccacagttatttaggaaaggctaattagtttataaaatgatgcttgattagtaacctaaagtacgagccatgggcagattagttggatcttaattcgtccgttgcaatgctgccaccttggaggttgcttcaaggaaggctcctgaccacaagcaaatactactactacagtactactatactacgctgttgaaatgcagagctttgctcctctgcggctgttcttgttcgcttgcggccggaatacatgcagccaagtacgtgagatgtacgcgctacggacaacgtgcatgtgaaggaggcgctgcttttcaggtcaacattttgtggaagggttttatgttgtgtttgcgtttgcgcagctctgctcggcgatcccagatttgcgtggaggaaactgctctggtactccatggtgacggctcaggcgcggctcaaccgttggatgctgatcggatggtcgatcgggttcggaaaaggcgtgctggttgcttcgggatgaagggcaatggttttacttgagaattactggagtagtagctgaactcggcgagtgagtgtacaggttgaccattttaactcgcactcaagttacttacagtactcctactcctaccttgtgaagcgaataatgtgatcaacattggatagcacaaaatggacgtacgacgcaggtaaacaaatgcagagttgaat

SEQ ID NO: 63530 - DNA, 754 bp, Oryza sativa
tacgacagtgcggcagtgccttcgctagctacgaatataggaccggggcgaggccagctacggatgctacagtcgagcggccaccacgattacgagatgcaccggagcgagtgcagggacgccgaggtgtccatggacgcggcgtcgaacatgcaccggcggtcagtagcctcgatgccgtagtccatgagcgggcggcgctcgagctcctcgtcatgccggcgcgcgcattccgggacctccatctcccccttgctcacgtgctcccacaggtactcgagcctgctcatgtacctcagcttctcgtacagcctgcaagatccaaaattccaaggaaaccacggtaaacaccagcgcctcacccacgaatcgtagtgcagcacacacggagtgattcgttgtatgtacatacccggagctgaagaggaatcgccccaaggtggcgaagaagaggcgggcctggaatcccgggtgcacgaagtacaccgcgcgcagccgctccttggccgcggcaggcagcgcctcgtacgccgcgcggatcgctgcgacgccggggaagttgtcgccgcggtcgacgagggagtggacgtacacgaccacgaactcccgctccccgatctccgggagcacgcgcctccgcacgtaccccctcaacgccgcctccgcccgcccgcccagcgcgcgcgctgccgcgacaaaggaaacggggtcacttttccgccggcaaaagcatcggaattggggctgcaggaat

SEQ ID NO: 63531 - DNA, 1266 bp, Oryza sativa
cctggacatggactcgatctcctcgaggacggcgacgacctccctcatggagggccggttcttgtggtcggcggcgaggcaccggagcgtgagctgcgccgcacgctgcgcgcccctggacgagtactgcccctcgaggcgcgggtccatgagccgagccagcttccggcggtcggacaggaatggcttggcccagtccaccaggtggtgctgcccgctgggccgcccggcgtcgagcgcgcggagccccgtcaggagctccagcagcacgacgccgaagccgtacacgtcgctcttcacgtacaggtggcccgtcgccacgtactccggcgccgcgtagccgtaggtgcccatcacgcgggtcgtcacgtggctgctgccgccggccggcccgtccttggcgagcccgaagtcggagagcttcgcgtggaattgctgcacgtacgcatgatcaatccgcgaggaaaaggagatgatcgagttagacgacggcgtgtactctggcgggaggcggcagcgtgcagggcgttaccgtgtcgaggaggatgttggaggccttgaagtctcggtagatgacgtgcttctccgacgagtggaggaacgccagcccgcgggccgcgccgatggcgatgcgcagccggaggctccacgacagcggctgctgaggcgacgcgcttccgccctctggttgacacaaaaagattgtcatttttcagctctcgttctaccgttcagttacagtgtgttcagaaaaattctggtttgattttccgatgccagctttgcaatccaataatgaagtaaattccattgtcattccaattccaacctggcaacccaattatatctatatatctatactcttcatatcaagctagcttttgatactctattcacctgtataaattatgcactatcagttgactctgttctcagaacatccactaatcccctctccatgtgaagcagaacaatgatctcaatttgtccccttgtgaccaccatcaggcatcgttaattagcagcccaagtcaagttgtcagctcttaataatcatggccataccgtcatggatctgaaagcaccatgaaaccttttgtcttaaagtttacttactgcgtggctcacttctgaagaggtggttctccaagctgccttgggccatgtactcgtacacaagcagtagctccttgtcctcccagcagtagcccagtagcctcaccaggttgggatgtgaaagtctccccagaaaattcacctcggact

SEQ ID NO: 63532 - DNA, 2605 bp, Oryza sativa
cgacggccatgccggagccgctccgcgcggggctcgtggtcctctcgtccacccaccccttgtgcacccgcccgaacccgccctcgccgaggacggtgtccgccttgagttcctcgtggcggccctgagctcggcgaacgtgaagatccggaggttgggcgcctccaggatcctcccctccgcgctggcgtcgccgccggcgttcgtccggcctcaccaccagccaccgatcgcccgccgccggtgcttgtggctgtggcctggctcggcaacttaccagttggtggccgccctgggctcatcgcgacgcgtgcattgggctgcgcgatcgcgaccatgaccggtctcgccattgccgctgcaaaagagcaaaacccagcacacgaagtgcgtcagaactagagacgcagcaccaaaaccatgacaaaatggctttgttggttccagatcccgatgaacaaaataaatctcacgaatacaaagaaaacgtagtgatattgtaagcagagcatcgggatgtcgatattcatatatgtaccttgtggcagcgcatgacgggccatcaccttgacggcctccacctcgccgtcatcggagccgaagcaattccccatggcggacgcggccggcgagcagccaaacgagcagggaagcaccgggagcacttcctctctgtgagtctcttccccgagctataatggcttgtgtgcgtagatcatgtccttccagcgacgtgcttcgccatgtcttccgctcttcctctattaaaaaaggaggcggaaatgacctggacgtggtgtggaaggacgagacgaggcctggaggaaggctgctcctggctgggcgactggtcgactgtcatctgggaacccatgcatcaggggaggagcacatggcggcatggccgcatggcgcatatcgcggcaatatacatgttttgtggcacactggcacctcgtttcaaatttcatcagtgttcaaaaacattttgagtttctcaagattagaattttttttgcggggtcaagattataatattagatccattccaatgaaaaaagaatattagatccatttgcctattattgtacttatttttcaattttcttttgagaaacgcttgtttataatatgggatatttagcagaattgctaaccttcatttgacacaaatttgagttgaatatctgatgaatccttcaccattagatccttgtcactctttctccttgaaagccagcgagatagtggcgacttaagttaggatcccatattaagatcggggtaggaggagggaattcgccaaccttaaagagatggttaggtagtggaatgggctggcggcaaaattgccatagccgagtagtcggtaactagcagtgggccagtgatagcggatccaacagcaaatagacacaagagacgagaaaaaggtagggcgtgagaatatgatttggcaaattggcagcccttaggtagggcgtgagaatatgatttggcaaattggcagccctttgatttgcagtaggatcttgtggggtttatgatacccgggtattcgatagtagttctttggggctagatatgatggggcgggctgtcgacctccgattttataaatcggaaatcttatgtgtttatcagtaccaatccctgaatcagtagttggtacacacatacatagccgaatcacaacatatcacgaatgaatccaggctaagagagttaaatgcttacattagggccaggtaggccaacaactatcagagaacaacagcggaaaacaaaataatatctagcccgagacctagaatggaaccgcactccgatcagcttgttaggtacgcaagcgtactaacaagggcttctcttcaacactttgctaaaagatatatatagagcaacaatgagtacaaaagtactcagcaagccaccacacaaaatgcagtaatgtataggataatacaacgagtggctatggttactttgcgtaaagctgagttttcaaatatcatttcacaaacctaagacctagcataaactaatcatgttttaattccattgttcattaaacagcgacggttgtgtccactatccattgtgttcccaaggatagcttcctgccactggtcgtcatggttttctggggtctaccccttctcgcctctcgagaagttgatctaccagtacaaaatcatcatgcaacattccacccaatcagattaagaaattagagtctagccaagtgtaatatatgtcccggtgctcaataaccacgagcacgactattcgaatagatttggtttactcacactacagtggatgtacactttacccgtactccgcgacttgcccaacacatgagcctacgtcccaacgaatgagacttgccacggcaaagcctttcaataaccccactttggcagtacccgctccatgaactttagtcctcatgcactctaggcgtccaaggtttctagcagtgagaggagttctggctctcccgggaagggaagactcacacatgcattaagttatagttaagtttaggtttacacatggcagtcctaccgatggtgacaccactgtaggcactcgcccctcg

SEQ ID NO: 63533 - DNA, 4717 bp, Oryza sativa
tcctgcagcccctctcgcctgttaccgagcgaggcagaggcgcggctcagcgcagccggcgtggccggcccgatccgggacggcggcgggcggctcggagacggccggggtgaggcgcggaggagctccggcgatctcccgccgatggcagccggcgcgcgaggagacgggggcgtgcggcgcctcaggcgacgccatgcccgagctcggctacaaggggcttcgatgctagggacatcctccggccgaattgaagggtgagggagcatctacggggtatggggattcgatttcacgaactatatggagaggggagctcccgggatagcctacccacggagagctcgccggcgacgaaacggcggccggggcggcacggccatgggcgctaatcgccgattttagagccggcgctagcaattagatgtatggaggacgctacgggcgcgagggtgtaccgcgagacggcgagatggcgaaacgcggcgaagtggagctcgacgcggtgcaggacaggggcaaacgacggcgacgtaaggtgcttgacaacgtttcttgatgtccagcggctacccggcttcccccatggcgacggcggcagcacggctcttcctccactccctccaacctccagctccggccggggagcctcacaatggtgatctctagcggtggtgagagggtgatcgcaaggtgttcgatgaaatgcatacgagaagaaggctgagagggatgaggattttgttgagggcttcgcttaggatgcaagcaaactatggggataagatcaccagcacatgcctaggcgagctggagtactaatggtgatcggataagagcaatgaggtggatgacgcggataaggtttgatctcctcctccattaaggttatgtggctccatcatcgtacctaaagcctaaagtctgtgcgttctaactctagctgtggcaggaggctccgttttattcattgggcgcgaatgggggcgacggaacgcgcgcacatgggagctgtggcggagcggcggcttgctggggcggttttcccgtcctaaggtagttggctagggctagggatgacgcggattggcgttctggccgttatccatcggtggcgaggtgatgggtgatggcgatggcgacggcgcgacaagacgcgaggcgccatgtttcctggagggaatccggacgcgctggcggggaggcggctaggtttggcgcggttctggtgcggcacggaggggatggcgcaccggcacggacacgatgcggtgcacgggggcgacacgagatgcggagatggcgcgattgatcacgtgcgcggctcagtagtgaccgggaaggagcggactcgcagcatgtgagcggcttgggcccagatcgaacggttcatgggcgatgaacagtgccgactgaaaaagaaaaggaatgggggaaaaggaaaaagagaaagggggaagggctaatctgcaaaagtgaatgggattggatttgaaatgaaatgaaatctatacattctggttttgagaattcaaatgtttgatttgaatatttatttagttattcattagttcccaaatgagtttgctttccattagattatccaaaaattatccaattcaacttctaggctttgatatttcttaaaaactaattaaatattctattgtgacatttaataatacaatagcacattggtcgaatttatttgtatagcaatatattttacatacataggtttaatttatttaagttttattctatgaaggtattatgagatttggtgcaatattggtcttaaacattgaatcgaatactcccataagctcttttttatatatagaactcaatttatttacatgacaaattattttacatgagtgaatctatcccctgagagacttgatgaacattgtaaatattaatttaattattccagtgcaacactcctttatatatagggtcgtcatagtggcgattatttcatggttacttagatgtcatgacacctgtcacatggttccaatatttaatatttggcctataaattaaattagtaattaaccttctctttgtatggctttgttgtgttgtgcgtaaatatttatagggttcacaataaatatcttatttttataattattaatcagttgtatagctttagcttaattttcagtggtgacaatttatagtttgacaagcaataccaaccataacatccagcatgatgcaaaagttttaaaaagttcaaaattttagtgatttttattgtcggggattttcaggatgttacacgggccaagtgccctagactcatccaacttacttctattataagaaaggaattagagataaggcaatggatcttatctcatgtaaataggaggcatgtaccggattataagagatatcacgcatgtcttagctggctccctgatgactatataagggggtcggctaaccctaattcgggtgatcgctacaagctactctcaacgtcgtattgcgaaattctgcacagatccaatctcatacgactgaactagggtattacctctcttcgagtgcctgaactagcataatcactgtgtcaccatctttcctacgtctagtgcacccgataaatattattgccgatctagaaaatcgacatatctcttgttacatgttgtaatggtcttttaggcttctttggcaaatgggatcgggaaatgatatcccatccatcgaagggtaatatcgtatcctagccatctattcttctcatctatatcttcacatctcatttagtcctagccattcatccatttccctttgacaatcctgaatctcataacacatttgcaacaggttctttgatttaggcttttttctgtgttttatcggtgacataaggcccaatagcccagtgccgcgactgaccgcaatgttgggccatcccacacggcccagcccgcttcctccaacccaaaaccgatcgtaccaccgacccacgcgtcgcaggtacagcgctcagcccgtcgctgtcctttatttatttccctttcacgcactcccacgcggccacgcaccgcgcaacgctccgccccaaaaggccagacaacgcccgttgcgccgcctcccaaactccgcctcctcctcctccgctgcacccccgcaaaaaccctagcgcaccgacttcgcgatctccgcgccgcagccatgaagggcaaggccgacgcctccaagaagggcgagggcaggtaagatcctctctccggccgtctttgctgctgcgtatgggcggtggaggagggttttctggcggtggctgttgttggttcacatctgagcggttttgtgtttggtgttgttgttgttgttgttgttaggctcaaggccgccggcggcgccgggaagcggaagaaggccgccgctagcggcaagccgaagcgcccgccgtctgctttcttcgtcttcatgtgagtttctcgctccctcgcccacgttttgctctgttcagatctagtacagatctgtcttgagtttttgtttaatttttgttgattttcttgaattttaatattttttgtggtttttattttttacttttgcaggtctgagttcaggcaggagtaccaggcagcgcatcctgacaacaagagtgtcgccgccgtgagcttcctgacaccatcatctttttcgccactttttggctgatgtactttagatgtccaatttttttctcctctgttggttcattaggtgagcaaggctgcaggggagaagtggcgagctatgtctgagcaagtgagtttttctctgcagtgttcaaaaattagtacatgttcctattaagtgtgtgcatctgttatttagcatacatcatccatgagtatcactagaggactgtttaataattgttctggcctgtttgttaggaaaaagattgaattgctcctaaagtactagttgaatgaaaattgcaatttgtttttgaattctactcagtgaagcgcttaagtacacataagtaccatgggtggctattgatgtgacaatgtgccatatgtttttggcccttcgtgttaaattttattaggagaaggcaccttatgtggacaaggctggccaaaagaagcaggactacgagaagaccaaggccaacttcgataagaaggtgatgatagaataattgtgcatcctaattatagagcccttcaagcgttaggcactaattggacttcttgaattacttcttcaggagagcacaagctcaaagaaagctaagacccatgatgatggagaaggctctgacaagtccaagtctgaggtcgacgatgaccaggatggtggtagcgatgaggtaatcattaaaggaacacccggtgccctattttagcttgaatgcccaatgaatttttactactgctagttgtgttgctaatgaacatttttaatttgctctttgcaggaaaatgaggacgatgaagagtaaatagtgtatccgggggcatgaggtagcaaactgtgtcttaggtcccctattagctttactagtttgctatcttcgaccctaagatgttgggaataggcgtgcgtgggtgtgaagggggaccgtttagaattatggtactcagaatgttttcctacagtggattagcaaagaaaaagcctgaatgccgcctgctgttctgttgcttttcttttgctaaccacttgtcacagaactttgttt

SEQ ID NO: 63534 - DNA, 1323 bp, Oryza sativa
ggcttctgtgatggtactcaattgtcattgcccgctcttatgctgttccatctaattgtgatctaagatttcgtatcaaattaagtaagttcagaccgaagatatgtaagtactgaactcgttttggatattgatgatttagttttctataaacaaggcattgtaggcttgttgtagctttatacggttccctttgctttgacttttcaacttcgaggattccagcaaatgctgttaatagtagcataaaccgtgtcgaccatctgctggtgctccccgattctgacagaatattttcccctttctaacaagtaaaaacaaaagaactgaacctttataccattcgtaccatgagagaacatggatgcctataattttttttacatttttttttaaaaaatcaacttgtacaaataattccgtataaacacttatctagatttattctgattttttttatggacggaggattacctcccatcactccccatctccaacagcacacatgccaaactatccctctcgttggcaacattgtcttcccgcattcatccaccactgcggtactccctctatcaacattgtcttcccgcctttatccaccactattaacattgtcttcccgcctttatgcaccactgcggtactccctctgtctcataacatagcaatctaggactgtatttgatatttcatagtacaacaaatctggacacacccctactcagattcgttgcactataaaatatcccatccaatcatagatcacacccctactcagattcgttgcactataaaatatcccatccaatcatagattactatattataggacagagggaggacctcttacctccgcgttgttgtgcggcaacaatccccacaacgatgaactgctacttcggttagtgcgacggcaccacaccggacaccaccacaacgacggcaccacctcgtccttgccatgcattggcatgagctcggcagtggcgacgaaggatgcacaccagtaaccatcctcatcatcgttgatggaggcgagggtgtcagggtgagcgaacaggctgagaagctagacgacggaggcaactacagctagcacaccatagtgacggactcacaattgccgagtcggaacttgatagtgcactccctgtcactacaaacacggagcatgtcgaaggaggagaggacgagcgagatcaacatcaagtcgttggtgattcacattgggagggaaaacgtccctacggttaatacgcctacccggtggccggtacacgcccatctgcttcctgttcacacgatcattggaggcaaggc

SEQ ID NO: 63535 - DNA, 1175 bp, Oryza sativa
gtggatagatttatcgttcaaggatgagtgctgctactgatgacaacccggtgagcaaattcgctcaattgcagcaatcgcccttctccaaacacgggtttccttaacattaaaatgttatcaaatggaatggattaagagaagcagaggttggctaagccaaccaaattgtttactaaatccacaccagctggcctgattagtcggaatggtcagcagctgatggcgccgttgggacttcaggaatcagaacctgcttttctgcatacccaacccacaaaacggttagccaccgacactgcgctccacctcatgttcactggtctgtgcttaatgatgattagcaccagaactgctgctactattcgaactttcgaaagagggaaagcgaaagtagcgtacacacgtttatgactccattgaaacaaagggttcttggaggaatataatcctatgaattcttttattgctccaaatacagagatttaagagtaattttaacataaggtccaacctattggaaacattctgtgtgtctatctttcttctgtttcgtgtggtttcttgcgtttcatccaaacgattatttctatagattacctatgtttctcgatcaatatgatttgagatgctgagatgtttggttgatgaccaatttttatatgtgttttgaatcttactccctttatcccaaaatataacaacttttaacttttaaaatttattttaaaatgtaacaacttcttcatctacattctcttcttaacaaaatataacattccaccatttaaatttaaattcctacttgactaggaaaagtacctgtcacacaacaatgttgtcagcaaattagcaagccagcactcagttcggttcgttattattactacaacgacacttaggatatctgcatatacatatagtgcgtactttagatcgtcatgatggtgcatgaaaccattttcgttaggttagagcgggtagcacagtggcgtaggttttgatgcatgagaaattgagatttgaggaacctctctcgttgagtcattttctgccttggcagcgaacggggttcggtttgctgtgttgggtgcgacgtcgctttcatagctcgcatatgcaagatcctttgtcttgctcgccttggaacatggggcttttttcttcccgtgggg

SEQ ID NO: 63536 - DNA, 1443 bp, Oryza sativa
gttcgaagtagtggaatgattcgtctcttgatggtgtagaatgattcgaagtagtcacaaggttcggatgaacagaagacatctgagagcaaaacaacgatccccttcgcctcgatgaaatattttgccggcggcgcgccgcgcatggaaccacaagaggagctgaagaggcgtagcatatcagcgccgtgattaacgagatcagctgaagaggcggtaccagatgggctgttctgcaaaacagaagtggaggaggcgggcgtgtattcgtaaaattgccacgctaggagacttggccgtaggatgtcgatcgaacggatccggacgcacgtgtacacgagtgcagctgtactcccgtgtgcacaggatacccttcctacttataattggcttgctatttgtagagttatgcatactattgccaaatatagtcttagtcaatgaacaactaacattaacaactcctagtacctcgaggggcaagaggattggagcactgtaaaaacactaataatagtcatgggtcgtgctaatagaaattctcattttacaagaagggcaacaatcatgtttcttccgccttacacacttaattaacattggtcacacgacagcggaacagctagctcatggcattcggtccaagccaagtgcacctcatatgtacgcgtgacaaagagggtagcatatatgtctggctcaaacctcactagcaacgcccgagatacgaactcttttgcttgccctgttagaactcctattctattgcatatcaacatacttttgtttgccggttcattctatttatcctcgtcgacatcacatatttacatccttcagaaatgggttaaaggacggtgatatgaatcaatgaccaggtcgtcatagagctaggttagttggcatggagctcgagaagaacggcaggctgtttggttgatagtcgaattttaccatgtcaaatcttaggtgtagcgtaatttcttatacagtgtttgattgtgtgttacacttggagttaagtcacactttattagtatgttagctcacacattatatatactcttattttcaagacaaagtttatcacaattgtgactaaccgatagtgataaagttaacctccatccaaacagtctcagctagttaaatgaggaaatgaacatagatagatagatagatagaggatgaaggaggaggagaatagttatacacggaagtattatgaacaagataaaaattaagttttagttcctccatcccacaatggggttgatcgtttgtgctactttccagctgcaggcatctggagcaacaatagtagcaatcgaaaaattaattgtggctgcagcagctgctacggctgtgctgccacagctagcacaaacaaacaacccaaatataaataactttggatggatatgacacatactaaggctatgt

SEQ ID NO: 63537 - DNA, 762 bp, Oryza sativa
ttcctgcagcccttttttatacaatgaaagtaggattaacatgataaaaatactatatggaaccggttcattaataatttggaagctctccatctatcgctcttatttaatttgaaaaaaaatgtatatattttgtatataggtggtgaagaaaggacaattgcatttttgaagagggagggtgcggagattctggggaacctcttttgcatggtgcttctgaaaaagggatcatacaccatcacttccctgtgaattacatattgaaaccatggagaatgggtgtgaggttttaccagattatcaaatttggtatatttcaatatgtatgaccacttgtccagctagttgaaatggaatttatgattttgagagcatattggttaagtactttgtacctgtgcaggtgattataaagaccctcacagctagcctatccctgattcttcaaccttttggtgcatattgtgatggagaattcaatttgagatgcgggtaagacaattttccattttcacctcttgtgtcttgagttcagcaaagcaaaaggcattcacctttataatttgaatttcataatgcttggaaaaattttataataggaataatgcagagacagataactgcatagaagagtaatgcaatcttcttgatgactctacctgtgtcactgcataagctgttatcaccttgtctttatccccagaatatatgtgaacatctagcagtccacttcaatgaattattttatgcatgcttatc

SEQ ID NO: 63538 - DNA, 1248 bp, Oryza sativa
agctcatttctgtaaagagagttcttgggttgaattcacctacggtatatcacctgcgggcaactcctcatacatgttttcctcagagtgtatttctttttccagcgcagatgggtattgcttcagttgttcacctatatgtgttccctgcaaagccctattcgctattaggtaatcatcgttcacctgaaaacatttcagtgctaggggactatgccgccactgaccctgtggaccctgatgagataaaagatattagtcggcctaccaaattgaggcttccacagttggaaccagatgagataattgtgacaaatgttaaagagagtgttcgagactttgtaattggcagtggagaatatgtgagttcttgcaaactagtcctaccaagatttaaatctattctgttcttttatttttttacacttcataagattttcttcgtagagctcatatctactgctttcacccctccgaggtgtgggcttctcactgtgtttcaccatttcttttttatctgcttcacctagtttgcacgtgtttgccaatattcttattatgttttgtgtttttctttatctttaggtgataaaagatctcaaattcacgatgaagcaagcagtgcgaccagtcgggaagcgctttgagaaattaatgaagaagaagggcaagttcgggcaaagccgtgatgacaattgggtgagtacctccacgccacagagagcaatccatgggatcgatgatcctctcatatgcgggagctctagtgacagtgggatcggtagaggaaaacggcaccgcagggacgtaagctcagctggtgttgtggacagttgggaaggcagcgaccagacatcagatgggtatgtcatacggggacgccgctgggaaatcaagaaatcatgatattcttttgtacaggagctacggaatacaagctgggttgctgactcgctggtaaattttggtgctagcgtacagctcccgtagattgcttagctacttgtgtgattgattgtttgatactgtacaggtttctcgttttctatctataggtgcggtcagagtattgtaagtgcagaattccacaaattgtgccatgcttcaaggggccaagtgtaattgagttcctttacaaagtgcaaggtattgtaccagaacacaagtacacaactccctctgtaatttcgtgaaagtcgctgacacgaactggatgtacgccaaggtaggacacttcatgtgcactcg

SEQ ID NO: 63539 - DNA, 1362 bp, Oryza sativa
agcaagatttcagtggacaattttccttctgatttttgaattttgttagcagaatttattttgctctctggaatttttatagctcttgggaagtactccatgagaagtaaccatgaggtactccctagaatatactagggagtatatacctccctattaaaccggaaaaatactcaatactacgccacgaactgcattcaactctttccactcttgcacagttgtacattcattcaagtgcaccggaaaaatactcaatacaacgccacgaactgcattcaactctttcaactcttgcacagttgcacattcattccaagtgcactcttgctcattcattcaattgtatggaggccaagaaaaaggcaacacagaagatcagtacattgcatactagcaccgaaacgagcacttcacctatatgtacctaatgtacctgctacttcaacacaactatatctattatgatggatcaacacaggacatttgcctgaactgcatcgacaaacaacggtcagttagcaaaactccaaagtcagaacttccccacaaaaatttgatctgcaagcagcatttgcccagaacattctgcattgatctgataaattataaccacctggagaggagacccttgtattttacaagctgtgttcactgtagtgtcagatggaacctctatgccaatgcctatgaaactttggctctttctctagacaacctttcctcttcggcatgcctcagggtctcatccaaagctcgcagggaattggaagagtaactttctagggcttcaagaacacgcttcaaactaacctgcacactgtttgcctcaagaaaatggacctggtacgtttgtgctgttggaagaaggctttgccggcccggtactagagctagctttctgttgagtgtgtcggcctccttgttaatctccagggtcttcctttccaatatcttgttccatttttctctttcccggattgcaatcagctgttcagtttgctcaacattttgtttctcccataggctccgtacactagacacaagagcttgcatgctggtaatcacctccttctcagaaatccgatccatagcttgggaccagctattacagatgacaaacacaaggggtgcgcccactcttccaggagaatacggaggaactccatcagccgtctcctcctgctgatagttaagacagagtgccagccatccattcagtgccttgatgaagctcctctgctcattcacccaggaggaaaaattgacgatccatttaatcaactctagttcaagctccattgccagatctcgactggttccaccagaaattattgaatccaagtttttgggctgcaggaa

SEQ ID NO: 63540 - DNA, 768 bp, Oryza sativa
gtcaaatacacttttgccatagagtacccaaaaaaaaaagcaattctagacgtacacatgactgtttgtgatgctttaacttgattaacttaaatgtgcataaatcatttttgttatgaaaatgtgtcaatttctacagagatcaatttagtgcactggtacataattaccttcagaattaaggcagttactttctgatagacatactacacatgtggactgacattacaaaataaaaaaaataatgggtaaagacaaagctaaatcagactatttgaataaatgtcagagggaaagaatagagtgtacccttggattaaggtattaacttgtggccataactcctcgtcccttactctgtttatctttttcgacaccttagcaataactcgcacagctatccgtatttttgttgatagcttcctaaccaaattacgagttgcatcaatcttgggagcttcagcgcctttttgatccaagaatttcagcctcttagagttcttggcaagcaggagccgcattttctcttcagcctggaagaggaaaacagcaccaaaacattcaatacggaatagagactaccaagggtgagctcaagcaaacaacatgatttccccaatgtagagcagtaattcttcattgatgggttcctcataggattattagtttacacgtagggtgataatgatatgaaaacaaaatataatattgtcctgttatgctacaagggaacctaaaaaggcatggcagcaacagggctgcaggaat

SEQ ID NO: 63541 - DNA, 1195 bp, Oryza sativa
ttacatctataaatcgttcgacttttctcttagtttatttctttaagtttcatcaaatttgtagaaaaatatattaacatttttaatgtaaaataaatatatttaattttaaatttaatgaaactaatttagtgttataatgttgctaattttttttataaatttgatcaaaccaatagacttctgactatgaaaaaagtcaaacaacatattcatttgccggaatacattatgaacatgtcttcgataagaaccagtaagaactagtttggtatactccgatgcttttttgtttgtttatgtataattactcacatgggagtattactatttaaagtagaaactatgatgatgaaatctagaacacttaaaaaaataatgatgaaattcagaccacttaaaaaaatgattaactgttggtggaagaggaaaacgagagattttttatgcataacatgtgccctgatcttattcaactctaagtgtgtcagcatgaaagtgaatttggattgaaatggtgtaaccttttatcccatatttgtatttctctttagactttgagctgaatgtcagtggacctaaaaccactccggatttgtatttctctttagactttgagctgaatgttagtggacccaaaaccactccggattgagtagggggagttatttgttcggtttcaatagttgagggtgcaacatgtctggttttcgagttcgggggtataattcggtcgacctcgatagtacggtggggggtagtaattcgtactttttccttgtaaagcacacatgtaaagctggcatatctgttaaaaaagatatttggttaattcaactgacttgaaaagttattttttaacaaagaaaatttgtgctcctgcttctgatggattaattcaactgacttaaaaagttatttttaaaaaaaagaaaatgtgtgctcctgcttctgatgatattctgcaatgagtatattctcacagttgcagtatactagactaaatttatagtacctaataacgtgcgttttacgtgtactgttactatactgaaaagagtgagcctgtttgattacacaaattgatgtatacatatactcgagctaacacaatcaatcaaattgtttttttcctttactttcagtcatattttctactttaacatatacctaataactaggggctgcaggaatt

SEQ ID NO: 63542 - DNA, 1113 bp, Oryza sativa
ccactgcctaatcttcttctctagtgccgaccgaacgtcaccgctgccactttgatttgggaactttcacctcggggagttctagtccaattccttcccatgggagaatcaaaatttcccatgctcttcttctctagttgaggagatattagccactgcctaatcttcttctctagtgccgaccgaacgtcaccgctgccactttgatttgggaactttcacctcggggagttctagtccaattccttccatgggagaatcaaaatttcacatgctttggtttcaatctgcaacgtttggagttccgccatcagacaaattccacccgccgccaccttgccggtagcctcaaccagtgagctcctttttctggatgtgcttatcacttgttccagtgtggcaactagcacttcccacgtccttgccatgaccagcgatgttgtggttcgtctagccgcccaagcgctggtgtattttaagaaccgctggtgtattttactccagaataaacaaaccattccagagatttctcaactcccaaaacaattattccatgtttccataaattgcaatgcaataattacccaaaaatgaatttcttttggaacaaacgaaagagaccagaaataaatttatttcgggacagaaggggtattaattaaactgctgtagacggccggtcacactatctttatgctgagtcatgtgaacaggatgacccacagaaatcctcttgaataaagtgtttaataatttattatgtgtatgtgtatggctaggatacagccgtgcacgctgccaaagcatcacactagagttgctgctataactgattgtacctaacaaccatcagtaccaacaatagtgtcggtggcagtttcaataaaccatagagtcactgatataattatatgaacagatagtgtcggtggtggtttcaatcaacaatcgtcacctatataatctatatatccccaacgtttgcatcacaaaaacttttagagctccccaacctatcagccatggaacaagttcatgttgagaccaaagagaaagactcgaacttacttgcagctatttcatctgaaaccaaccacgatgacaatcccatat

SEQ ID NO: 63543 - DNA, 1387 bp, Oryza sativa
gggagttattttgtgatgtatgttgataacatactgatatttgggacaaaccttaaggtgataaatgaggttaaatcattcttgtctcaaaattttgatatgaaggatttgggagtagatgatgttatcttaaacattaagctaattagaggtgagaatgggattacactcttgcagtcccattatgtggagaagatcttgaatcgctttggctacattgatagtaagccttgtccaacaccttatgatcatagcttgttgcttcgcaagaacaagagaattgctaggaatcatctggaatactcccaaatcattggctcgctgatgtacctggctagtgcaaataggcttgatatctcctttgctatgagcaagttgagccgttttgcctctaatccgggagatgatcactggcgtgcgcttgagcgagtaatgcactatctgaaaggtactatggaattggggcttcactatactgggtatcctgcggtactggagggttatagtgattctaactggatctctgatgtggatgagatcaaagccactagtggatatgtcttcacactgggtggtggtcctgtttcgtggaggtcttgcaaacagaccattttgacgaggtcaactatggaatcagagctgacggcaccggatactactactgttgaggcagaatggctgcgtgatctattaatgaatctgcctattgttgaaaaaccagtgccgactatccttatgaaatgtgacaatcaaacggtaattgtcaaagtgaatagttctaaggataatatgaaatcgtctagacatgtgaaaagacgattgaagtctgtcaggaaattgagaaactccagagttataacgttggattacatccaaacagctagaaacctggcagatcccttcacgaagggactatcacgaaatgtgatagacaatgcatcgaaggagatgggtttgagacccatgtgagttatactatggtggtaacccagtctatgtgatccgagatcccgtgaattagaacctaggaagaacaaaccattagtaaactagaggagagtaccaatctataccctctctaagtgaagatgcatgtactctcgtgagcagcaaggcaggttggctatgccttaatgagttctgttggctttaattagcaaagatgctgtcttgcagagcattcttgaaagacatcacctttgtgagcttaactgttagtcacagtccgtggagattttgggtgaatattctaggaagcttagtaaagacctaggagtatgacttatacgctccacccaaggggtagtctatagacggtctagtaccagataagactcttagtaaaacttgcatgcacaagacttgcaattcaaggcgtagtccattg

SEQ ID NO: 63544 - DNA, 3223 bp, Oryza sativa
attcctgcagcccttgtgatgtatcagtttcttaattatttattcaccttttgaattatggagtataatgatttcgcaggcattaccatgtattctgcagaagacagaagctttagtgacaacatgaatcctactgtaggattcaatattagaaaggtggccaaaggtaatgtcacaataaaattgtgggaacttggaggccagccggtattcccaagcatgtgggagagagattgctgtactgtttcggcaattgagtaatttattttcctgtctaattactaatttgatgcatgtgcaacatggcactatactcagtagtagttgtcatgcactcatgcttaattggctgttggttacatacgctaaccaattgtttcgaagacattttgattaatttgacctctgctgaaattaggcaaatttccaaaagcacatttcagtaggcgagaccatatctgccctcctaattttggctgtagattcaaacagaatgctaagtggtcctttatctgcaacttgaataattatattatctttttaattaatttaaaatcatccaggattattgggacaggaacattctgatgtggaaccatttttctagaggagaaagactacactgcagaggatgtcaaatttaagaactcaactgttggaattaatggatgggccttagcccacacgaagattaattctttgtaaaatcacaaaagcccacctcatgagatggtatgcatgtggagttttgtaccaccttgcttattctaggagagggggacctccttaaaagggaggatgcccttctagccacttgaagcatgtgtggtggagagaagagggggaacacacgcgcgcgcttgctggcctggcctggcacggcaggcggcgtgcgtgcacgtcgaatgatcagcaaaattggctccttatgcttacgcagatgcagcctccttttgcagttttgttttgttgcggaaaattcggatttgttttcttttggaaacattccgaaaaatccggtgcgtgaaaacggcgtggagtccggataagtttcgcacgacttatccggttcggttacacggagtggagatcgtgcgggcgccttgatcaagcaacctatctctatataaaccgagccgccgcctacacgcaacacatacgaaatcaatttatggtttgcctcctactctgtgctgcaccgtcgctcgtagactactccatcccgctcgccggcgtgcactggcgatcaggagagcaggtctccggaacctctgccttggacgtcctgcatcgggagaaggcggcaataaggtttttgaaagcgcttcgcgggactgacgactcgccttcctcttcgctcgcgtgctgcgcgccttcgtcgacgcccgcaaccgtgagtagttcctaccgagcaaccggtctttccgccaccttggtacgtgttcgacatgttgcgcatatttgatatgttcatgttttactgcttagtttacatgtgtagatctaatgatgcgttcatgctagtttacatctgcaatgtcataatttatttatgaaataaattaaatcattatgtgcttataatttcaataactccccaggtgcttaaattttgcttgttccttttttttttttttttttatgaaacttgttcgtgttccatggagggatgcctatgcgatgagtgcaggaagctgatataccagtgtggtgcatgggtaagtgcagacaaatgcagccttagtaacaacagatatatgtgtgcctcatacaattccaggttcttgatggcaggttaaatcacttcatcatttaagagttttagcagcagttgatatcgtcgtcgatacgaggtgctttgaagcggataaatttttttatgtgaccatgacagggaagaagcagagtgatgtggagctcaatgattttcagaagtatgcctgtccatttttgcatggtgcgtgaattctgatttttattagccttcagaatttttttactcggattgttggaaatgttaaaaatctaagactgggattggtttgagatgcttgtgcacgatagggtgattgatcttgtcagctttgtagatgttgtacatttctttccagaatatgatgaaacctaaccattgttgagtgtttgtcacagactttagtctatttctgtctcttaaataagcatgttaagtatacacctgggtcctgaaaacctatttcttgccatttattttcagggaagttaactgttggaaatgatcactgttccttcataggcgtcattgtcaacataaaactgccagtggtttatgcatagataatggtaattaaggctggccgttttcaatagactgatgtaagtgtatccgttcttgcacccaatacagaaacctggaactggagtattataacgacggaaaattttggtctgtgacattcacattcctttgtagcagtttgtgtcttcctgcgaattcttgaggtgtctgtcatacacaaaagtgtctaatactcagaaattgatgttttggatctgtccaaacatgtattgccttaacaattttttggagagttcaggccatgacaggttatgtgtattgcttgtggtcttctgttcgatgaacaaactaatctctataatttgtactgattgtgatcgcagttgtgcacttttgttgtgatcatggatgttttcatgcatagagagaaggaaatatttatttatatacctacttaaaaaatagctagggagtgtttctgtcttgatctcgtttcatctgttgtctgtctcggcagcgcctgtttagtccggttggcgagtcgtgagcgattggagagcaacaaacgagagctgagtcttgacagtctaacaaaaatgagtccatgtctgctttttcttggtaacacagggacattattgctatatagaaataaaatttttggaggcaagtttaggaaatcaaggtcccacatctcgttcgcatgcaattttcctgtcatctctctggttactgcacggacacagcccagctcttttttttttcagaagaagaaccaaccactataatatatcctgtagttctcttttatggtgaatcttaaaatctttgttctatacttcgttaccaaaacttatattgtattaacataaattgtattaacttatattgtattttttattaaatattaccgtatcgttagcacgggcaaattactagttatgt

SEQ ID NO: 63545 - DNA, 1549 bp, Oryza sativa
gtttttgagtctaataaagtagtcgtgtctaaacatagatattttattggtaaaggttatgagtgcggaggcctgttccgcttttccctttctgatttctgcaataagtctgtaaaccatatttgtggcagtgtggatgatgaggctaatgtttggcactcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccagtagaactcctacattcagatctttgtgaaataaatggggttttgacgaagggtggaaaacgatatttcatgacgttgattgatgatgctactagattttgctatgtgtacttgttgaaaacgaaagacgaggctctagaatattttaaaatttataaggcagaagttgaaaatcaactctagactattttaaaatttataaggcagaagttgaaaatcaacttaacagaaagataaaaaggcttaggactgatcgtggtagagagtttttctcaaatgagtttgacttattccgtgaggaacatggcatcatacataagaggacacctccctattctcacgagtctaatgggattgccgaaaggaagaaccgcacactgactgacttggtgagtgggactgtaacaccctgcctccaaaatccgcattagtccgctctacacgttgagcagacccacgttcgcatggtatcccgattacgctttcgtcctcgcttcatgtaaaagggttaacccggggataccatggttggagcaccaaggcttataagcaggccctcacccacctaaacttccaaggtggtactaaaccaccactacacatccacttctgggccacatgggccaaactcacactactgacaggcttcaaacaggctggggtgttacagggactacctaaggcatggtggggggaggcattgttgacctcgaatcatgtgctaaacagagttcctaacagaaataaggacaaaacaccatatgagatatctattgggagaaaaccatcactttcttatttgcgcacatgggggtgcttggcgaaagtcaatgtaccaataacgaagaagcgcaaacttggacctaagactgtagaccgtgtctttctgggatatgctcatcacaacattgcctatagatttttaatagttaaatctgaggtacctgacatgcatgttggtacaattatggagtctcgtgatgctaccttttttgagagcttcttcccaatgaaggatacacatagtagttctagccgaccttctaaaataatttatagttcaatctcaccaccagaacaaactgaacatacacatgaacatgtcactgaggaggatgacagtgaagctcctcgaaggagtaagagacaaaggacggctaagtcttttggtgatgatttcactgtgtacctcgtggactgacactcctatgtcaattttagaagcata

SEQ ID NO: 63546 - DNA, 1277 bp, Oryza sativa
attcctgcagcccttcaaaagattaaaaattatctactccctccgtcgggagtcctaaaaataatacaattatagcattaaaaagacaaattcgaagagaaagaaaatgatcttagatatggatagaaattctaaggatgggtggctggataggaaagtactactctagaactgcattctttttaacaaattcagtgctatagttgcttttttttcgacaaaggaagtagtttaaaataactagcattgaccttcttgttgtctcaagagtatggatagtacctactatatatatacagaccttattgttgggagtccacttccacattgctaagcaacacccaatacgttaagttgttaagctactcccttcgttccatactactccccctgtttcataagtcgtttggcttttcttcttagtaaaaattctttaggtttaatcaaatttatagaaaaactttctaacatctacacctccaaattagttttaataaatttagcgttgaatatatttttgataatatagttgctttgtattaaaaatattagcataattttctataaacttagtcaaacttagaaaagtttaactatgaaaaaagtcaaacaacatacaatatgacatgggggagtataaaataagttaatttggtcctaattcaaatttctctaacattaacggaatttatgtgggtgaagcacactcatgcaccaagctatttgtgaaaagcaacgggatttcgcacgcagttacctatgccaaccgcatgcgaaaataatttcgatgaaaaaaaaattcctaaaaaaatttcatcgaaaccctagatccccaattccctgaaaccctagctcccaaagccactaccatcgtcgcagttccaactactgtcgctgcagctgaagccactaccaccgtcgctacagtcgaagctaccatcgtcatcaccgctcccaaagccattgtcgtcgtcgcggccgcagctgccgtcgccactccaattgccatgccgtggggaagaactgcccgccacggggccggtggtggcagatccgcccgccacggggacagtggtgtggcttgctccctccccaccacttcgcgggagcgccacaatagatccacccgccaaggggccggcgcatcgtctgctccctccccaccacttcgtgagggaggtggagaggccgcctttgatccattacctttgtgctcggccgttgtcggatggaaggggggaggcgataggtaagtgggagaaggatggccaacctcc

SEQ ID NO: 63547 - DNA, 1412 bp, Oryza sativa
atctttttttttccatgcgtacatcatattttaagatgatttttcgtgtgatgatacatgtcatagtgctgcagatctctgattttttttcacatttttttgactttttggatgcatttgtgatgatatatgtcttagagctacacatctctgaatcgtctttcaacttttttttgactttttaggtgtattttttagctcagcagtacgggagcacggaactgttccatagcacctgatacttcctcgggtggtctgacatgtataacaacaaccttgacatgtaagccccaatattttctgtttgtttactacacgtggcatccccgtagcgtactactgtaataaaatcatggtataaacagacctaggtataaattgcacggtattaataaaaaacaaatcgaaatacgatgatagggagaaaataaaaacaaatcttcggtgaatagtaaagtgacatgtttgaacattgttgaaggacgaatttattgtttttttctccctgcgtacatcatatttttaagctgattttttgtgtgatgatacatgtcttaaagctacacatctctaaattttttttgaactttttttttgacttttttggtgcatttttaaagtttggtagtatagaaacatgaaactgttacgtagcacctgtacttcgtcgggtgatcatcacagcaccctttccatcgaagtcgttggcttctcagccctgggtggtagtttcatggccacagtcaccgcagatatcgctggcatgtcgactttcctcttgagcgtctttctgaatacggcggcctcctcgtgcaagataatggcgaaggggacaaggtaagccacgaacatgacggcagctctgacatgtatgacagaaaccctaacatgtactccctccgtcccaaaaaaaaaaaagacaaaccctggtttccgtgcccaacgtttgaccgtctgtcttatttgaaaaagttatgaaaaaattaaaaagacaagtcacccataaaatattaatcatgttttatcatctaacaacaatgaaaatacgaattataaaaaaatttcatataagacggacagttaaagttggacacggaaacccagggtttgcctttttttaggacgaagggagtaggctccaatattttctgtttctttacaagtggcatcctcagtagcatactatctatctatctattatattattaaaacagctttgaaaggagacaccacgttcactgtggggactaaaaattcccacattaatcggagaaaaggaaaaaagagtccaagtagaaatacaatctaaaaatagctgaaattcggaattaaaagtaagcaatattgaaagaaaagtccatatagcaacctaatacgaaattaatcaaaattcagaataaaaataaaataaa

SEQ ID NO: 63548 - DNA, 1898 bp, Oryza sativa
cagtctgggccaagtgtgcttctcctttcttcttctttgggtgcggacactggttggaatagtgaccatactcctcgcagttgaagcatttgatgtggctcttgtcacggccaccgccgcctgagccacttgcagagttgccgcgagcggcgccaccgcgcccacctgcgccacggcctcgcccgcgtccgcgaccgctttggccgcctttagctccctctccggaagctttccctttctggggcgacgatgactccccgccatccttcttgaaccgcgcctcccactcagcctgagtgagaagaacctgcccgtcggtggtgactccgccggccgctgccttcttcttacgcacccgttcctcgtaagccttaagccggcccacagcttcttcgaatggcatgtcatcaacattataaaactgctcaatacctgtgacaaggttgacgaatttctccggcaccgtgtcgaacaacttcttcaccatcgcggcatcactcaacgtcgagcccaacgccgagtggcgcacgctcatcgtggtgatgcggcctgcgtactgatccagggtttcccccggctccatcaccatggcgccgaattcgcccttcagcgtctacagccgcgcgtcacgcagtcgatcagcacccacgaatcttgtcttgagacaatcccatacttccttcgccaatcgtttctttgccacctgcatgaggagatcctctggcagcgactgcagcaggtgcgacttcgctttcttgtccttctgagggtcgacggccgccccggccgccggttcaatcacctcccacacaccctggtcctccatcatcgcctggacacggatcacccaactagtgtagttggtggccgtgagttgtggatacaagaaagcgctccccgagctccccctcgccggatccgacgttgccggaaccaacgccatggtgtcagaccagccctcaaacctgggtgctctgataccacttgttagcgctagaccctcgatcgaacaccttgcatgcgtactgcagcaatccggcacggcaacgaacgagattcagaggaatacagagcagaacaagaacacaggaaattgagaagtttcagagaacaatagcagataggaaatttgtggggctaaatttctgtggttttcattcactgaacagagtaacatgcaactcgaataacagtacaaaaactcctacttatactgcacacaaaagaaagaatccgaggctcaaatcgtgccatcccacgatccgcttttctctgaattcgacgactcacgcacccacgctaaactcacgcacacgaatgctaccgacgcggtcttcttctgactcgatcaccgcatcattcgcatctgctaacaaacacagatttattccttcaaccgttgcaactgcaatcaccaggaacacgttggggccacagctgtaataacaaactcaacagtcgcctctgatttttggcagctacctatgcaccatgtgcttcagctgacgctggtctgccgtcgtccgtcagtcaccatgcatgcgtcctggcatcgcatctgcatgcacaaagaaattgatgtagaattgatcatcatcggtaagcaatagaaactgatctaacaagaggaagatctgtgagagatgcgcaaagaaaatggaaagagatcaaacgtcaggcttggtggtggtgcatctgcacacaggcttgccgacgggatctatcgcagtacccacgtctgcgaaggatcaccgctgccggttcctagaaaacactatgcccatggatcgcggcgtcgccttcgacttgccgtagatcctgtgtcatcactgccgtttttggcttcacttgacaaaatctgaaatcaaatcacaacttgttggtaaaataaaataaca

SEQ ID NO: 63549 - DNA, 2043 bp, Oryza sativa
tgcaaaatgatatatcacttggcatttattataaactttaaaaagtacatgactggtgttcctacgaatatatgccattgcatcataaaatctatttttttccaattgtaattaacatagtaatgtaatataagccaatacatcataatatctaagtttatgagtatatatactttttccaattgtaattaacatggtaatgtaatctgaccaagttgaccacggtaaaaagctaattttgagatttgataatagcacttgacatatgaaatcgaatagatctattgcaaatttgataatagctctagagcaactaactagcaatatttgctcacttaaatatacaaataaatttgtaaaattaattttccagagtgaatatgtcagatcctttgtccgagctatcttccgaaaggctttcaaaattatgaacgcaattttgtgcagcagaggtgagtagtattgatatgtttctcatcatgctttatttatattattttcttttggatcgctacggacatgtatattaaaaactttactcacaaattaaattatttttttagttattgttaataagctacgaaacataaagaaactgatataagtaaaacaatgaagtcactcatgcatgaagaggcaaaactcccgggcacggtctgtccataaaaaaaaagttgtgtccatgtgacatgacaagtcacagccaacttctaaagagtgttaattaatacggcagaaattgaagcgtcaaaaggagcccacgcgtcccgtcagccatactagactacaggctgctacagcaatcaacaaaactagtactactcaatcgtgctataagcatatgcacttggcacgcatcttggaaccaacgagcagctgagatttatggtgcatatgaacttcggttcacatctgagtttccatatatatatatatatatatatatatatatgtatatatatgtatatgtatatatgtatatgtatatatatgtatatgtatatatgtatatgtatatatatgtatatgtatatatatatgtatatatacatatgtatatatacatatacatatatacatatgtatatatgtagagatacatgtacatatatgtatatatatacatatacatatacatatatacatatacatatatacatatatacacatatatatatatcgggtataattgatggatatatgttatacaccccactaatgttattgtaagtgcatttcaacgaattagttactgcaaataagttgatattgaaaacaaacgaggcgttaaacaaagtttttgtcaaaatttaaacaatgatatggtgctatgaagatttccagggtggtatggtacatttgtttcgctatagtttctttaggtagtgtcgaataatcgacctagctcattttcaatttcaaaagagaatgccatatcaatacaatgagaatttgagtactattgattaactccaaatgatgtctactctatacgataaattgacaaaaaaaactatttttcatcaccttcattttctctgtccttccctggaggatgcaagtatatataacagagcttgctacactgctctaagtatggtaagaccatacataatagtaaacaagaaattaaaattgtgatctgcacggatctttaggggcatgaccatgtctatgtggccaccttgtttaaaggttactgagaagaaagtcttggtagctatggtcggctactcagtttcatccattagataggtattcgtgtttaattttaacggtattgtcctatcaatgggcagaatcagtatatttaaaatatttatatatagtgttggaaataagtagacatgatcacttaggtaagtagtgggataaattttttagtgtattaatgatgtattgagcttatttttgtggtacagatataatttcatctattaaatagggagcttttaaaacaatgataatgagtagtggtgatgatatgcgaatttacatataaatggtacaaagtgatttttttttaatgggctgcaggaattc

SEQ ID NO: 63550 - DNA, 1725 bp, Oryza sativa
tacgatgatataagacttattttagtattctttttctgaataataaataagatgcccacgtatctgcacgggttttcttcctacttaggttaataatgaacggtgtttccaaaaatgaaataaagagacgtactagcgtggaactaatataaaattttttgacaaattgacctttgtacaaaacttattttaagattagactgtgctaaaacttatattctataaatgaaccgtcggctcagcgccatcaagattggcgttggggtatcacatctcagctccaacggctttggcattaagatcctagttgagggtggggagttccatagtgataattaaggtggtgccttgtttctagccggaagtgagctagtggtgcaatggtttggtagcttacttggtttatgtaatgttgtactatactttctctgccccataaaaaataaatctagtatgagatgtgacacatcctagtaacatgactgttactatggtgtgttacatcatgtgcttgcccctgtccagatttatagtattatgatgtgtcacatactggaatcggtttgttttttatgagacggatggagtaggttcaaatccctttggccgccaggtaagtcattttcattttttctctctttaaatctcaatgctacacatatatacactgctaagaaaaatctttttctcaggtagccaaaaatagtttttcaggcggggaaaggaccgcttttccccaaaggcctgtgaaaatagatattttcgcatgcgacatctctatcaatattttcagcgaacaaagaaaaaaatcgctgccaccaccgttcttgtcgccgccgttggcggcctccccctccgactgacgtctctcctccgtccgccgcccttatgtgtcttaccggccagcacgatgcgccttgagtaaagcaacgacctcatcatgtgtatcctgatcccaccggtgggcacgtaggcaacgaggaaccccgttaccaccaacggccccatcatcttcgcctgcgccgccgcttccacctgcagcgcgtcgggctcgtacttgggcagctcctcctcctcggcgtggtgcatcacctagcgcggtagcgcgcgacatctcgatgagacccgggtcgagccacactcgcccggcctcacagattgaactgcgcagcgtctcgctgtggtggtaccggaactgggagatctaggaagggaggggtcgacgctgcctgcggtgccggctccgttggctcctcctccgccaccgcttcctcctcagccgatggacaaatctgggagggagggaggattggagcgccgccgccgcttcccaacctcgtcgccaagccacttatggatagatgggccaaaaactcagaaatgacatgaccaactgggccaaaatttaaaagtctgaagtgagcaacagaagaggaggctgccgaccaaattgtgggccggttgagccagcctagggttcggctgaaccctgggttcggccgaaccaaccgtggcgcagtttgacccaggttttggctagatggctcagatagactccctatgatggttggagggtattaccgacctttccaaccgtcatacttaagctataaaaggccctcgctctctccatttcaagatacgcctcaagcaagaagcttcagtggaatagaaatagaatagaaatagaatagaatcttcagtcctcggagtcttcggaagagt

SEQ ID NO: 63551 - DNA, 1149 bp, Oryza sativa
ttcctgcagccccattggtgtgggtataatgttcatttatatgattactctaagtcacgacggtgattgtagagtagtatttggtagcataagagaggtgcttaggctactgaatatcattatttggggttatatggtgtggatatgtcgaggtgggccgcttatggtgacagctcagtacgggtattccttcgcgcgtgtatataatcctaagttactttcctgggcagggtactcctccgtatttagccccgattggatggccatgacgggttgtcgtaaggaactcgacaactaggggcggtctctcgaaacaccaagagggcattgtaagaggggtcttggctatataattatatagtagataatattgactaaagtgtatgtatgtatattagaagtataggaaatgattcttttttaattctttccacttaacctagaattagtatgtacgagaatagtgaatgcttcagctttgtgtcatttgaattgaactaacccctgcttagactttgattattacaagtaagatacaaatattagcttggttctctctattataatcttcccacgggattaaaaaaatacaatattgttggaatactcccaggtgaaatgctacaatggtatatctgtgcgcttgcggatgaaatctgtagccataatataccacgagtgtttctgtgccattgctgggaattacatttctagtaatatcgttaagaaataccaacagccgggacgggagagggaggagccgagccaccgcctcacctcctcgtcgctgagccgccgccgttgccgggagagggaggagccgagccgctgtctcccctcccctccccgagaccggctggcggtggatctgcgcacctgggcctagccggcggtggatctaggcggcgtcgtcgttgcagcaggcggcgggacccaggtgtcggcgccgttgtcatcgcggcagtcgttgtcgtcgtcggcatcggctagatgagagagagagaggagagggagggaaatgagtggtggcgatggtggaggaatttttgcaggcaaaccacgtaaagttcggtttgcgaacatcatatttttctaggcggatcccttaagaggtctgcttgttaaaataaaggggttccgcctagaaaa

SEQ ID NO: 63552 - DNA, 2299 bp, Oryza sativa
tacacgttcaagccattttataaaatttgtggatcaaattgccatttttcatccttcattcccacacgtctctctctcatctcttccatccacagctggcctcaaatccatgcgcctcctcgcggcagcggggatagcttgggcaccagcagggagagcggacatacagcaaaaatgcgaaaatgattgaaacaatggacaccaaatcggccaaaaaagtgaaacctagagaaactgatggggaaagaatatttccgctttgtaatttggatggatgcagaaggaaatatccaatcgtgttagcttgctcatgaacagatcagcagagcgcccgttcgtctgagagccatcgatccaaacatacaaagcacccgatacttgatacttctcactgaatcaaactagaaaataaaacagaacaaaagaacaacaatccaggaaaaaaagtgatatttttagggagatatgctgccacattgggttgacactcaaatttagcatttgtttggatttatagcaaattctcattagatttggaaactaccgagtctttcccgtgaaagcggtcggtccgccattgtgtggccagttagacctcatgtgtccaggcggtcagaccttcagcacaaagttcaaatccaatctagatatttcttgtattttcttgtttgatacaggatttctttaagttctaggtgatttctaagcttaattgtacttggaaacaaccctatgctaagggccgaccattttgcattaacactgctgcaattacaaatccactagcatcagcctccaatacaaaaggttgtgagaaatcagacatggccaagactggggattgggccaattgaagtttgatttgctcaaaggcagcctgctgttatgaaccccaattaaattgttcttcttaagagcatcaaagagtgggcggcaaataactccaaaattcttaataaatctgatcctgtagtagtccgcaagacctaaaaatcctttgagcagtgtgacattagcaggaactggctgtcatgacccaaaaaattgtattttttttacagtctgccgtatccttatatagcatatatactaaatacttatatatatgtccataaggatacaaggcaagatgtaatgtctaactatcacaactgaagcttggacacctacagtaatggttccatttatttttcaccagctacatttcttaatacatcggttggtttactgaccaacttattatcaccaggacgattccctgtacctagcatgcaggtatatgtcctcttgtatgactctaaagactaagtagaccacactccccactaggtctgcatgtcaccatttccctctgacatctcatcttgactagtttctgcgcacatcaaatagtaagaatatatgagtatgttgtacatactcagcaagattagtacatatatctacatatatatttttaaagaaaaatactactacccatagatattaacagccgataaatagtaaaagacactaaacatagtgagttaaatacattctgcagaggtattaaaataaccgtcacaatctcgttccttcaatccattttttccgcaagtagtgataccctcgtctgagatcacgccgccaaattccctacttgtgtgaggcatttctcatctcacactgatatcagccgacccgatatcgttgtttcaggtatcgactgtctcaggctaagtatcagtgtgtcacaatcacgttattattctcactgataaaatcatcaatccattattcgggtgaataatatttactgttagattgttagcatcaccatctcaatataatacaggtaagcaaatttagttagagatgattaagtaaaatagttgatgggcgcagtcttgcctagtttctgccgttctaccagcgcgtcccacctagtcaaatatgcaaatctttgatattaattaatatctagattttcatgcatgataactactaacatactactaggtagctagttgatgtgactatactaaagaaagagaacctaacatgtagtagcaggtgcttgcatgttagtcgagcatgcatgtaactgctgctagccattaaaagtactagtcttttcactaatatatatattttcttctagtgcatttactagacactgatccacctattctatggctagacatcatgtgtttatactacctatagaactagccatatactcgtaaaaaaccaaagcacaggttccaggcattacctagaaggcttctactagctctaatctcccatggccctcgccaca

SEQ ID NO: 63553 - DNA, 1139 bp, Oryza sativa
tgatcagtaatttcaattgtggacttggccccaaacctctggcacatcttacaaaactccggccaggataaatgttctgttgggatatcgtaactagatatccattggtcagcttagcctgtaatgtaggcctctgccattaagaccttctcatcttcaagagtttgtgtgagaaagaagtatttttctactttgcgaatcgaagccttaggataatcaccatcgaaaataggaaaatcgacatgtttcctattggaggtggagtgtgtgttcacaatgacaatatggttcaccaaatgctttgccttgaaaaggtcctctgtcaagtagaatagatggatcacaaagaggccaaggtggttgatgttgtttaggagctggaagccaattgggattgtagggtgggtaatagtattgtgggtaaggtgggtaaggggaagtgtcagggttacgaataaggcatactctctatcctacgacttatgagatatactgataatgtataccctcacgtataaggttggttcccacatacgccgttagaaatttgcctcagattatggaaaatatttctatgagttaaggaattgccgaagtcctactcatcgcgtcggtttacataactccaagtcttacttgggggtcaaggtattccacagtataaaagggacccctagggggaggcaaagggcatcgcatctcatcgccaacacacccaccaaagtttacgaagccagagtccacggagccaactcgccgggagatcttgtcgaatcccttgactacgatctcgtcggtatcgcctgtttcgattactctctttgtaatctgttctcatcatcatcaatcccatataaactggactagggctattacctgttaaggggcctgaaccagtataattcttgtcttttgtctattttgatgtcgtactatgtagacccctgtttcaacgtaccccaatactctattcattcggtccgcgagtatcactcgtcgacaggaagcatatgcattaggtggaggtcctccttgagtatagttccatgggccaggggagccaaattgcatatgtagctgccgccctgttggtgttggtggaataggcgggaatattggtggtggtggtggtatggttg

SEQ ID NO: 63554 - DNA, 1510 bp, Oryza sativa
taatatatttgcctacctatttatcatatgtctctgttaatctagtcttagcatatcaatttagctctatcggctgcttctcgttttagggcttctgccggtatcggctaaatcgatttgctagattatattagcttagacatctaccaccctgaaaactcagtcaatagcttgattgtctattgtctagatattatgtttctcttcatacttagtgctgcatcagttaagtttgatctactaagtggtgcttagaaccataatctctagctgcgtttgactgccaataagggtttcatcggggttttagccgatgaggtatctagacattgcatcggcttataaggattgcatatatatatatatatataagttggatttagctgatgacaacaaatgtttcactgttttatctaatcatttggattttatggcatcggacctccagccgatgtgtgctttaaccttcggataagtgtttattctatcatattattgttagtcgattggtttctactggattatattgctatattatattatcatcagccgattgccttcatatcattatctacattggacatatagccgatttcttacaccctatcgctatcggctggtatcggcatcggctattatcggctatcggctggaactactccatcggcttgttagccgatcggctgttttgatctactatttgcatatcttgtcagttgcaggatcaaactgactggtacgctcgcatctcatcaatctttggacctgcactggagctaagcagatctcccaggccggtgtgttcgattttttcgtcaacacttacgtatgtgcacaatctttaaaattatatttttaaataaaatatattactctacaaagtataaataaactaggtctataataaaaaaataaaatatcaaatcaacatactttaaatgtcactcttttaaattatatattcaatttatgatttggttgtatttgttaaattaaattgtagtgctaaatacatcacgagtcatgataccgacatataataattaatgtcataataattttttaaataatttcacatcatattttatggtgtcaaatattactcgacaaacacagaactctaatttaaatctatgtatgtaaaatgaaaaacataatttagttgtgtttttcagttagatctgattttattttatttttgtgtaaggttaatattctcaaagtttttaatttgtgttatttggtatttgataggtgaggagaatttccatagatgtgaaacattatcaaaaaaaatttccaaccagttatctttctataatacaaccccttaatccatcacgagaattatggtcatacatataggattttttttctttaccaaatattgttttggcaacagatgaacaatctaataagatgcgcattaaagtactattatatgtgtatatatacatatatatatatatatatatatatatatatatatatatatatatgggctgcagga

SEQ ID NO: 63555 - DNA, 1026 bp, Oryza sativa
cataatgatttgaccattattggacaccacactaaatgttccacccaatgctaagtttatctagagactttggaaaggtacagagaggtacaaagctaatcttgtacctttcagtacctccaaagaacagaaacaacactcttaaaatctatgctcttccaacatcttcaaacttgatgctcctcctagaggcctagaagctaagatctaggtccatggtggatgactgacccaaggtgaggcggaccatgtcctcgtgctcaggcatcacgtactcacagagaacaccagaagcagatgagctagatatggcaggaggcagtgaaagctgatctatgaggatatcccgcattggcatcatgttcagcgttgatggtacggcagtgctagtgatacattccggagaagcagatgagtttaacatggttggatgtagcatgtgctgctccatgtggatagccggcatctgcatgaggttcaccattgatgtggtggcactagtgataccggtcagagacggcaccgttccaacatgctggccacctgcagctgacggaatgtggatgcttggtatctcggatgaccaaatgagatcagccatttcctgcttgggcatatattgcatggtgacagcaaaatgatgtgggtctgagcacaccgctgctatccgagaagcatctcttgctggtggaaacaatgacagtaatggtggtggtcccatgggttctgggtagctaaatccaggaggagggaggaaccccgggatttccgatgacctgagggcaaacaccagcccacaatagatgcatgaaaggggattcccgttaccatggaccgccacaggtgaaacaacgccgtggagcctctggatatctggagtttccctcatgaaatgcatgatatcatggttgatgatcctgtggttggtaaccggttccacggtagctggcatagtgttctccatggcgagcatctgggtggtcggcggtgccggcgccggtgccggtgctatcgtagggattacaa

SEQ ID NO: 63556 - DNA, 1955 bp, Oryza sativa
agaaacaacccaatagcacggacctggtttagcggcaacgatgccacagacatagttgtgctgccatcagcacgccaccgtcgtgcctgtggggccatcggcaagatacgacgctggccgcttgatggttgtggcaaccgctctggcgatgccactctaagcccctggataatctgcaaagatgacagtgccctcagcgcttgttgcgtcggcagtagcggcggtccaggcatcggcgacaccaaatccctaacaaatctggagtcgccgttctccatggacatctctcgctacctacctacctacctacctacctagctatagtgaccaagggcgagatgccaagatctttgttgtagcttgatttgctttgtgggggtgattcaaccctgctatgtgaaggtggtatatatatttgaaaaccagcgaggtgtaacgcacagtttgactactttccatccacaagagacaaaagggagaagctgtagtgatatcacctacttaatatttgccagcaacatattggcatgcatatctagcaaattgaacatttattgctgccaagtatagcactaggggaggttatatgtggtatgcatgcacaactcgtttgacaactacatatgaattcctggtgtttggagcaaagcatctgccaagaagaagccaacacaactgtcatcaatatttattaagctgcaaatgaatggacgcccatatgccacgctgcgtgtcccctcacacatgctcagataaaaatcggacgtcctagacctctagcgcctgctgcatgtggtcccacttaatgtgcttcagttgttgcttgcaatacattttcaatgcactatgttttttttccttcttgagcttcttcccatttaatctagctagaccaaaatttcttgagcttcttcctttcaatctagccagaccaaatgtcacgaccggaaataacccaatagacattccatacgtgagtgtattaatccttgtcccaggaggcaaggtacaccaaagttcaaatcagagttttaacaagcggaagtgtaaatagtacttatattacaagagcgaccaaaggcccaacactcagagataaatgaacaaaagcggaagactagggcaaataccacaggcgcttgacagcaggcatgagctagacaccaaaaccttcatcctccaggaactccttttctggtttggggaaaaatagagcaagattgagtgcaaccacagtactcaacaagtcacaccgataaatgcacaataaatgccaagtgagtacaaaggagtaatcatatgggttatgttttgcagaaaacaatatttaaaacacttagttgcccaaagttattttggtaaacacgatcctagaactacacaatattattaatgaaggccgtgaacccacatgaacctaccttaacccaaggactataacgagttagaccgaactagcaacctaaaccggtcccagctcgtcccaagccaacccaagccaaccattccacattttagttgttaagcaagttttaggaattaaaccactaactttggtacattgctaggcttgctcataactgagggcgcggctattcgaatagattatactctgattaaaggtgcacatctttacccacaagacacaccttcctcatgtgttaccacgtgccacatcaaatactaacaattatttatggcatctttgctgaggaatggatgttgtatcatgttcgaacctgattcgtcctcgtatcttttcttttctcttgttcctttgtcttcttaccaacaatggagcacctttctattcaaaatctttatgctccaagggctgagttctgtgaggcaccattttctacaaaacttatccgttcatctggctatgaactccatcctaacattatagccatagttcgggaacaacccttctcggggcgcgaaagagaaaactc

SEQ ID NO: 63557 - DNA, 3913 bp, Oryza sativa
attcctgcagccctgaatcccctgaatccctcctccacgatgatgccaatgcattcgtcaatgaagaggatgatcctggataggtgatcgagttacccaaaactgatccaccttcacaaccactagttgagctcaaatctcttccttcaggtattcactatgctttcttgcatggtgatatggagttgccagtcatcataagagagaagctttttgatgatgagacctccaaactcacagctgtgttaaaaaaccttcgctctatgctaggttactcacttcaaggcctcaaaggcattagtcctaccctttgtactcatcgcactcctttagacccttcttgtgtgccttctcgagagccacaatgaagactaaataatgcatgttgacgaccgttaagtaccaatctcgaccaacaactagcatatgaataaagggaaaattagcatttcttacacatataccaataataaataatgtagttgtattaggatttgagaattagcttggaagtaggaattatacaccaaagtgaaggagaaatgaaaccaacatgcaatgaaacacactatagattgagaggctcacaagtcagctcaaacggacttaaagtggggccaaccacccgggaatcgaccaagggcccacctggcagccacttaccaaaggtggtggagagagccgttgccgagggttcggccaaaacctgtcatagcagtgccacatctccatcgtccacgtgttgactcctcattggctcccaatggtgtttgtgggtgtttagcagccatataaccgtcactagtagcctatttaaggagttcactctcttcacttagaacacacaccacaaggagcaaatttcctcttccactttgtattctctatagttttagtaggaataaaggttaggagcttcagtcaaatagtcttctcggagttttgggtatgtctttagcactttactattcttgtaagaccatagttgaataaacataattatcttcttaatttatttatgctcatggtttatatatttctttattaaatatatgttctatgagcattatatactttgtatatctacatcatcctggctagtcgatccatgctacggtaacggtccaatgacctttatagctaggttgctctagcttcaagctgttcatcagtaggatgagagtcctgggagagttagtgatattatttactagcataagcatgatgcttaggttagataaatatcgttggatgcgggtgtgccccacggaaagtgaggtgggcagtaggtgggtatgatgtaagagtgtgtaaatgtcataactatgctagcagaccaatagggcggtagtacctgggtgcctggaactaagtcctatgttgtaagcatgtgtatgttaagtgtataatagacatgattagtatagaagtacatgtgtattgtagtttcctaaagctaatttccttctggatattcatatagaggtgaatctcctgtgtgttcactacctatcaattattatcctaacccctatttttcctatggtaaataaattatagattgattatagagatataaaccatatctttgtgccaccgctttccctgcagaaatataaatacgatgcccttggaaatacacatgggtgaaatgctacagcagtatccgtgcgcttgcgaatttatctacgaacataaaaaataccaacaagcatttctcacgttgttgccagggaagacactggttttaagatatagtttatatgtctataatcattttatgattaatgaaaccctagtccaaacatgtttacctcgatgtattttctcttttatgtgaaaataggtaatgcatcactagttttaacctgccgacagacttcgttgataatccagagaagcttacgagaagaatccgacctcgtgtcgttccttcgcaaattaggctcttggcacctgaaccagttttctttgcaccagatcactcgtagctgatggcgcagaagaccattcgtgagtagtcggctccctcttcttccaatgtgcacgttgggccaaccatccatacttgggatgcaaactttgagatcaagactggtctgatcactatggtgcaggccatcctgttctacgggaaggccaatgaggatacgaacgtacaactctagcaattccttgagctatatgaaactattgccatcaggctctgtctgtttctgttccatctactcgggagtgcaaaacaatggttctactccaagagaggtgccatagacacttgggtgaggtgctcaattgctttcctagctaacttctttctgatgggcaaaaccaacaccctttgttggagaatttcatgtttccagcaagccaacaatgagccgatgccagaggcatgggagaggctccaagattacaccatgacttgtccttaccatgggatggacaattggcttatcatctagaacttctaaacggattgatgcagtcagcccgtgaccatattgtcgctgctactgaaggagccttcttctcacttactatcgctcgtgcattagaactaattgagaagatggtctccaatcaaggatggagtgaaggtcgactccaatcttgtcaacggggcatgcacaccgttaaggagacaaacatgctcgcttcttagatggacctccccctaaagcgcttggatgaacgcgctcgacacaagtcgaaaatgtacggtatagtccaggtcttggacgtctgtatgacgtgtgagacctaccacaatactggacagtcgaggaatgattgccccaagacctgtgaagatgtcttcttcataaacaacaacaacgggtaccgttcacaaggagtctaggggtggaatcaaccatgctcatactatcaaggaggcaacaatgataacttcaatcccaattaaccctccttgaaagatcatgtctattgccaaaccaagataaatgagatgatgttaaagagactgtcatccagtggcaaaacattggagagaattcatgtcttaacagtgaaatttggcaagttagactcggatttggagttggatatcgaagcggatttcaaggagattggatcttaccaaaatagattacgcatcggctgacaactgttaacgactaaatttggtaagccatgaactaggttcaacagagtcagggtttgagtgagacaatatggaaagcagccgatacaacttgaggctcggtttggtcctcaattaagataaccatcattgacatacagagatagagctcatttaaggcaattgtatgtattaattaggattttaatgtcagtttgaattagagatatggtaagagtctgccattttgtttttatctttaggaaagttttagtcgtgtccacaatggacgaattttgtactctgggtataaatataaaccccagttcactgttataagggacgacaatccaaccaatacaactttcggtacatcgcgacccttttcttttactttttcgatgagttcttgctttaagtcgaagcatcggctacaatctcttgacaagaggtaacttgtctcgatggcttgcactatctgggcttttatatctttttaaatgtattagactattagtatttttgttgtggtcatcatttatcatatatcttagttaatctagcttagtatctcaacttagtcatatcggctgattcttgctttagggtttacaccggtatcagctaagtcgttttactagattagattagctaagatatttaccatcctgaaaagtgattaattacttgattgtttacactttaggtttctctatatactttgagttgcatcaaccctagtcttgtctagaatccaaaaaactaagctggaaataatcataattaaggataatatcggagtttcag

SEQ ID NO: 63558 - DNA, 3481 bp, Oryza sativa
agcacgcatctcgacaacttcatcgacggtgcgcagtgcgggtggacatactactagatgttagaatccatcctccctgtccatactatgatttggcttaccaaccctagatctttgtcatgtgtattaccttgttgacggctttctgatggggtgggaaatattttatctacctggagagaggctgcagtcaacaaaacagatagggagagcacgggtagaaaagtaaatggttcgcaaagtttatgttgaaaaataaatggtttctcgaggggtgtttagatttagaggtgtaaagtttctgcgtgtcacgtcggatattatatagggtgttgcatggggtgtttggacactaataagaaaactaattacagaatccgtcagtaaaccgcgagacgaatttattaagcccaattaatctatcattagcaaatgtttattataacaccacattgtcaaacatggagcaattaggcttaaaaaattcgtctcacaaattagtcgcaatctgtgtaattagttattttagtctatatttaatactttatgcagatatttaaatattcgatgtgataggttgaaaaattttaaggtgggatctaaatagcgtcctagtttagagataaaattggacttttcacaatgttgaggaagcgtgggagaccgaagctgatgaggacgggcatgggatgggagatatgcaatggctggcaactacgatggacggtttgactactcgtcttattaaaataatatatgcaaatataaaaaacaaaaaaattgtgcttcaagtactaaatcataaataaaataaataataattcaaaatttttttaataagacgaatggtcaaacaatacaataaattatcaaaattctttatattaggggacggaggggtagcattcttcacaggtgatgtgttactctttgttgcttctgatcactacaacagatagattaatttgtaacggaagaaaaagttcaacattaagtgttggaccatgtgtcagaaataattggttaatgatgatagagccacaccaggtaaccatccacactgatcctgcacatctgttcaccccttttgcatccgtcagttatgtacaagaaaaaatttcatgcatactgtgctagctactcatagccattcagaacaaggtactgatgtttcgataggtattggatagatcgattatggagacccgacgttcatgatccaaacaaaggctctggaatgatcgaactccaggcaatctgctgagattataggcatataatgatttaatttatttcataaataaattatgacattacagatgtatactagtatgaacgcatcattagatctacacatgtaaactaagcagtaaaacgtaaacagatcaaatatgtgcaacatgtcgaacacgaaccaaggtggcggaaagaccggttgctcggcaggaactactcgcggttgcgggcatcgacgaaggcgtgcagcatgcgagctaagaggaaggcgagccgtcgcggacgaacagggagcagtcgcgcgaagcgcttcccaaaaaccttattgccgccttagattgatttcgcgtgtgttgtatgtaagcggcggctcggtttatatagagataggtcgcttgatcagggcgccgcacgatctccactccgcataaccgaaccggataagtcgcgtgtaacttatccggactccacaccattttcacgcatcggatttttcggaatgtttccaaaagaaaacaaatctgaatttcccgcagcaaaacaaaactacaaaaggaggctgcatctgtgcaaggatgaggagccaattttgcggaccattcgacgcgtacgtcgtgcgcgcgccgcctgccctgcaggcaggcgaggcgagcgagcgcgcccgtgtgttccccctcttctctccactagacatgcttcaagtggctaggagggcatcctcctttttaaggaggtcccactctcctagaataagcaaggtggtactaaactctccatgcatgccatcccatgaggttggcttttgtgattttccaaagaattaatcttcgaataggctaaggcccatctattaattccaacacaatcattatggcacttctccattgattatcaaccgagcgaaatgcggttgaccttgccaagaaggttatctctacaaacaaatggtgaccgcaggacaaaacgtagaagaaacaatctggataattctgaatttaaaatgaatctcacaagttgagattccacaaaacgaactaactaagcagcgaaactgcaatggcaaaataatctatgccaaaccaacacaaatgagatcccgtccaagtcctgccccggttctccttgtcatcatttctgccagcactgatatgtcatcatttctgccatcatttctccttgtcatcatttcttctcctatctagcttatttttcgttctctttttatatttgttatatgaatatagaaaaaaattaaattttggaacttaaattatataatatcatgtttgtattaatactataaatcgacacccttgcgtctttcttatttttagctttttttatttctctctttatttgtaaatttacttgtttttaatttgaaaaaaatgaaaaaaagtaaatttgttttaaaaaatatatgtcgtttaaaaacttctttcattttgaactttacaaataagaaaaagattagtactttccatacaaatattaggagagtaattttctttccatgtaaatattaggagaaaaagttaggagactaatgttctttccatataaatattaagagggtattgggaaaataccgttctttccatattagaataagagaaaacaatacaaaaaagttactctttccaatttaaagataaaaaattaagaaagttacgttctttcgatttattttttacaggacagtaaaagaaacaaataagaaaaagaagaaaacaaggggtgactgggaatcgaacctagctggatttttcacaatttggtccttttaaaaaacttatttcgcaaatatacccctgaaaaaatggtccttttggaggcgccagagtcactggcgctgtcgtccaatgggacggcgccagtctatctggcgtcgtcctcctgctgacgtggtggggcggtgctgaggtggcagggggagcgcgccactgtggctgccccacccccagcaatttttatttttattttatttttttgatatttttttcacgtttaggagcacacaagaaccaaccatagaaaaaataaactcaaatagagattctaatatcgccgaacctgataaagcggggagaatcagatgtaactttttctgtagatgtccgtggatatattatttgcctgattctgagcacgtatgagaaagttaaacctattctaagaaatgacacccgaaaaacacctattttcggtagagttttggaaaattctacgagttacatatttcgtc

SEQ ID NO: 63559 - DNA, 2011 bp, Oryza sativa
atttgcgaaataagttttttttaaaaggactaaattataaaaaaatccaatcgaacctagcaccttttagttgcaagatgatatcacccaccactgagctaagaagagttgttgtaaacataggcgcatgtttgcgcctttatcaatgaagacctcagcgccaagtagtgtgccgctgagctttgctgatttggcttttccttgttgcgcagcgctatcgggattggcgctgaataaaaggtttatttttgcaattagtttttatcacggttcaatcctcaaataagtttcctaaaacgataattttgtcaaattttcggggttattagtctcgaaagctttgtgtcggtttgactttcgatattttctttagtagtaacctatttgagtgtaagtgaaaaataaatcaaccgagtgacagatagacagtcaaaaagattcaggagattaaatttttggtagttcgttgaggatgctctaataacaataataataaaacctcgtgtagtaagaacaatagtccccatttactgcatgaaattttttaaggtaaaatataactctcacatgttcactggcgctgcaactgctcaaacatttcctgcagagattacagctcaagatgtgtctcattgctctctgtgtttctccgctatgccgccacgtcttccacaatggaaaggcccatatatagctgtgttcggcactgctcccaaccgaagcggcctatattagcgtgtaattaattaagtattaactattttttaaaaaataattaatttaaactttttaagccactttcatatagaaacttcttttgaaaaactcactgtttaacagtttaaaaaatatgcgtgtaaaaaatgagggagcggggttggaaataagggtaccgaacacagccacgtaatcatgcaggttgcagccacgagtcgtcatctcggtgaaccgcaccgctcttccagctccatatattcggccacacccacacctagcttcgttgcagctagctaacaattggacgtgtcatcacaagcatcaaaccaatggcaactcaccagcagaagatgcagatgccgccgtcgtccaaggacgacgagccggcggcggcaacacgcccgccaccgccgaagcgggaggagcgcgccgagaaggcgccggagatggagaagaaggtggtcgtcaccgtcgtgaacggcgaggaggaggacgacgacagtgggtccacggacaacgggcgccgccgctgcgtctgctccgccgccggccagccggccgggcacttccggtgtgtgtgcgcggagacggacggtgccgacgagcccgacgagtgaattaccgagaaggtgttttcacgtgtgcctttgctacgagttttgttttgattgatgtatggagatgagggtgcacgaacttatgattgttttaattttggttgtcttaattgtcgtagtattttgttgcaagctagcaataatcataaatgggcaaaagaagagtatctcttttttttttacctcatgttccaatgttgtgtgttgttgtttcaaataaagattacaaaaatgttgtgtgcttagctaagatcaatcggtttaatcttaagccagcactctcgtcggcgaaaaagaaaagcgtgattcttttcacgaaaatgcaaaagcatgcgaagtccttaacctttttttgttgcatatttttcaacaggaattgctgataactttcaatagaaaagtttgaacttccaatggttgtttcactttcaatgtcaaattcttgacaactttccaaatacatcttttgcacacaacttattattaagaaccacattcaaataatagcaataataaacactaccaagaatagtgaaagccaaaaaggcctcgtgcagggctggactggggtcgatctggggagtattaattctcccacaacgcgcgcgcaaaataccattttcgttaaatcacagattaactgtttaccgaaacaaatggcgtacacaaacaagaac

SEQ ID NO: 63560 - DNA, 15734 bp, Oryza sativa
aattcctgcagccctgggtcttctatggtctccccatcgtccatcccaacagcatcctcgtcgttaccatcaacggcattggcctcgtcatcgaggccgtctacctcaccatcttcttcctcttctccaacaagaagaactagaagaaaatgggagtggtgctcgctacggaggctctcttcatggcggcggtggcactcggcgtgcttttgggcgcgcacacccatcagagacgctccttgatcgtcggcatcctctgcgtcatctttggtaccatcatgtactcctcaccactcaccatcatgagtcaggttgtgaagactaaaagcgtggagtacatgccgttgctgttgtcagtggtgagcttcctcaatggactctgctggacatcatacgcgctcatccgcttcgacatcttcatcaccatacccaatggtcttggcgtgctctttactctcatgcaactcatcctcttgagctggtaagataagaatcaagataagaatcttgagctgccaaccgtcgcccctgtcgccaaggaaaccagcatcgtcacccctgtcagcaaggacgacgacatcaatggcagcactgccagccatgtcataatcaatatcacgaaggagccataagctagttaggtgatcgaacaagtctaacgctgtaagctagttaggtgttaccaatttctacatttaggtgttaccaatttctacattcaagtcatagtacttttttttagtaaccaatgtaattttgtgttttttatctatttgtgaagttgcgattatatatattatatcctgtaattttgatttgtcaaatggattccaaaatttcggaataaaattttctagaatgttgtttgtcatcctcttcagggttgttaatagccgtgcaaaaggactagtagccaaacatgtcatggtgtacagcaccatgtgaccaataaatcagcacgagcaaccatgtccataccgtctagttcagagcattgcgcaaaatctctacagagaaacatagagaaagacagttcttaataaaaattctaggtccgtgggacctaagactacgagattatatcgatcgcctgctctgccattaccttagaaacgaaaccttcacgaatatgtgggcatgcattgtgggttgtatttgagaaacttataaagacgtaatatcaaccgaataacacatgtcatgctttaactgtacgattctccacaaaatttcttcgtcatcattgcttaaataatattttcaaactatttttagttttatactctactactagaaaaaatacccgtgcgttgcaacaggttgtaaataacatttattcaaataaattaaaattctaaaccacatatcataattgggcataaatgataaaaaaataaatatcataaaaattatataactaaatccttttttttcatttagctataaataatttaattcagaggaaaattataatcaataaattttaatggatcaaatagagctgaaactaatattgtaaatagagaaacaactgaaattagctataaattaaaaaagaacttattttatagtcagatgaaaattcgaactgatgcaattttggtcactaaatcgaattagcaacttttgagaaaaatattagctcatcatcctaccaccagagacattccatttttgacagtgttctcatcgttgagattaaaaatgaactggaaggtaggaacaccgcaaatataagggttaattagatccatgccattaaaattttagcagttttgaaatataccattactataacgatgccactgctacttgtttgaaatcttagtggtgccactgagatacgtattttacatgtattagacgaaaatgcgctcatcttctacctctctctcttccccatcttctacccctctctctcccctcgctgcgccgttcattccgtccccgctgctcctaatgatgctcgtgatgccgccgctcaccgccgttgcagctcgccactgcctccgccgtgtcgccgcagccactgctgccgcttgccgccgcggccctgttgctgctgctgctgccgccgctcgtcgcggcgccgtcgcatgaacgtgttcggcaggtggcgaagcctagtgacgagtcgtgtcaccgaagcgcggtgaagctcggcgagcgacggcgaaccgaggaatcccaggagctcgcaccgcgtctcacccggcgcaccgtcggccacaagcgcgagcgccacatggaaggagcaagcgccccatggaaggacagcgccgctgacgaggaggttcaccgcgccatgctgttcccgccgctgtccctgctgccgcgcgccgtagcttgctctgccgccctcactgttgccgctagctccgccgctgctcgctgctgccactcgcgccgccgtccccgctgctcctgctgctccaccgccgtcgtcgagcaagaagaaaggagaaggggaggaaggaagaagaagaagagagaagggcaatttggtccaaaatttattggaaatgcatctaaggggtaagcagtggcatatctggctcaaacatatgtaaaattataatggcatggtttcaaatacacgaatgctggtggcatatttcaaaattggtaaaattttaatggcatatatgcaattaacccaacatataatggatgatgtgtgggagggaggcccgagcagcccaccaggcccaacattagcaaaaccctaatccaactccccttttcagccttctccatctcattcctcagccgcaccggcacaccccgcaccagtgctgcgccgcttctctttcacaccgcgctcgccaggacgatggcatcctccttgcatcatgccgctgccgcgccaacattcttctccttcttcatcatccacgcgccacgccgccgtcaatcgtccctccccctagccatcgacatcagcccctcctcctccatgttgttgtgccggtcaaagccgatcgacatgcggtatttggggagggtagggtgcggcaggaggtggtcgccttcgcctctgtactgtcccatggcacctgtttcaagaggtgaacgcatggcctatgagaagaaccgccgttcaacgatattttccacgcctacaatttgtgtgatttttcttcctcctatttcttctttcgctagggttctccatcgtttatctgtgttcaattggaaccgctcgattggattctttccttgttctccccttctagaacatgtagttcagtctgattggataattttttcagggttctcttagttcttgtagatatgcccgattaaaattttataatagggagggaatcggacggaaaaatagcggaaacatcgcaaaaaacacgcacggtgagcgaatcagattgcgcaacgtacgaaaatacttgacaaaaacatcttaaacttttataatatataggtaaagataaagataatatctcttatatactaaaagtccactaaactttctataaacactactaacccatcacgtggtatttctatggacactttttaattgtcacattctaataagtcggtggtccttatctttagaaaaaaaataccacaacccacctcttgtcgaaacaagatttcagcaatactaaaagggggtgactatcaagctggaaaagtggatgggttgaaagacaaagaattttatacaggttcaggccttcttaatcaagaagtaataccctactcctgcccggggattgatccgccgagtgtattattgatcgtatgatctgggagaaaaacgtgccccaaaaggcacccggacacctccttatataggggaagggattcgtattacaaaatacagtccatatccctaacggaataggtagttacagataagattcaatcctaaccgactaggatcccgggtatttccttgacatacaagtttggaatttaacccaagtccctttaaagatattctatctatacatggcaccccatacccagtcggactatacataccgtgttaggtatggggtatccataatctccacagtagcccctgagacctttacagtcgacaaaatagtcttctctcgtaatccaaacgataatccgagtactccgatttcttctgccttgatctcccgagtaccaaaatcaaagactgtgaagggctaaaaatagagaaaatcaagtgcatcgatcagatacacctaattaggtgtagacctgactatgtgattagttaaaaactaagcgtataatcaaggtgtaaacaatatccaatcaagtggttttacaaccggatcatccatggtatcatatagctaagcatatgcgacgtttaataaaacatccagccgactactttagctttgatacaccataaaaggagatattaaaagacccgagtgaaaaacactctaaaggtctataaaccaacacatatgataagaatccgagtaaaaactctcaaaaaagatccatcaaatgtggcataaatcataacaataggtgagtctaaattgcctgagctataactcacaccatatcaaaataagcatataacatgccgagagaatgactattcaaaaactagtcatctcaacaaaacccgaacagcttttgcagcctaaaaaggcttacaaaattagtataacacctttctgttgggcacctttttatttgcatcgtagtaattccaaagaattatctaactgcgtcaaaaaggattttaacagcattgggctataccgtcgtgagcaagtgttgctgaatcaaaatgcctaagtccctaaggatcacaacttggccacgtcgatagccaaatttaggcctaggcccattagtactcccgataacctaatgaaataacaccgaaagcaaagcgtcggttcgtcttccccgccgaaactctcgccactttccccattctctgctacagtgtcagaccacaccggcgaagttacggttcacagtttcgctccaatccatccaccaaagctccacaaaattctcccacgcaaccaccgcatcaatctcccatccattcccagccacattttgaaccaaatcacatcatccaggccacatccatggcgaaagagagagaaagctttgagagtcagtgggcgtcttccgatgtaacggaggagaacctgaaggagatggtggcgcacggcgtgcttccggcaaatgagatcatcgggtggcgtccagcgtgcggtgaaacgtttccgacccccgacacacacgaggtggtggtattctcccatttcttctatggcgggttttcccttccgacctcaagtttcttccgagggattttagatttctatgggctcagtttgcatcacctaaaccccaattccatagtccacatcgccaatttcatccatgcttgcgaggcctttctggggattaggccgcattttgctctattccgtcgcatcttcttcctcaagccccagccaaataaaagcaaaccgtgcgtagttgggggagccagatttcaactgagagggaccttgagccaaaaatacttctccatgccatttaagacctcgaacaaaggttggcacgcgaactggttctatgtgcaaaaccccgagccaacgcttcctgggtactcctgtcttcctccagcatatcgcgatacctggaatcacttcctatgggagaagaggctgcccaagcgcttgacctattggatcgcatgctgaagcttaaggaacagggtctgcagggggagcaaattacccggcacttcatcaggagccagctggcaccattcaaggaaagatcccgaacagcttttgagttcgatggcaagcatgaccccaaccgagagaacccagttcaaaattatgcaggagagaatgtacaaaatcttctcgatgccatcgtgatcagctattcacacttactgccagtcgtgccatacaatgccttcaaccctcctccaccggtacgtatcatacatctcagcctttctcaaagcatgcttttatcttctgtaaggtcgactgaaaacttggaataccatgcacaggaattcgctttgatgaaatccgatgctccaatcgctcaacgccgctcacctcgccggcacactggccaagccagtggagggccgaagatcaagtcgaacgtccaacccaacacctcgaggtcaactaaccagtcagattctcgtaagaggaagttggtttcaagtgacgatgaaggtgatgacgcggaaaagacgggcaacaaagggtaattgggaaacaaccaaagcaagccaattcgaagaagaaaacatccagtcgtctcatgccaaaaataaggaaatcatccagatatgtgtcatctagctatttcccctgtttcgctaatcactcattattgaagcagagctaatagcatgtttcaaatttgtaggaaaccatctgacatagatccttttggaaaagaccccatgccgaatggcacggagactggtccttcagcagaaactgagccgactgccaaggaccacccgggtaataatcaaccggcgaccgacaatgtagataccagcaacgagcccccgactggaaattagtcggccgaagctgaagtcggcactgatcaggagcccccaactagaaactagtcgggtactgaacaaactagagatatcccagaagtagaagctcaagccaacagccctcccaagacgaacgctggcgctgaccctggaaccaactctcctgttaaggtgcaaggacctgcacgtccccgtccggaaattattacaggtaaacaagtcctccaaatctttccttgatccgacaaactttcttaaattgctttaccattattttgatccgacaaacttttttcaattgctttaccattattcatgaatgtataaggaccaatgatcggtgatgaagaagaggttcttcggatacaatcggctgaagattctcgcccaccaatattagtcaagtggtgggatgatgaaatacgatcacagggaattgtaataaataaacaaaaggaagacgaggaagtatgcctgctgaaaaagacactcggccaagctactcatcttgtaaatgtaagtctctttacacatagcttcaatcatcctgtcggccactttactgaataaagacgcacttgtaatgcagagaatccatcttaggaatgaggcaaatactgcaaccctcgagaaattggttccctaccttggaaccctggaagcaaccagagatcaactgtgtgaagcgaaggagcttgccaggaagactgagcatgaccttagggactggatcgccgagctccaggactccaactttgagctaagtggttcatcaaaacgtaactctcatccttatctgatttgtttcatgctgctattcatgtgcgactaaccagtggaaagcaatatagtgcaagctgccaagatatccgagctagaaaggcgaatccaggctctggagaaagacaaggtcgaacgggcaaaacagagggactcggctctgaaagacgtcgaaggtacttgtagctgaaacttcaaaaaccactctcatcttcatgcccagtcgttgatgtgaatttatttgtacagatcgcaaaatcaaatcccaggctcaattcgacgtcttggttaacaaaatcaagaagcttgaaggagccagagatgaaatcgccaatgccgctacgccactcgtccaggccatgtttttcaataacaatggtccgagttcaattgatgctgccaaaatcttcaacaagctgagaactgctccggatacatattttatgaacatcaaagaagctggaagtatgggggcgagtctagcgttggcgatgaccaagtccttgtacccgaagattgatattgatgccgttgatggcttcgcagacgggacaagtgaggaaaccgcccttgacctcatcagtgatgcgcaaaaagctgctgacaaaatagccgctgatgtagttgagaggttccgggacaacgatcttaagccgactaggtctgataactctgatgatgaaaaaactgaatctgattgattgtgtattctgatgataatgatgatgataatggaggcacaatttgtacaatactgatgaatttatgctgtgcttgatgatttaatctcagctccagatttcttaaaagtttttgtcaaaccttattgagcctagaacccgaagttgttaaaaactttcagtcctcattggctaagctaaaaaatcaaacaaggcaatgataaatcaagtaagcaaattgaattgataaaaatcacactccattattattatagtagcccccgactgataactgaaggaaaaacttgatgttagcagtcaaagaggaagatacaaaaagtaatgcctaagcataaaaacgacgaagatgttcgatattccaagagttgtcgatttgagtactgtcttcatgcttgagtcgataagaacatggctgagtaacttcagaaactatgaacggtccttcccacaagggagataacttgtgccgatctcgtgtagcctgaattttcctcagaaccaagtcaccgactaagaaagctcatgatcgaacattgcgattgtgataacgacgcatcccttgtaaataccgagccgactgaattagcgatgcttcacgggcttcttctagtcggttgagatcatctactcggtcttctccatagcactcctcgctgaaattacgaaatcgcaaagattcgaattctacctcacttggcaacattgcttccgcaccatatactagaaagaatggtgactgtcgcgtagcccgactgggtgtggtgcgcagggaccaaaggacggatggcaactgttctacccatttgccaacatagggatgcagttggtcaaaaacttgtgcttttatcccttgaagtaccataccattggcacgttcaacttgtccattgctcatggggtgcgctacggaggcataacaaattttgatgccgaagtcctcgcaaaaatctttaaatactccgccagtgaattgagtgccgttattagttattatccgattgggtaccgaaaaacggtgcacaatgttgataaaaaaatctctagccttgtttgccgtgattgtgacgaccggtttggcttcgatccacttggaaaatttgtcaacagctacaaagagatgagtataaccaccgatagcctttttgtacgggccaaccatgtcgagcccccaaaccgcgaacagccaagataacgggatggtttgcaactcctgagccggtagatgagtttgtcgagcgaaaaattgacaacattcacatgttcgcacaattttgtccgcgtcagatacagctgttggccagaagaaaccttgccgataagccttgccaacgatgggtcgtgcggcagcgtaattgccacagatgcctgaatgtatatctcttagcaattgtcttccctcctccaaagacacacaacgttgcagaatccctgatggacttttcttgtacagctcggtctcatgtatgacataaagtttgctgcgcctggacatccgctcggcttcatctttatcttgagggagctcttgtttagtcaaaaatctaatgaggggctctctccagtcggcttcaatcatgcctacttcttgagtgtccgtggcctcgattatttatttccttggtatggttggctcataaagatattcaacaaacacgtcggaaggagctgcttctcattttgaaccaaaattagccagtctgtcggctggctcattattatgtcgaaggacatgggttagctcaaggccatcaaatttatcttctaacttgcgtacctcctgacgataggcggtcatgttatcatcaaggcaggaccactctttcatgacttgattaacaatcaactgagaatctccacgaactatcagacgccgaattcccaaggagatcgcaatccttaatccgtgaagtagtgcctcatattccgccacgttatgggacgcagaaaaatgtatccataatacgtagttcaacctctctccagtcatggagattagaacaacccccgctccggtgcctgaaagcctctttgacccgtcaaaatgcatagtccaatactccatcttctctgtaggcgtgtcttcttggcactcggtccacttggcgatgaagtctgctaaagcttgggacttgatcgaagttcgcggcttgaaggatagatccaaagacatcaactctaaggcccactttgcgatccgcccatttgcttcgcgggtgtgaagtatatccccgaaccgagtgaccttgaaaatagtgggataatttcctaacggtaatcaaaacaccatacaataacttttgaacctgaggatatcttatcttgaagtcggccaaaacctcgctgacgaaatagattggtcgttggactttttgaacatggccttcttcctcacgctcgacaaccaggactgtgctcacaacctgggaagtcgctgacacgtataacaacaacggctcttgcggatctggtgaagctaagactggtggagtagtgagaagtttgttgaagtcttcaaaggctttttgtgcttcgggtcccctctggaagttgtcggttttctttaacaacttgaaaaagggcttcccccgctcgccaagtcgtgagacaaaccgactgagcgccgccatgcatctagttaacttttgaacatctttctaggaactcgacagtttcatgttgaggatggcgttgattttctccgggttggcttgtatgcctctatgggacaccataaagccaagcagcttccctgacgatactccgaagatgcacttttcagggtttaatttcatcctgaaagcacggatgcccgcaaaggtctcttctagatccgtaatcaaatcatccttctgcttggtcttgacaactacatcatcaacataagcttcaacgttgcgaccaatctgagttgaaaagcatctctggatcatgcgttgataagttgctcctgcattctttaatccaaaaggcatggtgatgtagcagtaggccccgaagggcgtgatgaacgaagtctttaaacagtcggactcctttagtcggatctgatgatatcctgtgtagcaatccaaaaaactgagtaactcgcagccggccgttgaattaactacctggtcaatgcgaggtaccccgaagggatctttgggacaagatttattgaggttggtgtaatcaacacacatgcgccattgccccgtcttcttccaaaccaggactgggttggccagccagtcgggatgtaggacttccttgatgaagcctgctgctaacagcttggtcaattcctccttgatcgcatctttcctatcctgtgagaaacggcggagtcgttgcttgataggtttagcatcttccttaacatgtaaagagtgcttcacctctctaggaatacgaggcatatcagatggtttccacgcaaagatatctttattattttgaagaaaggtgatgagcgcgctttcctatttataatctaactcagcgcctattacagcagtcttagtagggtcaaagggatctaggggaatcttcttggtcttggcgtcgccttctccgccctttgacatcttggtcgtaggcacttctccttcggttgctgtggacgcagccagtcggatttcttctcgagcgagtgtgatctcgcgggtttgggctatctcacagctttccttgttgcaagtgacagcttgcttgatgtcgctccgcagggatatgactcctctgggacctggcatcttcatcatcatgtaggtgtagtgcgggacagtcatgaacttggctaatgccgggcgtccgagtatggtatggtacgctgtctcaaaatcagcaacttcgaagcaaatattctctgtgcgaaagttctcccgagtgccaaaagtaaccggtagagtgatctggccgagtggagtagaagacagcctggggatgactccgtgaatgggcgcattacttggcttcaattccgtgcgagggatttgcatgttgtccagagtcttggtgaaaaggatgttgagtgcgctgccaccattgatgagggatcttcggagctagacactgcgaaccactgggtctagtaccagggggcaccgccccgggtggaccactcggtcagggtgatccgagcggtcaaacttgatagttgtttctgaccaccgaagatattggggcgtgtcgggctgaacagcattgatctcccgttcagtcaccttttgctttcgcttggattcataagccagggttctgccaaagatgtggttgagttccttgcgatgatcttgaaaaccagtcggggcatcatcttcatcatccttcttctttgtcgtgctttaatctccgtcagtcgtcttgcgtgcgttcttggcgtattgctctgcgaactgtttatagacaaagcagtctttggctgcgtggttggaatttggaggatgcggacattgagagttcatgatcttgtcgaaagtgttgacgcgcgaatgttgtcgggaggatggtgtagtggttgccacaagttcctcaggtttacgcttgcgatccttgtgattggtacttccactccctcctgtggtcagtgtatctttcttcggcttccaagtagtgcccgactgcttggatacggtgacagcatcttcagcttttgcgtactcattggctttctcgaacatctgcttgactgtcctgggaggcttgcgtccaaacttgccgactaagagatcgtggcgaatgcccttggtgaaggcggtgatgatgacgtcgtcggtgatatcggagatcttgttgcgttgctcagaaaaacatcgaatgtaatctcgaagggattctccggacttctggacaacgttgtaaagatcgaactgggtgccagggcgttcaaaggtgccttggaaattggcgatgaagtggtcgcgaagttccgcccaagatccgatcatgccacggggtagcccgtgaagccaggaccgggcagaatccgctagggctacgagcagatagtttgccatagctttgctgtctcctcctgctgcgcgaattgcgagactgtagacggtaagccaagactcaggattagtggtgccgtcatacttctcgattccagtcggcttgaagccggctgcccaatccactcgatgcaggtcacttgtgaaggtagcaactccatccacgccgtcgtcgtaacgatctggtgaatggtgggggttgtagcctcttgccgcgcggcgctggttgatagtttcgcaaagatcgatgggatgcctgcgatatggggagcggggacgttcagctcgacgctccctgtgtcggtcaggaggcgagtgaacggatcgctcgtcgtgatccctgctcctgcgactggttccggcgtcgacgacgctgaggctcggttggtgatagtctcgagatcgaagaggaggaactcggctgccagtcggcgtgcggacgcttgcggagttaatcgggaccgaagctgcgatcatggtcttggtctggttcaagatgttgacgacgtgattggcctgattgagtgcgtcttccttgaggagggtgtcgaggagggtgatcgctgcaaccgcgttctgctgaggagtgcgaaaaaccgtcgtcccctcgacgtcttgctgcccgatgagttcccgtgctcgccgcccggcctccaaggcgcgctttcgccggtcctcggcctcctttgtagccgctcgcgctcctgttgctcacgctgcagccgtctcgctcttgtgcttgacgctcctcctctagtcggcgacgttcggcttcttgtcgcacgcgctgttcttctacttcttgggcttgacgcttttcttccgtctcgttgtcggccatgaaaatgccgaagtagaggggcatgtagttatcttcaaagccttcggcgaagttgtcgaggttgcggtagtcgtagtggtagccgaagtcatcgtgctctacgatctcgattggtcgtgagtcgacaccgggggagctgaggtagccgtccaattgttccgtcgaaaccgtgccgagaggttggagtatgacgccgacttccctggagctagacaggatcggggccggggccggatcccgcctagacctacggggagaggacgcccttgtggtgaagacggtagccaagtcatcggggagtttcattagaattggcggataggctccatcgtcttgatcgggtcgtgttggagtagattagatctcgtccgagtggtttggggccaactcgactgagatgatcttggtgtagatctcggccgagttcgggatactgaacggggcagagacctggcctcttcctgactggttcgattccgagtcgaggagagaaatcctgccgatgtcgttggtgatgaagtcgaggctgccgaactggaacgcctgctcgggagggaagacgaagtcgtcgatgccggagacgaaacccatcgcactagtcggcgaagaacttgacgctgcccctacctggcgcgccaactgtcgaaacaagttttcggcaatactaaaaggggtggctatcaagctggaaaagtggatgggttgagagataaggaattttatacaggttcaggccttcttaatcaagaagtaataccctactcctatccggggattgatccgccgagtgtattattgatcgtatgatctgggagaaaaacgtgccccaagaggcacccggaccccttcttatataggggaagggatccgtattacaaaatacagtctatatccctaacgtaataggtatttacagataagattcaatcgtaaccgactagaatcccgggtatttctttgacatataagtttggaatttaacccaagcccctttaaagatattctatctatacatggcaccccatacccagttgtactatacatgccgtgtaggtatgaggtatacataatctccacacctctttcccttctctccaaccagcccaaacctcaagtacggtcgtacattacttacgtttcctccttctaatcctcctctctcctttctatataatcgaaagtttacaagtttaccttcgtaccattgaaagttcgggggtaaactttaataccattgaaaattttccaccgttactttttctaccactgccggttacttctgtctagattttctcatttctatttcattttccctcgaaaaggccgaataaaatgagtgtctacccttctttcacattgcagttccctgggacacgatctttttctcgttctttccatcggcccatttgtggaattggaaacggattgattttgctcgttgtttcgatcagcccgatcgatctttgcgtacgttcagatgggagaaaatcgtggctagctggagcctggagcgaggtcgttccgtcgttgcatgtcgacctcgtcgtcatggtcatcggcggacggcgggggacaagctgctactggatagtgttgccggagcggcggcggcacgtcgagcccgttctcatctgaggggattggagtggaggacctgctaatagatcatgttgccggtgctgacgacgctgaggctcggttggtgatagtctcgagatcgaagaggaggaactcggctgccagtcggcgtgcggacgcttgcggagttaatcgggaccgaagctgcgatcatggtcttggtctggttcaagatgttgacgacgtgattggcctgattgagtgcgtcttccttgaggagg

SEQ ID NO: 63561 - DNA, 2731 bp, Oryza sativa
  unsure (1)..(2731): unsure at all n locations
cgccgtcgccgtcgagattaggcggacaaaggagagggctcaccgaaacacctttttcttatatgtatttctnactggacacaagttggccagatggtaaagtctgaaaatccacctctcttgctttactttatttgttttcctgatttgtgggtaaaaaacttagggccgctttgaatcgcaggattgagaaaacgtagtaacagaaaaaacgtaaaattttgataggaatataagtttaaaacaaagaattgcaaaacacaggaaaaatacagaaacgaccgtttgattgaaccacaggaaaaacacaaaaattggatgagagagatagactcaaaggaaagttagcaagaggttggagctcttgttaaatttcctccaaaatctctataggattgtccattccataggaatttcaaaggattggataggattcaatcctttgtttcaaagggcttcataggaatttttcttataggattgaaatcctctaaaatttctatatttttcctctaaatcaaagggcccttagttaggcctcaacaagtgaagtaggcctttcttggctggcccgtctattggccaaaccacaagttcacgttagcctggttcaccggtttttctccaaataccatccggtccttacggttcacatcaatcatcatgctacatgggtgatctttgtagcaaaccacttcaattaggatacccagctctaatttcttcgtgtaaaacggcaggccggtctagtttttcagcataccagtggctgagttcgtttaggagggttcccaatgtctctccctcattttctacacgcaagcttttcaaactgatctattaaaaagagtattttttaaaaaagattctatacgaaagttgtttaaaaaaatcatattgatttatttttttaaaaaaaagctaatactccctccatcaatttttgatagtcatatttccaaatctgaaaattttatttttgataggcatatttcaatctaacaacttattatattaatgactttcttagatttaatgcatgactcttcattcttccatacatgattggttacatgggcattgagaaatgtaaatattaatgaatcgcttgtttatgagaatgactagtagcatatttaaatggatgataagtagaattacttatccttgctctgtgtgccaagatgaaatatgactatcaaaaatagatggagggagtacttaattaatcatgtgctaatagactgctccgtgttctgtgcgggagggtaatattcccaaccatgaggaacggcactcacacacacctccttctctctccccctctttccccttgtcggctcaggcagccacacgcacacctgtgagatgaccagtgcatattcttcttcgttttgctgagtgttttccatcctgtccggtcaacgtcccatcaccgttgatggcttactctcttatcccttaaaaaaattaaatcctagcgatgaatctgtacaatagttcattgtcaagatttgagtttttttttacggagggattatgtctctagtttgctttatctcgagccttcctagcagcattagtgtcagatgtgtttatcttcctcgtggagccaagaaccaaacaatcgatctgtcgagggattggaagagtatggatacatgttgtgcatattgtttcttgctagtgtgggattgttcagtggtatatgtaactgaaattgcaatccaacaaactacctacagagttttgtttggaaccgtggccaagcagaggcacacacatatggcatgtattcctgtcatccggtatgcatgattcacatgctccgtaggattcatcttgtgttgaagtatcttatttgtgacaaagctaccaaacatatatcttgaagtctaggtgtcttgagaaaattcctaatacttcctctgtcccaaaatatagctacctaatacatgatacctctggtccagatttgtagtactaggtaatatcacatactgtactagatagctacattttagaatggagaaagtactataattttttaattcaagaaagaaagactcaagctaatctgtaggataggtgtaactcattccacttggtccccaaacaaaacacacactactacaaaaatgatttttatatacgatgacccctttcggttgcaaacggaccgtaactggcggcgtctacaaaaaatcgaactacattttcgcatacagttccttaagagaccaacatacaaaaatcttttctcgcagatgggcctcttaagggccgcatgcaaaaatatgcttattttcaaatgtggatctcttaagtggtccgtatgcagaactaccacccattcacatatttctttatctctgtccactctcttttccctctaaccacttcaaatttcttccaactcctctcctctctccccctcttgcatgcaaaactaccaccccttcacatatttttttactctatctactctcttttccctccgaccacttcaaatttcttccaactcctctcctcactctccccctctcctctcctctctctttcttttcttctttctctccctctttgagcgggcgccggtggctgggaggggcaacagtgggtgcgggggcgggagcaagggaggcgatggcgtcggtgggtagcggatcctgtggcgccgccctcgggagggtcggatccacctccctagggagtggctgcggctatggcg

SEQ ID NO: 63562 - DNA, 2581 bp, Oryza sativa
  unsure (1)..(2581): unsure at all n locations
cgcgtgtcgggcgccggccgcacgacgacatggtggcatggaggcgtcaaggcgagctcgaccaacgaaagagccaccaaggtggccgcatggtggctaccagtgaggaagaaggcagcaatgcttcgttacaaggagctagaggcaaaggggaaggattgggggctcggggttgagctcttatagtaggtcgcatgcaagtgggcgctcggttggcgaccgcgaatggcatctacattttcgtggacaacgcgaaaacggcggacattcaggaggcaaaggacggccaaagacagtggataggacagcgaaaattgaatgcgagatgctggaggagcagcagggcaagctggcacatggtcaagatggggctccaaggcgtagatgcagtcgtcatggagctcaatgttcgctaccgcaccaggacaagggggagagcaaggtggccttgcccgcgagagaaaaagcgaaaggaggaggaggaaagggagctttgcctccctccattttgggcggcggggctggcgagacatgtaggagcggcgtcaccacgttggtggcttgtggcatgtggagtcggggacgaggtgacaatggtggatgacagcaaaagtgatgaggacacaactagcccagatataaccaagactaccttatgtattaatcaaccaaaggtgcatatgctttacattagatttacttgttatatatttgaacaaacgttgctacacaatgagttttgtatgtttttgtttgcagaggtacttgcttgggcaaaggaaaagaggccgagcataacgaatacatggataataaaagaagttgattggggatcaaaccaagacatcctccaagtctacttctacctcaccacattacttttggtccatataagacaagaaataaaattctacacgttttggattcggattcgggcctcctgacagcatcaactacaaacggacctacccactgatctagaaggaatttcggggcccatgagtacttgttggaaagtgtgacatcctggcctagggcttaataggattaatagaatactcatatcaacaagttgcaacttcttttccggaagccgatctataaataactctgaggttaagcgtgcttggcctggagcaatttagagatgggtgaccggccgtgctcagcccaagggggtgtgcgccctagggcaaccctagggcgtccctaatcatatttattcagtagccgtcattgtttagagtcgggttttgcttagattaatctgtcaagaacagtttcgccgctagatcagtttgtggaatcccaagttcgagtgtttaatcattcaaatgcaatttggttgcaatctatcttgttcttgcttgtgttcttcgattcacatgcaaggattaaccttctcagcaaggtcaaccgggtttcagcatggttgataatcaggggagacgtggtgctgtgatagcggagcttagtagcatgttcgttcagaagccggatcgagttgtgtcgcgactctgcccaaattgactgtttatcaatacctattggaagatcgggacataacatcctcatcaaaaagggggtggggatggtttggcaccatgtggaaacaagcgggcgccagcgcagagttgatggtggcagtgtcctcgacggttgatggtggcagtgtcctcgacggtcggccatgacaggtcgtgagcgcgtgaagtgatggcagtgacgggatttgaatcggcaaagtggcgatggccggcgcatgtgagagagagagggggagggtattccccaaaaaaagagagagggggggggaggaagagaacacgcagtggagaaagaaagggggagaggagcacgtctcctcggtgggggcacgtgcggcgcacgtggagagggagggaggttaggatgctagtaaaaaaatacttttttttagaacaaactgaggctacagcctgagattaggattttattaagaaagctgagagtacagcaagtcttacagatggtgtggccacgaggaccgagggcaatagtaaaaagaaaaatattacccgggttgttaagggctgtggggcgagctgtttacttagacggcatgtagggtgctttgtgtgtgtatatagactggtgattccccgcactttgctgcagaaatttctaagtaacttttaatatttttttaataaatgagctaaaagtaaaaattatatcattattaacaataaataaaactggtttgcaactatgttcagagagatacatttagtagactatgtaagtagatgaaatttgatatcatacactttgattatatggatgaatatgtgttaaggattataaaaatgatagatatatactacctccatattttaatgtatgacgccgnngactntttatncanncggngaccatttgtcttatttaaaaaatttatgtaattatcatttattttattatgacttgatttgtcataaaatgttctttaagcacgacataaatattttcatatttgcacaaaaaatatgaataaaacgaatggtcacccgttgttcaaaaagtcaacggcgtcatacat

SEQ ID NO: 63563 - DNA, 5796 bp, Oryza sativa
  unsure (1)..(5796): unsure at all n locations
ggcgaggatgacgacgacgatgctagaggaagcctaattggagtagattaaacggatgggttagggttacagccaaaacttcaccaacacaattgtatggaagctcaccggcgacgcgaaggcgatgacgacggtggcaacaggaggcggcggcgtggcaacaggaggcagcggcgctaggactccaactaaaagaaaaaaaaagaaaaacaggggtagggtggcttatatatgggtggaggtaaaagaggtggggctagagtggagtcatcagaggggagggggagttgaactcggctcggcaggggagagggcgcgcgcgcagggaggtggagagagggggcggcggctgaataggatagggagaggggaggaaaaataggaataggaggtcaggcagagggctttcctaaaaaggaaaacaaatgcgatgccattttagaaaaagaacggaaacggtcccgcgaacaaaaacggacacggttcgccatgcaaaacgaaaccgcggacaaagaggggagtgaatcgggcacgattcacgaccaaaggctgaagagaacagaattaattactacaaatcttgacaacttaattagcaacattaactccgatgctctgtaaattccgctttaagtcctgttaatgattttaggagcaaagagaattcgaaaaaaattctccctgacaattccaattattaaatacattgttaatttaggttttctcctggttaaccaaaataatttctttagacgaattattgttgaattggaaccacgggaaaggggaaaactccggttgtgacaacaagtctctaatccatcattaaaccagattataatggcattcgccaagtctaggacaacaacagaaaacaactggatgtttctaacagagcattgctaactgtaattctaaaatttctaagcacatcatatggagttctcactagctggtttttgttacctagggttatcaaaggtaattacataatatttagtaaataaagccaaaacaagaaaatataggaaaggctaagtaagtaaaacagttatagtgcagtaagtttaataaagcgaatgcgataattcaaattaaaatacatttcgcatattgtggtgcaatatgcttaaggagaacgtgacttgccttgctcagagaaaaatggtcttcggaggcttcatagacgaactcaaattgcaccacaggaacatatgaaacaacaacaactacacccaacaaaagaaggctaaatctctagaaagaaacaaagatagtaaaagaacaacatacatgggttgtttaagttataacaaaaattaagcaacttaaacaaccaatttggagctcatatggctgagaaacgaccatccaaaattacacgctatttaagtggagattttcatgttatttaattagtattatatcattaaattatgtgcaatgcaacaacgctctaggagagaaaggatcgttccactggcaaacgaccatatgaaattatatgtcatttaagtggagattttcatgttatttaaattgtattatatcattatattatatgcaatgaaacaacgctccaagagaggaacgatggagttcctactggcagctgagacccatgggtcagacgactagcttaccgtggatcgggtttaccgtggctccgtccccatcagctgccgctcaggccgagctcgtgcttgtgcgagaagagagaggggagagagaacgtgggacccactagatggacggccggcttgacgggctagagttggccagcgggtactcaggtttggctagccagatggcttagccattcagttggagagaccgttggagtatgttttttttttgtcaaaattgctaaaatttacttggccagccatttgtctattctattcgagttgctctaagggtgtgtttagttcatgccaaaattggaagtttggttgaaattggaacgatgtgatagaaaagttggaagttcatgtatgtaggaaagtttagatgtgatgaaaaagttggaagtttgaagaaaaagttaggaactactccctccattccaaattgatctacatattaggtacactaagaccaataaaaactaataactctcttataaaatatttactctagcaaaaactcaacgcatacaccattctcactatttcctagccaatagcaaatcaagatattgtatatgggttataaatacttgtgatgcatgcatcaatgtccatttactctaatgcacaaataactaatagtcttaatgaatgaacacaaatatttagatcatttaggaataccctaaaaaaaactatatgtagatcaatttggaatggagggagtaatcaagacctaaaacagttagtggcgacgccgagcgaggtggtggcatggtcctgcagcgcccagggcgacgccagtaggcggctggaggtggtgcagcggcggtggcacttgagcagcagcgcacggcgtggagaggcacgggctggaggcagaaggagaagaagggaaggagggggctccatgataggccgggaggacctaggctaacggccggggagctcgttggccggcaatcaatggcggcagttcgccggagattaaattcagcgaatagaggtcgaaatgaaaggggaaaacatggggggaataaagaataggaggtggggaaccgatttttgcaatcaatgtggaggagaaacggccgaggaggcggatcaactcggtggcggctctagggttacgcggccgggaagaggagcggtcggcagctggaggaagacgacgacacgtcgcctccctgggctggctgggccgcgcccgagcgaggtggggagggaggcccgagcgagaggaggaggatctggccgtggcagctgcggcccaagggagagagggaaggagaggatgggaaaaggaggcccnnnagagggaaaaggtggagaggaagagtctccggcggcgggccgagggagaaagagagagctttgggccggaaaacggaaatagcccaaaagagaaggaggatttatttttagttttttcattttaaattggtttttgttgctttaaaaatatttaggtcgctctgaaaattcaagtaaaaattgagaagatatttagagcatggagaatttaataaaaatacacaaagtaacatttgaatttttcttgtccgtattgtaatgttcaagatttgttttagacttttaataatttcaattatttcttttataaaatgatttttaatttgagattaatttttcaggatgtgacaagcttcaactagctgccatcgatcaagcctcctatctgtgttgggaagcttcctttctcgttagaattataacacaactattgaaagagcaaaattgttcttaatttaatttcatcaatttggttgtatgcaactgaattgactaatatatcacgttcaaatagtttgaaactcttttagcgtgtattttgaggtggagtccaatatatatggactttttaggaaataccacgactactatagaatcaaatttttttggacaataccccctaagtaccaccatatgtaaaaatgggtacctggagggcagttcaatgatcgtttacgaaaatcaattttgcgcatgagagcgttttaacatgcccacggacaaaaataaacctagttttgcatgccgtcctttcaagatgaccgcatgcgaaaatacccttctctacccctccactcctttttctctcccacttaagtcacgtctagtcacgtccccatgtctccctcttctcttcccattccttctctcccctctctcccattccctctccgctcctctattgtctcctgcactccctctccaagtcccgacgagggtggatgagggcagcgggtgagggctagagtggtgggctcaggcgagacaaattccaccggtggaggcgacgggatgtgcagatccggcatccctctccctcccgcatgaatattgtcatcacttcgcccacacgtgtgagaatacggtgatggctttgagcgacaatggatcctagcatgatgaccatggcagcggatccagccatggtggctgcagcggattctagggtttggacttttggatctagggtttgtggatttttggtttttgccaaaattatttttgtagtcaggtggcttatgcgcccgcatgtgaaatagaatttttgcatgtggttgattttcgtatacaggtggtgtaggtgggccacccacccgcttgcgaaaattgattttgaccgcatggaaaagttatttatgtagtagtgtactcatatcattttaaaatataagatgttttggttttatcttttatgtttatataaaaaaatattaacatatgtaatgcaaaattaatttcattaaatccaccactgtatgtatttttataatatattagtttggtgttaaaaatgtcgtgacgtattttataaactgtcatacttgaaagaggtttggacaaacccaacacttcttacatttctgaagtacatgttgtttagagtataccctttacgatagttgagacttgagacaataaagactactattaagtattaacctatcaaaataaattgtgttactcttctttcctttttcccacactcatgtgtcaaaaatttattttctagagacttatttttatatttaacatcgatgtttctgtctcctataaatgacggagccaggttatgctttggtggtgcaccagaaccaccctaaatccaagatttctcctactcgtctctttaattagtttcagcaaattttctggttggcaaggctaagaggccctaagcacatgcctttagtgggtggtattaactactccctatagttatctacgtcatcgacatcagccgttggatgaaatctcaatggtttggatgtagctaaatcccaatggtgtggatcaaaatagcccacacgagatagcccatgaggctagttccaacccaatgactaatatgatgtccataccattaaataagttgacacctagaataaaagatgacgtggcaagtgaataaatgaggaaagagaagaaaatcagatcttgcatgagacatggtttctatacaacatccaaaacatcatttgagataagtagcattaaatttaagtatggaacactagtgtttgcattgaaacagagtagtgtctaagggcatgtacaacggcctttattagtggtctctctctattgccatgcaaataaatttgatgacatggaagaaatagaaagaagtatggttgttatgcatgacaacggctcagagtcgactcttagcatttattagagtaaattttgttgcatggtggtgaaatgaaggaaagaaaagtaagaaaaagtatttaaatatattaatgattagagatcattctaactgttgtaggatgctagtctctaaataatgtagagctcatgtctgactctatctttgtacctgccctaatactagttagttttttttttgatgatgtggaatttataaaaattatgtcttggttgggactggcatgagcccattcgtgcgtagcactcccctgatcccttctcctccctagtccccaccctaacctccgacctaagcgcgctgcatcgtcgcccacggcaggcagccccgagcgccgcggcacgaggtcgctctccctaattccgcagctcctagcgctgcatcgactattcgcctcccctgcctccagctccgcagcgcccgtcactccctctcccgctctgcgagaaaaggaaaccg

SEQ ID NO: 63564 - DNA, 1961 bp, Oryza sativa
caagacagtgtatcgcaaaacggtgatgatacgcgtcatgacttgggctctaattggctgattagccgtgactgattatatgttaataaaaatgtttatgagttactgggatataacttagcacgtgttgcaagcctgcaattaatatttggcaaattttcctaccggacacttaaattttatataatttgctgatcgatatcgtaaacacgtggtacggcttaacaaaataaaaaaaactagtaatttgctagaagacacttttaacttaattggtgcataccgcagcatccaccacacaacgctagtggcggctttggagtgtgtgattaggaagaaggggtgagggggcggggcaaccacatgaaacatgtctgacagcctaattacaaatttctggtttattggcaggtcatacttcttttggctgaaaattttaaattcaattaaataattgatccaaaatttaataaaaaatagtcgaatttgttcgatctaaggaatgcttaggtgaaataataacatgattaatttaaggcggccttaatttaattaggaggcgataccgcccaggatgcaacagtacagttggacctttcctcttgctaaggcgataccgcccaggagtagttttcattagccacgctgctacggctgttggcccaacgtccggatggaagaatggcccaactttgacttcaacagattaaatttcttttgaacaatttaattttgaaaacatttcgagtatcttttcaaactgtagttgaaacttatagtctctcatgtgaacgttttgtataaaatccttatgcaagtttcctatataaacttcctctaaggaaaacttttttgtgtgccaactttctttatggattttttttatcggaaaataatttgtaatgaacgttttgggtcgatgacaaaaaagtttaacgtaaaaattcaaatagtattaaagaaggaagtaagacactagtcatcgcagatcgacatggcccttcaacaaggaagatggccggtgaacatggatatgtgtaaatgagcgagaaaagaaaacaagaacgaggcaaaaaccattgtcagaaagtgcacataactttatcatttacgctagtaacagtgtgctctatggaaggggaaagggtgtgcgacgctgacggagggggagggaaagctgcgtcggtggtacggtgagggagagcggcttcgacggtgggaggagagaaaggagctctggctaaggggagagcggtctcgatagaggggagatagttgttggtgactcggttgagaaggggagggagtgacagagatgggaatgggagggtgattttatatattttttttgtttcttcgggtgtttgtgagaagcattagagttctctgtaaaattcaaaaatatgaggattgaaatatgaaataattagggttgatatgtaaaactgaagataccactccagctactctccactaagataggaaaaggcaaattttgctacaagatattatgacttcgcggttttagctgtaggacaccgcgcgaaatgacttttatggaagacactttgaaaaattggatatttgctggtggatactgtgctcattaaaataataattttgagttgaggaggagataaaatttagagtaaagtccatcaccggtccctaaacttgtactactgtgtcatcccggtccctaaactcacaaatcgaccgttcaggtcctcaaacttgtttgactgtgtcatcccggtctctaaacttgcagatcactcgtttagatcctccaactagttcagttgtatcaccccagtccctaaacttggatttgaatatcatctaggtcaaataggacggtctaaagactttatatttaaaaataattcataacttttttatgtgaactctaatgaagacaaactttatatcaaacttgtagccctcagggctgcaggaat

SEQ ID NO: 63565 - DNA, 1049 bp, Oryza sativa
cgagtgatctgcaagtttagtgaccgggatgacacagttgaacaagtttgaggatctgaacggtcgatttacgagtttagagaccaggatgacacagtggtacaagtttaggggaccggtgatgaactttactctagaaattaagtgaaagttttaaaatgcccttggagccaccatatctcccatctctcttctctccgtccccttattccatactactatggtcgccgccgctcgtcgtcaaccacagaggtggcatggccgccgccttgtactccggcatcagccgcccagacatgaacctcaagccacacgcgttgcagagggtcttgggacccaggggacccgtcagcagctacgacgttttctccgacgcgcagtgcatgcaccgccacgtacacgccggcctccatgcccaccttcacccccgcggggccggggctcttcttgccgcggctgccgctggagccgttcagccttgtggccgacagctttttagaggacgggaagtcggacgacgggcgggacgatgacagcgacgactaaaatgtcggatgtgggccaagggtgtgccacgcagcggcggtcgcggccgtcgcgcatgacctcttgctatgcgcgccgcgcccaggcgctgccgtgagacagctgtcttgaccaggccagttgccgccaccgttgttggccgcggaagcaggcgccgctgccgccgccattgcggcatgtgcagacgactagtaatcgagctcggcagcttccttggtctgaacccatcaacacacacatccatcatcattgttcagctcaaaactgtttgatgggagatctgacgggtgggtttaaggacattttataactttcgcgtgatttttctcccctttccaaccgaaaattattattttaatggacgcggtatccaccaacaaagattcaacttttcatccaatttttcagagtgtcttcccccaaaattcattttgcacggtgtcgtacagctaaaaccgcgaagtcacgatatcctatagcaaattttggggctgcaggaattc

SEQ ID NO: 63566 - DNA, 2192 bp, Oryza sativa
ctaatagttgaacttaatgagtgagatttgtaggactgcaattggtgaactataggatagattagtccattatgtaataactggtctgacaaaaattattcaatcattcagttgtattaacattaggttgcatatatggattttttctgaactacctaaatattcctaccatacactgtttatagatggtgcaaagacttaggctgagttctttttagggtgcggtaaaagacttgaaaaatagattaatatgatttttcaaagcaactttgctatagaaactttttacaaacaacacaccatataacagtttggaaagcgtgagcgtagaaaagaacttagggtaaaagaatatatcattaggtagtgtttggttgcaaggaagggatggggtgggatgggatgaacccacttttaggggtgcttggtttaggggtaagtgggctggtatggtccctagagaggaatattcctctcagatcatgtaccaatcaatccagcaaaatcgaccggacgagttcgccctatctgggacgagcgcacggcatgagccggtgctttaccctgctcgcgccgtcatctgtccgcgttctgttgcccttcccgccaccctgctcgctccgtcgtccatccatgctcgctcgcccaactcgccgccctgctcgccctgcacggtgggcgatggatccaatgatgccgccctcgggagaacgggctcaagcggcggtagacggcttgggcgacggcggcggcggggggctcggcgatggatccggcaagggtgagtgcaacggcagtggcggcggtttgcggccacgtcatgctcctcctcccgcctggctatccccgagacggagctcctccgctcgttaggccattgtcacacatatccgaagtgagtgctcgtcgttgtccttcttgcaagcctgccctcgccgcaagcttgcttgcccgccggcccatctcgcgcgccgcccggtcattgatggtagctgcaaacgtatccatcccatatctccctcatcccttcaaccaaacaaaaaattgtaattgtactatcctacaaaccaaatatgtgagtggaatcatcccaactctaaaatcaagaatggttaatttcatcccatcccgcctagtccggaaaccaaacacatgtttattttgttcgtatagttagggcacccgcaatggttatctataggctctctacaagagatccatgtcagcatatttttctacttgaaagaaattaaatgaagagagagagcaaagctatctactaacctggagatagtctatagagaaaaacgaggtaatgcattagagagctatagatatccatgtagacatactattgagatggtttactattaatctaatctattgctgagatgtacatattttatagagagcaccttactttaccattgcgggtgcccttacatgggcaaaatcccgtataatttttgggatagaggttggaaattgtacacttatttcggcataacctaggtagttttcacgtagctaagaatagtatagactgtctgcagcagcgatggcacaacgatgaccgccgcagccgccacgagcgacacgaccacccatggcgacgggaaaaagtgaagcacaaagccgccacaccaccagctcaccttcctgctccggtggcacgccacggcatccaccatctccgcgtactcgtcggggaggcgcgcgccgacggtctcctccccgagctcgcggaagaaggccaccagctccgcgtccgtcttgcgcatgctcgacagcacgcctcgccgccggaggaacgccgcgtcctgcgggcaccggacgaggccctccatcctcgccacgtgagccgtcacgcacgcgccgtgcgcccagtggaagtgcttctcgaaggcgatcatgttgtgcagcacggtggcgctgtactcgtgcacgtcgaggcaggggatggtcatcaccgccacggggctcgccgtccggccccagaaccacatgtcgaggtcgccgcagctcgccgccgcgctccggaaccacaccgccgaccggcagagctccatggagctcgggaacagccgctccgactccttcttgatcttgagaagcttccgtggcgtcgacaggatgcagtacttgctcgtcggcacgcgcgaccagtgaaagaggtgtagcacgtgctggaa

SEQ ID NO: 63567 - DNA, 757 bp, Oryza sativa
gaattcctgcagccctttttttattttcaatccatggcaagcgaataagcaatataccccaaatcatgtacccatacccagtagacatgacaactaacaaaaagagctgaaagtattttatgaatgagatttttagcttatagtgatgacatgatattggtgtcagagtataggtgaggcatgcaggtgcagggggactttgggaggcatagaagcaagtcaacttgtaccaagcaaacaagcatgcatacgcagccctatatagaaacggagtggagtaggtacatcttacagctgcattagtacataatggactgactcatccctggtgcaatgtgcatacgtgtcagccatatgaggtgggtacatatgaaccttggttcacttggttcatattatgcagctcctatatacacctaggtgtatgtactccctctcccatctaccgtccatcacaactagcctctcgatgaagtttgttaccggatccaccaggcagaccccttttaatttttcacgagaaaaaattttgcgtagtaattggaaaacaggaacactcggagctcgcgtataaatacctctcgtcagcctagatcgataaaccaggtcatgagctgtgtgcgatatctacggactacttggagggaacaacggcgggatccatcagttggcgtctacagcgagtcggaggcgatggtgcgatacatcggcgcggcatcttctgccgtgccgtcatcgcaggatccctacaaaatgg

SEQ ID NO: 63568 - DNA, 1250 bp, Oryza sativa
acttgatccacgagcgtaggtcgtgcctctagagtggctatgaatccatgttcaacgactcccacattgagacgtttcaagctcctgctgcaattcctcggtgcatagggcattgcagtagcttttcctgcttaatgcatctaccaccacattggcttttcccggatggtaatgaatgctcatgtcataatctttgattagctccaaccatcttcgctgtcggagatttagatccagttgggtaaatatgtatttcagactcttgtggtccgtatacacttcacagcggttgccaatcagatagttcctctagatcttcaaagcatgaaccactactgccaattccaggtcatgagttggataattcccttcatgtggacgcaactgccacgaggcatatgcgaccactctgccctcttgcattagaacacatctaagcccgtggtgggatgcgtcgcaatagacttggaagtctttcatctggtcgggcagaatcagaactggggtggatactaatttcttcttgagctcctcaaaactcttgtcacactcagctgtccatttaatcttctcatctttcttaagcaactgagtcatgggtcgggcgatcctggagaagttttcgatgaatcggcggtaataacccacaagtccaagaaaactacgaatttgcgacacggtcttaggtggggtccacttggtaactgactccacattcgatggatcaactgccacaccttgagctgcaataacgtgacctagaaatttgacttcagacaaccagaagtcacacttgctgaacttggcgtataactggtgctccttcaacttctcgagtaacagacggagatgtagctcatgttcttcttcgaactttgaatagataagtatgtcgtcgatgaacaccacaacaaacttgtcgagaaattccatgaacacattgttcatcagattcatgaagaatgcaggtgcgttggtaagtccgaaagacataaccgtgcactcatatagcccgtaccgagtggtgaaggctgtctttggaatatcctcttcccgaattctcaactggtggtagcctgatagtaggtctatcttagaaaacactttagctcctttcagttgatcaaacaaatcatcgatccgcggtaaaggatatttgttcttgattgtgacctcgttgagtgcgcgatagtcgatgcacatcctcttcgtcttatcctttttctccacaaaaatgaccggtgcaccct

SEQ ID NO: 63569 - DNA, 7187 bp, Oryza sativa
aattcctgcagcccgaaactttaggggccaccggacattctggagactcgccacgaaggccctacaacccgttcctccaggggtgagcgtggggggagggccgcctcgtgaggaggaacctggcactctagatgaggaggaaccttcccccatgcgggcagctcgacgctcgtcccggcgtcgctcgatattgatctgagcgtcctgctccccgtagagaccgtcatgacgcctccggcttcccgaggctcccgacgacgttggagccgtggaccgccttgaggccatggccgactgacgggccctcctccttgctgacgaggagagggtaacgggggtacgcgacataccggtggcggcgggtcggccgcccgcggccaattgccgctgggcagtggtgaccaagttggccacgtcgtctagccagcgctgaacaggggtctccggctccgagttcacggggggatgccgcagaagggcgcccgccgcctgaagcgtgcctcggggtgagccgccatcaccgtaagtgaggcggcgccgtgccccgacgcgtcgtggcctctcttcgcccaggggcggggagagggccgaaccacctgaacgggtgggatcctccctccgcgagggttcgtggcggggaggagttggagagtcgcggcggtggtgacgagggccacggctctcgctagaatccccactcccagatggagtgggggtgaacgccaccgcctcctcctcctccaggacctcgaccatgatcgtcgagggcccagggaaacttggggcggaagaaaacgacttctccttaaaacgcgcgacttcctcctacctggcgcattagctgtcgccagctgtcgagggaagtccctcgatagcgggaggtcgtgaggaccccctttcgtgagttcggccgggggaagaagctcgtctcttggaaatctcgtatccgcccctagggctactagctagcttgcacacaatcgaattatacaggttcgggccggtgagaagcgtaataccctactcctgtgtttaggattatggttgagtgttacaagggttccttaactccggagagctcttgctcttcttctcctagaattcaggtctactcagcgttttccttcttctcggtgagcaaggtcctccttatatctcaaggggataccacatgcaccgcctctacctactcttctttcgggtggggacccaccctatcttgaccagaactcgacccgtgccttcgcctggaagctaagccacagcttgtcctcgagtggggcccagtgccgtccctcgcctgacacgggggacagccctgtcattcccccattaatggatgaagacttgtggtggccgccgtccgaatgaccctccgatgggacgggtcatacctacctccactccgccgggagcagacgcgacgtgggagcacggttgtcggtctagtcagacgtgaccgatgtcatgaccggtcacagaccggtcattcttgattatggcgcgtcagatgcgcacaccgcatgtctgcctcactacattaaatgcgacagggggcagttggggcgttgcacgcattaaaggaagctcagcctgggccccctcctcgctcgctccccccgccaaatggcggctgggtgagggcctcggggcgaagcggtgcaagggcccgaggggcatgacgtggcaccccgaggccccgaccccccctggccgctccagcggttcgcgggctacaggggcaggaccaggctgtagggacacgcggcaggataggaaggtagattccccacacttcgcatacccccggtcccatatctccgacagtagcccccggcaccatatcggacattggcctcctgaggtcggtctgacgtggtgcctcacgacttcccaagctagggttgcgggcccggcagggaatctaagggaatgctgccgagtggccaagttggcgtatcaaccacagcagcggtttggccgccactgaccgtgctgatgatgaggatgtttaagacacgaaaatcggggggtcggttagaccacgcctcgactccttcgctcgctactcatgcggtggtactggcgacggttcgcctaggttgcgcccgtgaccgttgcgtgccctacgccgagtgtgccgctgacgggtgcactaaatgcggggcgcggattcagtgggcgatgtgatgagtggacgcgggaaatgatgagacaaccgcgggcgcgagaatcgtggaggcaaccgtgagggcgtgaaacgaggaggcgagcgcaggcgaggtgaggataaaaggatacggaggcagggactttgcattcttcctttcgccaagtgctcacccgcctactcacccgcctactcgctctctaagccctaacattctcgccaattcacactactccgcgcgccaagcccttcgccgtttctccgccggccatcatggctcaagacgctggcgacacagtgctcccggcatcacgcattatggcggataggcaccttagcctcccccgcaagaccatgccggaaggcaccgtcgtgagggcgggggagttgcggccacggccgcgatatccggagggatctgtgcacctcttgtcctttgctatggtggggttgattccgccattcttcggattcttccacgaggttttggatttctatgaaatccatgccttgcatctcgcacccaatgctgtgatgacgctgcccatcttcgcacatctgtgcgagatgttcatcggggtgcggccgatgatgcggctgttccagtctttcttcatcccgcagctgctgcaaggtgcggtggtggggggatgttacttccagccccggccagccacggcggggcaatacatcgagagtcatctccgcaagaaatgagtggactggaggaaggactggttctacatcgcgctgccggaccacccgcgacttcggcttcccgctggccctcccgaacgatccgccgcatggctggcggtttcagagttgggcgaagagtacgacgcggtgcaggatcgcctcaggggcctgtgaagcctaggcctcacagcggcaatggtctttggcgattatttccgccgccgcatcgcgcctcttcaggatcgatcccgtggcgcatgggagtacactggtcctaacgaccccatgcgcacgcatgtgggtgagcgctgggaatggggggaggaggacgcgaagacggtgattcggcgggtgttgggtctagactccgccgagcaaacactgattccagacgggatccttcccctctgctgtgaccgcgatcgggagagcatcctggctgtgatgtcggccggcaggagccggtcctaccggggcggcgccggtggcagcgctgccggcgtgagtggcggtgacgcgaccgtatgcgggagtcggacaagcggacccggcgggggtggcagctccggggcacccggcccgagccacggacccagggacgactcggccagcgacctgaaagggaagcggaagatgcccaaatctcgaccgccctctcccccgcgtggagggggcgccgagcgtgtggcggaccgaccgccagcaggccacaagcgccccgtcgagcctgaggccggacggaagaagaagcggctccggaagataggtcaaacggagccgtgttgggggagcttcattgagcccctgaagtggactttcaaccgccctccccgcaggtaccactgccggcacccactacggtgctttttactcatctcggtctcttgttccttcctcttctttttcttcattaacgccatcggggttctcttgtagcgagattctttcccaggggatctcggggtccgaccctttgcaggggatgaaatccgaacgaatggagtggcccgggcttggccgatccagggccgtggggccttcacagcctctcggcggggcccacgggccgcacaccgggtccgaccccgggctaacctcagccgggactcgacccactgcgagcgatagcggcggtgacgtccctcccgggggcggctctgagaccgggatccatgcggagcgccactcgggatcggggggcgagggaggtcgcggctcggaagccgaggccggaggcggccttgagcccgaggtcgaggctgaaattgggggcgggcacgagcccgaggccgaggctgaatctacccgaggacccgaagcgggggccgagagggacggccgctcccccttgcacttgggacgccctcggggctggtcgcgcagaaggggggctgagagcagcccccagtctcgcgggggatccagcagcactctgtcgtcctggggacggaccgcggctttttcttctccgactccggcaagtatggagccgctcctgcaggtgctcgctgccgccgattccaccgtccgggaggggctcaatgccaatgttcaagccctggcggaagagcgagcggccctggaggcagagtgggcacagctcgctgcggaccgcgcgcgggttgacgagggacgcggcgccgtggacgacatggtgaaggtgggacgcaaaatgcgccaagcccaactagccgaaatccaagcgggactggccagaccgaggctatgacgaccgggggtcggggacggccgtgtgtaggcccttccgagcccccagggttcggcgcaacccggggcgcggcccgtgtttgggctccctttcgacggttttcaggtcgccccacggcacttacggttcggagtaagcacgaactatcatttgaaccaggacaagccagaggaaagagtgagaaaaaggggcgcataacggccttcacactaagtggaaaaatttattgcttggaaagggaaaaggatacacagtggtagcctccggccaagctcgcacaagccgaggtgttgtgcgggggttggcccgagctcctggaaagcaaaaaatctcgacgctatggatagaagcgacgaaggtgtttgatattccaggggttaggcaactccgtgccatcctccgtggttagtcgaacggagcctggccggggaacgccgatcactttgtatggcccttcccacattggcgagagcttgctcagccctagatgtgattgcacgcggcataggacgaggtcgccaacttgcagtgaccgggcccggacgtggcgctgatggtagcgccgcaggctttgttggtagcgcgcggcacgcagggccgcacgctttctccgttcttcaagatagtcgaggtcgtcgcggtgaagatcatcctggttggcctcattgtacagcgtgacgcgaggcgatcccagggaaagctccgaaagtaggatagcctcggcgccatacaccaggaaaaagggcgtttaccccgttgcgcggcttggagtggtgcgatttgcccacaacacggcgggcaattcctcgagccacgaatccccgtgtttcttcaggacattgtacgtcttggtcttgaggcctttgaggatttcggcgttggctcgctcgacttggccgttgctcctggggtgggcgggcgaggcaaagcacaatttgatgcccatgtcgtcgcaatagttgtcaaatagctcactggtgaactgggtgccgttatctgtaatgatgcggttgggcactccgaatcgggatgtgatgcccctgatgaacttgagggcggaatgcttgtcgatcttgacgaccgggtaagcttcgggccacttggtgaacttgtcgatggcaacgtataggtgctgatacccgcctcgagccgtcttgaatggtccaaggatgtctagcccccaaaccgcaaaaggccaagagagtgggatgagctgcaaggcttgggccggctggtgggtttgcttggcgtggaactggcatgccttgcaccgctggacccattcttgggcatcttgcaatgcagtcgactagtaaaaaccttgtcggaaggctttaccgaccaaagttcgtgaggccgaatgggccccgcactcaccctgatgggtgtcggctatgagctcgatgccttgctctcgagaaacacacttcaagagtatcccgttggcggcacgccggtagagggtcccttctatgaggacgtaccgcttggagatgcgcgcgagcttctcagcttctgcgcgatcctcaggaagagtattgccgtcgagatacgcccggatgtcagtcatccaaacgacctgatgaggggggtcggggtcgaccccctcgggccccgagggccgcgagtcgccaagggtcggggcagagggcgtgtcgtcggggtccctcgaggggttcggtcgcgccgatggctgcgcgagtctttcctcgaaggtccccggggggagtggggctcgtgccgatgcaacacgcgacaactcatcagcgactgtgttgtcgcgtcggggcacgtgccggagctcgagtctgtcgatgtgatgttccatgcgccgcacttcgcgacatatgcgtccatttgtgggtcggtgcactggtactctttggatacttgattcacgaccagctgggagtcacctaggaccaggagacggtggatgcccattctggccaccgccctcaatcccgcgaggagtccttcgtattccgccatgttgttcgtggctcggaagtcgagccaaatgacatacttgaggacgtccccgcttggcgatgtcagcgtgactctggcgcctgcaccttgaaggttgagggagccgtcgaaatgcataacccagtgcccgccatgaatgtcggcgtttgggtcctttacatctctggggaggaaggagacgttgggtggaacaggttcgtccactggggtccactccgcgatgaagttagctaggacctggcttttgatcgcgtgtcgtggtttgaagtgcaggtcgaactcagccagctcgatggcccactttacaacccgaccagtgccctcttggttgtgcaggatttggccgagagggtaggatgtcactacggaaacccgatgcgcttggaaatagtggcgtaatttccttgaggccattaaaactgcataaagcattttctgggcctgtgggtatcgggtcttcgcatctcggagtgcctcgctgacaaagtagacgggccgctgcacctttcggcggggccggtccgtgttgttaggggcaaatgatctggggcgcccttgctcaggggcctcgggggggggtctcgagtcatgttggga

SEQ ID NO: 63570 - DNA, 1428 bp, Oryza sativa
cgatgcacatccggagcttgccgttggcctgggggacgaccaccgggttcgccagccactccggatggataacctcgcagatgaagtcagcctccaagagccgcaccacttcctctcggatgaaggcctgtcgctctggggcttgatgtcgcactttttgccggatgggtcgcgcatccggccgcacggcgaggcagtgctcgatcacctccctggggaccccgggcatgtccgatggcttccatgtgaagacgttagaatttgcccgcaggaaggagacgagtgcgctttcctatttggcgtccagggttccaccaattttggcggtcttggacggatcatcgccaagggggatctccttgacgggcacctcattagccgaggtgaggcgcttcttggaggcacgggacgcggtggcctccggggcctgcggctccgtggccactgccaggttgtcggcgcgttgctccgcgcaggcgagggcgactttgacatcgccaaagacggtgatgggaacagcagggcctggcatcttcatctggaggtaggcgtagtggttggtggccatgaacttcactaacgtaggtctgcccaggaccgcgttgtagggcagattgaggtccgccacatcgaagtcgattcgctcggtgcggaagttggtggagtcaccgaatgttaccgggagctcgacgtgtgtctcggagtcacgccaatgatcagcagcgacgactggagcttcatccccggggccttgagcgcatcgaaggcggctggggagatgatgctcaggctggcccccccgtcaaccaggacacgcttcatcctgacgttgtgaatggtcggggagtgtcacgcccagaaattcccgaatagaattcccaagcagaatgtgcattaaaacccccatccaggaccggccgggctacacaaacgacaatgttgacatacagatccacgtcttacaaacattataaaagtcttacataaatgtagcggaaaaacaaaagataactggagctaagccttgacttgatctgcagcgggaacaccactccacaggtatcctcgacggcacggacgaagcctactcctcggagaaaccaccatcggacacatactcatactctagggttggggaaaatagagcaagactgagtactacccactgtactcagcaagtcataccggaataggggtatgatgcagggatttatcaatggatagctataaaggttcatttgcataacactggcatttataaacagaggtagaatgcgaaaatagttgtaataattaatcaatattaacctaccccccttaaacggaatctcgaccccgagattcggaggagctggcgaagaggtgcggatgggcggccttcaactcatcttccctttcccaggttgcttcctcctcagaatggtggct

SEQ ID NO: 63571 - DNA, 1826 bp, Oryza sativa
ttttaagtgcaaaataccccgttttaaaagttcaaagtatgttttaagacaagataaatagtccaatgatgtaaagtagttttatcccatcattttctaagatcactctagtatgattcactctccttttagatggagttgaaacattttgattggactttaactgtaagaggggtgaagctaaagatatagcctaattatttagatacgagtatgtctacatacataactaaaacataactaaaagttagatacgagtatgtctatatacataataaaagttagtatatatatctgaaaacgtataaggtgtaaaataaaacatattttatgttcacgttcataattaaaagttactatattatgaaaatgatatatggtgtgaaactgtgaaatgagacatattttcgtgtttagttttagtctggcggcaaaccgccgtgccggctcagtcgctgtaaacgcctataaaacctccaccatatcacacagcagctcacttgtctcgcttcctcctccgactcgcctcttcccaccaactccttccccgatggagtccctcctcgccgcctcttcctctctccccgcggccgccttctcgccgccgtcgtccctctcttcgacctcctcgtcgccgcacgccctacggtcggccgtcgccggagccgcccgcgcggtgcgctgctccgccgccaaggtgctcctcctctcgagccacccgtttcttgattctgcagctctggaaaatcgcgcgttcaccgccgtgccctgtttttcctattcgatcgatcgtttctgcgggttttgatggcatctggttttggtgcaggattcgatcctgtacgcgctggagcacgacgagatgtttaactcggcggaggtgatccagtgggagagcggcaagtccatcaactccatcgccgccgcgcagggcatccgcatccgccgccgctgccgcccacgctacccctccgagggctccggcgccgacaaagccgtcccccgcaacatgctcgagcagatcatctgggacaaagaggtcgaggtgtcccaggtaaactcgtctgcgccgcgcgtaaactgtttgaataaattcgcacacaagaataaccatttgttactgattggcatgcattttcggttactctgttcttgtgcagaggaaggcgaagaagccgctgcagaaggtgatcgagtcgagccagcacgcgccaccggccagggacttcgtcggcgcgctaacggcggcctacagccgcaacgtcgcgccggcgctgatcgccgaggtgaagaaggcgtcgccgagcagaggcgtgctccgggaggacttcaatccggtgagtttcagagagttttgcttgcatctctctttacgaaaattcatgtctgaaggttgattgcctggtttataatttaattgtctgaatactgtttcatgtgttgctaatcttttgaactgataacaggttgagatcgcgcaatcctatgagaagaacggcgcggcttgcctcagtatcctgaccgacgaaaaacactttcaggttggctgttcttctgttcttttttctaagaaagaaggtctcgccttctggtagctttcgacttcgtagttctcaaattcttatccttacaattattaatgtttttttttcgcatatatctgacttttcaaactctttgattcttcagggtagctttgagaatctcgagaccgttcgcaattccggagtaaaggtacgcgctagtattcaaaatgggcttcttcttttttaactttttcggaagaatattcttcagctgcagttgacagttgaaacatgtgcatt

SEQ ID NO: 63572 - DNA, 1521 bp, Oryza sativa
tgattagttgacctgtatatgtggtgttaatggatttttttttatttcaggttgttggtgaatctggtcttttcacgcctgatgatgttgcatacgtgcagaatgctggtgtttctgcagtaagtttactgattacccgttttcagctaagttggtcatacatgtgcttcaaatttccagctgaaatattgtacggaacgtctgaaatggattaagaatatctgtaattggacttaatatttatccacgatataacaaataacactaattctgggaaattttaataagctagtttcagaacaattttactatattctaatttagatgtaattgtagtcaaaattgcaacctttttcctcctcccaattttttttctggtactttgttgtcgtttgaattatggtgttttggaaaaattcattttcgtttagagacaacaaaagaaacactagaccgatggattgtgtttcctcctctcagatattaaattttgaattatgaatcttttgttactttattctgaaataaatccctgactttttttttgcacacatagattttggtaggagagtccctggtgaaacaggaaaatcccgggcaagccattgctggactatatggaaaggatcttttgcactgaataattgatacgcgcggtagttactgtgtgtaccaatatgggctggagaaaaaaaaaagtaaagcctacaagcctcaaatgtaattatgaataagggccatgctttctacaagtgtaatttcttttgttcacatttgtggatttttttttatttttttatactttttttaaaaaaatgaaaataaaccatctagaataatattatctatattttcagaaggaaaatatgtgttccaaatcattggtatgatttctattttttcgaaagtttgcagtgcaaccatttttgcacgaaagacacacgtaagcacacactatcacctacgcacatgacacttacaccagcgagtgcacctcctttaacgaaatgaagcaatggaggaataatgatgaattcatcaacctcgccaaattcctgatgaaatctcacacattaatgtaattatgcgaatcagaatttaaacccgcgactccattgtaatataatatgttttttttttttttgctcacagacagataatgtttcccaatgtgcagtgagacaccaaaattaaatataaaagtagcaatatcttttgtcgtataaaacagtattaatttttatatgcttaaataataccaaatctttgtcataataatatacatattctatttgagcccccaatgctggtgtactaggccagactgggagggaagcaaagacgagtggaagctggtctatctcgggccagtgtgcaaacgagagatgggggaattgggttgggccgaaagaagagtaaagaaagggaatggacgccgaatgcatactggcatttgataatctccccagatttattttgaagaggaagtttgagcatttcagtggatttttttgctctcaa

SEQ ID NO: 63573 - DNA, 8897 bp, Oryza sativa
aaagaaaatgtactcctgcttctgatgatattctgtaatgagtatattcttgcggttgcagtatactagattaaatttatattacttaataatgtgcgttgtacgtgcacttactagtacacttacaaaagagcgaacctgtttgattacacccagtcgatgcatacaaatactcgaactaacacaatcaatcaaatcatcaaatcgttcctttacttactttcagtcatattttctagtttaccatatacctaataactagttcatccatctttatcaatttggttgtaaatcgtccatcttttttgcaagagcatgatatcctttgtagttttgttccatgaaccttccaattcgcttacgagaaagttggttatctacaaaccagtctaaatcgggctagacgtcagtttgatctctaaatcgtctctgcttgtcggttctaatcttttctaagcccatcttaggttgcgttcggaatcccctcttcccaacatgcacaatacttacggaaaacagagcaatccattagcacgtgattaatcaagtattagctaatttttttcgaaaatggatcaatatgatttttttaagcaactttcatttttacagaaaacacaacgtttagcattttgaaaagcgtacgcgcagaatacgatggggatgcactactaggaaatcgggcttatgcaacggcaagaattgttgcaatatgcccaaaaccgttgcaataggtacaattgcaatggatttttgtcgttagggctcatggcgcaaaagtccgtagcaatatggtttttaccactggatcactttgtcgttgtaaataaaaactcctgttgcaactgaatgaaccgtggcaattaacagataaggcaacggttggttggtggtaatacaacatattgcaacaccagatgtcgttgtcgtaggaactagtcgcatcgcaccaaagcgtggtaataagtgctaatgtgtattgccacagacctcaaacgtggtaataggtcgacctttattgccatgctcacagtttggttgttatagatagatcccactattgccacgctacacatgtctctttgctataagcaggccccacctatcagtgactaaggtcgacgagcgcatagtggactaggtcctcgcatgcaccggccgtgggcgcaccatgtggcagccacatggcggccacggtggaccagcgtgggaggtggcaaaatccgagacctggcgaaattcgacctgaactcggactcagcggtctgactggccacgagcctctggttagaccggtcccacgaagaaaaccaggttcttttcaagctttggcaatgtgttcatatttcgagtctagatgtcaaattttagtggtaacactagtcttccacgtaaatcatataactatgtaaaagttgatgggaacatatgttgtgtacacagcttcgtgtacacatcctacacaccaactaacacatatgaccgaaaacttctgacgaaattttgtttttctccttggtctatgtatgatgattttgtaagatatgactttatgcgtagatgtaatactactatatgtactaattttttaagttttttttggtatttattagttggtgtgtaagtgaagacttgtatgcgtagaatatgttgtccatgtggaaaccaaataaaaatgaaatagttttgcatgatagaaatgtcgaaattacgaaatggccgataaattaaaatgaaaagcatccaaaagttgaactcgaagaggggaaaaattagggtactcccatgtacggtcaatattctttcggtgaaaaatgatgtatccatcgacaacgagtcacccgcgatgactttgttactctaaagatatgtcaacctagtgtttcactacgtgctcacaaggataggacgtgtatatgcacagcttgaatttgcgcgtgttataagcgtatatgtttcttactgttcaagaaaaatcatacaaattaaagcaatacaccttatgtgttgtgcatatctatctatctatctatctatctatctattatctatctatctatctatctatctatctatctatctatctatctatctattatatactaaaagtccattaatctttctataaacgctcctaaaccgccatgtggcgtccctacgaacgctcctaagtcgccacatggcattttataatctcaccgttgattttcatttaaattaaagggcccataattttagaccggtaaattagatctatttgcttcctgttaatatcccgtgcttatggttaaaactagcgtgcctacttatgatggaaaaagctacggaactgttcatttaaaaaatcaagaaccgtacgtaagtacgagaagaaaaactataaaaaaacctactaaaaaaataaaaacatgcttacgtatgtaaaagaactataacgcacttaaaatttatatgtatgcacatcagaagaaaaaattagaccatctttttaaaataagattttctatactataaaaacacgcaatatgttagaccattagattagcccgctttctcttaataaatactccctctgtttcacaatgtaaaattttctagcattgtccccattcatatagatgctaatgaatctagacacatatatgtttagattcattaatatctatatgaatatgggtaatgctggaaagttttacattgtgaaacggagaaactataacaaaattcgataacccggattatgttattgaattattgcatcaaggaccataatttataataatttaataatattagataatttaataattttgttttatattaattgttgaatactaaaagtccatatgaactttcttaaaacgctctcacactgccacatgccaatccataaaacgctctcaagctaccacgtgacgctaataaaatccatccctcaatttttacttaattcagtgggtccaatatttttagccgtccaacttaattgagattaaaataacctagcgccgccggaaccgcggctaagggccggacggagggaaacttccctagggagtcaccgtagtcatcctgctcttgctcgtatgtcccgccatggctgatgattaagggggtgtttagatttaggggtgtaaagttttggcgtgtcatatcgggtattatatagggtgtcgcatggggtgtttgggcactaataaaaaaactaattacaaaattcgttagtaaaccgcgagacgaatttataagtctaattattccgtcattagcaaatgtttactgtagcatcacattgtcaaatcatggagcaattaggcttaaaatattcgtctcgcaaattagtcgcaatatgtgcaattagttattttttttggccgatatttattatttcattcaggtgttcaaacatctgatgtgaacatggtgtaaagttttggcatagaatctaaacatggcctaattcaattttggcttttcaattttgttattcacatgtacgtaatgtacgtactactctgtcccagaaaaagataaactctagctacgaatctggacaaaacaccttacttttacttttgttgacatgttttctgaagaaaataagtctaccatattttcaaatgatgaagaatattacaaataattgcttataaatattatttaaatatgatataatataaagctaatgggtttggagaattataaaagcaattaatgccgatgaaaaaaaattatgaagaaatcgtggcataacacaaatatgatatactataaagctaatacgttagagaattataaaagcaattaaggccgatgaaaaaaaaatatagagaaatcgtggcaaatgtttgcttctataagtgtctcaaacttagcgtacgacacaagcccacgcgaatgcgtgggctatcttcagactcaatcacgcacgaaccgtacggacatacgagcgatgcaacaaacacatacatatgttgaaaaagatccgatccaggtaacacatatgtattaatttctcatatataactatatgtatatatgagatggtaacacatatgtatgtttggtagatcatttggtggccagcttgaaggagctgagttggtaggtggtcgccccgaccaagtcagccacaacggccacgtacaactccctcgtctttttgcgagagctagcagcatcgatgacaaccagatagttggacccctgcaccacctgctcctcggctgcgaccacgcggacgaactgcagcctgtcattggtccccagctggttgtgcttccccaccgcccacgcgccgacccgctgaatctgattgttgccggcaacgtcctcgatcacgttccacccgccgacccactgcgcgcggctggtggtggcaacggcagcaacggctgcgaggaggatgagcaggagcccggggtgtctcgccatgtcgattcgagaacgatttgggacttgggagcagctgatcagcaggctagggtgcagtggagacagctgggtcttggaagaacacttgtgctagatgagccatttatatagggctagttagcatatattaattctaatttatgggacatatcgaattttttttacagttcgtttgatgacatggtcaaatactatcagttccaaactcgacattttgtacaacacttggttgtagttgaaagctacggatcacgttggggacattcaacaactagtaggatctatatatacctttggcaattaacacgacatgtatggttgtggtttaaatactactctctccgttttatattataagttcgtttttagttaaacttttttaagtttgaacaggtttatagaaaaaatataataacatttttaatataaaataagcatataatcaaaatatgttaaaatttagttttaatgaaactaatttggcgttaaaacttaaaaaagtttcagtaagaaaaaaaatcaatgtggattgcaatatgaaacgaagtgagtataactttgcatagctcagcagcttagtttccttatagtagaaccagattaaattcctaaatttgatatgagtgctctcacatacggctaattatttttctagtggtcaacattgtcttctaggtgatcccaacatatactggccagccactcggaggcactcaacaaagggattgagagtctcttcgagacgtcatgtgtgtgtgcatccatagtggtgggtgtgattcttttttatggcatgtggtgatatggcttcaactttctctgtggtttaatatcattccgtctaaagagaatagggatggagattgtctattcacgataaacccgtcacctgcctctaagcacgaccccccatgggttgtgctcatgacgcatctccatcgagcccttcagcacagccccctacgggctgtactcggtgcacatcttcagcgagcccctgtggcatgaccctccatggacggtgtttggggcatatatatagtaagccccgaagcatggtttccatcggttgtgcttagggttcatcgtcggcgaatccccaagtcaggcccttctatgggctgtgctcggggcacatcttaagcaagtccccaagtcccccctccccccctcttgtgaactatgctcgaggtacatcctcagccagtccccaagccactgcctcctgtgcttggggctacactcgaacccaaagtgctcgaggagcaacaacgcatggaccccattaagcctcacattcggtgtgaaactacgtataccaacccaacatataatcaatacaacatgcgataacatagtgcatgctgaccatgcaataggcccaatggataccccttttgtccgtgtcttctagtccaaaggcacgtgtcgaagcaatgagcaaggaggcagaaaggagctactccacgtccctctagctcctctatgataagacagtcatacctaacccctatattggggtctatctataaaaaacaagccactgttgcatccgcttgtagctataaaaggaggaccaggaccatagaaaaaaaaggttatgattttcctgtttcattcatctaatttagattagaatcctagttgcaactcagtgaaaattagtacatcctctcccactcagaacaactccaaaaaccacactgtacacatcctctcagctagcgagaacacaggagtagggtaccatgcctcttagcggcccgaacctgtttaaatctctctcacacttttatctctcccttttttacttcgacttcatgctaaatcattggctccgttttgcacacccgtcgtagccgaatcccaaaggtggtgtcactcctccccagtataagagcttcatttctccgatagaggttttcgatttttcaaccatcgagcatgctttaagagtcatgctagcaggggcgaggaattaaactcaagaccggggtttgggtgcatgaaagatagacgcactagctgctgcatccgccttcgtttttttgtcatatatatacaagcttgcatatagaagttacatcgtacagtgcaggatcagtattgcgacaatttaattatactataattattaaaactatattatacttatgtttagttatgtttgaaatttatttgaaggattttatttgcatgtttttatttatggctctatcggccaagtttgaaaatatatactaacatgtcgctgcccgaaatcatttgaaacactgaaaaaatcttttcataatagatctcaaaatttgaaacgcatattatattatgtagacgatgccaaatactccatccatttcatatttcatattataagtcggttgacttttttgctagccaaaatttattaaatttgaccaagtttacagaaaaatttagtaacatctaaaatatcaaattagtttcattatatttaacattgaatatattctaataatctgtttgttttatgttaaaaatattactatatttttttataaatttggtcaaacttaaaaaagtttgactagaaaaaaattcgaacgatttataatatggaacggatggagtaaaaaggttatccacttttaagttatagatttggttgacgtctacaacttttttatttagagaatgtctcaatatgaggttatttggaaaattcaaaaaatcatttttcagaaaatgatttaagaacttgcaatgcatatttagagatgtaaacaatctcaaacaaataaattgtcaaaattttacagattgtggcgagaaatatgagtttgatatagagcacgtctttattcgacttcatctaagacacctacaaaccaacttgttttctcccatattacagacgtgttttctcactggtgaagtgtgttgattggctagcaaaggtccagccttgacctagcaagttatcacattttgcgtcggctttcgacacgtctatgatgtgattttagaaacacggttgtgtccaggatgctttcacatctgtatccattatctaaaaaatgacttatatccctggctaagtgtttacatttagaagtatacatgagtgaactggaaaacacttttggcaaataaattaattgaatgctatggttggagccccccttgcatatgaatcgatctcaccctagtcagaaacagaggcaagacggttgcagatttgcggtaaactaaaacacaacacttgaaactacgctgagtctgaccaattcgtcccttgcctatgccgctgtgcaaagccaacaatccagacaagtatccggattctaaatccactagccaataacttcacggtcaaatactttgactcagcaactaaatcaccgctgctagtttatgttctcttcttcacggtcaaatatttttattaggtacggtcaaatactttgcctgattaatccgtttcaagacatagattccctttgcttactgaccgtgaatagggatgtaagtgggtcaacccacatgtccatttatggtcaaatacatgataactcatggattttcgtgtcgtggcccggctgacggtatctagagatgcaagtgggtcgacctataaacttatttatagctcaaattaagaggtaacccgtgagtcaaacctgtaggttacccactaattttatctataagtcggttcgcggatcagcccgcttataccctggtccatgaaagatgcagtacagtttgcacattgcacacagttggcacaaggaacaaatgtgttgtggccaactaatccaaccaagaagtccaagcggacacaggaaggatggtatgatcaatctgtccaaataacagcgcgctggactaagattattttttttggaaaataatgtaggggagtatcttgcactgtatgtattaaaaattaattataaaaattacatatgtacattcatgagttgaggttttgtagccattgtgaaataagtggaaagtaactagcttttgctctatggatagccaagaaaagttatgctttaagcttgtctttactagtggagtagccagaaatttcttttttctgggtagtcctacttcgagctatatccatggcatcagggactccggtcagttgttcgggctaatggggtgtgtgcaaatgaaatttgaatgtttttcagtgaattagaaataatatttatagcaaacacttgatacaactagaaaggtagcccgcgctgatgcgcgggcatcttatttagtggtgtttaaaattttgttatgaatgtttatgtatatatgattttttttaaaaaaatttctcttctaaatatgtgtatatcaataatttgtttgggaatgttttgaaagttagtttcgatcattggacgtacggacgtgtgctaaaagggacatgtttctcgacatttgtctatacgcatgttggaccgatggggatgtca

SEQ ID NO: 63574 - DNA, 2938 bp, Oryza sativa
tttatactacatgtgtttctttttaaaaaaattagcatcttaatttaaacttttaagtaatattttttcttgtatactaaagatgtattaataatttttaggatatattaagttaagaaatttcatattaaaaaatatggtaatatgacttctttatctaattaaagacataattacatacttctatttgcttgtactacctccattcataaattgaaggattcaaattttatcctaagatataaaggattttaatactactcgtcccatccaaccatccattattcaatttttatccaacagtactctatctatcttctaactctgcacatacctcatatttaatgagtcttatttagagaggggaatcttagtatatttttttcattcttccttaattccaataaaattttaggattcaatataggatggacgtaataattaaaaagaacttcattcatatacggatttacggatttatttgtacgtttgtagattgatttagctttacatatttataggtaaatagacctcgtatatatgttgagagatacaattaagttagtagaagtcgttagatgtataatagtatgaagcaatgagtccaccatttttattaaaaaattatgaagtactgagtccaccatttttattaaaagattaaggtggatatttttagggataatttttaggattttcttttatccggtggttaatttaattgccgtaagggaaaaaaaaaaggaggtgagagccggtgggttcgtctcatctgtgaggagggaagtggatatgttcattgtacatacggattttgacggcctggtcgatcgataagttttatttttaagatatagatctaacattttaaaataaggtccacaggtttgggtaagatgatttctttttctcaaaattttttatattaagatatatggtgatttaggaatgtttataggaagctacgtggtagctcgagagaatttgtaggacatctaatgaacttttaatatataataatagataattcatgtcatattaattaatatatcaatcaataattaaataatttgtgtgtgcagtgtcctgataatctttttatgggttcaccactgaaaacaaagggtatatatccaagtgatgtcttgataattttatttttgagttcgcccctggaaattaagggtatatatatccgagttatgtattataatttttatataaaaatatatgtaccaagagattatttagctatctaattaatttttatactatgcatttggttgttagccagaaaattggaaagatggaaggggagggttagacggggagagagggagtacgtacatacatgtgcgcattacgtgaacttgtgttcggagagggggaacgtacagtttttttttggaagataaaatttaatggtgaaaattaataatctaataatttaaaatattgggtctaccgatttaaaggaaagtgtcacgtgacggtatagaagcatttgtaggagtgtcatgtggcggcttaggagtatttgtatgaagtttaatggacttttagtaaaaatacaccttgttccgatcacatataaattctccatttatcataacaactcattatcactattataaaagttgattacctattaatagatgaaattgcatatgtgcaaataaaataagcctaatatatcattaatgcactacttagctaagtctcatgtctcacttatttccaaatccatatataaatattctaaaagtatcactttctaccgactaataggataacaacctttaagttaaatatgaatgcctcgctaacgggtgatctattaccttgaaagttgggtacctcatcgatgtagctgtgtcccctcaagatcagcatgaagcacaattctaatgcataatttactataacatcctcatagagtactgtaacatacttgggtcacctcaatttagccatttttatgccacgtgatccaccaatttaaatagaaattgacagtgacattatatagtgccacataacgacctaagagcatttgtaggagcaccgcatagcaacttagaatttttttaggtagtttagtagactattagtatataatattattttcttgctgcggacagtactaccgaaactttatttccttttcaatcctactgttttttttaacagttactatgtatacatatgatctaatggtctaaacaggtgcaccaatttaaacaaaaatcgagagtgagactatacagtaccacgtggtggcctaggagcatttgtaagagctccatatggcgacttagaagtgtttgtaggatcacaatttttttttagaattacatagtacaacgcagacactcacaacgcatgcgcattcacccatatgaacacacgcacgcaaccctacccctaagagcatcttgggccggcaaattagatatataattttaaaataattttaaaagatgaacatttatagatggttgatttgatatttgatatttatattatagatctagtttaacactacatgcaatatatttcatctttatattgtagatagttctattttaaaggccatcgatttttttcagatggtactaagtacttatgttttaatttggctctatctttatagtaagtacgtgcatttgtttttgaaccggcaaatattatgtacatgagaaaggtgttacatatttaatagtataaaataaaaggtccactaatttgaaaatcaataacacatatagataaaataatgaatccatctcaatttaagtgaaaatcaacattaaaattagttcaactgcatgtgtatatttgtgggccaatatatttcaactttatattgtagatatttgctttttgatagtactaatcatgtatgttttattttggttgtcgtatggggctgcaggaa

SEQ ID NO: 63575 - DNA, 2304 bp, Oryza sativa
attcctgcagccccatctgccacgatttctctataattttttttcatcggccttaattgcttttataattctctaacctattagctttatagtatatcatatttgtgttatgccacgatttcttcataattttttttatcggcattaattgcttttataattctccaaacccattagctttatattatatcatatttaaataatatttataagtaattatttgtaatattcttcatcatttgaaaagatggtagacttattttcttcagaaaacatgtcaacaaaagtaaaactaaggtgttttgtccagattcgtagctagagtttgtctttttctgggacagagtagtacatacatgtgaataacaaaattgaaaaaccaaaagtgaattaggccatgtttagattctatgccaaaactttacaccatgttcacatcagatgtttgaacacctgaatgaaataataaatatcggccaaaacaataactaattgcacatattgcgattaatttgcgagacgaatcttttaagcctaattgctctatgatttgacaatgtggtgctacagtaaacatttgctaatgacggaataattagacttataaattcgttagtattcgtctcgcggtttactaacgaattttgtaattagtttttttattagtgcccaaacaccccatgcgacaccctatataatactcgatgtgacacgccaaaactttacacccctggatctaaacacccccttaatcatcagccatggcgggacatacgagcaatagcaggatgactacggtgacgccctagggaagcttccctccgtccggcccttagccgcagttccggcggcggtaggttattttaatctcaattaagttggacggctaaaaatattggacccactgaattaagtaaaaattgagggatggattttattagcgtcacgtggtagcttgaaagcattttatggattggcacgtggcagtgtgagagcattttaagaaagttcaaatggacttttagtattcaacaattaatataaaacaaaattattaaattatctaatattattaaattattataaattatggtccttgatgcaataattcaataacataatccgggttatcgaattttgttatagtttctccgtttcacaatgtaaaactttccagcattacccatattcatatagatattaatgaatctaaacatatatgtgtctagattcattagcatctatataaatgtggacaatgctagaaaattttacattgtgaaacagagggagtatttattaagagaaagcgggctaatctaatggtctaacatattgcgtgtttttatagtatagaaaatcttattttaaaaagatggtctaattttttctactgatgtgcatacatataaattttaagtgcgttatagttcttttacatacgtaagcatgtttttatttttttagtaggtttttttatagtttttcttctcgtacttacgtatgattcttgattttttaaatgaacagttccatagctttttccctcataagtaggcatgctagttttacccatatgcacgggatactaacagcaagcaaatagatctaatctaccggtctaaaattatgggcccactaatttaaatgaaaatcaacagtgagattataaaatgccatgtggcgacttaggagcgttcgtagggacgccacatggcggattaggagcgtttatagaaagattaatggacttttagtatataatagatagaagatagatagataatagatagatagatagataatagatagatagataatagaagatagatagatagatagatagatagatagatagatgactattgttccctgttagtggtgcgagaagatcatcaacaacaatgacgccgatgactcctaccagatgttgtggcgctctcctcgaccgaattgcatttcctgctcaagctgttgttgcagttccgcatatggcgttgttgcagtactccgaccagcacttctgctaccaccagtggtgcccaaccaccattgcggagggcggcaaactgatgagggccaacgggaagacgatgttggtaaaggccgccgctttccacaccttgccattgctctgtgccaccactcgtcgtcgcgttgcgctgccgcttgatgtgaaaggcttgcagccacatcaggttgctatcgctacccagctccctcgagctcttccgacacgtcaccccactatcacctatcaccaccctatcctgatatcctcaacctcccgacgccctacaacca

SEQ ID NO: 63576 - DNA, 3362 bp, Oryza sativa
  unsure (1)..(3362): unsure at all n locations
ctatagtgctataaaaaattctccaaatattgggccgtatagcctggccgagatattcgcaaacagtccagctaatgttctgtggtaatggcccggtggaccgatttatgcaatggagtcaagcaaataatctggccgttcattttctatcgggagtgactattcatttgtcgtcgggtgatttctagtaaaaaatcacccagattttttttacccttagatttacatccaacagactacaaaagaaaataaaaattatatatttacttacacaacatttttatcaaaattacagtacacttacatgtcatatcaactaaatttacaaatgtaattttagttatataggactgtaattttatattttaaagaaaaataaaaattacatatttacttacataacatttttatcaaaattaaagtgcacttatatgtcatatcaacagaatttacaaatgtaattttagttatataggactgtaattttgtattttattttttactttagtttcaaatgagagtgaggagagagaacaacgcacgtgccgattttttagagcaaataaaaaagagcgactttaaccgtccgacgacgctgttacacgcggcccaactgaatcctatgcgggtttcccagcccaatatatacgcacgaatcttggtacacatcgaatggccgaaaaaacgtcaaatctgagagaaaaaatcacacgacaaatctatagcaaaatcgttttctatcagacacggctgataatcatccaaatgaactgcacttttattctgcctttatgcccatgaatgcaggacaaccaacgtaaccaaacacccataaagtaatgtaaatgtgctccaagaaatttaaatggaactgcttaagttggttttaccgtcaaaacaacaatcacttccattgtgtttgtgctttgataaatgctgaggttcagataagacaagatcatgtgatagctgtgtttctgcaaaccatcatatcatgtctttttcagagataaatgtgggctccacccaagctaacaatacctggaaatacttggcaacggatcagcatccatctttaggccaattgcagaagcaaccctatggatatttctttagcccatcaccattgcaccaaaatatcatttcagagaagcacatgatgtaagcatttttttcagattatttttaccaagtattcagatgattttttagataatggatcaatagctgactctatatccaaaaaggatgcatagtcaagtattcagaagaatgactgtccaatctccaatgtattaaagataattactttttatgtctgtgataaactgtactacattcgtttaaaattaattgtttatctatatttgaccggtgcatcttgaatcaaaggaattaggaggaatttcataggatataaatccttttttttctatttggccctttgatataaagggttggagcttttcaaatcccgtgaaattcctacggaataacttattgcgtgtagattttaaagaaaacttagcaagatctccaacttttgaaaaaaaaaactcttttgagctatatcttttcatgtgattcccatgtttttttcagactaatcgagcgaccattcctgcgtttttttatgtaagtaatcctctgttttgtacttaaatccctatcaaaatcctgtgtttcaaagaagccctaaatttttaaaatttgtgtagtttaacaacatccaaattatatctattattctaaagctggcagtgcctgctgccatttgattggtccgattggaatcacatttatacgtcgacacatgtccagctaaaatgcttagtcgcgattcgtggggaagcagcgcgagcaccgagcaactgcaaagatggttggcaggctgtcgcaggcctaccgagtcgagcacctggatgcccaataaccacacatgcacatgaagcccagccaaatacgtgaatgctttttgtgtctatgcttgtgctatatataaaaatatttaatttagatgatcacaagattttattcacataccaaacttattggtgtgtatatattagttattatgcacactaggcttgtgcacacaattttctttttaaaaaccaaaattattgattcgtcaatcaattgataatttatttttcaaaatatcaaataacaaatacaagtaaatgtcacatcatgccaaacgtatatatgtgcgctcaccgttcatactatgtgctgccctcgcttacactcatttttaatttgtaatattaagggtacttgttttggtaacataaaaacatgagataacacatggaataattagtggccaatngttggtttgcataataagctgaataaaaacaaacaaggtaaaaaaaatatttgcctaaggaaaaaatggatttatcagcttttagcgaggctaaaaagaggtataggtgattcagaaaagaattggcattgggccacacaaaaacgctatatctggattcttattggacaacattagtactttcggctcaatttggagcacttaaaatgtaggagtttatagatcctgtttgcacagcgccatatctaagacaaaagttaaatttgaagtttgtatgataaataatagtgatttaaaattttatattttatctaggatgggaacaaaataattcatcgaaacgttatcgagataatcttaaatctgaagtagtgccaaacaaatgccataatatatacgggctaaaattagttagcgcgtcaacggacgcgcctattttctagtattataaaaatacttctaatgacgaatctgaaaatatgaatcttgtcatgttaaactatatgatttataaaatttgatcaaaaattaaaatgtttgagtgcaaaccctcttcaagtaatttcaaatggataataaggttcagtaatcagtgtactccttttcatcggtcaagctttcgtccctttttttttctactagttgagaagaaggtatcacttgtagtgaggtagattccatttccaaagcctgaaaccgcaatcttgatttatcatctggacggtgacctttcaagaaaaacacccgatcagatcctaaatacctctgaactacaaagtttatccaattcattacatatcaaacagcagagagatcgaatctacatccctcgtacagctcggttacatgtggatccgatgaagatttacataaaaaatattacccatggtccgggtatccatggatacccgacccgatgagcacgggcgtgggagtgactttttacctatgggctcatccgcccaagacccgaagacgtcatgggcaataggcgggtttcattttttacccatggggctgcaggaat

SEQ ID NO: 63577 - DNA, 765 bp, Oryza sativa
taccatttctcttggttcatttgtgatgctaacggatactaagttgtgatcaacttgtgatgtaattcaaattattgttgataaccgataatttggtaagttattgattttatttctctttgttaaattacatatctttcaagttattattcatgtgagatccatagggtacccactggatatactcgcgcccgccgggcatgggtacgggcatggagttttgcccgctaactctagtaggcagtgttcgggtgggcaatgtcgggcatggttttgctctacccgtgtctgacccgacccattgccatccctacacttgacactacaaaattaacctatcagtcacatggaggcaaagcctgaagctaataaacattcagacttcgtgggctattaatatttctggggtcctcttcagagtaagttcagagcgagcaacaagaaggaaggcgatcagctcgttcttcttctccctctcctccagcgacggccatggcgagattaggtcttgccgtgtgcgccgttccttccacctctgccttcttctgtcgtcgacctcctcgctccggctaaaccccacgacggaggacacagccaaccatggcagaagaactgcttatcacttccagctgcaaagaactggcagaatggtaatcaaggactaatctttttgattaatcgcttgatccagttacggattcctgctgattagccaaactaatcccttttcctgtctgatcggtgccgaactctgcgggccgcagg

SEQ ID NO: 63578 - DNA, 6115 bp, Oryza sativa
atgcttatccactctactaaagaggtctggatacaacttactcaaaatctcaaaagatggatgtcctaactaacagtgaagcaaactgatctccttctcaacatctccaaccaccgcagctagtcccagttcctcatgattgatgtaccacaacccatcacgcctgactccagtcccaatcctcctcccagtccccttctcctggaacagacaagaattctcatcaaatacaacaatgcacttgagttgatcaatagccgagctaattgagagaaggttaactggaaaggaaggaacatgcagaacagaagacaagttcattgatgatgtgcactctaccgaccctataccatgaataggcttggatgtaccatcagcgatttggatagtttcagagtggatataaggggtgtatgatgtgaaagtattatgcaatcctgtgacatgctttgatgctcctgagtctatgatccaatctataggatgtctatatgtagatgcaagtgcctgtgcctgagtaccttcgcccacttgggcgtagttggcgaagttaccaaagtgagtggtggtgttagagctctcattggtcttgttcttctgccattcctcccattgtgtcacttgttcacctattagggtaacagctttcccatcctccttaactgcattggcctgaggaacacctctgcccctaccacgacctccaacacgacctccacgatcacctcctctaccaccacgatttcccccaaaaacaccacggtctcctctaaatccaccacgagttccaccatgccctcctcgaatcgatcccctaccaccaatgttccgggaagtgggacaattgtagctcacatgacccacttgcccacaattgtagcattccctattatcagctgcaatgtatgctgatcttataggatttgtacctctcatcaacctcaatctcatctcttcttgcaccattgctgaaatggcctcttccatagtgggcaatgtagcttggtggaacatagctgctctcctatcctcaaactccttgttcaaccccttcaagaaatgaatgactcttcgcctctgcagccatttatttccaatcacaatgtcatcctcatgtttcaattgtaggggatcatagtgatcaagatctgcccataactgttgcagctcgctagcgtactcttggactgttctcccctcttgcttcaaattctccactttgttctgagcctcaaccatcatcattacatttccctctcctgaatacatgttgctcagcgtcttccatacaactgcagcattctggatagcttctatcatcctgccaatagaaggagccaccgaggtcatcagccaagataccacagtggaatttgtagtattccacgtcctccatgcttggctctccttatcagaaggttcttcacaactctctagtaaaaaatgatccaccccttttgctctcaacatcagttgggctctcctacaccaactcaaataatttttgctcccctccaacctcaactcatttggcatcaattctagtttcacttcgaatccccctgctacactcttcggacctatcatgcccatcttcaacaaattctctagcaaatctttcatatcacccttagtaaccaccgaggaggcatctacaacctcctttccaacccctgaagacatttcccctccccctttctaagcttccttagtcctcacctgctactgctctctgctcctgtaatttttcagcacacaagacactaccaacagcaagcaacagcggccagccggctcacctggtcgcagctccgccaccactcctgcgccgtcgcccccacgccacggtcgcgcgaccggccgaccaccccggcacgccgctcagcagctgtcgccgtaggtcgcgccgccacctcgcgagtcccagcggtcgcctccacaccgtcttccacttcgtcctgctccggcacgagcgccgccgccggctagggttttgccgccgctggtcgccaggagctcggctctgataccatattgttcaatttggggaatttttctagggttagcctactcagctcaccccttcctcatgtattctattagcataacactttacagataggtccttggtacaatacatatttacaccaacaaacaccaatttagctaacgggcccacactgttagttagtctctgtttgtcactgagatgcaattgatagtacagtggcaaggtctgtgtgattttaactctgaaatccaatgttcagtcctcaacacgttcataatttttacttaaaaacaatatttggccgacgtttccccttcaaatctcttttttttttctttagtctgtctgtcactggcacaggcactcacacgcacacggcgtgaacagctttcacctcatcatgcaaactcatgcaatgcaggaggagcaggacgaagacgaccagagctttgcttgatctgcacttatcctccaatgccctttttctctcatcagtactaggctgaagattatgctccagctgcatgcctgcctgcatctgcatggcatcataaagcagagctactagctgtagcaacactgagtatccagcccaggggacaaaatgcttggcactgtcatgctctgtcagaatcccaatgtgagacacttgcttgtgctggacttaacctcgtagtgatgcttgttttggcctggctttagcttgtggaatattatatgcagagcaaaagtgaatgacacctaatcaacagcttgtttcaggttctttcaggagatcaaaaccagttagtttgcagttcaagggggttctcacttctgaacttgcaatgtcttcttttcacttcttatttttcttcatttcatttcatatctagtgttaagtgttaacgatggttggttctattctacaactcaattacatcaaaaaaaaaaaagttcacactactgtaaggacaatttcattatctctgtggccaaaagttacaagatacgcgcccgaatcaaaatttccatcgcaacacacggacacaatgcttgcaatcaagaaaatacgtcgatttgacgtgagaaaaaggtgtcttcagaaatgatgcggccttgcaacactatcatagagcatgagaagatgaaattttcacttttcaagcatctagtaaaggagctctttcggctcagttgcttggtctctcctttacctggcttctctactcactcctatcatcctatcagcatatatagcgcataccttactgcacaggtcttttctgctatggatggctcacttgcattcaatctcaagtgccaatacctactccaatccgggtgcatatcacatagccctttttttttatcaccttgggctcgtgcaattgtgcggtctttcaggaagtaccacatactagagattatttcaggaagccaaacttagtcacttcccttgtttaaaaaaactgtatatatccggttggatgtaaaggctgagtaaaaatacccttctctaaaaaaaaaaggagatactatcgggaggtatcaaaatttataatactccctttgtttcaaattacttgttattatagatttgtcctaagtcaaacacatttatctctaaccatcaattttttgaaatattgtcttataacgtcaagtgaattattgtaaaagtatttcttatggtgaatctaaaagcataaattttattatgacaaactatataaatttctagaagttgatcattatgttaacatttcatacaagtcaagtccatggatcaccaacctacccacctctctgcatttcatgtcattgcgttgtgcatgtgcattcaaaggatccagatacgattaggtgataacatcttggacagcttctgtgtaccaaattcaattccactccccatgaatgaacccatgatgatcaagacaagagcaatgcagctagtgctttctaggtaagctgtactgcaggtgacaaccctgctgatggttacttaaccaaaaacatgcagcacatcaattatctgatgtcctaaattaacaaatttcgttagatggagctttctccttcgatcggatcgaccaaaccgaaaggaataatcaatcacccgtgcgtggacaggcacacgtggatggtggcttcaatcagatgatttctttttgcacgctttggattttgatttgtctctctcatatggaagcaaacgatgcatggtggattccttgttcgtacgtagtggtcttcttgtgcatcatgaaaggggaggactagctaactgatgcataaatttggtgaaaataattcaattttttttctccatttgtcctttcttttggaaaaacaaatcgtttcagcactggtgaagtataagtgaattgtccgtcttttctcattagtttaagcttctgggttaaattgattagtagtttaagctttttggcaactcaatagacgcaacatttgaaatacaattttgataattaattctcttgatatgagaatatgtataccatgatatgatatcatgttcagtacggtgcattgaaaaccagtgctaagtcctgtctctgtcagcaaaattatttttctgctctaactgaatttcagagaattcaggtcgacattcattgctggagcgaagatgtgagtaactcctgatctccgattcgatcgggcgaacgccattgcagtcttgcattgaaggagaagtcctttcagtctgttgagccgccatgacaacttgacgagcgatcttaagtatgcactggacgcgagctgttcctccccctttgttcaggtttgccaaaaaaaatgtaacagacttgccaacgttacttagttacttttttttaacttagctacagatttgctattttgaagaacagaacaccccccccccctcctctctctctctctcaagcaacctgttgattgcttttttttaaacaagtacaaaagaaattgaaagaaggattgctgatttttagccaggacagatgagcttggtttgcactttgtagttttcattgtaattctcccatttgcatgttctgttttttctgaacaacaattgtatcttgtgttagttttgtgttgaactgaaatcttcagtttgcgacctgaatcaattagaaaaattatggaagtgaagtcgaaaatgcctatatggaccatcccatacaagcccaaggccatctagcagaacatcagagtgccacattgtgaaaatctgctaaaatatttggcccatttggaagaaaggaaatttcacctgaaactattcatgtaaaaaaaaacgagaaaaaaaatctctgaactttcaaaatccttttagccttctcctccttccactccagtgtgtcagcgtcagtaaaaagcatagtgaaagtcatcttcctggattgatccccggccattgctgtcatagaacactggttacagatggtctcttctgacaatctgatatggttgtactgtaagatttgttctctttttttcttcttcactcggctattaatttgtcattttatttggaatttggatcaaggaaaggaggaggaagaaatcactgtcggtttcaaggtgctgtgtcgtgtactaatcgacaaatgaacagtcgcaaatgctggccagattcagtcaggcacagccaagcgatggaatcctaaaacaaaattctgcatctagtagtatctattcatttctgcaatttgatcaaccaaaatatgcacatctagtagatctgaaaatatacaggaggttggttgaatgatattgtacatgaagaacacttggaccaaaccaatataaagaatatgagaatatagatggctatcatagagaacacctggatctaatacttgactatgaaaagaaatattctatcaaggtttctaacacattaaaatccatcgtagtagccaccaaatgatatgcttgcccttgtggatgcacctcccattactgttgacacagcttgattcagtctcgaggcttgctgcacaacctgctgaattctctgcagttcagacaggcaaaatcgtcaggagcagttggaattttcccctaccgactggtgatttagcctacacattatcatcattccacttg

SEQ ID NO: 63579 - DNA, 8364 bp, Oryza sativa
ccttttcagtcgacttacgaaaaatgtttccaaaatacaggtccaatatacaagtcaatttgacacagcactggttagtagactggtaacactgtgtagatgataagaaaaggacttgataaacgaaataaacaggaactgatgaaggatagtgacacacaccacttaaacacggcaggcataggataatcagacacatgttcagaaacttctacagaaattttactctggaaagctcagatgagaccatagatagaacccacaattttatagaagcagatttatgaacagggcacgcactcacaaatctccagtaaacaatagattcacatacaaaaggagcatcttccagaaacattttgttagcttcttataaacggtgatgtacatataacaatcacagtaaataaggcatgagtcggcggccccagcttcaggctggtgcagacaacgaccaagttaagagttcttcaaaggttaacactgtaatgattcatacagcagcaggagcaacaaaaattcatctaaaggctactcaaactggcaccacacatctcaaatttacagtagttatcttgacaacaagattaggcattgcatccgcaacgcaaaaggtattcctagtatacaacaaggtgaggccctcagaatttacatgaccatgaggttcccacatgcctgaatggcgcaacaaagcaactatcatatatagctggatgcggaagcaagattaaataactttggatcacatgtgcagctacactaaacaaacagccccgaaaaggttaagcacttaagcttgccgtgaggatgatgattcacccagtgaaacagaagtaaacgaggaagcccaagctcgagcattgcttgcgcctttcctaaggtcccttgtcttattgctcagtctaagcttgctacaaagcctcttcacatcaagtacattcagcgctcgttccaacagttggcttgatcccctacggatccctaagttcaagttctgaacacgcacgaccaagaacgttttcagatgggagacgacgatggggacgaaatgcgctgcaaccttcaggatgataaaaagcaccgcaagcaacacaaatggctcatcttttgcaattttacgcagagatcggtcccctggtgtgactggtctgaaatctccagtactgtcttgatgatcgacatcaaaatatgcaattggatcgaagcctgcaatataaataatttacttcaagaaatgctctgaagcaacaaaggcaacccaaaaaaatctaatcatcaatagcatatccctgtttagttgattggacaatggaatcgattctatacaattaatggttgtctgcattcacaagcatcaatatttcatactaaaaaggttcgaaagattaaaacattatagtaagatggagatcctggtgtgtaatatcgagaaagcatcatggcaatcctaacaggtgcagctaattaccagcgagggaactgtatagtttccaaactaaatagcacccaaaggctatgttctcatttctgggtttaatatatttgaaagttgttacgattcttgtatgcaggaaaagaagagcaatgcttgtacctgtagtttctttatagaagtccaccagagagctgagatcttttgggccccagtatcgtaccattgtagtctcatttacaagaagaatggccgggaatccacggacaccatatcttgaaaacaaactacaataagcagaaacagcataataagcagacgagtcgacttaaaagggggcatgatgcctcacttaaagagacatatagacaacataggagtcaacatttacatacctaggcattgcagatgattcttcaacagtaaagtgatatatctgagggaacatagtgctgagagcttcaaatattggccggaacttgcttgaaaatggacaccaagcagcatagaagagaacggagtacgtaacacctctgtggcgaaggttcaactctttagcaatagcctctcctctcaccttcagtaagaaaaatgcataagttatttacagataaacaataactacaatccagaggtttgcaaactttgcaatacggactatcgagcattatttacagtgccagcctggaagggtatttaattaccattgctagataatcaaatggggacaaactcttcagttaagaaaaaaaaatatcaatagtgactgacattaaagttggtttagagatatcctgaggaacattaatatggtcaacacacattgcacaattcatcaattttaaagactacccataagaaatttggaaatgcaggataatgccaaatttgccctagactgcatattgaaaagcaacaaatctacaagatatccttcaaacacgttgaggaagcgccttcacaagaaatacagcacatagcaacactccaacaagatatttaacattttctaagctttggggcatccagtcagcctaatgttattcacccggaacatgaaatgacaccacataacttggcccgggatcgtcgtctccgtcccaggaacaattgttaaaacctttcaaagtagcatacaatattccttgatctcattcctcaacccatcgatctgggaactttagtgaatttatatttcgtaactatgttaacatcatcatctcaatagctacttcctcctatgtctgcctttccaatcttacataagacactgaaaatccctcctgagtcctgcccgcccgtttcacctatgatgtagtccctccctaccgctagcacctgggcgccttgaatgtcgtttgcgctgccaatcattgttttgttaccttccctcaatcaattcccccgttaatcactaattgttggcaacaaacaaacgcacatatgcacaaattaatggtgcaatatatttctaaccacaaatcgcacatctatccggtggtttgataacggatacacacaatacgccactgtcgtttgcccgcattttgacaagtagatattccacacgaagaggaacacgcgcagatactcgctgcttctagaacaacatgggataattgaattgacaagctatctgccggagaggaggtggggattggggaacacctacctctacaggcggggatggctcgatccggatgcaggggcagcgcgacgcgagcgcgtcgacgaaacccgggcccctccgcgcgcaggtcgacggggcctcctcctcctccccaccccccgccgccgccgcgccggcgacgaggagcacggccgcgacggcggcgacgacggcgcagcgcgtcatagcctctctctctctcctcgggaagggtgggtggtggtggatttggatttggatttgctcgtttttcttttttccctttttttctccttttttttgcgagatgagctaattttgggaggccgtgcgggtctatagtggttagtggttgtggtgggccacgtgtggcgcgacggttcgcctggctggcatcgtcgcgtgccgaccggggggtggcggggcccgcatgtcagtggctgtaggtcggtttgttacggtggatatggacgaccgacgggcgttctaatcttggtttgtgatctgttgtaatcatcctacgtggctgtatttggaaaaaatctgataccgtgggctgatttttcgcttgtttcggttcttgtttctgcatgggcctgttgttatcattgtactgttttttttttcagttcttttcattgtgtttttttttattggatgggatttaggagagagcttaacaaatgggatagatattcaaaatttcaaaagaaaagggagagatattcaaagtgtaaaatgagataacacacaatagtgttaataacgatatattgagcgtagcacaatatgttaaatttatagtgatacagcctgttcacggattagttttaaacttgacacgcgtgtgctcgtatttactgctaattattctttcagtaataaacgatgtatctatcaatagcaaaaatccttctgataaattcgtgaattttgaaaagaaaaaaaaaggtaatcacatgtgcctcaacgtgggcctaaagtaagtccacacagaatacatgggcctaaattaagcccatattctaggagcggcccagtccacgcccacagcccaacctgcacatgcagctcaccattctcctccgcctcctcgccgccagcccgccacctgcgaactcccccactcccggctgcccgccgccgcgatgcagatcctccggcggaaacttctggaagcttcccgccgcctccccttctacttcccctccgcgcccaccgcccactaccgcggccacgcccatgccgtcgccaccctcgccgccgtcctgcgggaccagaccgccggctccctcgccgccgccccgtgggccgccatccagcgccgcggcgcgaagatgctcggctccgaagtaattccctatctccttggatctgtttacgtatacctgtctccagggtttatttagggttctaagctagttgcaaatatctgctctggttgccccgttacggttagctcgtttcaaatttgtgggaggaactggtttggtaacgtagtagttcattgttgatgtgtttttggataatcaactcagttgaggccactagaaactcttttttaacgattatgcaggatgtaatttggtctagcatctgttggtttcctctaaacttcttgttaggctttttaaatgtgttaatggtatgtgcttttaacaaattcgtcgacgcagtcatgcattcactatgtttacactaagtggtactgttgcagtgttgctgagtatgtgcttttaacaaattcgtcgacgcagtcatgcattcactatgtttacactaagtggtactgttgcagtgttgctgccgttggtgcaggacttggacataattatgcataattcatgaattatctctctctctctctccctctctcacgcataatgatgcttacattaattaattcagggctttcttcatttgtaggtgaagcttggaaacgtaatacagagaagaggtgtgtgtgtttacatgtagttatgttttatttttgccttcaagtattgtggattactacttatcccatccctttggtcaaccttcaaggtcgcatttatcaggtatgcccatttgctatttgggttctgcatgagttttgtggtttatactttatgctcatgtatcttataagaacaagcaatctattatttcttttcttaacttgcttgtgctttggcaggtgataaaagcacaacattcacatcaaggtagaggaggagccactatacaggttttcatctcgttttgttcttttagttttttgcagcacacaacaccgtatagttcagcatcaaaataataagtaacaagtaacaagtaacagccaaaatagttaattttagagcacccctttttttaataacagaatattgcaaagctaatcaaataacaaaatatggatatcttattatactcccgatcatattttttcttcaattctttgatgctgcaggtggaattgagggatgttgacactggcaacaaaataactgaaagatttcgtaccgatgaggctcttgagagtatgaacatctttaaaaccaagacatatatgccttctatttttcagactaattttccttttacgatcatatcatatattacctgttcttgagatattctagcgtgattttaaacgttaatctctttatatttctatctacagatctaactatcaaagcaatacattcttctgaagtgttattacattacattcatgtgtcaagctaattttaggcagtcacagctcatttagagtgttaaacatataaattgtaatcatgctttttttgataggcattacatattttttctccaaaacattcaggagtttttgttgaggagaagtcattcacatatctttatcaggaaggagacaatgtgactcttatggagtacgtttatttcctgttatcctatcattaaacagttgacatgctatacagtgattatctgagtatttactttacttcatttaaccatgatttcacctgaaacctttgttgtcaggcctgaaacgtttgagcaacttgaggtctcaaaggaactgtttggcaaaactgcagcatatctgaaaggtaaagattaacaatattaatctacgacaagcaggaacactggttgtcacaagtctaaatgctaaaatatgcttatggtttcgcttctgtatggcgaggttgtatttttcacttttatcgaaggcatcacctaggggatgccttggtgcagcaaggtcatgatgaccatattaccttgttttatgaggcagacctagtgtgagaaagcggcagtttcgtgacaagtagtccttgtttgttgtgactgtcgttgctcctcgccgcactgcttttggcatttactgttgtcataaactcataatcaaccagactgggcatgagggagcgatggaaagaggtagagatggaagggttgagacttgagaggagggagggggttagctgccttgtatcacaaggtttcgtaatttatctttgtcagtggtggttcacgatgcgttttgtcatgtcatgacatcatacccaatttcctcacttacaacagatgaaatgaaggtgactctgcagtactttgatggccgacctatgtctgcatcagtgcctccacgcgtgacttgcacggttgttgaagcacaacctcattcaaaagggataactgcacagcctcagtgagtctcacatgatcattttcgtttctatttttactgtaatgtttgtttctaatgttcttatgacttttgggttaactgttgctcttactaccttttacgactttgatactagattgttttgatatgctgatgctggtcactgttcacagtttgtggatcaaaatagccattttgcgaaattcagagataaggctagtattatatactaaaaggtttttctttgctattcacagtttatgcctgatggattaggtcattagggtgttaagacttaatttggcatggcttgaggcctattgtttatgagctgcgcaatgaatactgatatcatggggtaggcctttggcattttagtaggcctttttatataaccgacgagctatttgctgttacatgtatatgtatagctttgtagttaccttctagcattgatccattagattgcaaggtccatttgtccaatacttgtgagctgtctcattaagggacgggcttaggtccatttgtccaatacttgtgagctgtctcattaagggacgggctttgaaggaggcttggcttagctcagctcatttaacaactgagccaagctggttcacagcttgtaaggctcaggcttgtttccccagcactatctgtgacatgcgaggctgcggaactgtatctgtcattctatgcactacacacaaagactttttttttttgctattatgagcttcataatctttcgtcaccagatgtttgaggctatgttatgcgggtaactaagctcattttgcactgcagatataaaagggtattgctggataatggtcttacagtgcttgtaagttgatgcgccatttcctagattttattgacctatccttttatataaatgttgaagtacatctaagaatggttgctgtatgtgctatcactttgatatccttttatttgtggcaatgtgtggaaaatggcatttgcagcatacatatgtctctgattgagttactgaaaatcaactctgttttgttctacatctgacttactcaaaagttgggatacacgtgccactactgaaatcaaccttgcttttgccgtgaaataatttactggttacatatagattagtactgaaaattagaaaacattgatgagtctgctgctttgaaatagttcttacttcctgttgcccttctgcgattatcttaggtaccaccctttgtagaagccggtgagaaaattgttgttagtactgcagatgattcatatatgacgaggtaagttctgagagcatcatttgcatattttggcatttcagttacataaactatatacttcggtatttgtttttttttatgaatcttgcattgatgactttgatggccatgtgcatactggtagttaaattcttgacaactttattgaaacaattttgcatttcagggcctgagggcaatacctggtagatggtgttattactccaaatttggttctcagcttgcattttcttgggtaaattttcaaccgccttgttgtagaaagacatcacctagcttcattaataattcagtattcaacaagttctgttctcatagattcttcttttca

SEQ ID NO: 63580 - DNA, 3933 bp, Oryza sativa
ggacataatcctggaaatagaaggtcttctcgatgaagttggcgagccagcgggaggcggcgaagctctctggacacccgacatcaccgccgtctccttgccggcggcgaggaacccgacgacggcgaccgccgccacctgcaaggtgatctccagagccctcatccccttcagtgcagctctacaactggtgcactgcatgacatgcgaccaatacctgttgtttgtggtatccaaacaagtattcatgttagatgatcactgagagttctctccaagagctgaagattgattgcgtgaagatcagtagacagcttgtttacctctccaagagctgatctctggtaggagtttgtggcagctgctgtttaactgttggatttgggtttgcccagccaatctgatggttgcagtactttctaaaccagtttctgtaggcgatgaccaagttgtcagatgatgttggcacatagcaagctttgtgccagttatcaagcccaactgttgtgatattgcggtcctgggaaaatgattaattaattattcgtgttaagaatgacaaaaggagagaatgggctaattaattaattgcacctgttaaatcagcctacagatagcctgaaaaaaatcatttggtttgagcagaagagaccaaatatttcacctcaacatggaggtacgtatccgaatccaagatggtattcgacgtcatatggtagaaccaacgtggtaggatcttgtcgagccatcctccgactttatacctggatgcccagatgaacctgctccttcccggagccaccgggacggtgaacaacaccaccctcacctcgggcttcttcttcttcttcttcttcacctcgtcagcctgcatcatcagagtataaacctcttaacaagttcaggaatataacgcacatctaagttagctttcaatactccctctatcccaaaatataatagattttagagaaatgcgacgcatcataatactatgaatctatgaatctggacagtctactatgatgcctcacatttctgagcatgtccaaatttatggtactagaatgcgtcacatactcacatccctccaaaatcacttgtattataggacggaaagagtatagaacaatttagtgcgatcatagatgtgccgttgatttctatttatttgagctagcgtgtgctaaggaatgtattcgccggtgccttgagtgtattataagcctatgttctttgtcctgggttcccaacctctctccctcattttccgcgcgcacgctttttaaactgctaaacggtgcgtattttgtaaaaagtttctatacgaaagttgtttaaaacaatcaaattaatctattttttttaaaaattagctaatacttaattaatcacgtgctaatggatggttccgttttccgtgtggaggaaataggttcccaacccccattagcgaacacgcctaaccaaaaatctgcaatggcaaagtgaagagaggctgatcgatatatacctctaggtcggtccggaacggcgtgccgtagagcgtgcacggcgccacgaacttgaagtagccccaatcaccgtccaggttcgaatggaacccatcgatgctggcctcttctatcctcatcttcatcgggctgccgtgttccagatcaaactcaactgtggagatttttttttatagataagggaagtttttattaaactcagtcaattacatcaaggtgatacaattatcctgagaacacttccggtctatacataactaagatatacacagccgaacaaacaaaaccacactcgaaagaaaaaaagaatgacatggagtattgaggaccatcaatctaacgactaaattgccactcatgaacaactccttggccatttcctccaaaagcacagagttttaaggaccaccaattctaagactagatcgccacccatatccctgggtaaaaaactccttgaccaccttctccaaatgttgacatgccgcaactaccatatcccgcgaatcaggcttctgtaggatagcccatatacaaagccaatggataagagaatatataacctgcaaaggtgaagatatgacttttttttatcaaaaaccacattattcctgcatagccaaagcgaccaacaagtagcagctgctcctaacagaacatgtgatttcacattattatgaattccatcaagccagctcccaaacatatgcgctacacaatgtggtggaggaagtccagatgttgcttggatgatggaccaaacagaaagggcaaaacggcattcgaagaaaagatgtctaattgtctcgtcattgcaacaaaaacaacagttcttattgccttgccattttctttttatcaaattgtccttcgttaacaccactccacggcgcaagtaccaaagaaaaatcttaacttttaggggtatctttaatttccaaagacggttattaatgttgggaacattgctgtgaattagagctagataatgagacttcaccgagaactccccatttgaggttaagttccaatgaatctcatcttgctcctgagttaaatgaaaaccagtgatgcgcggtgataaattattccacgccgctagttttgatcctataaggtctcttcgccatgaaaaagatgaaggattgttttcgaagacttgtgcaactgtagcgtgcttatgtctaactatgttgtaaaggcaaggatactgttctcaactgtggagatagaagctaagatgaatgtctgaaccagtaaaacgcagttgatcattgcaagatgaaagtttggggagaaaactgaacatatatatcacgacagatgaggaacatatctggctggatcttctctctttgggagctcaccaaaaagccccttgtgtgcgtaggggacgtgagcagggtccatgaggttctccaccaacaactcatacctgcaaacccatggtagtactattgatcgtcaaatttagaacaacagtagttaggcatgaatatgggatgagtctacgttccgatgatgcgggggaaaaatgggacgctgatgtcagcatccgcgtctaatttacgtgcaaaattattttaaactgatttttctcttaaattacctatccaaatcatgatccgattgcaccattaaattcattacaattaaatcttcaaaacaagaccacacattgatatattccgacgaaaaaaattattattgaattatttttaaatgttgcacgatgttccactaggtatatcggaattgtttcactaagtagatcgaaaatgtttcactcgtttaaatcgggtgttgtttcaccttatataaaaacaatgtttcagcaaatagcgaaaaaaatgtttcagttcactgtaacatttgatctatacatagtgaaacattataagtacaataggtgaaatatttttcggtggaacaaaaaataaaacgaattcccttaatagggggtttccaaaatatgtgggttttttgtggcaatggaatatttcagttcactgcaacattagatctatacatagtgaaacattgtgagtatactaggtgaaacatttttttggaacaaaaaataaaccaaattcacttaatagagggtttccaaaatatgtggatgatttgttgcaatggtagatgagaacagagaacgcggtggggcctatggcctacatgtatgcacgtggggggaggggcgtgcgggggagcgcccgatccggctcccccgcgccggtcgcccggattgaatcattctcgatgaatatgtgcttgataaccagttagccgtcagattagttttttttaccattaattaatctggttattaggagctgattgggatagggtgagtggctaatgtggtgcttcagcttttaatttagtccctaacattttaaacaagctggcttaatat

SEQ ID NO: 63581 - DNA, 6834 bp, Oryza sativa
ggtgaagttaggaataacacaacctaattcagtcgtgtacatccatcaacgaatttgaggatttttgttgttttgctcagaagaaaaaattctcgcgtgtcggaacgaaattgagatagttatcgattcaccggccaggttcttggcaactaggacgtacgcgttgatgtgcgcttgtgcgttgtactctcttcatccataaaagtatttttgacaccaagactaaaaagaaattaaatcatcttaaatattaaaaaatcaagaagtgaatacaagcatgcaatcaataagtatttagatgactccttagattttaataaaacatttaatttatctcttcatttaaatcttgagtgtataaaaactacaaatagtaacaacttatttgaaaaaaactcaaatgtgaaataggtgtaacttttgtggatggatggagtaatatattttcatggagcaacaagcagtcaagcacatctcaatggcgcgacaagaaatactccctccgtttctaaatgtttgacaccattgactttttagcacatatttaaccgttcgtcttatttaaaaaattttgtgaaatatgtaaaactatatgtatacatgaaagtatatttaacaatgaatcaaataataggaaaaaaaattaatagttacttattttttttaataagacgaatggtcaaacatatttaaaaaaatcaacggcgtcaaatatttgggaacggatggagtatttcagagaagagaataatggatttgtttttttctcttctttttacccgtataagaggtccctgacaccgtagaccataaaatgggacgggtcatcgtcgtcgatctccggaacgtagggtggccgcttcctcttcagcacgtcgcagtactccggctccgacctcgggtagaaccacaagatgttgttctgcaccacgctcgggtacgacgccacgcacgccttgctattcttgtgcacctgccataaattgatccaagaactcaattaatcctaagaaaatcttgatatattttttgtttcactttgctgattgatcgaggagaggaagaaaaaaagtacaggagggccgagggcgggagcctgggggatgaactggcaggagccgtggccgtcgaagcaccagccatggtaggcgcactggaggcggcccttgccgtcgacgcgtccctccgacagcggcgcgaggcgatgcgggcacgcgtcgtccaccacgcgccactcgccgccgccgtcgagccacgccacgacgctgaggcccatcaccatcttcccgtgcggcctgcgcgggtcgaggtcgcacaccggagccacgggatgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgccgggccgtggctggcagcgtgcgtcacgtcgctatccttttgcagccactaacccacgttcccacgattccctccgcaacagcgcgtccacgttctttctcctgatagataaggaggccgcgagtccgatccgagttcctcgcttctttccaggtcttctttccaggtgttagtttctccttctccgttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctgccgccgctattggcggaggtggtacgccgccgccgacaggagctgcgccgccgccgacgccgacaggagctggatccggagctggtgcgccaggaggaggtgccgtgaacgactacaacaacggaggcaattctgcctcccatccagcggagggccattctcggggtataatcttctccttctactgctgttagcgctactcctgttcccattgttagcgctatactgtgtgcgctatgttcttgttcctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacacgggataccactggtccagccactcgaaccgctcctccgcccctaccaccggcggcgccgccaccgtctcggtctcggccgacggcgccggcattgacgacagccatcccgtgctggtgcatctcggctgccggagccgccgccgtggcgctagactggctgcgcgtggcctagggacgccatggcggagaggaagcgaagtgcgcgcccggaagagcaggtggagggagaagggagccatggcttccgggtgcgaagctcaagcgtggcaaccaacttattatatctgcagtgggccgaagatggagcctatacagacactgtccgtattgctgacagcatcaaaacatgccgtagtgtgtaatccacaagaggaatcattttattgctagtactattttcatctactggaagcttaatagaaaccactctccgtccaaatataaaggagtaacaacttctagcctttaaaaattaacgtaaaatataataatttcttcaccaacattctctttccaaccaattacaatcatcttccattcaattcagtattcaacaagaagttctagaattattttcagagctgttgctaggtgtgaagtgatttcggacatcttgttctgggatacctttggaatgggtctattggaagccaaacacatccagaattatgtgctcactctttagacagaagcatctctgtaaccaagttatgctataacggccccatcgtttggcttatttatgaaataaaccaaacgatatatttgcaaataaaaagtattttgtgaataaaaaatttatatacgcattcttagcgatctataagcaaaggctaaaactaaactttgatgaaacaaaaaatctcaaaatcaacttcaaatttaaggttaaaattcgaattttagcagataagcatgagcttaagtgaaaacatgaggccataagcctgtagaggattgcttcaggctacctcttaatgagaaaacatatgtccagtttcaggctcttcagatagaggttaatgatttacaattactggatgtaaacgaggataaatggagctatatttggaactctccgaattatacttcacagaaattttacaaaatgaactttctaggaactacccctcccaggctatacatttggttgtggaaaacaaatgtcatgaaaaccaaaagtttttatacggcttatgtttactgataggtaaacaccaaagacatgtttgatagacgatattgtgcagtggggattgtctgcagtactgcagctgcagtagcagtggctgataggctgcagtactgcagaggatccatgtccgatattgtgtcctaaaagatgttggtctatcatgtttactctgtcctttggggatcagagagacattaatccatctcttttttcaatgcccttttagtgtaatgtgttgggagagaattgggatcaaatggaacacaaatatgaactttgtaaaaatccccctggcgcatgggtttcatgttctttccctgtgttaacgccaaaatttggtaagcccgaagttatcatcggcctagagtcagtatcggcttcagagtcttagaatcagctgatgggagtcgtcaaatcgccaacagttgtatttttggtagagttggatcaattaaaggaaatttatccagaagagtccgagttcaagaaggatatggcatggcggtttatctattaattaggaagtatttgctagtttccttttatctttaggaaagtgtgtttagtgtccgataaggactttatgttttccttttatctttaggaaagtttctttcttgtcctacaaggactagtatctctccatgggtataaatatgtacacccggggtcattgtaaaatatctctcgatcaatacaattactctcggcgcatcgccaccctctttcctgaggttttacttatcatccggcggaatttggcacctgacgcggggctgcatcggctttcgatctccggtgaaggggtaagtcctacgttccgctggccctggtgaatctgtcggctacgttggtgttgttcaagactgcatcgtttcgatctcttggatcgctctggtttggttgatatatttgcctacctgatatctcaattctatctctaattacattgtgtttagagacacatcggtttagttgggactgtctcggttaggtccgattatctgtcttagctgatatatctctaaaatcacaatgttgttctaaatagatttgttatatccatcacattagatagatctatcagctcatcaagtattagattatcatatacaatctcgtgctgcatcggttaggttcgacctactagattgttgttgataatataagtcttgctaagccgataggttcatgctagtgttttatcggggtgctagccgataagttatctagacgttgcatcggcttataaggattgcatatacatataagttggatttagccgatgacaacaaagacttcactgtttaatctaatcttgtggattttatgacatgggacctccagccgatgtatgctttaaccgtcggatcagtgcttgttctattatatcatattgctatccaattggtttatactggattatattgttattttattacatcatcatcagccgattgactttatatcattatctacattggacatacaaccgattgcttaaaccctatcgctatcggctggtatcgacatcggctattatcagatatcggctggaattactccatcgacttgtcagccgatcggctgtttgatctactgtttgtaggatcaaactgactggtacacccgcatctcatcaatctttggacctgcactggagctaagcagatctcccaggccagtgtgtgtttttcgcatccacaccccctgtaatcacccggtccaccacaaatcttcgtctctcccacaaagacggtaacgcaaagctgctcaacgatggcgatgatgtcaccacacccacaagaaagctgatacgaaacagcgatcgacttaggccatagaaacaatgaatcaagtgctaaataggtatccactttatcattcctaaaattcttctttctcctattcgttctttccaaaacctaaatctttaattccactttgttatatgggaatcatgtgctaggtaagtgctgagtgcacctgatacgttgcccatttgcatattttgacattctagttacataaactatatactttgttattttttggatgaatcttgcattgtgtgtacaggcaattagattctgacaagtttactgaaacaattttgcatttcagggcctgagggcagtacctggtacatggcgttattacttcaaatttggctctcagcttgcatttgcttgggtaaattttcagccgtcctgttgcagaaagacatcccctagcttcactaatagttcggtcaacaagttctgttctaataggtgcttttcaatttgttgttttgagtttttttttcataaacgcaatcccaacatggtaccccatggtatttttgtgggaaaactctgatatagctattggcattgagtacttggttgtgttgtgttgtctatgtacatttctaagcggctaaatttaagctaggaattctatcacgaagccacttgattctcaatcatacaatgaccagcgtaagagataatcaacctccaatacaaaatacaagagttcgcccagctaatctgaatatctgatggtcacagtaccttctaaacctgtttctatagccatatagctatctagattcataatactatgttgcgtcttgtaatactaagttgctatattttggatgaaaattgatggaccgacaaaacgttctgtagcatgtaactatatactgttctgtaggattaataggaggaaacatatgcttctatcttcaccgaaaaagttgtcacatgaggaaccgtatgcttctaagtgatatggccctgggagtacgcacggtagagggaaataaacttcccatctagccacgtggccgtgcggcctgccttttctccaccccctcgggaggaggttaggtagttattaggtggtcaggggggcctcggggtgccacgtcacacccctcgggcccgtgaggcatgctgccccgaggcccttacccggccaccacgtggcggggtgagtgggcggagcaggaggcgctgttcagcgtcataaatgagcggcaccccaaccgtccctcactgcatttaatgcggtgtgggcggacgtgcggcgccgcctgattgacgcatgtcaatcgaccttgaccagtctgcgaccggtcgtaggcggataggacaggtggtcgtgcccccacgtcccgccctgtgtcaggcggagtgggggcaggtatgccccatcccatcggcacactgccaagtgcaccccctgtacatggtgaatccaccaaagtctccatacatttaagagggaatgacagggatgtcccccgtgtcaggtggaggacggcgctggccccacctagggcggacaaccactttgctt

SEQ ID NO: 63582 - DNA, 2416 bp, Oryza sativa
cccgaactagtaccgatcggaactagcccgtgacgctccaaattaacctgttaaccgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccagggctcggaccaaacatcacaggcgcgacttgggaactaggccgaaaccctaaaactcaacgtagccggcttgctcctggaagaactcctcatcagccggatccgcttcatcttctttagcaactgggggggaattatttatatagagcaagggtgagtacgggagtactcagcaagccaagggaattaagtgtttaatgcaggcttcaagggaaggctgttgtttttgcaattgattttatttgaactcttttctgaaaacaactaagtgagtgcttctcaaacgactcggatgagacagagcgtctcgtccggtcggagtatgtatcagtctttagaattgaaacaaggttggcacccggccaacagcttttcaaacggccacccgggccaacaacttttcaaacggccacccgggcctagctgatcccatcagctgctgaatctttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaataggttaggtcccagaccatactgtgccaggaagcccaggggtcctccccgacaccaccccgacgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtctcttgtaaaacccaagttttacccaagttgtttttcagattttaagtttgaaggcgtccgtcgatactcgcactgggtgcacgaatatcgagacgcaactggatggttacaaggggacatggtataacaattaacaattgagggatcagatgcaacaagttaggtaggtccgccaaactgtcatgcggacggaacaagcagattgagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccggaactacacgcgaaacgggacaactcaacaaacagcgaaaataaagccctattaatgacctctaagcgtgccattagatagatctcgagatttgaggaattttggaagttgaacggagtcaaacggacttacggttgggaagatattgaatttctaagattattggatttttggtctaaaggaaaaaggatttaattaaatcctttttggaaaagaaaaagaaaagaaaaggaaagagggagggaaaatagacttttctcgggcggctagggcgcggcccgagaggaagagcggctcggccaagcttaacgggccggccggcccaagaaggcggcccaagtgcgcgcgcgcgggagggaaggagagagagagggccggtggaccgggctcaccgtgcgcggtcccgggtgggacccgcttatcagcggctcggctcaccgtgtggagggagcacgcggcgcggcgctagggtggggaagggacgcggtgcacgcgcgcggttcgcggtggacgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacgccggccggaacggtggtcgacagccgcgagcgacggagcaaaccacggcgatacaggcaaaagcgagcacaccgggtggttgcacgtgacgaggggagacgaggcaacggctcggatttgccgggggttgctcgacggcggctgattgcggcggcggcaa

SEQ ID NO: 63583 - DNA, 39238 bp, Oryza sativa
agggggagatgggccgagagggattcggcccatcgaacccgggggaggcaaactagacttttgcggagggatttgatttggaaggatttggattcggaaatgaacttgacgatagatcggggattgagatcttgagatggcacgaacactagacaacaagcaaagaaacaaatttcgcaattagggtttttaggagataattttcccgctaggcgccacgacggaacgggcgctacagaccaacccccctaacaagaatctcgaccccgagattcagcacctaagggagcagctccgggaactcggcgcggagaagatcttctcgctcccaggttgcctcatcttcagaatgattgctctattggactttgtagaacttgatggtcttctttcgagtctgacgttctgcctcttcaagaaccttggtcggtctttccttgtaagtcagattcttttccagctcgatattacccagagggacttgctcttctggaactcgaagacatttcttcaactgagacacgtgaaacacgttgtgcacatctgcgagaccttcaggtaactcaagctgataagccacttcgccacgtctggcggttatgaggtaggggccgatgtagcggggtgctaacttgccggacatcccaaacctcctcataccacggaggggtgatacccgcaggtatacatgatctcctttttcgaactcaaggtcacgcctccgattgtcagcgtaattcttctgacggttttgcgctgtctttaaacgttctcggattagcttaacttgttcttctgctgccttgagtatgtcaagaccgaataccagcgcttcgcccacctcattccagcacaagggagtacggcactttcttccgaacattgcctcgttcggcgacatctgtatgctagcctgataactgttgttgtatgagaactccgcatacggcaaacaacgatcccaggtgccttcgaaatccaaggcacacgcacgtagcatgtcttctaggatttggtttaccctttctgtctgaccatcagtctgcggatggtagcccgtacttaaatttagatcggttccgagggcttcatgcaactgcttccagaaccttgaggtgaactgagtgcctcgatctgacacgatcttcttgggacagccaaatctacatacgacatgggtcatgtagagttctgctagtttctttccatcaaaggtggttttcactggcacgaaatgagctgatttcgtgagtcggtccacgattacccaaatggagtcgtacccgctaggggttcttggcaaaccggtgatgaaatccatcccgatctcttcccatttccactcgggaatcggtaggggctgtagcagaccagctggcctctggtgctctgccttgactctttggcaaatgtcacacagggctacgtattctgcgacatctcgcttcattctagcccaccagaaatatgccttgatatcttggtacatcttcgtacttcttggatgaatggagtaggcggactcatgagcttcctttaggatgagatctcttaactccttcttggctggtacacagatgtgtggaccgcaccaaactgtgccttggtcgtctatggagaaattggtgtctttcttttcctgtattctttttattaactcttttatcccttcgtcatctttctgagcctcccggatttgcgattctagggtaggctgtactgtcaagctggcagggacacctgactgtaccacggtcagccttaacttctccaattctctgcacaggcgatcttggtcaggccgtatttgagctacattgcaataggccttgcgacttagcgcatcagcgaccacgttagctttaccgggatgataatgaattcccagatcgtaatccttgattagttccaaccatcttctctgcctcatgtttaactcggtctgagtgaagatgtatttaagacttttgtgatcggtgtatacttcacatctctttccgattaaatagtgcctccagattttaagagcatgaatcacggctgccaactcgagatcatgggtggggtaattgacttcatgaggcctgagctgtctggacgcataggccaccacctttcgttcttgcattaggacacatcctaagccttgtcttgatgcatcacagaagatctcaaaatctttttggatatctggcaaggtgagaactggggcagtggtcaaccttttcttcatttcttgaaaactgtcttcacaggctgcagaccattgaaatttcctttccttctttaatagctcggtcataggtctggctagcttagagaatccttcaatgaatcttcgataatatccagctaagccaaggaagctgcgaatctctgacacattcttgggcgggttccaagcaagtacagcttcaaccttgctgggatctacttcgacaccgttggaggagatcacgtgtccaagaaatgctactcggtctaaccagaattcgcatttcgagaatttagcgaatagttgatgatctctgagcttttccattatcagcctcaggtgttcagcatgttcttcctcattcttggagtatatcaggatgtcatcgatgaacaccacgacaaactggtccagctattccataaagattttgttcattaagttcatgaagaacgctggagcattagtgagtccgaaggacattactgtgaactcgtatagaccataacgcgttgagaaagcggtcttcggaatatcttcaaatctgattttcaattggtggtaacctgatcttaagtcaattttttagaaaactcttgctcctttaagttgatcaaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttaccctccaattcttcgatttgtcttttaacttctgctaactcattagctgccattcggtagggtctttttgcaattggtgcagtgcctggcgccagttctatggcgaacacaatctctcggtctggtggcatacttgttaattcttctgggaatacgtcgggatattcacagactatgggcaccgactccaaggaggtgacttgtaaacaggttaggatagaccgacttgcggtaggggtgttagaggtaaagcggacttgctttcctccaggtccttgcaaggtgatggacttttcagcacaatctatctgtcctttgtgcttagccaaccaatccatccctagaatgatgtccaagctttgcgagtctaggactatcggtttggctaggaagtcaacttcctcaattctaaggttaactcccgggcatacttgagttgcccttatattcctcccaggggaatgtactatcattggtacacgtaaattttgggttttccaaccatttcttttcacaaaagcttgtgatatgaaagaatgggaagctcctgaatcaaacagaactattgcgggtacggagttgacagggaacatacctatcacaacgtctggagcatcctaagcggtctcagcttgaatgtggttcacccggcctcgaccaaagttgttggacgcacgagaaccttgtccacttgcctgagagctaggacgagactgagctgccgctggagtaggagttctggcagtgctgccattagcatgccctaagctggtgttggtaggattctgagggcactgtctggcatagtgacccatctggttgcaccggaaacactgaactgctgacggtccctgtggtgacttgaaagaggtaacactgtttggcgcagtattgccactaggggcacgctgctgtggctgaggtgccggacggttcatttgaggacgaggggcgtagcctggctggtggttagcctgagtgaccgactggtggtattgcatgggttgaccgtagcgagggcgaggtacgcctcgggaagaatttccctgatggttagacttgcgtttcttgtattcttcggtagcctcttttctggcatcctcaagtagaagcgccttgttgatcatatgttgaaaagtggggaaatcatgagcaagcaactggagtctcattccaactgcgattcctttcaagaatttcctgatcttcttcttgtctgtgtccacttcctcaggggcgtaccgagccaacttgttgaacatacttaggtactcattgacactgctgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattctcccaccaatctgcagcaggtcctcttagctggtgagaggcgtagagcgtcttctcgaccggagtacactgcactaagttgagttttctatcaacatctttcagccaatcgtcagcctcaacgggctcgatggtctgagagaactctggcggacgtgacctcagaaaatctgtcagcttggatctattgttgctcatgtgagggtggccatttccatgcgcattatgctgaaaaccggctacggctgcggctaatccttgcaagatttgtgtctgaactgccattaagtgttgcatgttgttttccacatgaggtgggaaagggaggcgttcttctccagaattgtgactggcagtgcggtgagagcggtgagactgttccatctctgcattacgggaaactgtgcgatgcgagcggctgctgcggcggggttgctcaacttctgcgttgcgggaagcagtacggtgcgaacggttgctgtggtgagactgctcattagctgactcatgattttcttctggctcaactctaccatcttcaaaaccaaagcgggctggtgcacgagctgcacggcgggggcggctagccatctaaactcccagaagagggcggggtaatagtcagatagcacttaggagggcaaggagcaaagtaaatagcaactcagatagcacacactaggcataaactggatttttcaaatcatagaaacacctaatacaacgggtgtggacaagtcacagagctacgccgagcttgactgcgcgcgcaccacctaggagaaccagactaccaaacaacacccacaacaaacacacgcacgcactacctcgccacgactccaaaagagttggcggcggaacaaaagggcctaacacacggacggctgctgaagactgcctcctctactcctcgtcggcctggctgcctcctgtggtcggctcctcagtcgaagaaacgtcgatcggctgacgcgaagggaccggcggaacctgtcgagggctggcagcagcacgggccgctggcggtgggggagctgggtagtggaaacggaacacagtggaagaaccaacaacacgcttccgcgcagtgcggataaagcgtgggccacggcgggtggaagcaactggggtgtgtccgggggtgtaggaagggctaactgggtgtgggtagggggagtacactggtgagtacggcgcacgcgagctgggggagcgcgggccactggaaggcgtggaagctgccgaaaggcggagcccccaagacggtggctgtagtcatgggccaggcgacgaagcgcagtccaggagaggtcctggtactcgatctggagagtgggcctggccacggtgaagtggtgtggacgagggccagctccgtgtatacctccacgggggtaaaggtacacagagagctcacagtgagggggaacacggtccacggagtaccccgtgtactcgggacacgagaagccaaggaaacgggcgaggtcacgaagctaagcgacgtggtgaccctcaccaaaaccgtgggagctgaagctggcgctcactgccatctacaattttgaaaaagggagaaaggatcagtaaccatttttagaaacaaactattgaaaataaagaaaacaaaagaaaccttagcttttcgcaagtagtttggaacttagtatccttagggtcgtcctaggcgtcgggtttcgtcctagggccaagcttgtgctctgataccatctcttgtcacgccccgaactagtaccgatcggaactagcccgtgacgctccaaattaacctgttaaccgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccagggcttagaccaaacatcacaggcgcgacttgggaactaggccgaaaccctaaaactcaacgtagccggcttgctcctggaagaactcctcatcagccggatccgcttcatcttcttcagcaactgggggggaattatttatatagagcaagggtgagtacgggagtactcagcaagccaagggaattaagtgtttaatgcaggcttcaagggaaggctgttgtttttgcaattgattttatttgaactcttttctgaaaacaactaagtgagtgcttctcaaacgactcggatgagacagagcgtctcgtccggtcggagtatgtatcagtctttagaattgaaacaaggttggcacccggccaacagcttttcaaacggccacccaagaaggcggcccaagtgcgcgcgcgcgggaggaaaggagagagagggccggtggaccgggctcaccgtgcgcggtcccgggtgggacccgcttgtcagcggctcggctcaccgtgcggagggagcacgcggtgcggcgctagggtggggaagggacgcggtgcatgcgcgcggttcgcggtggacgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacgccggccggaacggacggcggtcgacagcggcgagcgacggagcaaaccatggcgatacaggcaaaagcgagtacaccgggtggttgcacgtgacgaggggagacgagccaacggctcggatttgccgggggttgctcgacggcggcggattgcggcggcggtaaccggcggcgggagaaggggaaaacggcgacgaggtcacggggggctaattcctggcggcgagagcatctatgcggctacgggaatccgatgctagcgtcggattgggcggagctacgccgtgcgaggccgacgacgagcgggtgctacggagcacgggcggcgacggcggcgagcacacggcgagcgacggcaacggtcgggacggcgccggctaactacggggaggctactcgagctactaccgaaagctaagggggggagatggagcgaggaggaagaacggagggaggcactaccgtgcgggacggggcgcagtgacgagaggccgacggcgcgggagtaatctctccggcctcaggccggggaagaggaaggagagggcgcgcccggagtccccttccgcgtcctcgaacgcaccggctctccgacacgcgcaacgacgaacggcgacggcgaacagagctcgggggcggcggcaatggcgcggaggcgatgggaggagaagagagggagggcgcccggggcttttaagggcggcaacgtcggtttgggaaccgactttgggcggtcaaggcgcgagctggcgctcggcgctcgcgtccaaatcggcggcagggcggagggaggaggatgacgctggcggtgacggaaaaaggggaaaagagggagagaaaagggggcttgcctccttgccgcttttggaaaaggaggaggggagcgggggcgtcgcggcagagggaggagggaggctctgcctccgtcccttggagactagcgcgggagtggcggggccgaggcggtgacgacggcgatgacggcggggcggtgtggagcggagtggcgacacgggcgacaggcgcgggcaggcgtggcagagggtgacggcggcggcgaccaggcggtcggccaccacggcacgcgcgcgcgggttgcaacgggaggcgcggcggtttgagtggcgcggctcgggcacgcgcgctggctgcggggccgagcggctgcgcggctgcaggcgcggcagggcagcggggccgggcggcgcagacggcgcaggcgcgacacgggcgacgaccacgcgggcgcgcgcgcgaacaacgacgcgcggggccgattccgcgggcggggagctcgccagggatggaggcggggagaaggagatcgagggaaagggagggcactcggcgcgggcggctcacgcgcacgcgcgcgggcagagcggaggtagagagggagagagcgggggcgcgtcggggaagagcgagagagtgagggagccgggagggagggggagatgggccgagagggattcggcccatcgaacccgggggaggcaaactagacttttgcggagggatttgatttggaaggatttggattcggaaatgaacttgacgatagatcggggattgagatattgagatggcacggacactagacaacaagcaaagaaacaaatttcgcaattagggtttttaggagataattttcccgctaggcgccacgacggaacaggcgctacaatagcttgagctctagaggaagcacagctagggtttcccaggagctcaagatctcttgtaagaactccactataattcctcgcacaggagtaggttgttacgcttcccagcggcccgaacctgtataatccctcatcttccacacatattcgcaagcgatctagtagccagaccctaagcgaagatacgctcttgatcatcgcgccttatcccccggccgaactcacaaagggggggtctcacgacctcccgctagagaggatcactcctcgacacccttgtttcatattataagtcgtttaatttttttactagtcaaactttgttagatttgaccaaatttataaacaaaatttagtaacacttaaaatattaaattagtttcattaaatctaacattgaatatattttgataatatgtatgatttgtgttgaaaatactgctatatttttctataaatttggtcaaagttaaagaagtttgacttgaaaaagtcaaatgatttataatatgaaatcgaggtagtaatatgtttaactacacatgtgttgcatgcaatgatttccataatatgtacaaacttgaaaaggactatttggagtgggaaggattgggccagttgttagtcgggatcagggtttcccaaaccgccggggacggggttaccgcgccccggcggtaagcacggttaccgcgcagttaccgcggtaaccgtgaaaaaccgttcaaaatttatcaaaaattcaaattattttttaaatttatttaaatttaaggaggttaccgcggtatttatattactgtatcccgcggtaagcctggtaaccgtggtaaccacgcggttaccggctgtaaggtgaaccctggctgggatatccttatctcatgaggaggatatgatcctatggcccctggaaaaaaacagaagctattctacaaaatctttgtatgatatgctctcttttcattgtgttagggaccttagagggatgaaaaaaaaaacacaaatattaggaaaatacctaatattaaataaatagaaagggtgagacttcgaacactggccggctagcccaccatcttgtggagctagctaaaagatcccttggcgtttctctaaccttagagggatggacatatggaaatcgccaatttcactgaaagtgaatcactttgtgtgtcttgcttgcttagatagaattcaaactaaaaagaactaggaaggctctgagagatgtgttgtatgtaatgaggtggaaactgttgatcacataatctttgcttatcctattaatctcaatttcaaattattgtcctagtttaccgaccgtttatgataatcgaattttacaaacgaacatattattcacttgtcagcatggacatagtcctcgaataggtgttttcgactaagttggcgagccagcgggaggcagtgaagcacagataaagcaaacatatataagtgctctcttatacagccatgtcatcctaccctgaatcatttttctcaaaaattttgttatctcagctttgtatctcctttaatagacaaattctcaattggtcagtaggggaacgaaagaatgcacggctagcttctttgataattcagtattcaacaagaaattctagaatcatatatattctttttttttcaattcgtgtttatcgagatttatatcatagcgcaatgtcaccagggtaaaccatgagatttaatttcttgaacacatcgatcatttattagcaactatggttggaaatttacaaatagacttcaataattgtgatctccttacgttaggctgctttttttgtttttctagtgttctattcttttagatttacactacgttcatgaaaactactatataataattggctgtaactcttttgagtaaagaccgagatattatattccattatcttaaaaaaaaattagcaactacgagaagagacacacaccaatatatatcacttgtcagcgaggacatagtcctcgaaatagaaggtcttctcgatgaagccggcgagccagcgggaggcggcgaagcacagcaccgccgcagccacgacggcggctctctgaacacccgacgtgaccaccgtccccttgccggcggcgaggaacccgacgacggcgaccgaagccacctgcagggcgacctccagagctctcatccacttcagtgcagcgctgcagctcgtgcactgcatgacatgcgaccagtacctgttcatatctattttagattcaagaaattttacggtccttaaaaagtatctccaggtacaagtacaaccctttagattaacactgaattctcctatggaaattctatatgttttaggtcgatcagtgtgactgtgtgaagatcagcagactagcttgttaatttacctctcgtagacctcaactctggtagaagctggtggcagctgattaaccattggggttaaccagccaacctgattgttacagtacttcttgaaccagtttctgaaggcgatgatcaagttgtcagatgatgtgggcacgtagcatgctttatgccagttatcaaggccaaacgcggcgtaattacgctcctgcagaagcatatatattgttcaggtcaagtaagatctgagataatcgattgcatccatgcaaccacatacatagctcgaatcattcagtttgagctgaaaagagaattaaccggtcacctcaatatgaaggacagacgagtctgaatccaggacttggttcgtcttaatatgcaaccaccaacgtggtatcatcttgtcgaaccagccatcaagattatacccgttcgcccagatgaccctgcatcttcccggagacaccgggatgcagaagaacactgtcgtgacctcaggctgcttcttgttgttggtgttgttgttgtcctgatcaacctgcagctagcacaaagtgtaatcttttcaacatgattctttgagcttgtaacagtggctgcaatatggcgaagtgatcagaggcagataccactggcttagcacgaaatggcgagcctatgagagtaaccggcgcgatgaacttgaagtagccccagttctcctctgggttggaatggaaccctgcgatgttgagctcctctatattcatcttgatcgggaggccaccttcctggtcaaattcaactgtggagaggagatcaaatgtttcagaatcagtaacgcagcttagcattgagaaattgagattaacacggcattggctcaattaacagatcgtgtcaacgcagatgatgaggaacatatctgcctatatcttcctccctggggacatgagggaattggcccctgtgcgcgtagggaacgtgagcagggtccatgaaattctccaccaacaactcgtatctgcattggttcgattcggatttcagaatccatggcacatacatacatacatacatacatacatacatacatacatacatacatacatacatacatacatacatatacacacacacacacacacacacacacacatacacacacatacatcgaggcatcgagctgcttgtgaatagcttgtaaataatttctgtacccgtataagaggtctctgacgccggagttgatgacggacgacgggtcgtcgagctcccggatgtacggcggccgcttcctctgcaggatctccttgtactccggctccgatctcgggtagaaccacaggatgttgttctgcaccacgctcgggtacgacgccacgcacgccttgctattcttgtgcacctgccattagttgatccaagaactcggttaattaatcttgagaaaatgttgatgtttttttaaaaaaatttgttttacaggagggcctagggcgggggcctgggggatgaactggcaggagccgtggccatcgaagcaccagccatggtaggcgcactggaggcagcccttgccgtcgacgcgtccctcggagagcggcgcgaggcggtgcgggcacgcgtcgtccaccacgcgccactcgccgccgccgccgtcgaaccacacgacgacgctgatgcccatcaccatcttcccgtgcggcttgcgcttgtcgaggtcgcgcaccggagccaccgggtaccactggtccagccagtcgaaccgctcctcccctgccgccggcgtctccttctcatccacggctcgtgggagcggcgcctcggccgccactgccgacaccggcattgacagccgccgccgccgcgcgtcggtggggctgatccactgccggcgccatggtggtattcttggtgtgctcgggttggttacagtgtcgcggaagggaagcgaaaggcgggtgagcgagagcaggtggagggagacaggagccatggatgattcggagtgtggagtgtttagttaatacacgtgagtaggaaaacagatccctgactctgtgtctgtgcagtgtgcagtcgtgccactgacatgtaggccccatctaagatccatatatcagtgatacaactatacactgtataatttcaggggagtctcatccacggagtagtgactaagcaagacatagaccggaaacataaacgaatgcactgtatattttttcgggaaacggaaatggggacctacagcccatattgctctacacctgctacaatggttaacactggcgtagggtctatatattttttttataatactatttctgaagtagacaaacaacttttgaaagcgtgctaaacatcccaccgtagcaaattttttaaaagttgtgatagcaaaaagcttttcttactaaattcttactaacgctgataagtcatgttatgaatgcatctatattttttataatttctatatatctaaatcaaacggttgagataattgttagtacaaatttagtaagaaaaaattataacagtgctctttaagatactagcgtactactccttttcaaaatagttatctttttattcaaaatttattctaaaatatttgttactacttaatccatttatcacctctcattcaaatttccctctattttacccttaactgccactctaatcccaatcatgtatcatttaatgaaggatagtatgtcttttatttaaataaaaaaattaccaagaataacaagtatttcagatggagggctagttagttctcttaaaataattgtagattttaagccgtgtttgatgtctaactcggaatctggctgaggcaggagctgttgcctcaaccacaatgttattgtaccttacgtaacgtgcttttctttcgtttttagtaaaaaccggccagtgtttcttccgctaacccaagaaaaaaagttaatttaattataattttcatgtcattgagtgcattaaatttacgtatttttttactcatataatggctatgtgcatacgtgtccttaaatttcaagactattaccctataaggcagtagtaaggaaaacaaaaacaaaacactaccaccacacacactcacaacaactacacacgaccaagaaaagagctaacaccacatcggtcacagctagacccaacaaaggagctatagctaaatcgcccaaaatcaatccctaaaaaatgagtaccaagccagcaaggtgacaacggacgaaaaggtagtagagggagatagcgagagagaagaaatatccctttccctcgctcgaacccgtcgactcgttgccacttaccagattcgcacaaactgtctgagcacggttttggcaaaagagagtctcctagacgacatctccatggagaaaagcgatgaagagcaccaccgctatccatcgaggtctctaggagatccaaggcaaggttctcacccggcaaccccactaaggagggagagggatgtctcaacaatgccccaaagaggataaacgacgcccaaagcgtcgtagttgtcagcctcgtaaaactgggctaggcttacacctgttgcctatccctgttgacctgcaattgtagttccattgctccaccaccaaccacccaacattgttttcaattatgatctatctatcctgccaagttctacgcgagaacaacaatagcagcctatcctctatcttaaaatgttgcaatctagaatgagatttgacacatcctaaaacaacgaatctggacaaaattctatccagattcgttgtcctaggatggattaaataaaatctcattctaaattacaatatttgggatggaggtattaatatccaacatgtttgtacgattatattgacacgtactatatgcacacattttattggatttcaatgacacgatatataatccaaatttacatataattatgaattgacccatgtgacatttctctaggattattgagattgtgtcctcaccttacttgacgtgtaacattggatctatttcgttttatttccatatctcaaactcttttattgccaagtattctaactctacaaattcataattttgaagctgtgattgcatccatttataacataatgtttcaactaattgtttcgttctaatatttgaggaaatataaaattttaagaacattataatctaagttttaaatccaggaccttaggagctaaaagtgggggcattcaatgttatgacatccttaaccgtgaataacatacaatttaccattctaacccatattcaataatttaaatggtcccactcggtgacggagccaaaatggtttttaagctcagacaaactttaatataaattgtatttgctataaaagttttatcattaatttactcattaatattaaaatttaatggagttttggtcggtgagtcctggcagccgtccgagctaaccggacgatgtctccgccactagtcccactgtcccacaaaactaatcagatcgctgccacgcgtcggtgctgatctaccaccgactccatggcccatggcactagtctgattgaatgtgctcgatcggcgtggtgtcattgtgcaatttgtgccctattttttgtgcatggtggagtaacagtcaccgccagaaaccttcaaaagcgtgtacagaagcaccctgggtactgtacccaccccaccacatcgtgagcttttcaaaagttgtgatagccgacttatccttgcgaacttccaaaacagatacatagttggtaaattttaattgtattttttatgccatttagttcattgtttatataattttgcgttgatgacttattttgatgaccatccgaatatgagcaattttaccattcaacatttagtacttcgaggtaccaaattttacattagatagtactttgagaactaaaaaattgtggtacctcgaggtaccaaatgttgaatgataaaattgctcatcggaatatatataatttaatgaactgacacttggatatcataatatatcatttttatacgtcactagcaaaaatgtttatgtgttaaaacaggtgaagataattttcacgattgataaatttttttgtcaaacaatagcaaaacaaatttagaaatcatatataacattgaatccggttccgctcccttcatgcatcatcacacgaagaatagcttatatacacatttccaatagcctcacaaattgatcggatggttattccataagttgacacatgtggattttattatacctcatggtccaaagattaaaattttgagtattcaattagtaaaagttttttcccgtaaaatttttttactgtagatggaaggcatttgcaaagtaccaaacttaatgcatacaccttaacaatgataaattcaataggaaaataattgtgaggagagaaatttggaagagaaaaaagagaaaagaaggagatggagagaatcatgattattgagggaaaagaaaaggagaaaaagaaaatgaaaaaagagagaaaaaaaaaagaagccaatcgaggaagggtgtacgcagcgccgtctagtggaggcgtgcgggatggtgtgggccatttgggttgggctaggagggagagagaatgaactgggatatgggtgcataataattattctagactcacgtcaaattggatacgtgtgacatataactaactcatcaaacacagacgacgtatcaaagcgccgaagaaaatattttcaatttttgtaatattaaagatagacatagagataaatattgtactctttgaccgtgtcatatggagcctttttcatattaactagctgggtggcccgcgcaattgcgcggctagcaccgatataaaattatctattttttaatatagttttacttagaattttgttaaatagatatctcgttgtcttaagactttgaaaaaccaaaccttatcatccttgtgtttctaattttatattttttaaaagttatgtcagttgctactcctaaatattttgtcacccctcgtttatttgcttcctcgatctaccactacttctatttgttctcactaaaacctctaaaaattagaccttatagtttttagagtttattgtctcgtttgggttttgtttttataattttcagaagtctcgtcaaatgttgccaccatactactctacggtcaatccactgcctcttctctttatttttattgggattttaaaaatcaaacgtaattatcatttaggttctttttttactttctagaagttccaccaaactgtcagcgactttaccactgtactcatgtacagctcacccgctgccccctctttattgtctttgagattttaaaattcgaacatgattatcattagggttttttttttttactttttagaagtcccgccaaccgttgtgaccatgctgcttaatgacccgtccatcgtccctccttttaatcatcattgggattctatttgggggttttgtttatagtttttagatattccatcaaccgccaccactctaatcctttacattcatgttgcttctcctatatttgttgtcatttgtcatctttttataatttttagaagtcatgtcaaaccctatcaccatacttctcttcggcctgtccactacctcttctttttattgtcattaggattttaaaaatcgaacataattattattttggttcatattttactttctataagtcctgccaaccgccatgaccgggctgcttaacggcccatccgtcgtccctccttttaatcgtcattgggattctatttaaggttttgttaatagtttttagatgtcctatcaaccgtcaccattctacttctttataaacctgttgcttctccccctctttattattatttgtcatcatttgtgttctagatggagttttttttagaagtccatatttttcattctgatatttttatttataaattatatttctacttgaactcttataattatttttatatttacagaatttatttttttgttatttcaaattttagttaatctcgtcatatgttctaaatggtctcttatttcaatagtttttactttttatgacgaatttaagttatttataaattgtattcctagttgaactattatttttatttttctatttttggaatttattttaatttttatttagaattttagttaatatcgtattatgtcttatatgaattatttttttatgttttttaattttcaattttatagttgtttcatcctactcaaactatcttttttatttatctaatttcagattttattttatttttattttaaattttagttaatatcgtattgaattcttatatggactcttcttttaatatttcttatttttaattctgtattcctacatggactcttctttttaagattttattttatttttattctgaattttaattaatctcgtattggattcttatacggacttttctttcaatattgcttatttgtaattccgaatttcagctatttttaaattgtatttctacttggactcttcttttctttttctccgattaatgtgggaatttctagcccccgcagcaaacgtggtgccttcttttcgagctgttttaataatataatataatagatagatagatagatagatagatagatagatagatagatagatagatagatagatagatagatagatacttgtttttcttttgtaagctagcatatatagggatcgaactccactcccagattttcttagacactgtcacttgtaagcatggacgtagtcctggaagtagaagctcttctcaatgaagctcgcgagccagcgggaggcggcgaagcacagcacggcggtagacacggcggcggctcgccggacaaccgacggtgctagactccccttggcgacggcgaggaatccgacgatggcgaccgacgccacctgcagggcgacctccagcgccttcatcttcttcagtgcagcgctgcagctcgtgcactgcatgacatgcgacctgtacctgttgatggcaccagagaattaattgatcagcatcacagcagcccacaaattctgaatgaaaattttcgatgaagctgatcttgtaacgtgtttcgggtcagtgtgaagatcaacttatcacctctccaagacctgatctttggtaggagttggtggcagctgattagccattggggttgcccagccgatctgatgcttacagtactttctgaaccagtttctgaaggtgatgaccatgttgtcagatgatgtgggcacataacaagctttgtgccagttatcaaggccaaccgtggcgaagttgcgctcctagagaatgaaaatcttcaggtcaaaacatatatatgggcatagtaagtcagcaggcataatagctcacatcgccttctgtgtgtcttagaatagaaaccggatatgtaatccatttccgttatctaaaaatgtactcttttaaaaaaagagaaattttatagttcttaagaagatatcatgaggtaccactttttctattataaatttggtacctcatagtaactaggtaccaagagataccaaattttatactaaatttttttacatcatggtaccttcttatgaaccgtaaaattgctcttaaaaaaatcttgtgatgaattgtgaatctgccaccaccctcaccattaacttcctgatttttgaagttcaaaaaaaaaagagtgtgggaccaaatggtctacctattagctgaaagatacatgaatagaaaaatagataagatatgcagaatgagatggaaaaacggattgatgataatgttatttttttttaaaaaaaagtaaaaaatctgtcacaatgcatggacaatatgctagttttatcatgaatcattcagcttgagctaaacaaataggtcacctcaatatggaggaggtaggaatctgaatccaagacgatgttcgtcacaatgtggtacaaccaccgtggtattatattgtcgagccacgcatcaacattccgcgggaacgcccatatcaacctgcttcttcccggagccaccgggacgcacaagaacaccgtcatcgcctcaggttgcttcttcttctttttctccttgccctgatcaatctacacaaaatctaaccatttaatacgattatttgatcttcaagccttgaactagggacagatgtgccatgggggtggtgagggctcaagcccccactacccgtattgatactttaggagcctccactaaatccccttaattttacatcctgatactttttcaatgatgataaaattacgaacatctttcccatccttgaggaggtaccatgaggtaccaatataatctaaccgttgatttagaaggggtatgatggggctaaataaatttagggtggcgctaatccctcaccctcttgatggcgttttgcttgcttgctcgtggtggctcaaagggacccaaccatgtccgccgctggcggcggcaagagctgcatgggaggaggcgaggaggcgattgccgggctcctcgacagcggcagcggcgtctggcgagtacacgctcgtgacgacgagggcgacaagatactcgtcggcgacgtgccatgaatgaatgaatctctcgtcttctccaaatctttgccacatctccgtgccggcgtcgcatcgagtccgctgctgccgccgtcgcgtcgcatcgagtccgccgcggccgccgtcacgtcgcatcgagtccgccgcggccgccgtcacgtcgcatcgagtccgccactgccgccgccacgtcgcatcgagtccgccatcgagtccgccgtggccgccgtcgcgtcgcgtcgcatcgagtccgcagcggcagccatcgcgtcgagcttccgacgaatcgccgccgtaaccatcgtcgagctcccgatgaatggccgctgcaaccatcgccggccttaccctcttcccctctcttccctttgccgcatctccgtgccgacgtcgcatcaagttcgccgcggccaccgtcacatcgagcttccgacgaatcaccgccgcaaccatcgccgtggccgccgtcgccgatgaatcgtcgccgcaaccatcatcaagctcccgacgttgcagctatcctggtcctcccgccacccatcgccgatctgggccgccgccgggtttccgatctagggttcgggacctatatgcccctgctcccgccgccatctctcgccgccggttagttcaacgctgctcctgccctgtgagatgcagagacggaggaggaagagatgccgcgtgcgtgcgtgacgcggaataaagacgaaagtacaaaactgccctcccacccacggtaccgtttcaatgggtaggtgcggtacctcatggtaccgacgatttttgaccgtaggatgttgccagatcaacggtcacgatttggtactgcacaaccttaaagacagtaaaaaatctctaaaattacccaaaacttcatctagtttatttagcctcctctagtatttcttctttgctccgtaatggcaaagtaagagggtgctagggggcagatacctgtggttctttggtgcgaaagggcttgccatagagcgtgcagggcgcatcaaacttcatgtagcatacgtcatcctcctgtaccgacaggaagccgtcgatctttgcctgctccgtcctaatcttgaccgggtagcctccttcctgatcggactcaactgtggagaggagatgaacagttgaacactatcagtggtaggtgcagccggaacattacaaaatggcactagctcagtagcatgttcatgcgtgcagtagactgaagaattaaaactgatcatgtcatgatagatgatgaacatatctgcctggatcttctttgttctgtatgggcatcagccccttgtgcgcgtatgggacatgagcagggtccataagattctccaccaacacgtcgtacctacattacaatggagctagctaagcaaggtaaaatatgtggtggaaatgcagtggaaacctgaaagtaatagttggttcgaaaaataaacgtatgagatttgtccacgtcatcacggataaaaattttactcgcagattcactcatgagttaaaatttaactcctagtaaaattttaagattttaactcatgtagcacgttttaacttagacgtcgaattttaactcatggtgacatagatgaattccagatgtccatttttcggtccaacggtagttttcaaattttcactatatataggctttgcaactacatattttcccctaagcgaatgatcgagctgccatgctaatgggggagcaagaaattaagatttaggagaaatgcttggagatttctgtacccgtagaagaggtccctgacgccgaagactgtgttgaaggacgggtcatcgaggtctgggaagtacggcggccgcttcctctgcaggatctccttgtactccggctccgacctcgggtagaaccacaggatgttgttctgcaccacgctcgggtacgacgccacgcacgccttgctgttcttgtgcacctgccattaattgatccaagaactcggttaatcttcagaaaatgttgctgtttttttaaattttgttttgatttgttttacaggagggccgagggcgggggcctgggggatgaactggcaggagccgtggccatcgaagcaccagccatggtaggcgcactggaggcggcccttgccgtcgacgcgcccctccgacagcggcgcgaggcggtgcgggcacgcgtcgtccaccacgcgccactcgccgccgccgccgccgtcgaaccacgcgacgacgcggaggcccatcaccatcttcccgtgcggcttgcgcgggtcgaggtcgcacaccggagccacgggataccactggtccagccactcgaaccgcccctcctcgccgccgcccacggccggggcggcctcctcctcctcctcggcgcgcgcgtgtggcggcggcgtctcggccgccacggccgacgccggcattgatagccgtcgccgccgctcgccgctggtgtgtttccactgttggcgccatggaggaggtagcctgaccgtgctcagcttgacgccggcgtcgcggagcaggagaggagggcgagcgcgggagagcaggggaagggagaccggagccatggcgcttccgagggggagcttaagcgcgggacatcttttttaaagtggttacgcagaccatggccgaatgaaacgtgctacagtgggtaatattgtttcgtagggtccataagaggaatcatgctatcttttatttctgtatgtatacctattttttagctatccatgtgttgcgtgcaaatgatttctataataactagattacaaacttaaaatagtacaattctttttggaaaacgcaaacatattttagattgtgttggcaaactgagttgggaactaatagataccttccgcatgcaaaacatagtgactcattagcgtatgattaataaaatattagctatttttctaggacaacttgtcaacgaacaaaacgatctctttggacctgcactagagtaaagcaaaacgatctctttggaccttcattatttatatatcatccaaatggttatgaacaactagatagattaatatggaataaatcatttttcacaacacatgcaggttcaaatttaacttctacaagttgcaacgaaaaatacaaatttaaacgtagacatagtttaatttgtctgtttttgcaactcgtagagttgatttttaacttgcatatgcgtccagtgatatatcatatattaatctatcttgttatttttctttattttttccataaccaattagatgacatagactagctaaaaaaaatgtcgagtgttttttgaggggaaaactttcaaatctaactatagtatataatttcactagaactatactataataataataacttatatatatgtattaaaataatatatataactttatatctaatttatatagagataacaatgtagttataatgtagttacactgtagttacaatgtaattataatgtaattatagtgtaactacgatgtaactagcatgtaattggaatataacttagatgtaacttgaacaaatctaccataaacatgcgatgatgggactagcttgtaaaaaaagggtttagatccaatagtaaaatatctcagcacaaatcttagagcggaattgacggccaaaatttttttttgacagtcatctagcagttccgtataaataacggggagagacttttcgaaaacgagactacgctcagtcgttttcattctaggcctcccctaagcccactcaacatccagcgtcttcgtttctccgacacgtgtgctgccgaagacacaaaggcgatttagatttttttttataagaaaacatacatcagcaatgaaaaggaagagtgcataataacaaactggtcagactaaattagagttcaatcaaaagaagatcgaataaaatcaaacgtcagactaaattagagttcaatcaagagaagatcgaataaaaccaaacgtttgcaggtaagttctctcaatcaaaagcatcacccatttcacatatctatgttaaatcatgaaagaaaccaaagcatcgggtcaacaaaaacggttctaaatttttagttcagtggttatctgcaactttcatgtcttattttacttccaataatgcatcgaaatgtgaaaagaaaaaacaattttagtgggaacactgatacagacgctccattccccatgcaaacaaatatagagttttacatttttttttagataatgggcagcgtccggcctctacatcataagatcataaggtgaatacacacggccagatttagagttttacatatgtggttttttttttctttttcgttggacgccgatcgatcgaccaaatttattttccacagcattaaaactcacagagtttactgggcacatcgatcacttgtaagcatggacatagtcctggaagtagaagcttttctcgatgaagttggcgagccagcgggaggcagcgaagcacagcgcggccgcagccacgacggcggctctctgaaccgccgacgtgaccaccgtcgtccccttgccggcggcgaggaacccgacgacggcgaccgacgccacctgcagtgcgacctccatcgccctcatccacttcagtgcagcgctgcagctggtgcactgcatgacatgtgaccagtacctgttgatggcatcgcaagaatccaattttgatggtcactgaattctcttgtgttaattttgtgtttcagatcagtgtaaagatcactagatcagcagatttctatactacctctccatgagctgatctttggtaggagttgttggcagctgattaaccattggagttgcccagccaacctgatgcttgcagtactttctgaaccagtttctgaaggtgatgatcatgttgtcagataaagtgggaacatagcaagctttctgccatttatcaacgccaaccgccgcgaaattgcgctcctggagaaggattaattcgtcaggtcaagactgaacatatcacatatgggcatataatcaaggcagtttgatctgaagaaatgggtcacctcgatatggaggaggtacaaatccgaatccaaaacggtgttcgtcaccatgtggtgaagccaccgtggtatgaacttgtcaggccaggcgctgacgctctgtggaaacacccatatcaccctgctccttccaggagccacagggatgcacaagaacaccagcatcccctgaggctgctgctgctgcttctcctgatcaaaatctgaactttttagacggtttttttagcctgaataatgcaacggatcgagagggtggctgatgctgatacgtgccagtgtctcgaggggcaactctgaccggttgatcgtgcacggcgcgatgaacctgaagtggccccaattctccccctggattgacaggaacccgtcgatgttggcctcctctatcttcatcttgaccgggccgccgcgttcctgatcaaactcaactgtggagaggagatgaatgttctgaatcagtgacgacgcatatgagcattggagaatggcactagatgactaaactgaagaaaatttgggtagaaaattgattgatcatgtgatgagatagaacatatctgcctggatcttccttgtcttggaactgagggaagagccccttgtgtgcgtaggggacgtgagcagggtccatgaggttctccaccaacatgtcgtacctgcattgcaatggagccacggcatagtatatcaagctgcatgcctatgtgtccgtttcggagaagaatggcttgagcatttctgtacccgtaggggaagtccctgacgccgaagacggtgttgaaggacggatcatcgagatctgggaagtatggcggccgcttcctctgcagcacgtcgcggtactctggctccgttctcgggtagaaccacaggatgttgttctgtaccacgctcgggtacgacgccacgcacgccttgctgttcttgtgcacctgccattcatccaacaactcgataatcctgagaaattttgctttgagatcgacgcgggaatgtagattagatcgacgagagtagtggggctctgccttcaccctcccaatataggagcagtgtttagcatccgttatctattttttttctctcttttttttccctttcccttagcaatgggtctttcggggcggttgcgtgtaactaaaactctgcttcttctaatatattgacatgtaattctttttatgtgttcgtgaaaacaaagtttatcgttaagagaatgtagcaaaggagagtacgggagggccaagggcaggagcttgggggatgaactggcaggagccatgtccatcgaagcaccagccatggtaggcgcactggaggcggcccttgccgtcgacgcgtccctccgacagcggcgcgaggcggtgcgggcacgcgtcgtccaccacgcgccactcgccgccgccgtcgaaccacgcgacgacgcggaggcccagcaccatcttcccgtgcggcttgcgcgggtcgaggtcgcacaccggagccacgggataccactggtccagccagtcaaaccgctcctcccctgccgccggcgcccgcacctcctcggccaccggcggcgtctcggtctcggtctcggccgccgatacggccgagaccgacgtcggcagccgcagcgccacgccacggccgatccacggccgacgcggtggcgccgctaggctagctattctctgactggcggcgccatcgacacggaggggaagcgaagcaggccgcgcgccggagcggaggaggagggagaggggagccatggctttctttcacgttggcaacacagtgtgcgcgtgtgtgccagtgtgcatggctgtttggactttggatgtggcgcgcgatgttaaatatttgaagctccaggtggttcttgtagctgtagcctgtaggttgaggtggatctcgcaacaaattgtacagtctacagtaccatgtatagtaagaatctgcctgcccatccacatcatcatccaactatcctatccgtcggatgtcgggttgtatgtggcatttttttttcttggaccatatgatgcttttcttcacgtgctagctagtaggagtgaaaatgtaggaacagggtttacactttcctaaataaccgaaaattagtgaatttcggtactttcgaaactttttgtatgaaattatttaaaaatctaacaatttttttactgaatttgaattaattttgcaagttaaaaaaggtaaaattcaaaaaaattggctaggatagttgcttgccggagggggtccgaaattttaatcccttaatttgtataggaaaacaatctcaccgtgaccatacttttttctcacaagggtaaaataaaaggcaaaggtgatatcgaaactatagtgaacgaaactattcgagggggaagcacatcgatattgatcagaaactgacacttcatgagcaaagagataataagggccctttctccttattactttcatgtattaataagaagagaagaggtataacaatcaaggaagatcgttgtgttgtatgttgtcaaactttggaagatggcaggcatctttctttgaagggtagaggaataatagtgtgctactgtgttgggaatttgcaaatggaggatattggatcaaatcacctctgacctctgttaacaataaaataatagatattctagaagctgacaaacaaacaacagttaattactccctccaatctttagtgtaaaatgatattgattttaggatattacgtatgactatccatcttatttaaaattttagtgtaaatatgaaaaagtcccttctaaaaaaatatgaaaaagtataaatcatgttaaagtatttcagatgataaaacaagttacaacaaataatatttttaattagataaatgatcaaacggcttgtttaaaagttaatgacatcataccatgagacacggtattgtatttatggttgtaatgtgataagaggaacaggatatgtgagttcagagagagaaagaaagacggctacattgtcccaatgctatgtacaaactattttaaactctcgaggggacgtcccctcgttgtttacatgtcactaaaatggttatgaaaaaaactaaaaaaagttctacaacatagattaatatgcgatacatcaatccacaaatatgtaaggtaaaatttaacttttacactgattgtgaacatgtgttaactagttgtagtttgtttttttttttttgcaaagtgtagaagttcaatttaaacttgtatgtttgtgaaatgatatgccatatgataatacatgttttcaattttttattttttctataaccatttaaattacatgcaaacaacgagtgtacgtcctctcgaaagtttaaaatccactcctacacttaaaaaggcagtcctagccaacagtcaaaatggtcgctgcaggagggcaccagcaccaacctgaaggcaaatgtcatcataggataggaaggatatctagttacctctaacctctggttgttggagagtcatataactcgaaatggagctggtgaaccgacgaatatttggtagtgtagcactgtagcaagtcaatgttcactgccaaattaggacgggttattttactgtctccggtttttttcccgattccgcaagaactcccttgtccccctatcttgctatggaacctttgagaggtgatcatgtatcttttatatccttcttaatgaaattggcagagctcctatccttccccctcaaaaaaaaatatacgtatatgtgatatggaatagagctcctgtccttccccctcaaaaaaaatatacgcatacgtgatatggaattctcagggccctttctaaattgattagccgaacgttaaaaaaaagtaattatcatgtgattaatcggatatctatctatctatctattatatactaaaagttcattaaacatcttataaacactcctaagccgccaagtggcgctctaataaattagataaattcttagaaattctaagaaaaaagcaaaacatctagcccttggatttcacttaaaccggtggacccattattttacaccgtaagattagatttgtgagaaaaaaaagttaattcatctgtgatcctccttgcctgctattcgctttggatctataaaaacgtaacacactccacgattcttacacgtgatggggcatcagttaatcacaaaccaacgcactcctccaggtagcagggttctgcacgcaccatgaaacgttgactaggtacgtcaatctctttcaccggcgatcggcctgcccagctgccctagatgatcggctacaagggcagccataaccatgagtccgttgatgtcgaccagactctcgcgtcccccaacctctaccactccggcaatattttatcaattaatatttgatccaaactgaaatttgcaaactattgttgctgtttttttaaaagaaaatttccgttccaacttccaagttttttcatgtttctgatatgaaacgacatcatgaacttccaaattgtttctttccatgttaatgatatgaaacgatcgacatcgtggtcattcagtaacctaacaaatttgcactactgtatataagtaataaattgtgacactttcttattattactaattttgaagtttgcatctatttaagtggcaccaaatcataataacttactaatggttaattttaaaataagttctcaagttgataaaatattactgttgagagttacagatgagcacaattttatttttatatgttgtacttcccaaacgataaaatcatgaaaaattaaagttgtaactccaagtagagcacataccttttatgaattattttatcattagaaaaaaaatctaaaaattataactccatgcaaagatgactctagatgcattaactgttcaagtcataactctacatgtataacttgatatttactactcccaccatccttcctccatgccagtttgatctcatccaagttttttatatctccctaaaataattaacatataacaaatgacttttcgtttatttgtgtaaagagtaaataaatgggcatcgttgaataagctcatgcatgcaactaaccaaaattactttctattggtgtaaccctaaaaaaaattctcttggtgtaaactccacgaaatatttacagcgtgatgcaatcaacaccttgattgatgaaaataattttagaaccatggaggttttgttgtttttggtctcagcatcctttgcttaggtgatgatcaaattggaatagagggagtaatttctaagtcagaaatattctgtcttatttgtaagtgacaaattgcatcaatgtaaactgggctagcttgatgccaaataaaacacatgtgttagtagaaaataaacaaatttaataaaaaaaatagttagctcctaaacatttttttaaaaaaaaaccttatttttaattcacatttagtttattagatatgttttctaaatagactaagtcaacactatcttagatgatgaagaaaactatagggatgaattaaatattatacggtataaatctatcaaatagattaaacaattattgaatgcgcgggctagcttccttgttaattattaaaaacttaaaaaatagatttatttgatttttttaagcaacatgtatatagaaaagtttttgcatgaaacatataaaaacatgctaacaaaaatcaaataattagccaagctgaaattaacgtagtttagaacgcgcccgaaatttgttttctccatccatttgtttagctgcatcctatgaaatcgtcagctaactcttaagatgatcagttgtttatatacagatgctatcgatatcaagcatacttggttgtgttttctatatacatttttaagctgctaaattagaagctaaggaattcccagcaacaaagaactctctgatttcctggacgcatcgacgatcacttgtaagcatggacgtagtcctggaaatagaagttcttctcgatgaagttggcgagccagcgggaggcggcgaagcacagcacggccgcagccacgacggcggatctctgcacaaccgacgtgaccaccgtccccttggcgacggcgaggaacccgacgacggcgaccgacgccacctgcagggcgacctccagcgccttcatcttcttcagtgcaccgctgcagctcgtgcactgcatgacgtgcgaccaatacctgcagacggcatcacaagaatcatttgaattcaaaattcaaaagaagaataattgaattctcttgtgttaagttttgtgtttcaagtcagtgtgcaagagcagcagactgatgcaggtagattgtttagctgtttacctgtccaagagctgatctttgctaggagttggtggcagctgattagttattggggttgcccagccaatctgatgcttgcagtactttctgaaccagtttctgaaggtgatgatcatgttgtcagatgatgtgggcacatagcaagctttctgccagttatcaagaccaaccgtagcgaaattgcgctcctggagaaggaataataatgcttcaggtctagaatggcataacacttggcctgaatcattcagtttcagctgaagaaatagtcacctcaatgtggagcaggtagatgtctgaatccaagatggcattctgcccaatgtggtagtaccaccgtggtatgatcttgtccatccagacgccgacgttccgcgggaatgcccagaccaacctgctcctccccggagacaccgggatgcacaagaacaccagcatcactgtgggttgcttcttcttcttctccttgccctgatcatcctgtacagaatccagcagcaccaacaaggtaattgacaatactgatcttgtaagatggttctatgagcttgaacaatgcctgagatggagtctgaagtggcgagccgtagaacgtgcacggcgcgacgaacttgaagaagcccctgtctagcattgacaggaacccctcgacgttggtttcctctatctccatcttgagcggcccgccgccttccttgtcgaactcaactgtgtagaggagatgaatgttctgaatcagtgacgcagctaagcattgcaatttgcactagactgaaagaacagattaaattggggagcaaattggaaaagaaaatttgatcatgactaatgacagatgaggaacatatcttcctggatcttccttcttgcgggtgcgcatcaaccccttgtgcgcgtaggggacatgagcagggtccatgagattctccaccaacacatcgtacctgcattgcaaaatttgcaatggagctagccatgatcaacagctgcctgacaatggtgcagaaagaaagatttcagagaatggatttgggatttctgtacccataggggagatccctgacgccatagacggtgacgaaggacgggtcgtcgatctgcgggatgtatggcggccgcttcctctgcaggatctccttgtactccggctccgatctcgggtagaaccacaggatgttgttctgcaccacgcatgggtatgatgccacgcacgccttgctgttcttgtgcacctgccattgatgcgaaagctcgattaatcttgattgatttgagatggaggagaggggatgaagaagaagaggaggaggagagtaccgcggggccgagggcgggggcctgggggatgaactggcaggcgccgcggccgtcgaagcaccagccatggtagacgcactggaggcggcccttgtcgtcgacgcggccctcggacagcggcgcgaggcggtgcgggcacgagtcgtcgaacacccgccactcgccgccgccgccgtcggcggcggcggtggtgcggtcgaaccaggcgacgatgcggaggcccagcaccgtcttcccgtgcggcgcgcccgggtcgaggtcgcagacgggcgccaccgggtaccactggtccagccagtcgaaccgctcctccttacccgacgccgacggcgcgtcctccgcccgcggcgtctcggccgccacggccgcaaccgacgtcgacaacagccgcctcgccacggcgcggctccacggcagccgaggcggcgggacgcgggcggcggcggcggcggcggcggcgtcgcggaggtggagcgcggggcgcgcggggcgcgcggcggggaggaggaggagggagagggcatccatggctactcgcgtggtgggggaggggggcgcgagcggcccgcaacgaacttgtggcgcgcgcgcgcgcggttacgttgggtggggcccggcacaaacttatcggcgccgcaggtgattagctggacgctcgccacttggccaaattggagacgggagaggccgatgccgatgcaccggttttacagggtacatttaattatttgccatttttaaaatatgccaattaataatttgctacttttataacatgtggttccttatgtgcctataacatatggattcagagccaaattcttttgaaccactcgtaaaagtggcaaaaagttaatatttcgttttctagtatcacttgtcgagtcgtcgccaacgagccgccagaaactgtccgtgcaacttgtgccgatttttttattgaaagtacaaacagcaaggtagaaccatcactctttggatgataagacagttggttggttttatcggctaaatgccggttaactaaagaagggataaatcccctttatctgtttctaataaaattgaatatgtgatagagttaattttgtgatcggtaaaactaatctctaaaactgtattcgagataaaccctagagcccctccagcgtctataaaatagaagttgaacacaaaggagaagggacgccaaattctctatctaaacttcaaaaccctaaattgcccgaccaactagaaaaggtttgtgaggcgatctcggtgaaattttacattggcgcataagaagaaaagaaacagaagaataagagaaggaagaaactaaaggagaataattaacatcgatggcatattatgtgggtattgaagcataggtgattatgtataagctaaatcattgagatcgtaaatttatattccaacacagacatgctagatttttcattaacgaatcggttcgcgccaattccattaagtagagcaggaaaaaaatgttagaaaaaaatatcgaaaggtatataggaatgaatggaagctgccagtttctaggcacccgaaaggttcaagttttggcatgataaaatactaataagggtgtgttagatccaattttacaccccatcacatcgaacgtttgaacacatgtatgaagtattaaatatatgctaaaaaaataactaattgcacatattgctactactttgcaagatgacttttaaacataattgctccatgatttgacaatatggtgctacattaaacatctgctaatgacggattaattaggcttaagtctcgcggtttagtgatggatactataattagttttttcgttagtgcagaataccctatacgacacctatataatacctgatgtgacacataaaaactttacaccctgatctaaataacccgtaagaatgtactacctccgttttgttttttaatagataacgccgttgactttttttcacatgtttgaccattcatcttattcaaaaaatttacgtaattataatttattttgttatgagttgttttattactcatagtattttaagtatgatttatatcttatacatttgtataaaatttttaaaaaagacgaatggtcaaacatgtgagaaaaagttaacggcgtcgtgtattaaaaaacggagagagtattttgctatagccgtttttacttatggaagagtgacgacatctgagacagatcgaagagcatcgccattgtcacgatggcgacccaatcacaaacatggcagaattgcagagagtctagtaaggcagaagctgaggctgagcttaccaaacacaagcacacgcacacgcacaccacacagtctacctatacctactactacctgtcatcttctccttcttaatcccaactaaatgcgcacataaacgaagaagatttgcactgatacccgcgctgatacaagcaagcatccggcgatggcggcggcggcggcggcaagggggagcgtgtgggagatccagcagcgggacgtggaggccgcggggctggccgacgccgacgcgggcgccttcgtcgcggcgcttcgctccgccgccgccgttgcgacgggtgggcctgacgccgcgtgggaggccgtggcggcgggggtgctgcggccggagcacccgcacgcgctccaccagctcgtctactactccgtctacgccggctgggatcgcgccgcccggggcccgccgccgtactggttcccgtcacagtaagtcacctcgccggagacgaccagactggcaaactgacagtggctggtttcagtgtatgcaaagttcaagcttatgttgatagcgtcctagtactacttaatttctagtgtgatatcatcagtgataagatttccttgtgttaatttccacttgtcatgtcaagtaacctatttgaagtacaatgatcagtgcatgatttctctacgtagtgatttagtgtttgaaatgtgacaggattgacactaaacaaacaaatcttggtagactgatggaagcacatggtcctaggttgttaggatcatcatataaggacccagtttcaagttttcacctcttccacaagttctccgtagagcatcaagaggtcagtcggttgctctaaactagtcagctccagctaagcaaccaaacaagtttgaagtcatttctttacaaccattggagtggctatatgaatgttatttcttgaatggacagtttaagtttccacaggcattttgatcctactcccagtctatcctttgttaggtctactggtcaatggtgctgaaggagatctcaatcaagttccaacaagaaccaaagtcaattctagatacatcagataaatcaaggaaagggggaacatggctccaaggtgctgtgcttaatattgctgaatgttgtctgttaccttggccttcccaaaacaggacagatgacagcacagctattgtttggagggatgagggtcttgacaatcacccagtgaaccgtatgtcactgaaggagcttcacaatcaagtgatgtatgtatatgttatcagactaacagtaagaatcatgctaaagcgtattaagctttgccataacttattctgaatcatcaccattgttttgctgcttttggtgttttcagtacagttgctactgcgcttgataccatgttccaaaagggggatcgaattgcaatagacatgcctatgacatgcaatgcagtcatcatatatttggctattgtccttggtggttttgttgttgtgtcgatagcagacagttttgcacctcaggagattggtacacgcatgagtgtgtcaaaggcgaaagctatttttactcaggtaggaaattagtgaatctttcatgacatagtcattaacactaaagtagggcttcatctaaatttcacgagatttcaggatttcataattagaggagggaagaaggttccactatacaggtacgaacggatgattgatcagttcatttcagtttgtctattctgatagtataatgcacttagcattttgtttttttaaaaaaatgcattttcttcatatatttttctaatttatgacatttgcttagtttgaagttaagtaggagtgtaggacgttatcatgtgaacactgaaaacattctctttcattgattttagaattcagcttagatttttcctgtgaatctaaaaaataggagtacttaagtaccagatagttcatagtacatttcaatcagaaagacaatttgcagaacagataaatatttcataataattccattcttcagccgtgttgtgcaagggacttcatctaaagctgttgtaattcctgcaactggaggctttcttggggtttcactaaggaatggtgatatgtcctggaaagatttcctttcttgtgctgctggaaggtatattatacagaaataaatcttagatggctttggataagtgtattgtctttccattgaagaaaaaaggaacatgcaattgttttttttttctttactaatttcatgatatgagtgacaatatatgttggatttgcaggtcgtccatttatcccacagtttatcaaccttcagacgctctaactaatatactattttcttcagggacaactggtatattaacactatttcattgcttcccctgattttagtatttcttttgtccacccctgatttttgtctgttttatttacttgtgcaggagaaccaaaagctatcccatggtcacaactttctccaataagatgcacatgtgatacatgggcgcatttggatatccagccacaggacatattttgttggcctactaatcttggatgggttatggggcctatactcttgtactcatgctttttaagtggtgcaacgttggctttgtatcatgggtcaccacttggtcgtggtttttgcaagtttgtacaggtacatctgatgtactttgcaccgtcacttgctttggaatgttaaagaagatttatattttatcattgcttcttgtgtgcactgtaaactgtactaattatgtaggatttgagaccctgcttggttgagcttcaggttataatctaaagctgattttgaattttagaatttgattttaggattaatcttaggggtttcctttgttacttttgtcatctagctctcttctcacaattactataacaagacaagtaaaaatcctaactaaattattcttaaaaattaaacctcaaagttccaaattgcttttgatttttcttaaaaattaaaaatctgattattctttgtttattcattctgatttcatatttggttatggcacatctctactgggtagtgagtactaacaacgtgtttcacctcaaaaactgtttttgctctcagatcctgtttctttgagccccctttccccccacaaatcaggaagagttttgccaaatgcttatgtttgaagataaatatgaactgaacttacttaatcatcatgctctgtgaaatattttgcaggatgctggtgtcactatattaggaagtgtacctagcttagtgaagtcatggaaagctgggaattttactgaagggcttcactggaccaaaatcaggtgagtcatccttccactatcagaaggctcacagcttcatcacaatcagaaaggaagttaaaagtagtattataattgcagggtactctccacgacaggagaggcttctgatattgatg

SEQ ID NO: 63584 - DNA, 26970 bp, Oryza sativa
  unsure (1)..(26970): unsure at all n locations
tgatcgtccatgttttttgcttttttcttctatagaggaataggtggtagtgaggactaaggcgagaactatacgttcgaatttaaagaaatatagcgagtccggtattttcgcggatacgctattttgactgtggttatcttagctgtgcagagtctaggagtactctcggtgtaattggatcacctcgatttataattatttggactgataactatgaaagaagcttaattcttttatggtcagaaatgacaaattcatcaaaggtaaatgataaattcatcaaggtaactgattaaatagtatttttcaatcattaaatgatcattgcgtattagtcgttaatcataataatttacagagttaaacaatgcaatgtggcataaataatgttgaaattgtgttacactcggataagaattctaaacaagccaaaaaaatatatatcttctaaggaagtttgaattgataagctcaatacagacatcaaatattctgaggaagtttgaattgataagctcaatacagacatcaaatatgcatttgttgaattcagacgacacactacaaaatggaatgagtgaccatgctgccccaattaaattcaatatatatatttatgtatgatatttatatttcatatgatttgaaaagtttcaatcatttgaattaaatggctacattgaaaaattttctataggattgaaatcctataaaatcctacatagatctttggatttaaagtagcgcttatttacttaagtatttattttttatattacatgtatttaaactaatgtatttataaaacaataaattatctaaagaaatgtaaaaaattcaatacattataaaaatagactaaagataaactaaatctcatttttatatgtagatctcattataatgcataggcatgtaactagtaaatagtgaatatcacaactcacttgaataatatatatcacattatgatcattggattcataacaagtgttgatcactacttcatccaaaaaaaattatatgactatatcgtttaatattattaaactttatagcattctagattatatttagcaaaaatatctttctactaaaaaactagtcagataccttttataaatacaatatcatttacaaagataatagttattattttctcatataaaaaacatagataatatatattacagagcacacacacacataagctagctgctactgcctccgtctctaaatataagggattatgtctagatttattgtactagaatgtgtcacatctaaccaaaatcgcttatatttagggacggagggagtagtattcatgtgcaagtaatagtgttgagtgctgactgtagcaatattattatcaaaaataaataagaatgagaaaacaagaagaagatggaacaacaaaagaatataaggttaaagttgttagtttcacaccattcactacaaagaacaattttaataatattaatatattatctattaatgtgagtatataccataccatggatgtgagcaaccaccctcatgtgtttgggctagtgactaacctcctctttttcttacttcttttgaagttctctgaacgtatttaggtaaaagatgttttgttttgaataaaaaagaaacaatttaactggattattttttagagagaatccatcgtgtgccgctaactttgtcactgttctataatatgccactgagtttgttaagttctacaatatgtcattgtattttgcttaaattctataatataccatcgccgtccatttagattctgttagtactttataattttgtcctaatgattgaaatatccctaggacaaaattttctaaaatttggctgaaaattccaaaatatcatattataaaataggcagagaagttgcccatctcaaactttgtaagttttacaatctgtatgataaaattgtacaatgctaacggaggctaactagacgatgatggtatattatagaagttaagcaaaatgcggtgccatattagaacttgacaacccaatgacatattgtagaccggggacaaaatcagtgacacacaatggattgtctctattttttatggttgttcggttaactacctatctactatgatgcggcttttttagaaaaaaaagttaaatcttacactataagtccatatcttacacattaaattacatacacttataatataattttcaaattttaaaatgccctattctcattttataggagaattatggaaaaatgatttattgtctatttaattatgagaaaaatattagtccaaattaacatatatgtagaaaataaaaaacaatatgaaagaactacggaaatacctactaatgtagtaatcatatatcatgcaatgaaaaaagaagaccatagtcgaatactttattattgagcaaaaatgatggtattatttttatcatcttttagcggaatctatctaaccataattaatcatcccgtgttttttgtgggacaaaagggagtaaattatagcacatactatggattcttaaaaattcttaaaagttttcatataatattatcctttaaccattcttttcatttacacaatagccaactttacatttcaatttggaccaccttattctatccaagtccggtgattcagcaatgactctgcacattaactctctctctctctctccattttctttttccctccaacagttggataaccaatagatctagcaagaaggagcccaaatatagcgccttcgcgcttcgtcaggtcagctcctgcctcccaaagtccctgcaagcctgacttccccgacctgaacgacaaccataacaatagtgtgcatcacgataggggagggtaaaaagacatgtcggttactagagggtaaggctgcgcatgtaaaggcaagaggaggaatgatgatggctcatggagaaagagtggtggtggtggtgcgtagagtgacagttagtgtttgttggtggtatgaggaatttgttgttgacacaatcgcttaattttcctttaagtattgatgatacgtggatcaccagttatataaataaatagtaactacttttaataaaatagtaaaaatattgagataagggctatagatggccatttggccctcctggtatggcccggcccaggcacgagcaaggcacggccaaagaagaatcaggccggcatgacacggtcggctctttgtgccgggccgtgccggcccacgtgctacacctcaggcctaggcacgacccactagcagtcgggccgggtctttgggatgtgacatatatataactaaaataaatatattttatgtccatattcttttggccgtgccatataatacgtctatttttgctcctactgtgtcttacatatggttgaaaattagtccgttatgtatcctgaacttcgtaccaggcttggctgtgccatcccggcccagcgtgccggtggggaagcccaagcatggcccggcggtcgggccgggccggcacgggcacaacccccagtcgggccgtgccgtgtttgggccgggccgtcaggcttggaccttgtgggcatctataataagggcggagtagtcgagtatcgcgtagaagaaaaagaaatctgccgtctcgctctcgttgtctcctccgctccttgcgccgccgccaagacgagtcgcggctgaacaggggagcgccgggcggcgagctccatctggcgagcagagcagagcagcggaggggaggggatcctggtgagcatccgcgtcctctctctttctgattcatctctctcttccaccccaccgggactggaatttgcttgcgttcgtgaacccctactagcttctcttctagatctggaagaagctcttctcctcctccttaatttgatagccttaaacctctcttaattcagtttatttgttcacccaaaagtttggtggttcagtcccaagttggatccgcccctgtagttaaatatccattttttgggctatctactgatttcccgtcaatgattttgttgctgaaaatttccagccttttctgcttcaggaatcaggacatagatggatccagaggtgaaggactcaaggccatcgaggtctcccggcgaaccaaatcttttcctgcaatggggcagccggaaacgactccgctgtgtcaagacgagggacgacggctcgccatcacctgcgcggaccgatgttcttaggcgcaccataccacgagtgaatcgcccgcttggcggtgatgttgccccgtttcgttcgccgcggcgcccgagcacgctgaaccgaaggtagcttcagtatgccatagaacacactcgcatcgactggaaatatcgagcaattcttcctaatataaggtaactgattgtctgagagcaggaaaaccgagccatttgtgagcgataacaggcactccatgtcactctcgccagagaaggatcgatattactccactaggggttctccattcccattcgagggaaatgggtttgattttggtggtggaatggaagaaaagggaaccacagcactgccaaggttcttcatttcattatccaacaaggagaaagaagaggacttcatggcaatgaagggatgcaagctcccacagaggccgaagaagaggccaaagttgatgcagaagtgcttgcttgtaatcccttctttcacaaagattactgcaaaattttgttcttttatgtgatcatgctcacttttttttaacccttccatattctgtttcattgttgggcttgttgtagatggtaagtccaggagcatggctgtctgatttgtctcatgagaggtatgaagttagagagaagaagtgcgctagaaaggtaaacctagctttgttgttattttccttttagctccttgtccaaattttagtttgatggttgctaattcaaggaaaaactttttgcagagggctagaggattgaaggctctttgcaatgagagtgattcagaatagaaatacagagcgggatcaattttttttgacttttgctggagacagttaggtacaatgctggttcattcattaactagacagatctgagcggctaatttagagagggaggatcaccggctctcctactatccttatttcaccacccctgtatctccatcctttttttgttcattcgttgttccaaacaaatcgtcatctagaactaagcctatcgaccgaaatagttgtatattagatcattcctgatctagcaagtttgtagctcagaccttaaaggcaccgcggagtttggtcaccactgaagtgaaagtaaatgaaaacgaagagagagagcttaagatggaaggcagcaatgcatggtctatgagtctatcatgatttgggattgagaaagaagatgggaggttgttgggtatggtgcatggtgcattttggtgcctcaattgttgtaacagtaacaccaagttgggaggaagatttgaggccagctggccattcaaataggttactactgaatcccaaatattgtaatcctagttgatgttgaagagaacgccgtgtgcaggccatgcctgggcatgatcctggattcatggttagactgtttctcctgaaatatatatcaaattcgcagagttgtttgaccttctccataagtcttgtgttacagtttaagttctgttggagtgatggattgtgctgtgtcactcactcctgttaataattctgcttggtatgttacgaccgttgttatctttggttcgtttcagactcagtaatctgtctaggcgcctcgtcaggctgctgaaattgagcattttgtggggagggccgagatggtggtcgtgggccgtaattgggagcccatgaagagaaacccggcctgccacgggctgcctcgatcaatgccgccgcaggaatttgggcctccatttggcctaccagtaaatggaccgctgctgcccgtgggctgtacgagggagcccaagcgaagaaacgcggcccacctcacaaatttgggttcgttttggcccaccaagaaatccgtattgggcctagagtggagtaggagagcaatttcacgcgccgagaaatggtggctgtcggactattttgggcctccaaatggcctgcttagaaagtgggtcgtcgtgggccgtttttagcgtgacaggccgagttggagcccaactgttcagccatcctcggccatcgggaagtccgtcgatccatggcaaccgctcgccggaaagtccgtcgtctccggcaccggcaagtgtacgccactccgtcatcattttgcttgctacacgtccaagacaggaactgcttggcatgtgagcaccaccaaggctcctgcagtgtccgggtctgcgagtgcatcatctcacttctgactaatttaggctgtgtttaggttacgggtgtaaagttttggcgtgtcacgtcggatatacggatatatatttgaagtattaaacgcagtaacaaattacagaatccgcctgtaaaccgtgagacgaatttattaacctaattaatccgtcattagcaaatatttactgtaacaccacattgtcaaatcatagcgtaattaggcttaaaagattcgtctcgcaatttacacgcaatctgtgtaattagttatttttcgactatatttaatactacatgcatatgtccaaacatttgatgtaatatggtgtaaaattttgccagggatctaaacagggtctaataactgactggaactggacagtgacacatctctacttccagtgtttctttttcttcagagaacagacaactgagggggcccctctctcccaaacaccccctcagtgacctcacctatgatcaggagtacaccatccttctgttcagggaggttcagagctttcaaaattcaacacagattcatcagagaaatatagtactactgtacaatgcaaatgttgatgatccacatttgtgtagttctcttcgaaccaagtcaaaagaaaacacatcaaagaagcaaagggacaactaccattgcctacaggatttgagcattcatcaccagtagccaacaccgagtgcctcattagttatccaaaagcttattataagccataacagcttattgagataaaaaaaaatgtatatacatatatgtttttaatgacttaactaatactgaaaaaaaaaactatgttgaaaatatgttaaaatcaacttcaaagttaagtttaaaatttgaattttagctttgattttgtttttttaggcgcaccgatgaggctaagcccttgtttagttcctaactttttcttcaaacttctaacttttccatcacaccgaaacttttctactcacataaacttccaacttttccatcacatcgttctaattttaaccaaacttccaattttaacgtgaaaaaaaacacaccctaagattcagaaacaattaaggagaagaagttggcctgaggagttatggcactggcaaacatggacctagtttcagaatggcccaaaatttcaagcatcttcacatgacacatatacaaactcctgcatatacaaacatgcacatttgttgaggctgctctgcccccaaactgtctctgaatctggtcctggcctgtcaaacagcatgggttctcttccaacccaccaaactggagcatatactatgaaacaagggcaaacaaaccagacctctagaaacactcctcaaccaattttgttcatctgcacatgactgttgatggcattaagatggtcaatgcaatgtacagtacctcttacaaatccttcttcatctgcaattgacaaaaatatacctgacatttatgctccccatgaatactagtactcacaatattcaacatactactatttaggtctgatgctttcatggttggcagaagagataaatggcacaacattttagttattttttgtgctttttatagcctactaccagatactcctccatgggaatggcatacaagttgctgagtaactgaatcctaccaattcctctttcctatacaccactgacattcaaaggaggtaaaggtgacatgagaaaaataaagcatggccctctgaccctttagttaagcccaagagagaagctccataaccagaaagacaagtgaatctaccatataggaaaaaggaggtaggccatcaccacaaccaccaccagatgccattgcttctcttcagaagacttggcattacaaaaaaggaagaaagaaagctcaaggcagagagagattagaaagcaacaccggggacccattcacatgacacacactatctagggctaaaaaactggagcagatggtgtattacacttgaatggttaaacacttgctcagggtgttcagttcagttttcagttgtcatgggcagtttgagctccttccagggcctccatagtagaagtatgtgccccagtcggcattgttaccgttttgcacgtcgtagcagttcgattgctcagtgaatgtgcccacccccttgggggctttcaggttgttggtgctgtccaccacctgtatgttcttgaagtagcttgacttgctgaacccttcctccgggaagtgaccgctgcccatctgcgtcgacgtgtgcacgccatcgagctgcgagtttaccacctccccgccccactcgatcatcgacgcgctgtcgccaaggtaggagaataggaaggatggccaatagccaagaacataatccttgccaaactgcatccaccagttcccctcctttggatcctgctcatatatatgtccagcaaatttcattagagcaatgcattagtgcattactaaaaaatccaatgtaccaatatacagatgtatttagacattaaaaccaatatatcaatatacagatgtatttagacattaaaaccaatatatcaatatacagatgtcttcaattatcaatatacagatgtatttaagacatttgcaccgacatatctggacttcagtacacaggcattgtgcccatttagtactacaataggatgcctcgcattcatgttgtactaagcaaactatgtttgcactcattactcgtgctcaatggaaatgaaaaacagcttgctttctatcttgcactttgctcggcacttgcttgcttgctgaggtgaaaagtagcaatggttctttcttttggaaaacaatgaaactagagtaatcattaaggataagaaaggctgttgaggaagaaaaaaaaagtattatgaccacactaccacaggggcacagggtgaggaggaaactattttcaaagcccaaagggtatcagccaaggagcacgagtaagagcacagcagcaagtgggcagagagattctctggcctgcatgttttgtgacaactctgaacttactactactactactaagcgggggcatgtggtgagtaactgaatttctagtttaattttctagctcaccttccaaatcattatactgatatcgtattgggagccagagtagcttgagatggggaagatgctggctcccatggcgatctcactgtttatctgcacgaatcctgcacacaatacgttgtagcaccctgttgcctggtatgcatcgctctgcagaaacccaggtttaaacacaacgaattagacatcaatacaagcacatttcaccaattcttcaggctttaattcattctggaatgaacaaacaaaacttacagtccagtaagtgaacagcctcgtgttgttgtcgccgtagaggtcggggctaacctgaagaaaatcaaaggaaaacacaaaagcagattcagagctcgtgagtgacacagcacgcggggcatcgcggcagaaagggggtattgcaaccgcaagaacggtgccgcatttactcgccaatgcaaaagctcacgcatgagatgagatgaaatcatgaacatgaacatgagattagtttctttcggattgctacctgccatccagcctcgatgctgttgaggtcctcgccgaaggagccacccaagatccagagctgggacaagctgaactcgttgggctgctcgatcttgggcgcccagacattgatggttgccttggcgccgtagtacttgtcgccctggacgtacgcgatggcatgctgcaaaacaaagaaagataaattttcacccaggcaaatcagtaaatgagccattgctggtacccgcagtgcaacaacaaacattgcaagcatggaggtcatagcgcatcaatggcgaccccctctcattcctgggtgaatatgtgattgtgacgtacctggtggccgccctcgttgagcaggttggggtcgacggacatggggttgggcgccgggtgccgcttcttgccgtagcggcgcatggagctcgcccggagcaggtcgtcccgcttcgtacgccggattgggacggtgtcctccgggcacctgccgccctggtgccagagctggaccatgggcttctcgccgccgccgccgctcttggattcgtcgtacaggccatcgggatggtagttcggcctcatctgcggagagcatgatgatggtcaccgccattgttgcggaatccaacgaattgaggtttgtagatgccattgttgcagctgaaggtttacctggatggtgtggttcttgaggaagggatgatcgaaagctggctggtgtgagatgtgcacgcaatctatgatgtccccatctgggctctatttgattccacagttcgaaaatgacacaaatcagatgtgtttggtggggtaagaattgccagagatagctgcttgggtatccctatgaaaacttgctaaattttgcacaaagttaagcaagatagaagaacttgagaaaagaacaagcacaaagtgacagccaaaaggaaagtcacaaaatctttgctggtacaattttttgcatatttttcacccaatgtagccaaaaggaaggtaaaggttttgaacgaatggtaaagagagaaagtgaattcccccaagatcaaccacaaagagccacagaaaagacatcttctcttttgaatcagaataccaccttgcactttgaacgattagcccaagagcaaacctaccaccttgctcgtgcttcctcccaaatcctctccccccaaatgaagctacacacgcttaactttgaccaggacgacgaacccatgatagataccaattaaaaaaaaagcaaattcaaaatcttcacacatgacgcacctcgatgctcttcaccgccggcttgttgagccgcttcaggtgccggtgcgccctccccgccggagacctcgccgccgccgccgcgcacgacaggcagaccaccgccaccaccaccaccagccaccccacgccgccaccgccgcgcgcggtggccatgtgcggctctcgcctcctcacgccgccaccgctccctcctcaaatcgcacttcacttcacaccccccccccccccttcctcttcaccgacgaactcacctcgccgccggtgaccgcgccgccgcagcccgagggccgatttgagaaattcgaaacaatgcggggggtgcagcagcaggagcagcagcagcagtggatgggtgggtgctggattcttgggcggctcgtcgtcttccgctacagcagcagcagccacgaggatccaagtgggcagtgaagcgaagacacacacacacacacactctctctatctctctctctctcagcttcatcagctttcgcagattacgagctttatttttggggcttctggactggaccaaaatgccctccatgattcgcaaattattacgggtaccgggcattccacgccaggaccacgggtaacgcccactgatttgtggggtccgaggaaagcctttctcaagaaatggagtaatagccgctgtgttagtgaaaaaaaaaaagagtgaattgtactttgggctatgttttattgcgatagtttcactttgaactaccctgtatacaatcttttcacgttggactaaataattttacctttgttgcataatggaccaccataaatcttttcgctagtgatgtctagcgtctctttcgacaaatgtatggcatgcatattggtatgaaagtttactggcatgtcgttaacaatttgctcgaagtcatcgaagaactgaagatatgttttggggtggttcattgtgcaacaaaggtaaagttacctagtccaacgtgaaaagattggacaaatggtagtccaaagtgaaaattttggcaataaaatatggcccaaagtgaaattaactcaaaaaataatgtactccgttccaatgctaaattatactacagctatttctaacttagtataccttgttttaaaataaaattatttctttatctgttctcttttttttaatcaatcacaatcattttctcattcatttatttacctactttctcttcgatcattttttatatactttttaatagccgtgtccaactaaaaatatacttaaattctgttgtgattctctaatcatttttatctactttattaatacatgtgtctacctagaaaatacttacattctcaaaccgaggaaatatgttgttttgcgatataaaatccaacactatctatattagtgagtgatactttaaagattatactatctatatctttagtgaccaccaaatttttacaaaatatattggggctcaagaaaaccacttcccacgataaggtataaatattagtttgttttttgaacttaccaattaatcgagtggtttcatgtatcagacaacatcgagtggtggccgtcaatatttgaaaccttcatattcgtttcgcaatccggcttaaatttgaataaatggaaatgttgttgtgaagaaaataggtagttagacataatttttgtaataaatataaatgttgttgtgaagaaaatgggcagttgactgtaatgtcgcacaatgataataagagttaaacattagaaaagtccacaccatcaacatgacaacatgcattaaatgtattaattatactaagattatccataatatgcactggcataagattaattaatctaagtcaatgagacttttttttccttcggacttcatgccagacgatctatagctagcatgatctagctttgactattacagttcgtcgtagtgcttcctagattttctgtcatagctgactctcaccatctcaaatccgtaatacgtttgtctttcacagtttgttcctagatgtttatgcacgcattgcacggtggttcaaacggctaaacccgacttcttcctcctcttggggggcaaaaccctgggtatggttggtaattttctttattcgggccactcacgtgggcccccaccaacctgcccactgtgccgcggccgggcccccgttccgtttcccccaacacggccccaccccccacccgcggcccggcacgtgggagcagccggcactcgtgccaccgccccacccgctgaccagtgggtcccatcttacgtggtgggaccggacgcgtgagcttttcgcttctctctctctctcgcacgcgcgacgcgagcggcggtcgcagcattggatcccggcggggggcgcacgcgtgcctccgtgcaccggctaacgaaagttttaaggaaagtgattaggcagtgcttaaggtacggtgagctttggaaaaggggaccctgcaaagtgcacaccatgcttacagtactgatatattacagttaagtcattttgtttaacggtagtactacgagtagtaggtaagtacagtactgatattgcagttaagtcgtttttatcattacccgcatgcgaagacatgctaatacgtattaatggtgtcgagctagtatactagtatactctagtttttaatgacattcgtcaggtctacgcaagagaagtaactcaactgtcccgtcttcagatactccttccgtccaaaaaaaaaagacaatttcatgcctaacgtttgaccgtccgtctttcaaattataaaaaaaaataaaaagacaaatcacgcataaaatattaatcatgttttatcatctaacaataatgaaaatacgaattataaaaaaatttcatataagacgggccgttaaagttggacacgaaaatccagggtttgtcttttttttatgacggaggaggtatgttcaaatagaccccacacaaatacactatacggtatacctggataagatagtagtaggagtacattataaaaggaacattgtaaaatggctggtgaaatgaagaccgaaatgttaacctatcctataaaaaaaaagtaacgatcaccggtatgacacgtttagcagcaaaaagcaggtacagttctacgtataaaactaaccgcgaccgtgcactcatcactccgttttttaacccggcctttgctccagaatgtttttcacgctagtaacactaatcagaggagggtgaggactaaacgtggagggttaaaaagataaacatcgtctggtaacaacctgacaacagtaataatagtgcttgcacagtcgccctgcctgccacgatggctggttgtcgaagcagtaacaacagcacatcacatgcattggtcaatccagaccctgctaatgctacgaccgttgaccggtctcgtcttgaccggatcttacagcatcggacctcttggtaaacgggtaaaaaacctagaaatacagcagcagtaacatgctaaacagatggatacaaaatttatttagtatcggagtagtattacgtgcggtccatactggccccacctgtcagtaggccctttgcattaggacaggctttggatgttttcagtttggtccgtagtagttgaaatttttttcaccggctcagaagacagtcataataattcgaggcacacctatacaaataatgagctcaaatagacactaatagattttacttcatccacaagctgaatcgcccgcgaatataaaagcatataaccacgtcagagaaggaggaatccatctctcttctactggcttttcttgcacaagcacttgaagttgaagggcacctttatgtacaatttccaaactacaaagaattgaagcaaggctaccaaaagccagtgattctatacaaatggtcacttcccaacaagcggtgcaagaatcgaatcattatccaacatagctagctcaacaacgcactgaggatgtgcaaaaatgcagcttgtgtactagcaacacacacgcaccaagatggatacgaacaattatacgtggatacatgcatgggggctgatcggttagcatcagggcatgggggacaaagtacaaagcaggctacaagttggggataaggaaacccattacacgtcagctttagccttggacacaggaatgcataccaggtaagaacagtagaggagtcatgggcacaatcacaattcaaagccgttatatcacatggttcgctgtttctctcagtgagccaccctggcaggtttgtccagttatgataaagaggctaaacagataaacacacagggcatcattttcagtctccgtatgaacaattgtttaatgtcataaactcctgaagcagatttttaatatagggtcgcaactcacaagtgacatgcttgatcggttgatcctaggagctaggactccataaaggtactatatatattttgagatgttgagcaaatagtcacattgtaacagctgctatttaagtgctactgctaaccagctaaaattagcctgtattgacagagatggattacgtactaataactctaaagttccaatcagtgtcattacatacatttattcagggattgcccccatcctaatcactctccatcagctatcattcttgaaaaaacaaatcacctaccaagatactccctccgttttttaatagatgacgccattgactttttctcacatgtttgaccattcgtcttatttaaaaaatttacgtaattataatttattttgttataggttgttttatcactcatagtactttaagtgtgatttatatcttatacatttgcataaaatttttaaataagacgaatggtcaaacatgtgagaaaaagtcaacaacgtcatctattaaaaaacggaggtagtaacatgcatgggtctgcgactctaaattcaatctacgcaagcttaaaaggacattactcaacagcaacattcaaggggtcattttcttagacaaaagggtaatttacatccaacgggactgcgtgcatggtctttgggctgtaagctcatttatttgagtgctttcctgctgtgtgtggttgagctgccaaatcagttgcctcaccaaacgatagcatgtgcctttaccaggcatcaggcatatgaacggtgattcgtgctggacatggccctctctagtttgtaccgcaattccatgaatggttcttaaactttacttgcttaactaaggcatgattttcctgtaccacaaaactacaacacaacgtggtacagtgtgttccaacttccaagcccgatacttaaatctgactgtgaataggtttcaagtaattgggtttcagttctagaaagatctcatgctgcaatatgccaccagacgagttcaatgaaagcttaattaagcaactaatgccaggcaatctacctatttgtaacagaagattcccagaccctagttccacttagcagtacttttcagccttcaaacagagagcagaaagagactttcagtgcatcataaatcgtaacagtataaaagacccaaggccagaacggcatagtttctattgggcaggcatatcgcttgcccgtgaagcaattagttgcctaggagactaccaaccaagcttatttatcagtactcctctaggttccaaagttgagattaatggctatcgtccagtgtctacaggacagaaagagcagagacacgcaataatagagccatggctaaaaaagcttgtgttactatggtagcaccatttgcctttccatgataagcagagggccagaggaccctacgtgttcacggttcatgaggccactgacatgtgcgaggttggtcacacttcaacacttgcaatgagggcctgtttcttctcccagtctatttaatcagctaacgaggtatttgaacgctacatttcaactctagcaaacaatttattagaattaaatgattacggacatgctcaattctatgaaaaatttgatataatcaacctaaatcatggatatcgtataagataacggataagtggaaaggcaatctttggtcacataggaaatggatgctttctagttaggcagtgagcaatttacacaaatagtgagtagattgaaacagaacgatataaacaagctacctcatacacttcattatagagttggaaacaaacataccttcatggaatatagcattttatatctcttgcctcttcaaagcttgaaccgagagaaaaagaggatatccagaggcagtaaagctggaaaagggaggtgacataagatcttcagttaccttgataggtgatcacaataaacaggatgaaccattttcactgtaacataacagaagcacaaatcacatgcaatgaatcagagatgtgctcacatgcgatgaatcagatatgtgctctcactccctccctctctctgctgcaccaccttgcccaaagcccttataatatttcttgacttgggaaatgcaattccacaaactaaataagtcgctaagcagacacaaaaaaattgatgactacacatatagttgccaaaatgcaatgctgaatcattacagaattagtgcttctgactaaaatccacttcacagacagaagcacaaacaaaagttttctgtaatcaaagattctccttgtcttcacaacaatgttcaattcctgaacaaaaaaaatatgacctattttctttctttaagactatattaatcgttttattaccaacatttatggcaacctattttagtataggaagaatggaacattacctttactcaaaaaccgacatggtacagagcacagctgtaatccgtcagacagcaaaagtaatccatcagacagcaaaagatgacaagatgatagatccatttccttgttctgtcctgtccttatagagagaaagatgtgctaaataccagtgtactcacaacgaagatgggcgcttcacaatgctgtgtcatcattcatcaagtataatacataacatattttcaacaaagaaaacagccatcttcaatcaatatctggaattgcatttcaacttttaaatacagtgtgtggcgttcatcagcactacccagtgatgagttccacaataaaacaatgcaatcataaaaatagagcttctaacctatggaactattatcaatgaacaacctcagaacgtgttaggttctgagtgctagatgcaagggcgaatgattttgcatcaggtacagaatgcaagtatgcattcaatctttgcacctgaaagcccaaaagttgcctcccacagagccttattcctaagcaacctgaaatagacgaaaattagagatgatgggggatcaacaaaacaactcaagttttaaatccagaagaggtcctaagaaatgaaccacaattcttaagcctcaaacatgcacgcctgctttgtgagggtgacggaaaacatattaaaagatcaatgtgcactgaaatatggaagttgtaagttgtaaatctcttcacttggttactttatttcccatgcaaaaaagaatggttttagcacattactttcactaaaaaatgatgcattctagttgagctacagcttgactttaactgcgcacaaaatagtcccaaaatatatagttctataccatcttttagaagctagaaaactgtcaaggttgagtagaaaaatctactcaagaaatatacccaaatggccaaatgaagcaagcacaatatatattctaaaagttcaaaacaaattatgaatacagtcaaactgcacgaactaatgttgcatttttcttcaggagtggccagagatccatctagcttgttttgcatgactgaatgagcgcattcaacaaaaggattttattccagaagcatacttcctccctgagcatggaattaggcccatcaaccaatttaagaaaacggcacatctaatgtttccagcagattgaccatacaaggcaccacccatcatcacaatgaaggtggaaacagcaagcaattatgcagatgcagacagaagtttgagaactatgtccttctcatcatcatcttatagctatcaaactgctgtcagccagaatgttgaacactatcaggttaacctttcaagtctgtcagggccaactgtcattgattgcacaggaatgaggcatacgcaaataactgtatccactactttctagtttctatagatgccaacatagattgaataataccacaacaataggctaaagtaaaacacggtatgcaatcttatgcaagttcacggaacagacagtctaacaaccttatatcagatttctaataagtcaacatggtacaaatcaattgagtgtgcatagtgttatagaatcactctctccacttaaagtagtgaggttggatggaaaattattttaaaaaagaaaatattaactcaaaaaaggtaattaaattctaggttcattctgatgttatcaatggttcgggtctcatttaactatattagctgactaatttgactaaactacacctaactgcatctgtagaagatggtaaataccgatcgaacaatgaaaatgcacactaatccaaccaaatatcagcagaatttcagcacatgatgacctactgacctacgtgagatatctcctccagacatattgaggattagcatcatataaataaatttcagcggcttacaagttatactgtctagtaagcaggtccccataactgagtcatcacatcacatgtttgaactttaaattttactgtggtttgttcaagtgggcgacctaacgaatgcccaatgagttcgggtagttagactactgatcctgaatttgcaaaaaatttcacaatttgacccttttgcaaaaactattttacaaatgaaccgtcagcaaaacttatttcaaaaataacccttggcgctgaacttagacacctcagcgccaaatagcgtgacgctaaatatgcattggcatgctgacttagtctcccatccgcggtggcacggcattcagcgccagttgacatggcgctgaagtgtctaagttcagcgccaggtgatttggtgctgaccaaaagagtcatttttgaaataagttttggcagcggttcatttgtaaaaaaagtttttgcaaagggacaaattgtgaaaatttcagctgaatttgtgtcatttgtcactagagctacatattatccagagttccacaattcacaattcctttccacacgctaggattgctagactatgaacaaatggatacgaaatcaaaggcggtaagtgaccagccgcgaacctcaatcgaagtgaagatgaacaatctccccgtcctcgatgtcgctgtcgtcatcgtcatccgacgaggacgaggaggaggaagggaaaggggagtacataggttcgacttcgacgaactcctgaggcgggaggaggaggaggcggcgcgggtggccttgcaggcgaggggagaggaggcggggcatggcttggacggggacgaaggggatgcagaggaacgcggcgaggcgggcgaggaggtggagcggcgcgcagcagagcagcccgaggacctggtcggcggggagcgtctccgggttgcacgccacgcgctgccacgccgccgccgacgcccgcgccaccgccaccgcccaccccggccgcaccgccattaacacgatgccccaaaatccaaaatccgaattcccctcctcctaggatgaacctaggggtgtcgtgacgaggaaggcacgagcgcgcgagcgcgcgtggggcctcgccggccgccgggccgccgcgaggatctcgccggcggggctcggattcggccgcggcggcggttttccgtcgttggatcgatcgatcacggtggctgggttggcgtggcgaggtagccaactttatctactcggatgcgcacgtggactaggggggaggttgactcgacggccgacggcgacgggtggaccccacatgtcggtgggatattccttcttccgggcggaacgctcggatctccgcgatggctctgcggagaaaatatctttcattccattttttacgggaattttgtgaaaattaaactatttcctgcaaaatatctgtaaaatccttgcgttagtaaaggagtcctaaagcattctagctgagattactgcataatgaaccctagctaatattagggagtaattggtaattgaaattggtttaaaccatgtgctacttgtcactgcgctattaagtacatctcaagagcacctatatatccatattcaaatcttgaagttgtttttttccttttaataggagtagaagggcatgtttggattgctatcataccaaattgttggtagtgtcaaattttagacaagttttgacattaccaatattttggcaaagatttctattgatttggcaagttttggcatcaatccaaacatcacacaagtactatttaggctaccaaaaaatttggtagggcaagatttggcactaaaccaaaacagcccgaagttattttagctcttatggatttcaacaggccaagagctctattacgctctcattactattctagatcgtgccggagtatatttgacaaccaaaagctgatactttcatggacttgaacaagctgagagctctaatgctattttaggggtttacaaaaccgcgcggtaaccttttcagtttttgaaaccacggtatgtctcgtggttaccgtggtaaccgacttaccgcgggggtgcggtaaccgcgccaaaaataataagaggaaccctaactcgttaggaagaacaagccggaagctctattactatactagctcgtgctcgtcaattgtcataaccagtagctgctcaaatgaaaggctgcaaaatcatccatgacatatgcaaaataatactctctccatttttatctcattttacattataaggcatattaacttttttatttaagtcaaaattgtttaagtttggctaagtttataaaagtatagcagtacctttgacaccaaacaaatatattatcaaaatatttttcatgttagatttaatgaaactaatttggtgttgtaagagattatacattttttttatattagaaaaaaagtcaaagcgtattataatatgaaacagtgggtgtagttgtaaacataaagcaattctttgctcaggtgaagcacaatatacatgaataatcgctcaaatgcgactctgcacaaacaaccatgaccaagaaccatggcataatcaaaacaataggtggtaaaacaaaagccattctgagcaaacaacagacattcttctcatgtgaagcacaatacatgaagaatttacgacaatgatgtaaaagaaaaattgttgctgttaaattaacatatttgaaaaggatgcgaagtaatcagtgacgaccaatgcatcacacacgaatatatatgaaaatggaacttcaaaatgagagacagtatcatgagtcatccactgcattttatttgatgcattgtggtgggaaaaaacagcagggcctatcaagataagacttcagggaagggtcctctggtgaaggggaagggctcccagttcttcacgctctaatctctccttcttcacctgcaacaagggggggaaagggcatttagactagcacaagcttcaaatgaaaattagctgcacgtcataaatggctaatgggtaatggcaaaccataaaattaaggcctaggaatttcttaggtagttatttcagttgttttttctatgtacaactaattgaatgcagtgggtattgcatggttagattgcatacaacccctgaggagttagaaggatactagaaaataatagtcacaacccatgactgcaaattttatagggatcacgcttcttgtaacccagtaatactaaaagcgaccatgcccagcaagataataaacaagaaaaaaaaggtgatcgatattcatgccgacatgcaccctcgaggatactcaagaacaaaagcaaatttataaacacacaatatcttcagcttagagtggcgtcaagaggaaaaccctttttacatgaatttaatagactgccatttcaaactaatctgaatacattttacccagcacaagagaaaattacaaggctatagattacattatggcatgctaatgtataaccaaatgcaacaagacctcatactaagaattataagggtaatgcttaatgtaacttggcattcaattagagcgtttgtgcaatgaacaagtgcaatgacaaagagcatcttcagatacacttaccagatccatcatgtcactcaaatagcctctgaatggtgtctgttgcgcctgtgcaaatagagagaatgtttcagaagcacatcagtttaccgggttagtacagataatgacaaatgtaatggtaatcactggctcactgctaaagatgaaagatggcctaattgtgtattcaggttcttaggtaagaaattttacaagaatacatgtgtaacaagctgtaactccgaaatcaagaattcgtaggacgaatatacaccctcttcacaaacaaggaacaagttttgtaacatatgttaacccgaatcatgcatccacaaccttccggcctaaaagaatcatcaacatcatactatacccaaaatgagtgcatcgatcccctttgctctacactcatttcactttacaggcaataatcgggataacctataatttacgtatttgttgcgtgggctctcaaaaaacacaaacctagaaacccggccaccctaatctgcacaccatcgccgcaaaaactagatcagggcaggagggaaatgaacggacctggtcgttttcggagaggtactggtgcttcatggagaggtccatggcgcgcttgaggcgctggtggcgggcgtcgaccacctccctgggaagcctctcgagcgcctccttgatgtccagatcatgcttcgggtcgtacagatcgtcgtacctcaggcctaacaacggatcaatcacacatacagaataacaagaacaaaatcccatcaaatttccagatcaagaaagccccccaccccccccgaatcgagacacccagatccaggcgagacagcaaaccctaccgtatttccggaggcgcgaggagatcgcctgcatgtggaggcgggcgagcgggttgcggcgcgggttcacgaaccactgcgagaacgcggacagcatcgacgacatcgtggcggcggcgggcggcgatccggcgatctctccctctcttccttctctgcggcggcggcggcctccttcgcgtcctcgcttttgtgggggaaagagagaggagaccagtctcgggcccaagtcgtagggaggattcggaaaaatgagccagatttgtgaattgtaataggccaaatgggccgacgaaggaggagggcccatatagttaaattttctctttctatattgtacaagtagggttttgttatttgagcgacaccttttctttttcttttttgacatgatgaacatcagttttagatctatggctttaataagccataaaatatgcataaagaaaggaaaaataatttatgggtaaaaacttttgtatttatattagtaatggtttaaaagctaatactggaaaatagacaaccatgaacaaacctcaaaatcaactctaaagattatgttccaagattttaattttggtgtggaggataggctaacaagagcacgctagggaacttttaagatgcaattttgagttagggtagcacctgcagaatgatttaggatttaggcaggaattaattttgtttattctatgttcttccttttgaagtcctcaaattcttagtagctagattttttcaattgtagaccaaactgttggtgttaggattatttcatatagaatacttgccaataagcactgcattggttcaagaatagtactagttttgacattgatgtgcagtattatatggtacagaacctttataattttgcctttatataaacatatccttccaagttattttcttatgggcactatgaacacgtgtgggagtgggaaggaattggccagacacaatacatccaaaaacacaattgaacctataaaaaataaatcagcaaaaaaacagggagagaaaaatacgtgctaccaaacttcataccattaggtaaggcatcagagcatctgtatatacaaatacattaaactcaacctcactcgcattcacatcaaccaaaggtgacatttcaacctcactcacaaagccacaagacagaaacatcaatacacacaagaaaggcatataaacatctgcctattttgtccttctattttttttgccccttcaatcttgatgccattgaaatcatgctgttctatacagaggtaatggccgagtaaacggcaaaatcacagaaaattcatagctgccatcatccttgctctgttcttcaagaaccctagagcttcagcttcatcagagctgggtgacggtgcgaatccaccaatatggaccatagaacatgcacatcctcatcctggcaagacttgacatccttgtacagaatgtgcattcccctccctgccaagaaagcatcaagcacagcaatgtcagggccataacaacgttagaaggaagaaacaagtcgatttcaccgcgtaaaatgatcaatgaaaatggctttgcaatcgcggaaatcaccaagaggagttgatgcatgttgaaagaatgagttctcagaaacaacttacggtttcgacgtgcggaatgcgcacgaacccagagcttcctcagaggggagaagagggagtggagccaccccatgaggaagccctgctgagacctccggctatggcctcatagagaggaggtgaaaggaggaatggagcaagctatgcaaaagaaaagaaataaaaggatgggtagttagagaggaagtaaccatcaggtttgcttttggcacgaggtgaagtttagtgcactgtacccttcttctgccacattgtgcttccttgcaacccaatcatagtgctttcagaaattttattccggtatcttgtccctttccacttcttactcttcctacctcttttctcatttaaaagagggcatttttacacccccccccccaaaaacaaacctacagaataattcaaggtacatgacaaccatagcatccatagcatttcttgtttgtatcttctgagtgctgccaagcttaagattttcacaccaaatttgagggacatttttttntaattcaacctgcattccgctcgcgtgttttgtgcattactaaggtgcttcccttttttaaacaaaatgggcttcacaacggcctttgggtccagttggatatataatgcaggaaaagacattttcagacagagagagagagagagagagagagagagagagagagagagagagagagagagagagagaggaaatgcatttggtcttaatgatatcatgaaaacatagcatgaaaatacatttttcacagattttaactgcaaactcacatgtatcacatgaactaattatgctaaacttatagtagattttgcttggacatttgggtatagcactaactcaatgttcttagcttttcgtacaggaaagctgttgctgatttggatggtttttaagactataggtagtcaaaacaaacattatcttgcctgctttttggatggtttttaagactat

SEQ ID NO: 63585 - DNA, 1773 bp, Oryza sativa
gttgatatgtcgtatgccgcccttgtcaataaggatagacatctttgactcggcttcttccaccagcaaaatgagaaggttgtattcaactatgacatgcaacaattcgttgagtagaagattggagaaaacatgtgaaaatcaggaagcacgagcagtcgagcaccaaccaggtaaatttttcatcaactaaaacaatagaaataaaataggcatccctacctgttgatgcctattcaggctctatgctgccacaaggcaaatgccaatcctggcccagcccatgttgcactcacaaatgcttaaaattttgatgttcgtactctcctaacatggactcactaacttgataaacctgtcaattatctgaattgctccttcttagaggatacagtaatatgaaaggtggaagttatggatatcgtttgtaatatgtatataaccaaagaaataaagaatctgcatggcctacaaatccaatatttggagtttatctacaataatctacatagacttcttctaaaaataaggcagcaagatgatggagacgatgacaataaatggtacatctactgcatactgttactgattatgcaatgtcttccatttagatagatcaacatcctttttctttcctttccatttcttcttctagttggaacaggatatcatctatttttggttggaagagaatttatactcctaaataagattactgtaccaaacaggcaaacaccacatggtcactttccattgtattcatatgctattaagccacagtaagattactgccgtactaaagtcatccctccatattactgtacctgactaagaaaagttggaacagttccttgttaaactagcaccgcaatccggtaggtagtagtcagtacttatagtgacagaaaattccattcatatgatgtagctatcaatggacaatcactagaatcagttgtgaggttcttctcaaatgtcactgttaaaggactatgtttgcattgaccagaaatgcaatcttgtgtattgctccaaacagtagctacaagaaattactgaatgaatggacaggaactaacagacagaatgctgtctgtctgtgtgaaactagtgaaaaccaactgtcagagagctgaatattactcccaaaatatcatatatgaaatgcttccaataatgtaggaaggctaattaaatttaccaacaatgaatcaatgaagactacaagattgatttaaggaagcaaagtaagccggctttgcaacccaatttacgttgagcaaaacaagttctactgaagtatatcttggatggcctgtatatttgggggtctagcaaggccgtaagaccctaaggagtactttggatcttaactcagctcaaggcaagaaatttccagttccatttggtaattttggttgcaaaccaagagcttttctgattttaacgatagttcagtctgttcctttgtactactcacaaaataagttgatggataaaaatgccaacttacagcatggttaaagaaaggacttgttcagttaaccacttaaccaatgataccatgattaaaataatataatattagcccatttcatagattcatgatttgatcagagtttagacattgttgtgtactgttaatgatgaatttccacgatcttctgttcaaagggaagcatcaatggaattagatacactcactagagttaaaagattatataagcaatacaaatggtgtacctttcaggaaaaaaaaagagatttaaattc

SEQ ID NO: 63586 - DNA, 3281 bp, Oryza sativa
tcagatgtctgtagataagcataaaaaggaccgccattagggtaaatagaccttgatgcgcgcgtattccatgagtcttgattcctcaaaatccacacttttccacagggatcaaagttatatcatgatgaactttacaagtttgttgatctccaagtaacaattgtgactgatcacaagataatacagggaagaacaagtagtagaaatcgtctgacgatgttgctattaacaaataatctatatccgaactttgaagtactttacatcatgacaacattctttcttggagcattgccacagtaaactattgagagcattaggagcaaaaggaagggaatttgagaatcacaggattgtcacagaatcttgccaaactattcaaacagtgtttataaaagatggcaaaaccaagaaaaattgaaagaacatatattggagagcctccataacatttccaagaattgacactcaataaacatcccgttagcactaaaacggaggcaattgcagaagcaaattatgattctgcaagaacctattcaagcttccatgctataggatcagcgagaaaccaagaccctgcaactgagactccctaaaaacctgcgagtatgaccaaggcatcgacttctcaggtgcttggcatgtctgaaacatgaacaccgcattgcttgtcgtcaatccaaacagccaactgtggacatcccagaacacctccacgggcaaaccatccacaagaattgtctggtttcccctaaatttccaagccagacgcttcacctgcatgacgggcttcttgtcgacccgtatctcaagacatggatccttgaggctgacggtgtcacactctatcacaacatcatggaattgaccattttcacagaattgtgccttggcagtgtaaatcttcttcccatatatgtgctccctcctagccacaaatgcagcattcagcatcggccggtttgcgccggtcttccggtatgcatccttcttcatgtcgccgagcaggagtatcagctcaaggtcaaacaccacggcgacatagaacccttccattggctctggcccagcaccaaacttggcaccggacaggtcccagaagatctcaatcttgccgtcctcgacgtcaagcctcttggagcccttcttcttggagaagagccatggcttgatgtctgccttgcacaggcactggttggacagatcgtccacgccaatgctgagcccttgccccatgaggctcttgctccaggtcaccgagatcacgcatggccggcccgagaactgcgcctggtagaggcaggtcaccagattctgcgccgcgccctttccggcgctcgacgacgacgacgacgcgtccgcgatctggacgccgctctccccgaagcaggaagggaagtccctcatgctcgcttgctcgcgcctttcaccgaacacctggcggccgccgcagcagcagcacagcgagaagctccgctccgccgcctcaccgcatcaacaagcgacccggcggcgagctcgcctcccccgcaatgccggcaacgaggagaagccgcggggagatcgctcgctacctcgagtggcggcgagatcccccaacctttcaccccaataaagcagcaccaagaaccgcccaaaaagcaagcaagcgagcggaggcgattgatcccgcaagcaagattccttcacgaagccgacctcttccaacgcaatcaatcaagatttgccgcgaaaccagcagcaaagcagcaatctttcccccggagatttcttcagaagtttccccaagaccaccaccattaaagcaaaaatgatggaagcttcaggtgcttcttcacccaagataagcctttgaagactttgaagaagaagaagaagaagaagaagaagaagaagaagttccaagatgtggaggaggattcaacactacactacaccactctactctccctaaaagcatcaagcaacaagagaggcaatgagagaagctagcaaacaagcaaagaactgaagtagagtgggggagagagaggaggggaaaaggagacaagaggtttggggctacagcctactacaggccacagccatacaagagatactcctcctctcctaccactacaccacacacactactgtcactcactcacccaactcaaggagggcagggcagtagtggcagcagcaagcagaggagggggagcagttgctgtggctaactgctgccattactactgttaccataccactagctgttctttcttcattcatgcaatgaatggagtggtttctaccatttcttctttgcaagcttttaaaaaaaagagtgagggcgtgtttagttcatgctaaaattaaaagttttgttaaaattagaacgatatgatggaaaagttggaagtttatgtgtatagaaaagttttgatgtgataaaaaagttagaagtttaaagaaaaagtttggaactaaacaaggcctgaactaagattcagttataaaatcaccctcttgggttcaaattctcattcaataaaatcaccttcttgtagtagtagaggttgcacaaaatctttggctccaggtggtacttgctctctttggtcataggccactgcctagctctactacggctctactttctctgtgtcactgacatgagaataccagctctcaatagttttatttttctctctctcttgtatgtattctggaccagttcacatgcgttacagtggaaaatgactggattgtatttgatcccccttgctacaagcactccagtgcctactccatggaagccccatccttttttgttgtctcgtgtaaaagagcatatactatgcttgcttttctatataaaaatgtcgaaaagataacccaatcacctgaatgtaactagtttaaaacagggcatttaactatttatcacttttagattttaattgctacatctaaaagtggtaaatggttaaatatctcgtttaaaacaggttcatgatatcttcagtggttcttaacaagacatcacaagattcagaaccatcaatcctttacaagtcttgatatgaaattgtattcattgatttattcccagcctcactaaaaaaaattcagacatgcgtatgtatatacgctactaccattttaatggttttcttgcttggtttactaaaagatagagccaaattgagtgcctttagcttactagttcgtagtatttttttgccatgcttgactttgttgcaaatattcaagtggaatacatgctttctcaatca

SEQ ID NO: 63587 - DNA, 13442 bp, Oryza sativa
  unsure (1)..(13442): unsure at all n locations
nnnnnnnnnnnnnnnnnnnnnnnnnnnnnnnnnnnnnnnnnnnnnnnnnnnnncgtcgggtctatctctcacccaaaatcctatactttctctatgaagcatccaaacaaaaaaatcacatagttcctacattttaaaattcctaagcatcaacttagatatgccacctcgattaattcctacgtttttttaatgtttgtgttttttattcctgcgtttgaaaagagctctgcttttcttcagtgtagtttattatgaaatttgtgtcgcgcgatcaacagataaaatgagaaaataacaacagacatgccagcagatgacgtgcttgtgttgtaaactttaccagatcctctctagaaccaacagcaagagttgtaactcatgaaataaactgtgtcgacgaacttgacccaaattacaagtattagttgctacgttgtacttgtacactgtcgatgaaatggaccaaacagtttgcagcttcttcacttcactcaccaaatgaccaaactaaaccacacgctatcagctagatcttaatctatacttaaccctgaatgcatcttgaatttgtacccattacactggcttggtacattaattgtacacttaatatacatacatatacatcggactcgatcgagcaggaataatttagaatgctctacctaacgagctaaagtttaattaagttgagcaactcaaaaagaagtgtatgcgtcaggcagacagatcaggcattatttttcagccaatcttctcagtgttggtgtcgtctgttggccagatgaccgtctccatgagccgctctcgcatcaacgccaggttctcgtcagatatcctctcgtacatcatcgcatggtcacatttctgaaagatcaaaaccagaatctcatttggttacaaacttcagagctttgtgatggattatctaagagtaccaaaaaggaatcaccttgatccatttgctgtacaagtgaagcctagttatcatcactcgctctgcaagctcctgcttctcctataaaccaaaatgaacattcatgcgtgtgcaatttttctttagttttcagtttacatttgtatcgttcgaaagtttaaacaactgtggagtagtttatatatttacctttccaagagcacgaaggaacactttgccatcggtaggcttgtttacagcaacgaagctgaaaccaatgagaagcaagaacacaaattcagtaatctgacagggattttgctgattgatttgtggaataaatgggtggcttacttgtataaccatcggtagcttggtgggttcatttcgtagagctgcgtgagcacggtcttgacggctttgtaggtgaacacattaatcagttgctgcgcaaacaagaatgaacaaaaaaccaaatcaatcgatctcctctactcatcccaaccatgaaaatctcatcaaaatcacagcattttatatatcagcagtagaacttcaactctttacgttaggatctgctaacatggattaattaattagattcggcatgtggggaatgattataagccgcaacgcttaatagcgaaaggaataatttttcgataaaactttgttatatacacatatattctttacgacttaaaaaaaaattcaaaatcaactttaagattaaaactaaaattttaaattttagctacgtctgataagttaattaccacgtggatgtcctcgaaaccttcatcgtaggtgccaccgaggttgcagacgacggcgaggccctgctgctgctgctgctgcctcctgcccctgaccctggccgtgcacgccgcccggcgaggccgccgcctccagtctccggcgaacaagctgctcacgccgcggcccctcctctgccccgccgccctgcagctcccttccgccgtcgccaccgcccccaccgccggcatcacctgcaccccggccatcctcaccctgccactctcttcttctccaacgcagcagcagcagcagcagctaagatagtttcgtgatcgagcttggtgtatatagcaaccaagtggcagaagaagaagaagaagcagcaagaagaagaagaggaagaggtgttgaattgtagtttggcctcggcttctcgccgcttcgtcgtcgtggctggccagtggccgggatgcaactctgaccaaccaaattttgtgaggctcaggaggcagctacagcctacacagctcgtcgtcgtcgcggtattttcagcggaatgctggacacgcggcggcgagcgattgggcgcggggaagattccaaagggcgattcggcactgccgggccccacgtgtcatggacggagagaaaccggtcgcgtttccggcaggttcggtgaacctgaagcacaaagttggaacggcgacgttcgccacggcaagcaaaaagcaagaggatgagcgttttcttgcaggaacaggaaccgatttctggcaacttcttgtgtggtgcgatcgctgcacacgactacgagcacgagcacgagcaatgaatgatcatatatacttacagctatacaggacaattagcacattgtctaaacacgttgcgtcctcgtcatcaacagcataagcaaatgaaaactctgattttcgaattttgggggtaagagaaaacgatatcccagtattccgttcatactggtcgcagcagcacgagccagagcgatgaaccgatgaaagtgaaaccaccacaaattcagaaacggcagcagcaaattcagagacggcagcacagcaaattcagagacggcagcatgattaccaacttcaggtcggagcaaaagttaaaatgatgcaacaggaagaaaaacatcaccgcactgaacttaagtggtggtggtagtagtatatggctgtatatcaaaacagccagatcatgatcagaaaattgaaaacaaaatggaaaattaaggatgctctaaaacaaaatgatcaaggctataaagccatatactgaccatgatctataaccgaacacaacgaccctgcacccagtcatcttcagatactttcaggacaaaatggatcgataacataataattatgcagcattcattgataaaagcagtatcacagtaccatgatccaaaacttgacaggaaatagaaacatccagacgcagcacaatccaaggatgacaaccggttcttaactattgtaaaacaaagtgcatcagacaagtccgagctagcaaagactctctttactccgccatcctaagcctctacgttctcgacaggtgcatcaatcataagagccttagtcggcttggccaagaggtcggtgtactcctggaatggagacttgacgaacttggtgtccctccagaagtcaggagtaaggaatccataagtcttcatcaggcagtcaaaggtggcctgcacaaaacagatcatttggttttaatagaggataaacttaccactaagaatacatcaatcaagcaaggcaaactaataagaaggcctcaagccatcacagagtatatataacacaatcaaaccaaagtaaaaacgactgggtgtagaagacatgaaaacatattacatattagatattaacactccctgtttgagtaggacttgatggcatcaatgtgcaaacagggcatacgaaatgtttaaagaaaagtttctattagatgatacaatgtgctgtgtgtataggcacgatatcaagcagacaggatacactaataagcactgtggcataaggtaatgaccaatgcacaaaaagattaaagatcaaacaattacagcagcagcgtaagtgtcaataatcaaatagacccatgaaatggttcattgacagcagacaatagtaaatccatactgatgggcagtaagcctgtaacaaagtaaaatattttgaacccaaccagtttaactgtatcgaattagatgagtagaatactatgaatcaccttcaaagatgcatgtgtatgtacactaagaacagtagtctcattgaacaattgatgctaatatacaaactgtgatatagtgagaaactatagcataatgcagttatattccacccaattcacatcagaaatcaacaatactatgcctacttgccaagcacacataaatctatcattcagtaccaaacactaaatactcatagtcagagaatagtatataaaataacaaaaggagggatgtgttataccttgacgaagttgccaagggtcttggtggatccacgggacgaggtgaagacatcctcaatgccggcgaactgcagcaccttcttgggcacgcgggcggcgacaatacccgaacccctcggggcgggcaccatgcgcacggtgacagagccacactttccggtgaccttgcacggcacggtgtgcggctgcccgatcttgttaccccagtaacccctcctgacgggcaccacggacagcttggccaggatgatggcgccgcggatggcggtggccacctccttggcgcacttgacccccagcccgacgtggccgttgttgtcgccgacgacgacgaacgccttgaaccgggtgcgctgcccggcgcgcgtctgcttctgcacgggtgtgatcttcatcacctcgtccttgagccccggcacgagggtctccacgatctggtgctccttgacggggagggagtggaggtagatctcctcgatcttggagaacctgccttccttcacgaggcggccgagcttggtgacgggcacccacttctcctcctcctggcgcgggccgcggcgcccgccacggcgccctccgcggtcgccgcgaccgccgcgcccgaagccgcggccgaacccgccgcgctcgccgccacgctcgccgccgcgctccgccatggctggcttgagagggtgtggattagggttctctgggggtgggggagtggaggcggctgctgcggcggcgcgaagagtgggagaacgagattggagaagggtatttatacgggagggttagcgcagctagggttttgaggtgaggatgcggcgggccaagtgggctgggcctcttcggcccaatatgtagctatttgagttgtttcaggcccatcaagtgcatgggccatggaattggggacgaatggcctttacctagcctgtaagcccattccgaattgccttcgcctagcggcttcctccaccgcgggatcattgggcctgttcggtagtttgtttttgcagctgttatggctgcactggatagtccagttgttcagctgtctatcaagaatgcatctcagccagctcttccgaacaggcccattaccatttgctgagcttgacaagtagcagcagcgtggctccgcttccactcgtgcggatccccactccctagggggtcggcagctctacttgccttccccggcctggccgagccatcctcctcctccttgttgtcgtcaatgtgcaccgctcatctctccgtcggacaccgtccttctcgccaccagctcctctcctatcggccaccgcccttctcctcgtcatccgctgtgccgtcattcctgtcggccattaccctacaggggattggaaagacaagggagggaggagagagaaaatgttagccacttatatggaggggtagtatgggtcccacgttgattcagcttgtcctgtcaactaaaataggatttcgaataatccaaatttgtaaaatgaggaagcccgttatatatagtatttcaatttagggatgaatttcaaactcgaccatgctagtgatccatctttggtgggccaaatggaggcccaaacctgatcggttgggctttaccttaggctgccgatggaagccttgcttctagcgttgggcttgctaataatacagcgtccggcgttcaatgccaacgagccctgatcccgttcctcacctcaccggcggcggcgaaacgcctccgactccgagcaattccacttcgtcggccggcggccggccgattacccacgcccgtttcagcagcgcagcgaccagaccatgtgcagcatcagcaacgacgccaacagcttcgacctcatcgatggtttcctataataaccttttttgccgacgcttgtgtccgcagaatcatggcttctctgttcgagcgtcgccgagatctcggaggagcccatgttccacacgccggaaaacaccagtgaaaccaactgtaatggtggccaatccggttgataacatcatcaacgatcgatagcgacattacaggcaacaataaccatgacacaatgtttagctagatcacacgaaagttcaatgtccaaaacccaaatcaccaatgcagagttttacagacacgacgtctaagtagagcaattagcaaaccatgatccgaaaggagagctctgaatcgtagggggatcatcacgccttcaatggctggaccttgacctgatccagcacggggccgcacagcgagacgccgtcgctcaccttggtgtggtagtacgagctgtagaaggtcaccctggtgcgcacgccggcggcgacgaaccggaagctcgccggcttgaacccgccgtttccgacggactcgaacggcaccttctgcgtcacgttcccggcgaacgcctccaccagcatcgacccgtggcagccgttcttggcgtcgccgacgacgaacgataggttgtaggcgcggttcgccaccgtgcggatcacctgcgcgatggcgctctccctgccggcgacgagctccacggcgtactgccccgccgggacggagaagtgcgccgcgtcgatgaagcggacggccttgagcgactcgatgatccagcccgggagcggcgacgtcgcgtccttctgcttcggcggaaggaggacgcccaccgtcgagttcttgaacacctgcggcccgatctcgaatccctcgttcttgatcaggttgtctgcagccatttgttcgtcagattaattaccagcagcaatccatcgttcagacaatgatgcggtctctcttacctttggttgggtatggcgttgggagctccttgatggcgacggcgtcgagcagggggccgcacgacgcgtcctcctggacgccggggttggagaaggtgacctgcgcggcggcggaggaggcgcggaagccccacgcccaggtgtcggcggtgtcggcgctgtagagcgtgcggacggcgacgtcggcgggcggcgagagcgacggcgcgacggcgacgcggagcgcctcgtcctgggcgcacgtgcgcgtggcggcgaaggtgagcgcgtagagcgcgccggggcgcacggacacgttctgggacgccgacgcgcggccgcccaggcggagagcgtgcacgccgtgcggcaccgcgaagaacatgccgccgggctgcggcccgccggagacgtactcgacgtgcccccgcagcgtccaccccggcagcgagtggcggccgacgatgagtgtcttgttcaccttcctcggcgccgtctcgaagttgccattgatgaggaggcctgggtcaccattaaaaaaatatatcaaaattcacttgtttgcttcaaatgtctacatgattgttgctttctttaggattcaacagctaaatatagcgctgaagactcttaaccaaaatcttgcaaaatgcaaatgcattacagatttacagtaccacaccattctggggaaatggattgagcaacaacaaaaagtcacaaaaccgatggataaaagtgagatgaatataagtgatgcacaagacacgaaaatgcagtgtgccagacacattcttgggctcttgccaagaacatttccacaggtcgaggtagtaatgtgcttgcatgaatgtgatactgaacttgaaacaaaaatgcagaaatgaaactgtaataactgaatctttctttgcttaaaagaaaactgaatctttcttcttagaacatttacatctgcaagaaaatgggatccaagaaaaaaccaagaagatgtgacagagaagagaacacagtgagctgagacctgagagaagaaccataccttcagcatctttaggttgaggaggtgcatgggcaggggcaggagctggaactggaactggaactggagctttgacggcgagtgtggcaccggcggaggaggcggcggcggcgacggcgagcagcaccagcagcagggcaccccgaggaagctccattggtaagctcactctccagcctccactgagttcagctctctttcgctttcactttggctgcttctcgctgacgctgagagttacaaggaagcaagcagccttctattttttttcctcctttattaccaaaaggagtgggaaattgcatacagaacctcccacgctgtcggaattacacatcagagactcattggatagatataattaatctctaaataaatcgtgaatcaatatttagttgggactttttgcaggcttgatgactgcactgtgagaaacaaaaacaaaactaagaaggattactaatagtgaaaaccgttcactctagggctagtgtgtgaatctcacatttacaagaagggttaagattgttgcattattatatctgactgtcccttctgatgcgaatgaatgtatggggggggggggggtgcccacggtcatggttcccgcgttttgtggtgtagttcccgcgcaatgttactgacgcgctctgcaaactagtacagacttgcataggacatgtactgatttactcctatgtgagtactgagtactatatactactactgctagagtgttagatccaccctaatgaatgactgaaactgtgaaattaacatgctaccgcaagcactactccatcatgcattagcactgttactactctactctactgtgttacatttacagaaggcaacagaggctaccagcagatgtatagtactagcagtaacaaaatatcacctagtacgatttttcatctagcagatgtatttcagtctctgttttctcactgggtcgaggagaaatttgcttgatgcagccctttgtacacttgcacgaagaggagcttctggagaaggcacagacatatcacatggccacatttgttaattagtagtactacactgtacccaggcaaagatacgtgcagtatactagcatcatctacgtatagtacgtgtacaccaagggaagggagacgagagcatccaaagctagaggagccggacgacacagatgttcttttctaccaaaaaaattgaatggtattagtatataattaattaagttttaatcattataaatataaaagtagatttgtttcatataacttatatacagaaagtttcgcagaagatggaccgtttaacattaaaatatgtgctagcacaaatcaacatatatatatatatatatatatatatatatatatatatatatatatatatatatataaaacctatatatatataacctatacttttttcgtcacaataaaaaaacaaacatagtattatctcttttccaaaatttagtgttccttccgatttatgttataagtggtttttacccttttaaagtcaaacttctaaaaagtttgagggaatttatgaaaaatatagtaatatttatagcaccaaatcagtttcattacatcaaacattgaatatattttagtatcttttttgttttgtgttaaaaatattattatatatttttataaatttgatcaaaactaaaatgtttgacttagaaaaaaataaaaataacttataatatgaaacggatgaataaataatttaggattggattaaacacatcactgccaatctagatagacagagtatctatccagagtaattactataaaacgttagattgctgtattccggtgacggaaggagcagccggagggagaggggcgacagtggcggccactgcagcactgggcccggatgataaaagccggttcggcgcatgtcatcggctgggatggggaagaaggccgcgggaacagtggccgcggccggtggtctcctcgtcgtcgtcgtcctcgccattgagccccgcaccctgcacgccctgctgctgcctgctgccgacgcacgcggcccggcgcatgcatggcccccgtcatggcgaccacgcagctgtgccatgtgggcccctccccctgcacattaagggtctgtttggttcaatgcttcaacttgccacaccacactttaggctgccacatctccacacttgtctaacattgtctaaagtgagttatgacaatgttagttaagaaccaaacagcctctaactttgctctacccaactcaacgcgccattgcattttgcaccgcagcgaatcagcgattgccgttgtcccggggatggatggatggacggacggacggacggccaggatgtgctttgcacttgcaacagaggagccgcgctgctgctgcatgctgatagtttaaaatttaaaataaactcggtccaaatttatttccaaatctaatctttttgttcaagcaagtccagattagcgggcctgctgcgcgcagagccggcccattgcgaaattcagggcttatgttagcccaagtgctcaacactctcccagttgttcagtttacagctcgcggtacgtgtatttatcatggaaagcgtatggccgcagtccaaaacgcactggttcgtgtacgtgcatccgatatgtgttaattgtacgtacgtatgcctccgtctaggtacgtactgtagatgaacaatatgcattgattaatacgtatgtgctgactaagatatatgcatgtcaacaatgaccatactgatccattttgtaaactgaacaaccacttctgtttaattagaccggatggttacgtgatcgtttatggctagatcagaagatcaagtattaatcccgtgatgttgtgtttgaactgaagattataggggttttggtttactccctcactttgacaaacgttgccacactttctaggatttttacttgtttcactttcaaagttgcggcattgacaaagtttttctattcaaagacccacatgtcatacacctatcttttatgtcatacaatcatcttttagccaaatcttgtctaagatgtgccatcaatttataagccacacatttggttaggtttggcgatatttggaagtgaatcaaacaacccattttttccactatggtttgaaggttatatcgatgtcgttctaggtggtgtcgagacggggtgtggcaacacgtcatcaccattgcaggaccagacatgccatgccatgagccgactcatcgtgtgggttgtaccggcacagcccggcccggtccatttgtccagtttcctctcccaaactcccctattttttccattgtttttcttttttttttcttattttccttttttaagcaatagaaggagataattaagcaatgtattgattattttcgtcacgacgacacatggcgacagtcatcatgctaatccatttattaattgaaccaaatttatttggacaggaatattttagatactctagccacgcatgagttaagagtgttgaattttactgaaacacggcaccgtgcatttaaatatgcctttaaaacaatattcttaagttaacgttatgtatatactactccctcgtatatactattccctctgtcctaagatataagaaactttagttggataagacacatatccaacctgtctagatttctcgtattaaaatatgtcatatccaactaaactttttatattttataggacggatggagtattggttaggaaactctagatgctgttaagataacattaaactgaatttttatatttctatcttattttatgtttccacgtgctttgctctcctactaatatactccaatactccatactactcaaacgaagagctcagatcggttgaccttgctgttattaatgatttttcattttttgctgttcaatttcataagcacgcgcactttgcgtgtcataggctcatagctgattacttcatggactatgtcggtgcttaagctaaagttgattttgaaattttaaattttaaatttagattattttaatttaggaggttttccattattttattttcagaaatatgtcacgagttattttatattaagatttgaagagagatttaccgtgcaagctacaaaacgacgaaggcatgttcggctgctggagctacgggcacgaacaataccgcactcattatacgcagtcgcagccgaagccattgtagccggcctgcctaataggcccatagtttagcaagggttatatatccatgacatgccttgtgggaccaaattcggcctaagctcagctgatggcaagaggctggtctctcgccatagtgtcgcctccgttaggacggagctcctgacaggtggggtttatctttataggtccacatgtcagtgaccatatccctctaactttacacgagtggagcctcttctcgcctcatccgttgtagaagtagctatgactacttccctctaaatctgggtttgttgattaaacaaacgattgttgtgcttcttttagattgtcaagcaaatatcgtttccattattttatcgactagctttgtaatggataaaccttccattgtatatatctttagaaaatacgcactgattgatttggattgaaacgagaggcgtatccttatgatgacggtacttagatataaaaataaattttttaagataacgtaactaaggattgcttggaagttttctttttataaaaaatatttgtggcttacaagccgaagacacatgtacaaagcaataaaaaaaactttagaatatgactttttatatttatactgcataaatttcacacaaaccctaagttttaggccatgtgtaacacaaaatcctaggtattatgattagctcaaaaaccctatattttgagacagaatatttcaagaaaccttatatttattaaaatactcatttatattattatacatggtattttttacattatatatactcacatataagtaggctcaaaatgcacattcataccacatagttttatcttcttcctcattctcacagagcaagattgcaaaattgttacatataaaaacaagtattgataactcacacatgttgacaatgtcactattgtataactcacgtaagttaatctctcagtactttctaaagaactataaaaagcatattataatttaatagaaatctgtctagatttattatactaggttatgtctgctatcattttatgttagggttttctcggacggccggagtttatgtcaggtagcaactagtaataaatagtagtacacactatcccgtaagtgtatgtgtccatctctaggtatggtcgatgagcggtgcatcattcatcggctgccgacacatctatccatgcaatgcaatgtcaacaacgaccatgaatgctgatccat

SEQ ID NO: 63588 - DNA, 1939 bp, Oryza sativa
catatataataccttcatcttcaattcctcctgttccaggtattgttctcacctctcttagtcttatgtataacatatatactacgtgtgatgtttagaaactctatgcttttcttacatactagcaaattactcatgccatgtcatgggaaacgaattaagaccgctttgccgtgtttttttaggcaccgttttggttttgtttcctaattttttgtttttttttctaattggctagttttttgagaaaccgttcgttcttttctggaggggacgagggtaggatctgtttctaccactgaattttttgcagacatgtgggaagaacggtgcggagaggaggatgactcctcttttattgtagtagagatattagaaaaaggaatcagtaaatcagctttgattaagttaagacaacttgagttgatatgtatgcttagctttgattagtgtttagcatgcgatatcttgtgcagatcaacacacccacacacatctcaattttctctcagaaggtgtatatatatttgcagctgttgtctaatcgatctgcagactgaactgaagtataatgtcgaagacgagtgccctggatcttgcttcaggattaggagggaagatcagaaaggagcaagtcaaatcggccgtggatcagtactgcacatctttatttacccttctaatacgttaattaattatgcttgaattttatagtgatatagtaacaattaataaatttgagttaagtgcacttacggggcctacaggagattagggggggagagaagaaaatatgttttttttttaattttattatttttatatgaatgacatgtaggctccattaacacgtatgcgtcaacatggcatgtcatatcagtgcacgtagcaggttagactgttagaactcgtttgaatctggatacacctatgataaatttaggaacctatataacatatccatttaagtttagacagaccactggtgtacttcactctaacaggttttgaccaactcgccagtcgtttctcgcttcgtttatgctgcccctttgttcaacaatcacacactaaaatgttcaggtgttccatcgtgtcaggtatgagaattatcatgaaatttatggaggtgaagtggaatcaaggacatccaactacgctgatttggtacctttttagctggagtagttgtttttcataataatttgcatatagctcatgtgaaatcgatcaattgaattagcaacgagaattttggaggttataaccaaactaattagtgccaaatttaatgcatcaggcaaacaagtattatgatcttgtcaccagtttctacgaatacggctggggagaatcattccatttcggcagcaggtcatgccataattttgccacgccataattttgccactaattaagtttgtttggatgggctttaggttattctgattttgtttttcttcgctgattatctttcagatggcaaggagaaactttacgcgaaagccttaagcgtcatgagcattttctggccttgcaactcggcctcaagaagggcatgaaggtcaatgttatactactattaattacagttcaagaaaagagaataatctattaactataaatgtgattgtttctaatcttcatagtggagtcatttttccctgtgcatatattgcaggtcctagacgtggggtgtggcattggaggacccttgagagagattgccagattcaggtgacaatttcctgttgccaatttcacaaattcagagataaaaatcaagcgaactataattattccaatgctactaattatagctcagcatcggtgactggactgaacaacaatgcgtaccagatatcaaggggcaaggtaacgagttctgcattttatttaaccatgtgcatttcttttacagagttagatgtgaattatt

SEQ ID NO: 63589 - DNA, 6611 bp, Oryza sativa
gtactattacttccgttctaaaatataactatctagataagtctaaaatatacgatattaggttgctatattttggaactgaggtactaggttggtaacatgaaaacttattatcttggtgaattaacttgtacatgtaggttggtgtctacagggagatctgccgagtgctgaaaccagggcagttgttcgcgttggacgagtggtgcatgaccgacaagtatgatccaggcaactcgaggcaccggagcatcaaggccgagatcgagctcggcaatggccttccagacatcagaaccaccaaacagtgcatccaggctctcaaagacgcgggctttgaggtgagctctactccaaatactacacatcacaacattaaaaataggagaaactcttttaatttcttgagggaagagatatctccttgtttgttcgaacaacattcaaataatcataaaaaaaatctaaaaaaatggactaacatttgtacaacatgtaactgtgatcgtttagggctagatcttaaatgagacctgaaaagagacgtccctccaaacatttatcttaaatgagatctgaagagagacgtccctccaaacatttattagtgtgagcgtattgaggattgaacacggaaccttagggttgacaccacacatccgttgtcactgcactatcaagtgcatctctttatagctagatcatcaaagatcaagatttatctttgtgatgatgtgtttgaaggttgtatcggtgaaggatctggcagaggattcgccgttgccatggtacctgcctcttgattccagccagttctcactcaatggcttccgtctcacccgtgtcggccgcttcatcactcacatgctggttcgtaacattttactgatataccatgtactccaatctagatttgtagtattatttgtgtcgaattcagttataagttactactacattttaagacggagcgagtacggaagtaaatgaattgttggtagagtgcaattgacgtcttaatttaccttcaaaaatcttcaggtaaagacgctcgagtgcctccatgttgccccacagggcagcctgagggtctccagctttcttgagaccgcggccgaagggcttgtgaagggcgccaagtaagttgatcggcctcgagcaaatctgaagcaagaaaattttgaatttgtgccgaatttatatcaatctccgaaacagtaatgctgctgaatgaatgctgcatctttttttaaacaacgctgcttaatgaagtgtgattttcatttccagggaagggatcttcacgcccattttcttcgtcttggctcggaaacctctggacaagcagccagagatctgaagaacagagcaaggtgtggtaattatcatcttcataagtgtgcaataaaaagaacaactgtttgatcagtgtgtacttctctgaacccagcgagatgtggtgttttatttggtcaattcgtgtcataaaaaagtagtaagtttgttcagtgtgtacgtaacagtttcgtctgggtatgaattcagtatttgtttttcagtcttatctttcttctctccagatagtctgcaagttcaacttcaacaacagatgggagtgtttgaatcaacactattttaccaaacgatcgagtagtaaaatgcttcaaagaccactagtctgagtacaaaatgtgtccatggttacatcgaagtcaaaaaaacaacaacaacaaaaaaaaaaaaacggttataaacccgcgggaaaacagtagagtgtctgaacacaatccacatatatctgaaatcgatcaagaaatcaaaaatcaacacaaaccacggtgaaagaatcgacaggagatagatgcatcgatcatggcgagagagagagaatcatcaaccggagatagatgcatcgatcaatgcatacgaacactggatcatatatcgaaattgattctactgtagcatcgccgtggcggcgaccagcgccaacgccacggcagcgaaggccgccttagcgccgccgccgccggcggcggcgctggcgttgggcgccggagcggtggtcgtggaggaggacgagctgtccgtggtgggggaggaggactccggcggcgacgacgagacggcgggggacggcgcggcggcggcgccgcgcttggaggcggcgggcgccggggaaggggcgtcagaggaggaggagcgctgtggcttgaggacgcggatgttgaccttctggccggcggcgcagtggccggggacgccgcagatgaagaagcggtggccggcggccttgatggcgatcttgtcgtcgccggaggtgtgcgtggcgatcggcgacgagttggtgcagctgtcgtagtccgccttcttcacctccaccacgttgtgaatcccctgcgggtacttgaactctgcccaaaataataaaattaaattaaaccattttttagaaaaaaaaaagctcccatcggatggcctaataagctaaagaaaaagccaaattttaaattttcaaacttaattttgatattgattttgagatattttcaacatagtttcttttttagcattggcttttaagtcaccaaaaacacatatataaaaattttacctataaatttattttattttctaataaaccgttttggcttattaggggaaaaactaaatgatggggcctaaaatttggcaccatgatcaactcgatgtagatttgctcgaaaagtacttccataatgccggatcgttaatggttactccctccgtttgatattataagttgtttgattttttcttcgtcaaagttcttaaggtttgactaaacttatcggaatatatagtaatatatcgaccacaccaaattagtttaatccaatttaacattaaatatgttttgataatatatttgttttgtattgaaaatgttattatatttttctataaatttggttaaatctaaagaagtttaaatgaaaaaaagtcaaacgaattataatatgaagcggagggagtagaattttataggtttataagaattttgtcctaaactataagcttttataaccggaggaagtactcaatttggtgccaaatcgatgtagatttgctcgaaatactgtcacaatatcgaaacctattagattttataaactcgttctaatataaaattagtagttgagattttaaaagtttgattgaaccttgtccttaacgtcaaatatatgtaaaccggaggaagtgctccatttgacgccatgatcatcacaagtccacaaggacagacgtagtgcaaattttatcttttttcaaacaagatatatcttttgaaattttcatcatcttttggtaccaaattgatcacgcgaaggcggcaggaagagaagtgtgaggaacgaaactaaaaacgtgcaacataaggtactgtatctacctgtcaaaaggattcatacaaagcacctctttttacaccaagagcaagttgtgaacaaagcatgcatttggatgcttctatactactcataggaaaaaagtgtcaaaagtgattagctttacaactaatcagtagttgacaaatagcatactgtcagatgaatagtatattgataagtagattgagctactggccatttgatacataagtataatttatctcctagagttttggatcaaaatttctatggcaactgaaataactacctcaataaaactaaaaaatttcagccggcattgttggatcatgtacaggacatccaggtacacgcaagttcaggatctgcaagatcctgtagccaatgtccaatgagcacaataaatgaaacagccacatatgccatggcctagtaattgtgctcaccaacactaccatttctgaggctttctgaatagcagttcagatggtccatgagaaaaatttatggatcatgctagttctatgcaaaggtagcagcacacggcgcaatattcgtgaaacgccttcaagactagaagtgtgaactgtgaagtgcaagaaagttgagataaattggccttctttttttaacccaaatttcgctgtcaatggcgtggttaaagtgagactcttcatctaaacgcaagacaaaagaggtaaggtgggttgtaaagtacaccggtgagggtgactgttcattaacattccatctctttgcagcagtaagctagcttgggtgaaggaaagaatggacaattactgcttaacatattaatagtccaattttattaattttctcgaacaatgctggcttattcacacatttcaccaacgaaaagaaaatcactgaaatacaaatgctaaactagctagaaactacttgtagtaagctgtagcgaatatatgcaatgaacaaaaggccgaagttactagcactggatctagcactgaaaaatttacacgatcaaaattaactagccttggcactgagcaaacattctacttctacatatacaaagcaaacaaaggttcattattcagatatttcaatgtgtataatccattaagaaccacagattgcatgtatttcaaatgtgtattgacacgcaagccttttgcatgttcgcgaaaaaaaaaaagataaaaactgcttgggaagaactgaaaattagagtgagaaatgagagagcttgcctatggtgtccccaacatggaaggtcttcttgacagcccagtcagtgtaattgacattgccgaggatggtccagccggaggtgtcgccgaccttgtagaccgccgccgacgatgtcgccgccattgcgagcccgagcatcagcaccagcacactgttcatggccattgccattgccgtgctacctagactgtgtggatggaggagatgaacagaggaggaggaagagatgctaagagcagagaagacgaaaagaatttagtactataaccttgcttgattgcttccaacaatgttatgccaatgaggaggattttatagtgccattgctcactttcagaactgaccattttgcccctgtacatttcctgtctgaaactggtatagctaaagtagatgagctatgtattatttttcatcttcttggatgatctatctattggtccttgagtaaagcaaacttaaaagctggccgtgtatccaagtcttgatcatgaggctggctgttcgatgaatggttaggtcagtgcagtgctcttcgccatgagtgagtggactctgctggtacgagatctcacatagactctcatagactcatacttgtttggagatctctttctttttgtcgaagcaaccaattgccaaacatgtgtgtatgtatgcgttgtttgttagtcgagatcgatcttccagttggtacccacttatctttttctttttcagctttgtttgagatgtgatgcacacacacatatagttttcagagtaatggaacttggggttcaataaaatttgagtttctttatctttctcttacccttttcttctcctttaatttaatcattacgatgtgcttgcagaagtctaatcaatagcaagcacctcgccgaacatgttcagaatttctgattggttgggatgctaatcatcagagctgatctactcaagctcagaacttaggatatctaagtatctaacactcatattgagatccattatctaaaaaaaacactcatattgagataatgctatcagtagttgaacagaaaactatttgtatttgcataaaaggttgtttctatttcgataaaaatcaggcacgtttggtaattaatcaaatgatccttgaaatttaatactacaaaattttatattaaaaaaaaaactttcttccatgtacatgtggattttttgactttttcaaatatgaatatgacaaaaaaatcgcatcgcttaaattggtatgagcattttttttccattaaactttgttatgttgtaagatatctaacattcaactgatttgtttatacatatttaattaaacgaaatttaattggtgtttaacaccacttatattttcttataatcagctgagattttcttatatgtctgccaactacctcggccatcaacctcggccatccgactgaaatcaaatggtcatcacattttcagcgtatgcgaaacgagacaagtcattagtgtatgactaggtgagtattaattattactaacttggaaaaatgatttatttgatattttaaaataacttttacgtagaaagttttcgcacgaaacacgtcggatagtagtttgagaaaagtgctagcaaaaccaaagaaaaaaatctacatctcaatcagaaaaaaaaaacaaggctgagcctttggatgaaccacaatcttatctcatcaaactgtcccgacaaacaacaatgtcatgtcgtgcattttgtcatggcttcccaagctaaggtggcaggattatgtcactggtttagggtgagggtggtcaagttagttggtgcagcgggtacgaaggtatgttgtagaggatgcatatcctctacattgctacacgctcactgacacaccagtgagtagtactgcatattgtagaggatctcgacgcatgttataggcaatggtgagagcaatccagtgaggtggaggtagcgccactgta

SEQ ID NO: 63590 - DNA, 1281 bp, Oryza sativa
cgtcatggcgtccccgcaggcgcctcccctcccgctttcgtcgctccaagaatcgagaagcgctcgtatccgtatcccccgcgacgagccgaggccgacgccgcccgcgcgcagcagcagcagggaggagccccggttcgtcgcggagaccaaactcatcaccgtgcattcctgcgcggggcggctcggggacgcacgggaggtgttcgacggaatgggccgcagggacctgctcgcctggtcggccatgatcggcgcgtacgccatcaggggaatgtacagtgacgtcctcgcgctcgcggtgaccatggtcgaggaaggggtgctcccggacaggttcctgatcacgcggattttacaggcgtgcgcatatgccgaggaccttgagcttggtagggcgctccattccatggctatcaggagagggttcatggggagggtaaaggatgtgccggttgggaactcggtgcttgtgatgtatgccaaatgtggagatttggggtgggcgcgcaaggtgtttgacaagatggtgtgcagggacttgggcacatggaattcgatgatttttggttattgccggtctgctgagtgggaggaggcacggcatctgctcgactccatgaggcaggaaggtacgcagccaggggttgttacgtggaatacattgatttcgagctatgccaggttcggggatcttgatgtggcaatggaattgcttgggcagatggaggagtctggagttgcaccggatgtcgtcacatggactagccttgtctctggctttgttcatatggataggagtgatgaggcacttcgatgtttcattcggatgcgtcttgctggagttgaacctaacggcatgtcaattgcatgtgctatctcagcttgtgccagtttgaagttactaaaccaggcaaaggagctccatagccatgctattaaggttggcagtgttaacaacgtgctctcagggaactccttggttgacatgtatgcaaaatgtggagaaatagttgcagcttggagaatatttagtgggatacctgacaaggatatattctcctggaattcaatgatttcagggtatgcacaagcaggttattgtggcaaagcatacgagctcttctgtaagatggaaaactatggtgttcggcgcaatgtgataacctggaatacaatgatctcagggtacatacggaatggggatgatgagagagcttttgagctattccagatgatggaaagtcatggagtaaaaagggatacagcaacctggaacat

SEQ ID NO: 63591 - DNA, 819 bp, Oryza sativa
attcctgccccccatcatcggtgacatcaacttcctctgcactgacgggactcttgatcatctctgcctcctcttctgcatcaaatatctcagtcaccttaggcacgaactcttctcggtacgattcaatcttcacgacatcgatgtccttgaacttgatgacaggatcacccacatagacctcttctgatagatggataggcagaaatatattcttggtctcatcatctaggatacaatcatagggagaagggtgagatgcaggggtgaaatggtccatgttgatcatgatcaaactggcaccaaacaagaactgatcatccttaccaacaacagtgccatggtcactggtgaactcctccatgaagtaggaactcttgttgtcaggcaggagctcccactcatctaggctgattgcatccatggaagcagtacctctgctcatgtcaaactagttcagaagcgagcttggatcacagagagatatatagctgcccaaatgcttttaattttgatactcccttgatactgtggaagtggtcaagaatggatgctcaccaagaatcaataccagcagtgctgaggaaggatactttctttttttctggaggagaataaatggaacaagagggtacacttcttgcaccaggggagatgggtggcaatccaacttgaggggtttgtgtgtgtgtattggcttagtctttctgctaagtgacaaaggtgaaaatgttacctggggcctaccagtgatgactcctcctttcctagtttccttcctttctactcaattctttctaggtttgtgcaagaatcaag

SEQ ID NO: 63592 - DNA, 1566 bp, Oryza sativa
  unsure (1)..(1566): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccatggcttccagcggtggtcggcgagcgagcaggcggcggcggcggcagaagaagaaagaaggcaagtcttatcggcaagggaaggctaagcctttcttccaggtctccctctctccatctaaatccgtttttggaggaggaggagggggctatctcgttttagctaatctgttgtgtgtgttggtgatggtttcagttcagtttcagtttcatgtttgtgatcagtgagagtgatggtgtgtcagtggtggtttagatcatgtgttaattagttctgtgggcgtgtctttgtgttggatcttggggttgggttttcagaaaatactattgctgtggtgtgtgtgtgtgtgtgagtgagtgagtgaattaatgagtctctgaaaattctggaataataagaatgtaagcagatgatgtatgtgccttggtgctacttatatatgtgctctcgttttctgatattacagatacatgagacactatatattcatgctactatttgacagattcagttgtttgaaaagggaaaaaaaaacaggctagttaaacatattcagtaagacagttatctgaatagatgagctttattgcatccacattttctgaagcaccatgtctcttcttctataaattcagttgtttgtaaagggaaaaaaacaatataaacatattcagtaagacagttaactgaatagatgagctttatttcatccgcattttctgaagaatcatgtctcttcttcttcttcttcttcttttgaaaattcagaagcaccatcccatagtcgggatttcaaatatgagggagattttggggttgtttggatcgtttgtttgatgttgtttaggattgaaccttgtttgtttgtttgtttggtctgacagaatccccgatatgaaaaacaaagttttctcaaaaagagctatcccctttcctcaaaactgatagctaattgggttccataattcttattgttttggacaagcttaactttcactaataataacctttaaagtatttagtttgaacatactacaacacaacgtatagattactctcaaaagttactttaataaacttaaatatttattacttatatatatataccgcacatcctataccgcacccaggtgcgtaataaataaaatgctccccctcacatcctacccccaccccacccacccacccactccctccccacccccacccacgcctaccgttcccagaggtactccgtattagaatgtcgttcccagaggtactccgtattaggatgcaaccaaccaaaacccaccatccgggaaactattttaacagctcg

SEQ ID NO: 63593 - DNA, 4713 bp, Oryza sativa
ggagtgatatattacatattgatctatcttatcaatttttttaaaattttttcgtaaccatctaattgacatgcaataggatggacgtccactcgaactattggaatcctctccccccaccaccctattttaaaatttttcgtaaccatctaattgacatgcaataggatggacgtccactcgaactattggaatcctctccccccaccaccctatttttctggatcgtacaccatccacttccacgttgatttcccggatcgaacaagagggagagggcacaggcggcgacggttggcggcgtgcgactgttgactcgggcttcctccggcggccggcgacggcgacggcttgtggcagcggcgggcgggcggctgcagcatgcgacggtcttggcgaggccgtaccccagggcatcctcgtcctggcctcgccgccctcgacctcgattcgccctggatctcgatgccgagtttggatctggagatgcggggtcgcatcctcccgctgtcgctagccgattcgccttcttgccagaccatcaccactcttctcgtgactgcgagaggtacacatcggctgcaccaatttgctctctttttgcatttttctcattgtgtgggcagtggatgtggtgaaggagcttggcgcgtgaggtcacgatgcagcccaaatgcgatctgcatcacgtggttcaatctgatgcgtgcgtaggtcaggagtctcgttgagtccttttttttcttttggactatttgaagctctaattttttggttgaaccacgttcttacgatgtgctagaaattcttttttttttgtgtgtgttcgaacgtgtgttcctgattcttttttggtgagatttcctttcatgagcttcacgttcaacagagcatctaagtaattcgtgttccagttgtactccctccgtcccctccgccccccccccctccaaccaaacaaacctttggttttcgtgtctaatgtttaaccgtccgtcttatttaaaaaaatatgaaaaaaaaattaaaaagacaagtcacgcataaaatattaatcatgttctatcctctaacaaaaataaaaatacgaattataaaaaaaaatcatataaaacggacagtcaaagttggacacggaaacctaggatttgactttttatgggacggagggagtatttgtttcctgagttgattgataccagttagtggagtatgtcagaaaacccaaagcaaagccgtggtgatgagagctacacatccacataacttgtttctattctgattttactgactttaatctctgtgttgttttagggtgagtttgagggataggggattgaaaagattggaaagatacgcaaaatgaagtgagccattaacgcatgattaattgagtataaattattttaaatttcaaaaatagattaatatgattttttaaaacaactttcctatataaattttttttgtcaaaaacacaccgtttaatagtttggaaagcgtgtgcgcggactacgatgtgatttctcaccctaactcaccagaacgaacgctcccttattgtttttactgtaacgtttctgaaaatccctgattgaacaagcactcaaggaggctcccgaaattcgacatatattaaggttgatgagctcgctagtacctagtacttggttatctgaaattttcttgctctattgagcagctgggatgaattggagcaatcatgtggaacagagccgtttggatgtattggtcggaacattttgtgcaaattaactttttttgctcagtatatacccatagatatatgatgtttcatttgactgactgactaataagtttcctgttgaacataccatttttactctgtatatttttgacagaatatacttcttcagactaaggtctaaattttactgaaattattaacttataattcttgcaggcgtcagcagctgcagtgtgcactcttgcagtggatgctctgctgaagacgtacatgttctaaattttttggttgctcatctatatctgaattttctttttaatcgtgaattcatctgtgtttaggaaactacgtaagaacatgagaagattatgccagtggtggtggtgccactggaatggcatcctggtcattatcctcgacatgtctgccgtcaacgcacgtcgccagcggccaaacacaaagagcaggggtgacgcagagatgtcgacccaggacgagcacaccacaattgatgaccggcttcggtggcaggcgatgccaaaaatcttcacgactgatgccctctggactgataatttttgacaacgagtgtatatgtgtgtttgtaacgatgatggcacgatcaattgaagaaaaaaaccattatacgtgtattctcgtgtagtaaaatatttactgccttaagcacaaagcaatttatttactgagaaaagacgaaactaatatttcttgccatatcaagagtttttactgagagaagactgagagtaaattatttatcgagagaaggacgttggtacaaaaatcaggaatgagataagggcgcagaactatctaagagtaatacatttagtgaaagaagaaatcgacagagagtaatacatctagtgaatgaagaaatcaactgagagtaaatagtaaagtaatacatttactgaaaggagaaaatcaactgaaagtaaatcgtttactaagagaaggatgcgagaagaaaaaacaggatagagaaaagatgcgaaccagggtgcatgtgggggcggttgggggtgtggagtcgtttactaagagaaggatgcgagaagaaaaaacagaatagagaaaagatgcgaaccagggtgcatgtgggggcggttgcgggtggggaggagagagaaaggtggtttcctggtgggagtgagggggggtgggggtggagggtaggttgtgaggggagcgttttagttattacgcaccctggatgtgatttagcgctgtcctatatatatttgtttgtttgtttattaatataaaatcatagtgaaaaatatgtttaggagattgtgtcgttgtctaaaacatcaattaattatggaactagagagacgataccatgttttttttttgtgaaaacttgttgagttcccttttctattctttcgtgggccaaacatgattattatacttggtgataccatgtgctttgctacggaatatatggatgaaaatatgtttaatattatagaaatgataaatgttgaagtattgtgaaaatgatgcgaggaagatgatatgatatatgttgagctctagtattatattttgcatgattagtcatgcttgtatgatatttaaaatactctataatagtaattgttagtgggtgatgatgtatcatacttaggagatgagtcgacaataacaaattaacatagtaaacaaacaaaatttagaaaataataataaaatatcgttatcagaaaacaatatcttattttccttacccatacaagcactaattattatctctaaccggcctatagtcatgtataaggggaaaatcttttggtcctgggaatggcaccccttatttgttcaaacatataaatatttatgggaacttcttaaaatatttgactacaattatgtaggatctaggtctacaaaatttaacttgattcacacatcaataattttttttaaaaaaagcatataagcaatacatgcattgttctgacctagatttttttttaccaaacttgaattttggtgaaatgataaccatactctgtattgtcaaattattacttcctccgtttcatattataagactctctagcattgcttacatttatatatatatatatatatatatgttaatgtatgcctagattcattaacatctatataaatatggacaatgctaaaaagtcttataactaaaacggaggaggtagtatatcacaatatgtgtaagggaagttccctttagatagaatgcatcttccattcgtttagctgtagtatatgttacaattaaactacgctcggagggatgcttgttttatagccttaggcccatttggttctgactaacacataggataatgattaatagatcacttaaggcccacatgacgagtcgaaggaataaagttggccatatatcctttttcatagaaaaaaaaacaaatatcataaactactctcaggaatcttttaaaaaacaacttttttggcgaacttttataacttttgtatgtcaacaaacacgccctacttccgttgttaataaactgaagaccctattctctcactaaaatactttgtcttcactatacctttttcccatgatgttgcatttgtatcatttaatagccaactgttcacttatttcattgctcactcaatgttcgttaggccattcctaacccaataattaggatagtgtccatagtattaaataagctaccacatagaatgaaaaataatgtgacaagtgaataaatgaggaaagagaaggaaaccatgtcttgcatgagggcagttccaacccataacactagacatggtttctataaactccacatcatcaagaaactagtagtagacactactgttccaatgcaaataccactattccatacttcaatttaatgttacttatctcacatgatgttttggatgttgtgtagaaactatgtctcatgcaagagggctgcaggaat

SEQ ID NO: 63594 - DNA, 3486 bp, Oryza sativa
aatgccctaatacttgcaaatggagctatcagcaatcaggtcgatctgactgaaatttctggtttaattattttgttattctagttgtcaacaaatatccagttattataacatgagattattactctaagacaaaatactaggatcatgaaattgctttggctcggtacatccacacttattagataaacaggtcgaatgctttcactatccttaatgaaatattccattatctagtaaagtctatagtaataaaccatttcttttttctctcctcccttctcaaggaaagataaaccctatataccaaatgattacatacaccttacacgtaccacactttacatgcccttaatttcttttaggaaccaagctttactttacatgctctgctacttggttcactttgtgataagagaaaaagaaaaaaaaagagtccaatttactcccccaaactatctcactgaatcacttaaccccctaaactattttgcagctaattttacccttgaactattaaaatagttcactttactggttacttacatttcacttctttactgatctttttataccagcaatattttaagctttaattttgtagagccatatggtctcattttttttgcttatgcttttatgcttatcagccaaaatttaaattttcaaccttaaatttggagctgattttgaggtttttttcattgaagcttatttttagccattgcttttagatcgctaagaacacatctataaaagttttatttacaaattacttttcatttgcagatatgaagtttcgcttattccgcgaataagcgaaataatggctccgatagatgacaccattatcaaagttcaaaaattttcatgactttctgcttgaacttaaaacctctatgttaaattagtcttagtgcttccaccctagtaaacaacgattcacaaatttcaaaaaatgttgagatataagttataatgcataaatatatcccaccatttatcattgcaaaatatgacatatagaaagagaaatgaaaaagaaaaatactcttagagaataagacgaaccatttttaataattcgaggtgtaaaatgagtcaagaaattgtttagactccagcgaaaagggttaacccggaagtgatatggttggagtcgcttcgtgtataagtgttaacccggaagtgatacggttgaagtcgcttagtgtataagggttaacctgagagtgcactttcgttctcgcttcgtgtacatacagtgaatagtgatatatgattggagggacaagcggacgttgtaagttggttgcaaccacacaactcaggcaggctcacagcccaaccagggaaacctacatctttggcccacgaggcccgtttaggcccaggagcgagtccacaaaggcatcatcgcatacgtgggttgccgaatattcgctccgcttcccccctcacgcgagatatttcctctcccccggtgggccgagccgccacgccacaccgccccctgtatcgctcactcgcttactatatagccagaggggagggagcgggtagggttttacctcctcccccccgcagcgccgccgccgccacacactcccccacatctccccttcccttccactcctcctcctcctcggatcgggaggcggagcgagcaatcccccaaggtgatttcctgctgctcttctctcatctccccccatcctctccgttgcgtgaatctgttgtgtggttcgtcgtcgattatcttagctaggctagattcctcgcggtggtggtgatttgagtgcgtccatctggtcaaaggttcgaggtaggagtagtagtatgtgtgggtgctctcagttcgttgcatgtttgggttctgtatctggtttggattatcatgtttagtggttggcgcggtagttgtaaatctgtggggttttgtcacgctggttaattttttggtttcgtcccggttccgatcgacgtttctttgggtcgtcaggtgtagcgaatggatgggattggttcgatccgtctggtagggattcgttctgctcgtagatctgctgtggattgctttcgcggtcgcctgctggagctaatttggcaggattaggatggttacccatttctccagggcagatctatgctatgttcgttgattggcgtgtgctggctacagacttgttcatgttgttcactagattgttaaacatgtgacgtcagccggtgattgcttgtctgccacggttttgtttgttgtcctagtgaaatatgcacagatacttaagggccgtgtttttgttttcacaataatggcagtagatgagttgaattcagtttgtcatatcgtttttgtatcaaaacaagtttttttcttactggttaagtgcttctcgcggtcccgccagaatttttatgtactgggtatctctgttatgagtactcccatatcctgcatgtacagtactgcagtggtgaattggtgatgtgctgatggtaatgaatatggcggaagtgtatcagtttgctgcttttgttacatttgatgtgtgttttcaagtttcatcttttttttcttattaatgctgcatctatcaagctgtgagtttttttctttgatcgtcttaaacctaacagtgtaactgcatcagtgtggtatttggaggtagtattagtaaaactggacatgttaaaaattcgcatttagtaaaactggacatgttaaaaaatcgtatttagtattttgtatcatgtatgatgcttaatttttgtttgcgatatcaattatatttttatttgttgcattgctatgtttttacttgagtcatgccgtgatatatttgtagttagaattttgattttaggttttgtgttttgcatggttctaactgggtttctttttttggtacaggaatttgtatttgtagcgtgatttgcaaagctagtcaagatggtgaagttcacagtagaagagctccgccggatcatggacaagaagaataacatccgtaatatgtccgtcattgctcatgtggaccacggtatgtgccagaatagttatgactggtgtattaatatctgatcataatgttattgttgggtttacttcaattggttatattccatttcttatacaattgacatttgcaataataaattcatcggattctgtgacatgagtcgatcacagtcgatctctgcatgattagtgccacaattacttgtgcaagttaattcatttggaaggtggcgatcattttaatttactctctttgttgagacggggggagtagttaatagtttgatcattactgtgtgttagcttaaatatttatgctgctgtgctggtcaccaaaatggtatgctaattttttgtatgtgctattttgcaattttgcattggaagaatatgttgtgtattatgctcttttatttaatagcttgtttacttttgcttattgctaatttctctttttgatatgt

SEQ ID NO: 63595 - DNA, 8036 bp, Oryza sativa
gcctatcagccttctcccgtgtcattgagaatgccaatgtcattatggcaacatatgaagacacactccttggtgatgtccaagtctaccctgagaagggaactgttgctttctctgctggtctgcatggctgggctttcacactctcgagctttgctaagatgtatgcttccaagtttggagttgatgaatttaagatgatggagaggctttggggtgagaacttctttgacccagccacaaagaaatggaccaacaagaacactggctcagctacctgcaaaagaggtttcgttcagttctgttatgagccgatcaagcaaatcatcaacacttgcatgaatgatcagaaggataagttgtggcctatgttgcagaagcttggtgtggtcatgaaggctgatgagaaggagcttatgggcaaggctctcatgaagcgtgttatgcaaacatggctgccagccagtaatgctcttcttgagatgatgatataccaccttccatctccgtccaaggcccagaggtaccgtgtggagaatttgtatgagggtcctcttgatgatgtctacgcaactgctatcagaaactgtgatccagaaggtcctcttatgctgtatgtttccaagatgattcccgcatcagacaaaggtaggttctttgcctttggtcgtgtcttctctgggagggttgcaactggcatgaaggtgcgtatcatgggtcccaactatgtccctggccagaagaaggatctgtatgtgaagagtgtccagcgtactgtcatctggatgggaaagaaacaagagtctgttgaggatgttccctgtggtaacactgttgctatggttggtttggatcagttcatcaccaagaatgccaccctgactaatgagaaggagtcagatgcctgcccaatcagagcaatgaagttctcagtgtcccctgttgtgcgtgttgctgttcagtgcaaggttgcctctgatctgcccaagcttgttgagggtttgaagcgtctggcgaagtctgatcctatggtgctctgtactattgaggagtctggtgagcatatcattgctggtgctggagagcttcaccttgaaatttgcttgaaggatctgcaggaagatttatgggtggtgctgaaatcattgtttccccacctgttgtttctttccgtgagactgtccttgagaagtcgtgccgtactgttatgagcaagtccccgaacaagcacaaccgtctctacatggaagctcgccccttggaggagggattggctgaggccattgatgacggtcgtattggcccacgtgatgatcccaaggtgcgctccaagatcctgtctgaggagttcggctgggacaaggatcttgcaaagaagatttggtgttttggacctgagacaactggccccaacatggtggttgatatgtgtaagggagttcagtatctgaatgaaatcaaggattccgttgtggctggtttccagtgggcatcaaaggagggtgctctggctgaggagaacatgcgtggtatctgctttgaggtgtgcgatgttgttctccatgctgatgctattcacagaggtggtggccaggtcattcccacggccaggagggtcatctatgcttctcagctcacagcaaagcccaggcttcttgagcccgtctacctggtggagatccaggcccctgagaatgcccttggtggtatctatggtgttctgaaccagaagagaggacatgtgttcgaggagatgcagaggcctggtacccctctgtacaacatcaaggcttacctccctgtcatcgagtcctttgggttctcaagccagcttagggctgcgacatctggccaggccttcccccagtgtgtgttcgaccattgggacatgatgacctctgatcctcttgaagctggctcgcaggcttcaaccctggtgcaggatatccgcaagaggaagggtctcaaggagcagatgactcccctctccgatttcgaggacaagctctaaatttttggccgccgcatgtgttgtgccgttacccttacatgttctagttggtctactgctaagagaactgctttcgttgtcgtatttcatttcccttttgtcgaatgcatgtgtttcacatcaacaatcctatgttcgcgtgctactgagaaactatttttactctgtcgtgatgtaacggatgtggaacctggatcatctttttgctgtctaagttatagtgttcacattcttgttgcgtttctgttgagtggtatttattgtttcctttggcttgccgttgtaagtccgcttatttttgttccgttcttcctagtttgtagttgttacttggtagaacctattctgttgtgtgttcttctagtttgtacctggcacttggtactaccagttctgttgttctagtttgtaggtacttcatactatgacgtatctagtttgtaggtacttggtactatgacgtatcttgcctgttctagtttgtaggttactacgacgtatgttgccgtttgatcagctcttttgccttgttaactcctggtctctgtttgatccgaactgttgcatttgagtaattttcccccgattgctctgaagtctatcttcgtgttcaatctcttttcatttgctttaatttcaatgggtcatgatgtcatcgacttatttctaatgccggatggcatagagcagggtttaccaaattgtttgggttgggttatcgtcaccttccggtttaaccacgtgacggactttagttagagttaaactactttaaatttaactaagtttgttttttttatgaatatagttatactaaattagtttcattaaatcaataattgaatatatttttataataaatttgtgttgagttaaaaatattattattttttctacaaacttaggtaaatttaaagcattttgattttaaccaaagtcaaaacgtcttataacctgaaacggatggagcatcaagttaccatctagtgttacaaaacgttcaattcccttgtttaatccctaatatttgtgttattcagatctgcttattctgatcgcattccctgatcgcttgcatgatattgaactcaactcacagactccacgaccccaaaatctaataccgcatcatatagtaaggggaaagcaatagccctatttggaaaacttaactatataggaaacgctaacccatctgaaaaagccaagtactccctccattccaaattgatgtatatatagttttttttaattattcctaaatgatttacatatttgtgttcattcattaagtctattcgttatttgtgtattggagtaaatggacattaatgcatgcatcgatgcacacaagtatttataacccacatgcaatatcttgatttgctattaactaggaaatagtggggatggtgcatgtatcgagtttgttgctagtgtaaatatagtataagagagttattagcttttcttgattttggtgtacctatgaaatatgtagatcaatttggaatggagggagtatgtcatagtctttaagtgataaagattaactaatagtctctcttcttacatgtccttagtccacctaattatcattttaaattaattggttgggtcctatcttgatagaagcacaatcattttggagaaaaaaattttaaatttttaatgatagtagaaacacattctttttaggacggagcatataataattagttgaataaaaataaacacctgaagattgcattgaagcgccagcagcaacacaaaggagcatgtgcattccgactgatgttttacactaacacacagtgacacagccacacaggagtaacaaacaaccaaggcccattacaaaacattgggccgaatggactcaaccacgaattaatacacaccaagactgaccagctgattattacacgcgcagacaacacacacgaggttaattaacacgcgtacatgacgccacacgactcgccacaccgaagcgttcgtaatcctccggcgggcgcgctcgccgccgtcgccgatccgccggcgacggcgatcgacggcggcgtgtctcagtagtaatacgaggaggacgacgacccgccgagctggaagccgtcggcggcgacctcgtcggccgcgggcatcggcgagaacatcgggctgtgcacgtacccctcctcgaagtacaccgccgccgccgccgccgacgcgcccgcgtcgtcgtacccgccgaactccagctccgacgcgtcgcaccacgccgcgccgccgccgccgccgacgacgtcgaacacgccacccacattctgaccgccaccgccaccgtaagccatttcctgggcgtcgccgccgtgtgcgggctgagccggcgccggcagcgcggcggcggtctgggtgtcggcgccggcgccggcgccgtagtagtggcggtggaggtcgttggtggagaggtcgggggagaggtagggcgtgagggaggagcccgggggcaggtccgggtaggcgaagttggtgcgcgcggcggcgccgcggatggtgcgggcggcgcggtcgtaggcgacggcggcctcctccgccgtgtcgaacgtgcccagccagtgccgctccttggtcgccgggtccctgatctccgccgcgtaccggccccacggccgccgcctcacgccgaggtatctcgcctcgttccctcctccacccccctcctgctcccgctgctgctgctgctgctgctgccgcctcgtcttcttctccggcgccggcgccgacgaggagaagaagtagaaatccatactcttcgagagatcgaggagaagaagtagttgtggtcgttggcgatgaagctgctgctactgctgctgcatggggaggttgcatggaggagtatatataagggcgggaaagcttaaaagttagtggggaaatggattaaataagcgaggtggtactaatgggcgatcttaagcatgattagcagcaggagtaatggagggaaaatgtaattggtgccctttttaaaaaaattgattcgtttgtgggggcggcaaaagtggtcaaccaatgatttgctctggtggtgactgcatgatgcatatgcttgatgggatgattaacatgcatggccgacttagctagttagctctggatccatcatactaaccttattaatattaaatcgagtttacatatgggaattatgatagtgatatgctcaagtattaattaataaaatttcctctcatcatatgtctatatcgatatcttccatgatagatttgctgggagtattgcagactagtaccgaactaccgatgttcagagcaattgatcaagtgggagttgtgttaggcttgcaccgtccagagtcaggcagaagtacagtacttacttctaaattaaacaataagtgtattatgtatagcaaagatagatgggaatccttttaccatcatataatctggctggtattgcaatttatacaataagtactatgcataattaaaatgcttcattttgatgtgggaagatcatgtgctgatattcatttttgcccttctgttatttcaaatgcgcaaaatcccaaatcctgcaaaatgaatacaaaatacataaagtgctattgtccatttacttttacaaggggcgtgcatgatttgacttgacgggaggttatattgctggcagtaacaaaaaataagtgatatatagtagagaaaatgttttcaaagatgaattcaattgtgctgtttttcctgtttcaagatatacttactgttggactaattgttagtagagagctcgcaaagaatgaatcttggagtacatgggcggcctataaaatcaacacagagagtacccactaattaaggttcaaggttttctgtccaagatagagaatactaagcttattattcaaggaaaaaaaatgtaataccatcgtcctccagaaatagtctattacattcatgttatacctatctataggatctataaataattcgaaatgaagaagacaatgaaacatatatcaactggtcaaaataggaatcatttacacaacagaagtataaatgatgaacaataaactacaagattctgacttataatatgcaacttctgggacatattaattttcctatacgttggttgcgaaatgtgtacaacaagatccaaaccgaccaaactgtgattctgattattctaatgccaagttgcaaagattagtctccctgtcatgtgttctctcccactgatgtcttgatttcactgtccaagaccacaagtcaaggtcaaagtttgtagggggcaagaacggcatgaaaatatactggtcctaatgcaaactctaacttcacatgccgccttaatacctgaggtgattatcgttttcctgcctttgattgactagattagctagctacagaagatcgcggtgtgtgtagtgtggtctacctacacaatatttttctattcattcgatcatgctcaagggatcaagtgaagtaatcagtagataatataatgggatctaatataataatgatgcctagcactaactaaagctaactagctggatgctcagtaaatgaattggagccattggattgatctgtccctacaagcgacacaaagagattttataatgttctttattgatagtagaatttatctaaacattatattgtgggcagtctcggcggtagctttcttattggtctggtgatcggtccagtgttaggtttctgctttgactctgtgtaggggctattgatgcgtggtagtggttttttttttcattcctgaccactaactttcagggtactagctaatttgtaatgttttcgtactctatttaatgaaccatcattctatctggtgctgatcgttaaaaaatgaatttttctaaacattttatttttttctaatctaatatgtcatgtctatttataccagctaccatcttaactatataaggtattagtataattttttgtattagtagtagaaataataaatcaataatactgtcaatagagactacccttgatttgtagcgttccagtagtaaactactcctatattagttcaactgaaaggtgaagtccacagcagtatagcagtttgtcgccggtttggctgggatcatgaagggcgccattattatgttgcttcccaaattttgctgcgctatatatatagcttatgaaactctctagcgatcactagcaaagtagcacgaactattgatgcagtttcagcaaagagcaagatctgtgcgtgtcgtgggtcattatatattttttttcacgaacgcgcaaaaagattgcacgtcaatatattagaggaatagagtttttgttacacaccgcaattggccagaccggcctacgtcagggaagggaaaaaataaagttaaaaaacaaggaagagaaaaaagaaaaagaaaaactcgaatgctactccaaacaacgagaagggtcagagccacgctacactcccaacaagttcccaaaggaagcaacgctcactaacgaccacaatcggccctccgacaggatggactcttggaccactgagaccgaagagagcgcggagtcaatcaccctagagttacgttcctttcatagctgccacaagaccaggaggaccagggagtcgaaactggaacggaggtgatcaggtaaaccagcactggaagatggccaccaaccctagagccagctgccacggggggcgagagggcagtccagctaggaggcgacagcacccgtaaccagacctgacgagcgaagatgcaatcgaggaggatgtggttcgccgtctcgagctcttgagcgcaaaaggggcaggccaagtggctatcgatgccacgcttttggaggaatatatattcttattataaataaactatgatcaaattgtttattgtagtaaatcaaactaaaataaatgaaaattttgttgcaccagacacaattacatttatgtgtgatgatctaatttcttatttgtaacaatgtgttgatgg

SEQ ID NO: 63596 - DNA, 806 bp, Oryza sativa
catattaggataacattgtatcttttttgctgcgtaccatttgatacccactttaactgaaaagaagatcatatatgtgtatgctcttactggaaaacctgatcagtagtaacttagtagatagtgacttttttttttaatcaagtgatcttattttcatcgcacttgttggggcgagtttttttttttgggggggggggggtgggggatggtaagatttcgttcttttgaattgttatacaggctcacaactctgtttctctgcaggaaaagaactatgggagtatcaaaataatgaagttgaggaatgcataaaccaatatatttggtttattttggaatatgcaaatatagccaatgacccaaaaagccatcacaaaacttggatggaggcatggtccaaaattttgagaattagttaagtctttctatcgaagatctgagatacttgtatatgatctgatggatatgaaaatgagcaagattgatgatttctcatcgccttttctctttaaaaaggaccatcatgtgcatctaacttaattatttgtttttagagaacttcacatataggcataaattaataacacaaaaccgtaggttttatgattttgttcacaatgcaaaccacatgtcagacccaagatttccttataccccgggccaaatctaattgctactatcccatatcataaatgagacccacactaatgcaaaacaaaaggtacaaattgttattgttagtttcaaaaggaaaaaaaagaaaaacaatcaagaaacaacatctaacctcaaaatgacaacta

SEQ ID NO: 63597 - DNA, 7570 bp, Oryza sativa
  unsure (1)..(7570): unsure at all n locations
ggcaacaacaatgaacaccttatccaacctagagtcgtgcaggtggaagagttgcaggtgccacatccctttccccgttatcaccggtcgcctgcgacactttagccatctaggccccttgatggcggtgctacttcttgatgaccacctacttctagcttttcacgacgatggatatgtaaataacaccgtgggactaatatttctgccgccgccaccccaactttagcatgcgcctgcagtaggcagcagccccaacggtggagtagctacccccggcatatggaagagagtccaactatgaacgtgccatagagccactgttgttgccgttgaggatttggacttcaacctgggcaatctgcgatgccagagcttgagggatcagagttcgcaccgattggcctctcgccgctggcggcgcttgtcatttcttctcgtctccgattgtgctctagtcacattgagagtggggagggtagccatggggggtgcaagtttgttcgtgggccggttttcattagcctagtccaagagcgagcatgttctccatcatgctcactcagctccgttcgatggcgaacgaatggagcagataggctgaatgtccctctaacgtagactgcagtacgttagatgatttagttctggaggaagtgggggcacatgtgtcagatcatctcccatgagcgcgtagtgccgtagcagtagcaaaggggttaggtaataaagagtattggaccatagatgctagcctgatgggcctcgggccaaaccaataggggctcattgctagttgggctagaccctgngccatggcctaggatagtaaaaacaaacaatagcttaatttccgtgttatttggtttgaatttatctcctaaacttcaagcataactcaaatttgagaacctgtttagcttgatggttattgttttatttacaaaatatttttatttgccaccaaattaggttttctttttagggggagggggagaggagtgacttaccgtgcatttaattttcttataacaaaaaactttttttttttaaaaaaaacaaacataacaaaaactttaggataccactgttcgagaccttcaagtgttgtgaaaaatcaaaagttaggttgggtttaaaatcaatatttttgaatagaagagcagaggtgtgcccctctcagcatgacaattcaaccaacaaaggacaaacaaaaatctgtaaacctcataaaagttaatatggaaagagcactgctacacgtactctaacacatactatttgcagtcaaatttgttttttctgttaaatttgaacttgcattttttttggggaaaagaagatatattatttagattttttttagataatggattttcattaatccggcctctatatccacgaaggatatacacagccaaatattacttagaattagcttcctctcttacaatatgtgatacggaaggacaaccatcctctagccaaaaattagactcctcctcacatctagctctgtttgctaaaatatatgtgttgagtacatttatcagtactctatttgctacacgtactcacaattttgactacgggggatttttgaataacaatctccctatttctagacataagagcattgatctccctgattatataggccagggtagacaaatccttctctgcatattgcagcatgcgtaccgcttccaagcagtctgattccaccacgatcggttttagagtccattgaatcgccaaagcaattccttccttgtatgctagaagctccatttcccgtgcatcagagcaccttccaaaaaatctgcaggaagaaaagatgacagttcccctctcatctctcaagatcgtgccagtgcctccattctcataattcggatcaaaagagccatctacattaagcttcatccatccaggctgtggtttcctccatttctgaatccaagcctgctgagcacaagcctttttaactgacggccccgggagatagctaaccacatgtttcccttttgccaaattagccattgggtgttgtcggatttctaatagtgaaaagatatagtgatctcttgaaacctcctagatgcctcagttggtggagctggtttcccatgaaggatctcatttcagcagtaccagttctccacaagaccattaagaacatggcatgttcttcttccgggcgtagctctagttgataaaaaaatcttggatgaggctgaacgcctaacaacacaccactctgacaaactcccggtactctacatagcttcccacaaagctttggcaagaggacaccgacacagcgcatgaaagacatcctctgtttccatcccacatacagtatatggatctgaacttgcatatttgtatagtgacatattatatgttgatctatcatatcaaattttcttaacgacatgtaaaaacgagaagttgtctcctcaaaaggtaaataaacttccgcacaatattgcacagcaactagcaagacaatgtacaacaagtcctaatagcaaagcacggctaaagaacatagtaatctagttctagccacaagatgtatgcatagggatttgtattttctttttcaaaaatacaaattggacaggataaagaagaagaaaaaaagtccacacctgcacccttagcgagaagcacgcattacacacgccgaagaatcaaacacgaaaggtataacctacaaatggattatgccattgtggtttagggattcatgaccaaagttaattagctccatgctagctaggtggccacccagccatgtggactacggaataaaatgatcggtgttgtcaaactccggtctccttgatagctaacatgttcatcttgtagcagggagcctacatgattagcagtacgaaggctctagtgctagctctagcatatctacagcttctcacctggttttcagatctgctactccacaatccatatgccgttttagtctacaagaaatttacaccgcaaatcgtcataacctatgagaaacctatgagaagatgttcataggactttgcttttcagaaaacagtacaaacatggaaagaataattaggtataaatacgagtacatatgtcaaatctatgatttgaatactggtggacagattaaaaaaaatatgaccagctgtgcagttagtaatttcataagaaatttgctataacggttttcttcatgatcttaaatgtgtaagaaattgggacttttacgcacaaatcaacctgctgcagcatcgaagttgagcacatacgtgttatctatttttcagtgacttaggctaaaacttccacgtgtccattttggagatttatgtgggcttcaccggaatactagtcaaaactggactataagtgattagatgcatgggctgaaaaatctgataaagttgctgggctacggcgtaggcaactaagctgcgtgaccaaaaactgccatgggcccatggaaaatgttgaaatccaattggcaaccttaaccctgttggtttaggtaataagtccacttggactcccttaactagtggcaaaatctgattcgtatagttgaactgtataataccaggtatctaacccctcaactattaaaatcggtacaatttaactctctaggcggttttgttgatgtggcatctaccggatccattgttttgcttattaggggaataagcgaaatgacatatttccaaacgaaaaataatttgtgaataaaacttttacatacgtgttcttagcgatctaaaagcaaagactgaaaaataaacttcgatgaaaaaaccccaaaatcaactccaaatttaaggttgaaaattcaaattttagttgataagtataagcataagtgaaaagatgaggccctatgtagcagtgttaacctggtctttgtcccacaaatatatatatgtatatatatatatgggacctatttgttattcaccaaaaaatagaatgagcccacatgtcatcctccctttctctccctcctctctctctctctctccccctttctctttctctcccctttctcttcgcctttagccatctatggggtcgggggtctggagtggcgatggcaggagggagggtgggcaggcggcttggcctgcagaagcgtcgccgcctcctcctccgccttcattgccagcaccacccctaatccgctgagagctagcttattatcgtccgcctcgctatccaaggctgtcgcgtggggaggggggaggtagcaccgccgagcttgtgggcgtgctggcgcagggcagagagatggggaggaaggacaaagaggataacatgtgagccccacatgacaggggtcctatattttttttatgacaaataagtcccacttatatgtttttagttcttataccacataagtgccacgccaataccacatgggcaaagatcaagtcaacaccgtcgtgtgccacgtcaacaaaaacatccttcaaaaccgttgaggaagtcaaattgtaccggttttaataggtggggtcgagatatccagtattacggtttaagagtacgaatcaaattcggctactagttaagggagtcacagtggacttattccttggtttagacctggaagtacagtagtacacgtggttgagtataaagtaatggcccagcccacaaaattttgttagaaaacaatatatactgactcgatcatcgatcacgttgcctttttcttctaactcttatttccagccattccttttttactctgtcgatgtaatactctcttcatttcatattataaaacactatttttttaatcaaccttctttaaattttaccaaatatataaaaaagcaaacatgtacaacaccaaattaataatgtttattttgtattaaaaatattgctatggtttttttaaaaacttggtaaaccttaaagaagtttgactcataaaaggttaaaatgtaaaacggagggagtagtaactttgaataagtattttgtttggcaagtatttaagaattgcaaggtcacatgtttgatttaaccaattcagacactacagatgcagattaagagcaacagagttggaaaaatctcatgacaggacttgaagataaatatgttcgcccagtaattcttgtagtgtacaaatttttacccttttaggttgactatttaattacatcaccccctttttttaagcagaattaacatttgatgaacttttgttaggaaaacattttgtggcctgagggaaacatcaggcattcagttggtattttttttctacaggtatttagggatttgtcccaacacatatggcaaaggccagggatataaatcatctccattatatataaaatttgttattgttcagaacatttcatctatacagaaagtccatctaaggatattgaaggcatatacaacacatgaacacatgcaaacatgttatataccttactaatttttgaatattacacagaagaattacacaggagaccccagtcatcagcagacattggattgatcatgcaaatggacactgcaatatgcatccacagaggttaaagtttcagtcacctatgaaacagttttttgccttaacctccgaagccaaccaataccaaagttgtggatggaagtgcctggagctgaggggttcaggtcatagaatctttcttagacaatgtgcagttgttcaagcagggcaacaactgcaggtattacagactcatcactagctgctcaagaaaaaaaaaagaaagattctaaagaagtgattagagattctgaattttctggtagccatgtttgcggttgaaggggattgacagctatactagttgcacgcctctgcgttcatcagttttatccacagcatcagcatcatcatcatcatcaatcagcacagcgcgaccgcgctatcagatgatgcctgcagcatcatgtacatgctagtttgatcagacagttcctgcgcagacggcaccggctcgatcatcgacaaccgctccagcagagcggtgagcgcctcgcgcatccattcgtaccggcagagctggtaggcttcaccgggggagacctgttcattgatcatcaatagtgagtgacagtagcaggtaagtctctgaattctgagattcagagcttccattgacacttgaaaatggtgaaaacttgcaattcattgtgtggtgggacaatggctcacccatcgacggccatgggtcgcctgctccggccacgactcgagctcctcagtgacctccatggcgaagatgtagcccttgcaagctccccttgggctgctgctgttctggctgctcttgctcttgaacacccagtgtcccaaggtagtcctctggtacatgcacacaagaaatggcaaagcagcaccaaatgtcaatgaaccgaaaaatttcgcatatctgccggattcaaaggagacactgaattgttctaacttctgtcacaatttcgcagttgcatgttgcatttgcatttccactgcaatttcagcaactgttcctatcagcattgcaagttgccttagaattgaatggtttgaaatgatgaaccaagcgaacaagagtcttgtcctatacatggtactaacagcaacatgctgacatgaatgcatcacctacgtaggagtactactaatcaggctggtgatggcagtgtgggggagcaagtaggaaacacaccacatgcatagttgttggggacatggttgcaattcacactagataaaaataaaatatcagcctattgactccgatctgaaggagaaaaactagttttctgatgtcgaacaggccggtcgacgaagtatggaagaaataggggggaaacaataattcatctggcttaattataccgagatcttctcccccaactagaaaatcacaatgatttcagagtatcaccttataaaatggtgggtaatgatatgtttatccccaacccaattgtgctctgcagtactgattaggttggttagtcaaaaaccatttcgttgctgcttttttttttctatcttgtgtgagtctcaaaccaccaactgattgctagtacagtgctagagtgcagttctagccaatgccaatgcctatagagaaacttccatgtcgctttcaccattgaggccttcctctacattcctacatgtttacttagagccatctgaccatagttgcaaacccatcagcctagtttaaccattgctgagctttcagtgacagggcaactggacaaatggctccaaatatcggctgctaaattactcccactatcaagatttgcgccgcaacacgacaccgaaaaaggcgtcgcgccgtgatcccgaacagcagacttttcaggacgcaggcagcattttctctggacgctaatcagcattcaccaccaacagtccaacaccagtgatccacacgtcatcatcgtttgttgttgttaagcatgcgggggaatcaatatagtatgaaatctactggcaaagcaaagaacagtgaagtgttaagcgagagaggaaatggtgaagctgctgggc

SEQ ID NO: 63598 - DNA, 2645 bp, Oryza sativa
atcgatcaatcatttcgcttcaagaaactctgaaccattctggtttcaggaaatcaactctgaaccatttcgtttcaagaaactctgaaccatttggtctcaagaaagtctgaaccatttcggtttcaggaaaattaactctgaacaatttggtttcaggaaattgggtcggaaccattccgattgaagaaatcagcaccgagcaaatttcatttcgaagagagatggtggtgcagttggtaccttggggaagaccatgtcggcgcggttgggggtggagaccatgagcacctccacctggcccggaacgtcgccgaggatgcgagggttggcctcgtctttcttcacccggtacggcacgcagctgcaatacgaacggaacaaaagatcgcaaggaaagaattgatcagcaaaaagattagcaagaaatcgatcaagaacgcagcggggggatggatcgatggatatgcagcaagacgacccaccctgcgacgaggcggtactcgttgtcgtagcgctgcctgaggcggcccgtcctggccaccaccttgtccggcgacgacattgcaatctgccgatcctaacgcacgtgagcagatcaccaacatatacaagaagaagcaaacagaaagtaggggaaatcttggtcaccttataaaggaagcagaagaagggtcaagaagacgaacagaaaatgcctcctctgcctctggatgaggagaggtgatgatgggattggtgatggcggcaatgatgccacggccttatctctccaagggggggaagaaaattgaagacgataaaatagcaacggaagcggaggcaatctctcacaattcacagaaccgagagacgcgcacgcgcctataatggcgcgaggcctcttggttcccgccagatttatgggcgacgacgcgcgagtaggagagagaaagagagagagagagagagagaagaggggtcaaccaacgtgacccgcctggcagtctgccattgctgccactgccaccaccgacccgcccaaagaaagctacggcagacagatttcgcgccatttctatttatgttcctcgatggctaaaatacgctaatttaagctgtcagggaagcaacgagggaaaaatgcagagattgcagcaggggtgatcacgttctcgtgtgttagcgagacaatgtggtgtcaactgttaaaattataataccttcgtctcaaaataaactaagttagctaacgatgtgataaaatccagtacaacgaatttagacaaatgtttatctagatttattatattaggttgtgtcatatcctaatttattttaggattaagggagtgtactttcaggacaagctgaaaaatatattcccttcgtttgatttattttaggataaaggaaatatacttgtagaagaagctgaaaattatattttgttcattcggagatagatgtgggtaagaaattggctaatggcccgtggcatccctacttctaaagatttagccatatctatttaggtttattatttaggtttatgatttggtcaaatttttaaaatttgactttgattttatcttaaatagatatatatttttctaaaaaaatgatatttgttagttagtgtacacggtatgtccatgcaaaaatataactatatatgtatatatgattccacgagagtttaacttagtgctatgattaaatcaatgtgtacgctaaattttattgtgccatatagtattatatctgttgacttctaaaatgccatattgttatacggagtatactctatgcggtttcataattttttatattatgaatgatgttgcggtcttcaaaatatatcttcgactatatttttcattacatattgaaaaaagtaagtaaacatttaattatgttcaattagttttaagaagatatatctatcgttttctagtgtttttaaactaaatattaacttgttgatagtctaggttttaattgttttatcttaacctatctgaaacgtcaagagctatggaatgcatcatcaaagatgtgtcaccatcaccgaacaacaagtactatcatttccccgaaaaaaaaaacaagtgctatcattcaggggttgctatgcaaatcaaacctacatattattgtaaactctttatgaataacattgagaagcttcgtgagatcacgaacatgcatgctagtaccacaattgtcaagttaaaaatagtgatcatgtacttggattcttaggttgctactcaatacaattaatcaattatcaagaatctcatctgctactcagtagagggaatcttttcatgattaaaaggcggtgatatatggagtaattaactaggttcctagttgaaagtacgtatattcttttaaaagtttgagcaatccctattggttttaggatgatctaaacttttgagaaattcaataacacaacaaatataaggactatacagataaactatgccaagtcataaaagtttctcagtctgcctacttctgtgcatccatctattgccgtatatgatcttacagcccatataatttatacgtaaatagtggaaacaaggaataaataattatattgtagtcagcattgtaatgccctggctagttaattagcagggcgcaggaat

SEQ ID NO: 63599 - DNA, 17399 bp, Oryza sativa
tatgggttgcagggttggttatgtgtccatttgtttgagttaaccaatttttttatgtgtgtaaacaacatctagcactagataattcgctagctaggtattatttgctttattttattttgataacacaagcatgttaatatatgttagtaccaaatatatgaacgtatcatagatcgtgggttggtagtacactaataagtaataacttcataattttgttcaaatgttagttagaatgagatctcaagccttgcattgagtcaaaccattttgtaacatagtacccacatctaaataactaaatgtatcattgatactccctcgtcccattttaaatgcagccatgagtttccgtgttcaactttaatcttttttcttatttaatttttttttaaaaaattaaaaacataagtcctgcataaagtactttatcatctaataacaataaaaaataggacgaagggaaacttatggttgtgcttaaaataggacgaagggagtgccaatgttccatatatagctgcagagagcagaaatttattctctgacaaacttcccattttcacatggctataaatgcattttaatcagctcgtcacatgcatgcccattgaatctccatcttgatcctgaccatatatactagtgtaattaaattattctcaacatgttaattaactgtttctttctagtactgttgaattgatgtttcccatttgatttatctattgtactaattaattaatgttcaaattgaggatgatgcattctgtttggagctctacaattcctggggtattctcattgaccagggatgatgagatctactctgctgaatcaataaccctgttccatttttctttgccaaaagaaagttgaacataggtggttttacaaaacatggcgatgataaacgaagactacatctataaccatgaagaagattaacgcaaaaaaggaggcacacattttatggtgtcggtcatgaatatcaaattactccctatttatccttgaaagcttactaaatccctctcgtatccctgaaatttacccaatctcttctttaccctctcatgcccctgaaatttaagaaattaaattaatcttcctatatgatctaatttaatttcagaactttttcgaaagagcagccacatgtatgcgtattacaagcatactgacatgctttcatatttcagttatatgtgttggtgtatatgagcacgatatctctaggtttggtagtttagcttttgtatcaggctctgccttatttgttatatggtctattacctctaaatataataaattaagctcttatcctccaagccatgtacaaatttaatcggtctctccatatatatgaaatcaataaatttgtacaccaaatatctccaaaatagatcatcactcaaagaactgttcccttgtcccaattgcatcatccttgtgctctaaccttttttatatttggcctttcaactgtactgaattttacaatagatttgaaagcgatgttggggccttaggggagaaacaatattcaatatggtgttaatattgttatggcctttgatatatatagcgacatgcttatgccatatgggctgcggtactgtgtttttattgaaacttttctttcctaaacacgtggagctatgctcagcagttgcgtcagtgcttctcttaatttatcgatgaaagtatagtcatatatagtgagtaggttatgatttttctctattagaaaattgtttcagagatttaccctcttactcttgtctttgtctatcccaccaaaccctactaccagataaaagggaccttcaactcttcaaacaaagaaattaacttaattatccctataaggctataattaacccaatcaatagtggtactagttcctcgtaatatgttgtagagtttgtactcccaccatgtaaaagtctctactgttataaaaattatatatatttttgccggtattttggtaagtcatcgtgtttgagttggtttttaagtcatttttgaaaatataaatccgtatttgagtcagtttttaagttcgttcacttttaaaaaatacagaatgagttgtataagaaatctctttaaacaaactcacaggctaacttaagacaatcgaactcctaattacaacttatgattttgtaagaaaaatatctaagcgaatttccatagggaatttgaccttagctaaacagtacaacaataataagattaaaatagccttcacctgttgcaatgcacgggcattgtgtgtgtgtgtatatatatatatatttgatatttaaattttataaaaatcataacttttaagtactaatttttcctccaaaaacctctcattcaaatttcttttcatcttacccctaatcacgttattcaataaggtactctatatgtttcagtttattaaagttctagcaaattttacactaaactaaggggtgtggcaaattgctaccctcattattaattgtatcctaatctccttcggtttcagtttatttaaagttctagcaaattttacactaaattaagaggtgtattaataaattgctacgaccctcattaattgtattataatcattttttttctaagcaagcatcaaaattccttgtaaggagtataggaagaaaaaagacatctctaaaaatattttggaatatgaagacgacaagtattttggcaaaattttgacttctagaacaacatgtaaactgaaactgagggaatagctcatttctcttccatactagtttattgaatgccataattttttttttggactgagggaccagtggtttggtcatacggggttcaatcgatattggataaaaactaagcgtatatgagagggttaaaccggaaaataatccgactacgagacatgacatatgcatgtttacatacgcaattcaatttttatagctaagatgtattttgagatgggtctacttacgcaattcaaaggctggatctcagagattagtttttaggttaaattcaccggtagaaaaaccatctttgctcggtcgtccaaaatccacaatagtcccggttcgaataggaaccgggactaaagattatttttagtcccggttaaaaaatttttgatcaccaaccggggctaacgatcatttttagtcccggttcaaaaagttatcggaccgagttagaccccaattcttttttagtcccggttggtataaacaaccgggacggacaaaaaaaaaatcaaccgagctggcgccactgccacgcccggccacctcggtctctccccctttttttccctctcctcacattaatcccttctccatccttatccatccctcctccatccttatccatccctcctccatcccttctcctctcccattcctctcccttctcttctcttcctcctcctcctcctaccacgtgaggccgggcggcgcgcggcggtagggagggcgtggagcggcgggcggccgagcaggcggccagcgaggcggcggtgctccccgggcgggcggtggagcccgaggcggcggcgctccccgggcgggcggcggagcccgaggcggcagcgggcgggcaccggccgccgaggcggcgggcggcgacgctccccaggcggcgacggagcccgaggcggccgagctggaggccggcgaggcggcggatggccggcacccgatctctgcgatgtggttttttcctgatctgtgcgatgtgtgcggccgatctgtgcgatgtggatttctttttctgatctgtgcagccaatctgtgtgatgtgatttctttttctgatctgtgtgatgtgtgatgtgtgaatgaatttgtggggatgattttgtaattttgtgaatgatttgtgatgtaggctatgtttagttcagcgtaaagtttggattttggttgaagttggagatgatgtgactaaaaatttgtgtgtgtatgacaggttgatgtgatggaaaaggactgaagtttggatccaaactttggatctaaacacaaccgtatttggagatagaaaatgcagcttgatgtatttggggattttgtgaatgatatgtggtgttagaatgatttgtggataatatgaatgatttgtagggctcgaaatcatgcaagcagcagtaaaagaaaaagaaaaaaaagaacattagtcccggttggtaactctaaccgggattagatctttagtcccggttagtaactccaaccgggactaaagatccttttttagtcccggttatttcaaccgggctaaaaatgagtatttttagtcccggattcgttagtcccggttacataaccgggactatagggggttgtgaaccgggactaaaaagggtttgttcaccagtaattggatcaacacacaagagttaatcgggtaactatatcgtattatcttgggcataacttgataccatcttttttgtggataccagataccagtgtcgtgatcgagccagcttggctcattttgaaaggactcacctttaatctttctataccttctatcatcgttcgctagcaataattatatatcaaaatttatacaaccatgcaatatcatttacaatatatttaattctacaaattaacacaaattaacatgaaagcatttccaatcatgatccctcacattatttttataatatttaaacatatatattcatcatgcattgaagtgcgggatactagtatcatttactctctccatcccaaaatataaaggatttgagagagtccaaattcgtagtgctagaatattcacattccttcaaatcgatgaagagagtagtttgtttcatgattagtaatttagtattacataacttgattaatatttcatttacaatctcccacagagtctactaaatctatttctttctaaacattgtttggaaaaaccaattttagttgtcactaataacgaatatcctttttacgtactcctagtatgattgttgaaaaaaaaccatatcaaagattacttaacaattctcctagcaaagcatgaagaatcaactactattcttcccgtctctaaatatttaaccccattgacttttttaaacatgtttgactattcgtcttattaaaaaaatttaagtaattattaattttttcctatcatttgattcattgttaaatatacttatatatatatatagttttatatatttcacaaaagtttttaaataagacgaacggtcaaacatgtttaaaaaaatcaacggcaccaaatattaaaggacggagggagtagttctgatctgatcaattgagtactcaattgtgatcttatgtacgcatgacaatttttcgctaaatttcagtcacacttattatatttcaaatttcgaaattttacttggaatatgcataaattacgtcccgcatcaaaacctcaaaattaatttcgtgacatttcaatcggttttcgagctatatatgtagaaatatttggagttaatatgcctccgatccggccggccggccggccatctgcacgtagaacgcacgcacgcgtgccgacatgccgcaaatcggccgcgtcagctacgttactccctagctagctagccgtcaaaaaatggaaacaatccgtgcttgcccaacgatacatcatatggtccatccggccgaaccgacgaccacgacgaggtcagtttcgacctgctgcatgccaaagtcgatcgtctacaaatcaaatgtaatggcaattaataggagtagtaattaagctatatatagcttacattgtgtaattagctgctaggaattaatcgcataccggtggcttacaggctggctggctcaaagctatgcatacaatatttatgtactcccttcgtaaaaaaaataccaatcctaactttaaatatgaatatacactatatccaaatttaaatttaaaattagatttagcattaggcttttcttaatagcagagtgagtagtcgtaaaagaaattgttttggacagtgacagtctaaaaaaacacaactttgacttcttatttctaataaaatattattgaaaagtgatatatgtatatttttatgaaagtatttttgaagacaaatctatttatataatttttatatttttaaactcaacaacttgagagttattcataatttaaattctcaagatttgacttaaatattgttctcaacgattttctttatgagtacggaggaattaagtaggaagtcggttgcgagatggaagcgtcgtcgtggcggctgactgggtcaggtctctagtctgcaggcaaggtcaggtgcttttgcttgtcggcaactcggcatcgatcgttactttcttgtctactcctactcattattattaattaatgggggtagtaggtcaatttaagtaggcacacgcacgcgtccaaactcgacccccaagctgcatctgcatgccgaccgcgaggagttgttataagccatacacggagtatgtaattaacccctcggacacgcccccgcgttccacagcgatcgccgacgtcgatcgagatcatgggcgcgttgctatatcatgttcgatggaaaaaaaaacagaaacaaaacctcgcaaatttcaaaccttaatttatatccacttaacgattcgtgcttaatttaggatgtcttcggaacctgttcccaacactaggtgcctgcacggaaaatggaggagcgattagcgggtaattaattaagtatttgctatttattttaaaaaatggattcatttaattttttatgcaactttcttatagaaactttttgcaaaaaaatgcaccgcttagcagtttgaaaagcgtgcgcgtaaaaaacgagagtgatgggtagggaagaggggctgccgaacacagtctttgcaactgcgtgcaagcccctgtgacctccatcgccatggcgccgcgcagattcatgttcctccatcgattcgaatacctcattcacttcaacaaccaaacacagtctgaccggttgatgttctcctggatcgatcatcagtcaatccacaccgttgatctcattcacttcatccgctatgcctaccaagggcatttatatttgcacatcatcttattgaagctagcaagcctgcaaccaattcctgctcagtactatcgatcctccatccctatctccctgcagtcgtaccgctagcggcgccgccgccgaccaacaaggcaaaggacgacggagcctcgatctccacgtctatatgtttatgattcgtaagtctgcgatgcgcctgctcaatctgtttggtagtattttctcgtgttgtgtctttggttcatgtttgcccagcaaattcctgattaatatgtatgcttgtgtcctgtacgctttcactcgcactgcagactaacgaatattggctatagccgactgggggtgcctgacgagatatggccgttgcactgccatcacacattcacaccagcttcgacatgaacaaagctgcagagtattgaaagctgattctgtgattcgtttaatttgtactactaatttattatatgagctaggcaaaatcacatagcatttacatacatggttttttttattcgtttacgtgctatttgccattttgtaattaaatctgttaagcgaagaaccacttacatggacaacactcaatctcacatgttttagcactaattataaattattcgtacataattttaccacatatacatggtttaattagtacataatataaggttttttgcttgcctgctttgaaattgttatccaaacgagcaagtagtttccatcttgcaagatatcagaattatattggcaatttaacgtacaaatgtctcggctagattgcatatatgaactcatctattgagcaatagtttttatttagtcaagaaagcttatttttcttacaaagtcttgccgcaacgcgtggggtatccactagttatataatgtttctaatcccatgaaaactttagaatccctgaacaaagttggttatttgttgttagagtctactggcttacgtctctttgacaacatatatattagagggtccactcgaggatatatgtacatgcgctttttgtgtaatcacaaaaatgaaaagaacattattatggctcgaatgtcattagatggtcaaatgtttcattggatgctcgcatacaacatttacaaaatagaggtggatcattactttaaaaaacagtaagataccgacatatatacatgtttaattagatgtttgatacaacaatataatctacatgtataaggtgtgaaacatcacttaaaataattattacaatatttcataaagattgtgccatgtccaaaaatcagtgcaacatttctagaaacaactggtataccattcgaatgaaaagagtgaaacacttgaatgcaaaattacaacaaataaaagaaagaccacaacaagttgtaaagagtatgcagaaggagcctatcagtctaaatgtacatatatacttgctcccttttatcggtcggatctagtctctatcaatgttaccaaagtggaccaatgttgagctttgttaggatccaacaagtggtacctctaggtaatagtaccactaggtaccaaataaaatccagccgttgaattagcagggtacgattggaaacgaaccgaagcggggcggagagaagacccgcgacgcgagcagttgcgtatagatgccataatctcctcgtcgtcctcaagcgcccgcgccgacaccatgatctccaagtcctcatccgccgcagtctctgccatcgctggaccgccgcaaaaatctcgatacgatgccggcggcttgcctgctcctgctgggctgcatgcaggctgctcccatccgcgatatcccaaacaaaatgttatgcaagggctcctaagctcctctagaaaaatgttttatccgttgatattagcatttggcttatggagagataatcggcagttaacatcgcataatctcgtacagaggaatcaaattagtgccggggaggagagaggatgctggaaagtagtcgagcagtcgtcccaacatatcagcccacgtcctccgatgtcgccgccgcgtcaccgtggccgcctcttcgtcatcgtgctcgtagccagcctgcccacgagctcaaggagatcttcccgttcccgtcgccgccctgagctatatctggcgccccgaagtcggcggcgaccggatctggcccggaagccggaaggggggagttgagttgggatggggtagggtggtgacggcaggttgcggcgagggaggcggaggtgtccaccgatctggccggcgagattggtcgcgccgccgccatggaggacgtgctggagggggatcgggaggagcggcgttgggaaggagcctgcggtacaggagtcagggaatacggaccatgcgaaatcctaattttgcccttccgcttcttcaatgcatgcggatgggatttctgtacctggcggtaccgaggatcgatagccgttggatttacctatatggatggttcagattacaggtaccgggaggtaccaaaagtttggatggacggtaaaaaaactctagaaggagaaaaggaaaaaaaatagagaagctttgaagggctcggtagtctaatgtacacatgcacttcctatatagtgtgtaattgatttggattttaaatcagaatgaaagaggaaaaatgcaagtaaaaaagaactgttggatatcttagatgaccgattggatccaaatgccaaatgccatagagagacagaaaacaaaacatggacaccacatacgtgaaaaccacaaacaagcataagggtaaattcgacaaacttgcttcaagagttgagaagcaagttttatacgtccggttttgaattttggagaccaaagttaaaacatttgaaatgttgaaggaaaataaatacttcttttagcacaaaaatgattagctatatcacacctatatcttatataccacattcaaggtaaaaaatcaagcatatgattgggccacgtggctccctaagattttagggtttgctcctttgaaaatcagccacatgtcccgtgagattcagctagagcgtcgatcgtgcaatgtctcatctcttctattaatctaaagctaacggctagccattcttctagcgtttcattggtccacatggcatgtttcattcgtccagccctctcgattagtccagacactggaccgtgaaaaagaaaaagaaaaataaaagaaaagccattgattcattcactgtctgtcatgggctgtacagcccagtcacgcactcatgcatgactgcactaggcctggtcatctagcgttgttgctacagtatttgcatgttgcactttaccttctcgggctaattaattagtaataacacaaacaggaccaaacagaaataggaaaaaggaaggtagaaaaaagtataaataattttgtaaaaaaaatcttcaaaacataaaatattgatatcatgtatttatataaaataaataataatcgggaaaaactaaatatcaaatataaagtgaaagagattggatgagaatttgtaatactaagaaccgttttttcaaatatgcactttatcattgatactatatgtacgattttttggttaatgaaatcacaacaattttgaggaaacataactttaaattttctaatagagtctctagctatttgccaaattattgatcatcattaattacaatcttactttggtttttctcataattctaagacaaacataaaattaaattccattaatatgtccatttgaaagaattttttcagagttaaacttactcatgaaacaatatattactctgcatgtttaatattacttgtcattctcacatttcaaattattatttttacatcgtggtcttctatcttcaccttttaaatgccatgtataactattaatcagttaatattgcttttgaaaacgattataatgtagttaataagcatatagcagtgtaatttgccacatctccttgtttgatgtgaaattttgctagagttacaaataatataaaatgagaggtagtcaaatatattacagatgagccatattacaggctaaattaggtggcacgccaacaggcgtgcagatcttctagtataattctattctacgattcacgaaagacaatcttataataactttccctgattaacatgcaagcaacttcaattttgttgttcgtacgattcaactagggatgtcattctctattttttttataggaataagttcactttaggttccttaatttatcgttcagtctgattttcatcattcaacaaaaataccaaatacaatctgtgtcccaacttacaaaaccaatgcaaacgaggtccctcgatagtattgtcctcggttttaactgacgtgacgtccatgtgactcctttgactaaggtcttcatctcacgtagcattgacgtggtacttatgtgacagtttgatccaaaataaatagaaggagcaaaattaaaaactaaaaaaattaaaacaaatatgtggggccccatgttagccaaacaagaagataaaaaatagcgggaccaacatatcatggctcccactttctccacctcacccctttacccctttatctctgtcacctctctccaccggtgagcgcgcatagaaagagacgaggctaggagggagggggtaggaatggaggagatgaggaggacgagagggactgagaggccggcgagtctcctctctctccaccacccttgccgcttggtgcaacagtagccgagggggcgaagatctaggagggaaaggagagcgaccgctactctcccccatccgccacgtgcccatcacctatcttgccgcgtgctgacttggaaagatggggaagatagagctgaaataggttgggaggagaaggaaaaagtacatcgaaggtccctcaacttgtcatcaaattacaaaatcgtccttaaaccacaaaaccggatacaacgtgtcccccaacttacaaaaccagggtagaataggtccctcggcagttttgactccagttttatccgacgtggcagctgactcagcgtgggacccatgtgggtcccacgtgtcagccccttcttcccctcccctctcttcctctctcctcttcttttctctctccctttgctccagttcggcaggcgggagtccgacggccggcgacgggcgatgaggcggcggcggcggctgcgacgagcgacgaggccgcccgctccgcctccacatcgcctccgcctactcggagcgggaggcggccgcggccgacgacgacctcgccgtgggacgcgctcatcgcctacgcccgcgccctctccctcatcgagcccccagatccgacgacgacgacaaccgccgcgttcaactcctcgcccccccacccccgccgccgcccagctcctccccggcggctgccggccgcgcccatctccggttcgattgatcgaccatgcctcccctcgtggcgccggtggagcacaaggacgggccctgcaggcagcggcacgcggcggtggcggcgatgacagcggcaacggtggctaagccgcagcagtggtcggcgtcgttccacggcgcggcgcggcggagcagcggtcgctgacgcagcctgacttgctcgccgagcatgtggccgctgcacgtgatggcgcgcttcgagtgtcgcgtggctgacctggtcgccgccgccgtggagctctacctccgggaggggcgccggctgctgctgctgtccgccgaccccgccgccttcggactctgcttcttcctctccccaaaggccgcaacgattgccgcaatcaccgccgccgccgctcctcccccaccagtttagggatgagagaggaagagaggaagagagaggaggagaagaaggggctgacatgtgggacccacgtgggtcccacgctgagtcagctgccacgttggacaaaaccggagtcaaaaccgccgagggacctagtctacattggttttgtaagttgggggacgcgttgtatccggttttgtgttttaaggatgattttgtaattcgatgacaagttgagggaccttcggtgtactttttccgaaggagaatgttccgccccattataagcccactgttgaatgtagtctatacatgtacaaattgtgagctaggatgacgttttactttttcctgggagcaaaaaggagggggaaatcataagaactaagaagcactaggtgaaaccccgcgcattactgcgggaatttagtatgataacaataaaaaaataacgtttaagatagctagataacatcagattaagtaaattaatgtggtttatgataatttaaatttaaatagtatgtagaatggtgattcaaacgtaaaaagtaaggtggtatgactttatggaagaagaaaagtaggaagatagtttggaccgtagattaatcatctaaaggctaaatacaattgatgtgatatgacttaattagaggaaaaaatgataatttggaccatagattaatcatttaagcactaattgaggatgaactatatataagtatataggatatcataaaacataaaacataataaagatatacattgaaacattatgtgaattatgttggatgataatttaacatgtttgtatttcaaaagctcttaaattataaaaactataaagatataacatgtttgcatgatgtttaaatgtgatgattgttagtggatgatgatgtgtcatcttgttaattagtggataatgatgtgtcatcttgttagtggatgatgatatgtcatctttgcatgttaagcttaaggagttaattagaggaaaaaaagagaaagataatttggaccatagattaatcatttaagcactaattaagtgaggatgaactatttaagtatgtatgatattataaaacatagtaaagatatacattgaaatattatgtgaattatgtgggatgataatttaacatacttgtattttaaaaactcttaaattataaaaactataaaatcatagataatataacatgtttacatgatgtttaaatgtgatgattattagtggatgatgatgtggcatcttgttagtggatgatgatgtggcatctttgcatgttaagcttaaggagttagtggggataactgtaaggattagttaatcagtattcatcagtaaccactatacatttttctttactaattactcctttaaataaaattttaaaaattaaataaaattctgtaaatacaaaacatattgttttaaataaaattttaaaaataaaaaaaattatttaaatacaaaacatattgttaattactcctttaaataaaattttaaaaataaaataatgttctttaaatacaaaaacatattgttgagagtgggatttgaacccacgccctttcggaccagaaccttaatctggcgccttagaccaactcggccatctcaacttcttggtcaaccagttattatattctaattgaaacagtttgtattacagatcacacatcttccgtgtaccaaattcgctaatcacccggatcgcgtgtgcccgtgcgcggaaaagcaacaccagcatgcacacacacacaccaaaaacgcaaatccaagcatcgcacgctacatcagcaacaacggcactatataaacccatcttaacgacacctgattagcagctccagtacactaattaacccaaactccctccacacacattaaccactgcacaaacgcagccagcgacagcgaggatggccggccgagccagctgcgtactcatcctcctcctcgccattgccggcttcgccgacgtcctcgccgccggcggcgcgacgccatcgtcgtcgtcgtcgcaggtgagcacgacgacggcagcggagttgaaggaggtgaacgggatgcttgcgtgcatgatcgggtgcttcacgcagatgttcgggtgcgccttcgggtgcatggcgaagggccccgacacgacgctctgcgtcgtcagctgcaaccagaacagcatcgtctgcatggtgcgttgcgccctcacgccgccgccgcccaagcccaagcccacgccgccgccgcccgcgcccacgcccaagcctcccgcgccctcgccgtcgccgccgccgcccaaagccgccggccacggcgtcgctggcgaccccttggcctagacatgtacagctcagctcactctactatacccctacaagtgctagctcctgatacgacattataaatgtgcctagctacgtgatatataatcaagaatcaagaaaatacaaactgataaaagaaaaaaaaatcaagaaatacgtatctatgtagatctcatagttttcatatatgcatttatgtggctgaacatgtgtttgtgccagccatatgtaacaaatgaaaatgggtcgtcagtcatactgagtgtatgtatttagtatgacctgagaaatgtactcaattgtgtaatgttccataattatgttctggaaatgaaaattttagattatatttttgtctgtgcaagcatctgctcttgcctaatagcacttccttaattaccacaggttagtatggtccttcctacatgccaaaatcacaccaacaacggctgcaaaatgtgtgtattcatcaagtcactttgctgactgtcagatgggtttctaagaattaacaagcaaattgtagtataaaatgtgagacttgagcaatgtgttaagatacggaagtgtaacttaatttacagtaaactgttaatacaacttacagcctgtagttcacctgcaagagttgcatctctccctttactccactttgagacagtatgtacaccttttttttttagtacataatcaatctttagtcctgcaacacagagtaataacataatggcaagccaacattacatctgcactaatctattatattattaaaacagccttgaaaggaggcaccatgttcgctgttgagactagaaattctcacattaatcggagaaaaagagaaaaaagctacacctttagattatacagtgcatatagattaaagggtgtagatttattgggcaatatttctattggtatgaaacaaactctatttatataataaataaataggaaaggttaaagtacttctaacgagcatgcatgtcagagtcctaatagtatttaggcaggtatgtccgattgggtgtggaaaaaaaaggaaaaaaaaacacaatccacggaaggaaaggggaaaaaaagatgcacagtccacggaagagtattttgtagctaccaaaagttcacttgcccagataatcttgatgccactctaaaatcacgtgcattcatccatcttgctatcaacacctacacgatagatcactggaaataattttgtagcctaccaaaagtttttttttctacttaaatacatatttgaggagtctgttcactatattggaactagaaaaaatatgcataattatatttgacgtttaattatgcgtttaattatgagggctttatatttaccccattaatcatatttaaaaaagtttagaccattaatatggttgatttaatttaaataagttataacaaaacatatacagtatataagttaatcgtataaaaaaataaattggcgtcatggatcactttaataaataataattataaacacacgggttcagacaagaaggacaaaaaaaacatccatgtcttcgtaatatttaccactttgtgaaccctttacttgagaaaataaagaacaagttattatgccatatgtcatatgttatactccctctgtttcatattataagttatttgattttttttcttatcaaagtcgttaggtttgaccaagtttatagaaaaatacattaacattttaatacaaaacaaacatattattaaaatatattcaatattaaatttaatggagctactttggtattgtaaatattactaattttttctataaatttggtcaaacctaaagaaatttgactaagaaaaaagtcaaatgacttataatatgaaatggagggagtagcacctaaaacataatttcatagacatccaacgtcacccacctacacgatcacaagcggtccatgagaaggcctggttgcgataattttggtctatggtgggaggcttggggtcgcctatgtaaaagaattatcataggcagcccactacgctggccacctctagaaatacatttattttttaggactacaaataacgggtgtaagtgggtaagccgttaactcacttataagttaaaataagtaggttcataacttattttgacatgggctgcagga

SEQ ID NO: 63600 - DNA, 11173 bp, Oryza sativa
ctagaaatacaatttaaaagtaactgaaattcagaattaaaaataagcaaaattgaaagaagagtccatataaaaacccaatacgagattattaaaattaggaataaaaaataaaataaaatccgaaattagcaaaaaaacaaaaagaagagttcgaatacaaatactgtcagggttacgggttaggtataccctttacccttcgatatacgtcgcatatcggtatggcatacccacgcgcatacggataccctctgcatatattaaggaaatccttcacggagtttacggacgaaaagagtcctactcggacaagactgggtcgtcaatgtatcgtgtagggtctgatgtctccaagttcgacttggaaaccgcctgacctgtgatataaaagggacccccggggaggacctaaggcatcgaatctcagagccaacacaacccccacagcatacgaagccggagcctgcaggagccaaaccgctagggatctagtcgaaccaactcgactacgatctcgccggatccctcgagttccaccgttccctttgtaatctgtgtttttccatcatataatcccgcatcaactggattagggctattacctatcaaggggcctgaaccagtataatctttgtcttttgtttgcttgatgtcgtactacgtagatccttataccaacataccccaataccctctatatccggtctacgggtatcacccatcgacagtggcgcgctaggtagggggacttggtgctcaaggttctactactatgtcatccagcttcgtcgacaacaacttcaacaccaacctcaaccagggattccctgcttcaacaatgctggtgtggactcaagtcggagaaatcgtcttcccagtttacaccacaatgctgatctcagccggtccatcaatgaccggaaacgagaatgcagtggctacaaaccaaaacgactccatgtcgaaagatcctcccgctgaggcggagaacggaacatcaatgacatccgagctcgagaaggattccaaggcggccaaaccttgtcactccgacaagaaccacgagccgacaaggataacttctgaagcgacaaggtcctggtgtcctatccacaaaaccaggaaacatactttgcaagcctgctgggttttctcaacgtctgcgccgaaattcgcgcctgcaaagagcgtggaattcagcgtatttctccaactcgtgatgtctattgtcctatccacaagacaaaaaatcacgacctctcaagctgcaaggtttttctcagcgccatgaaggtgtcatctcctaaggtccaatagtcacacatccccatcagggataaagacaaggaacgaggagcgacaccaacttcagatcgatttgttggggtaatcgacatcggtccccatgaaccatcagtattgcacctcctcgaagactatggatcatcgacagcgagcgcgccgcgggaagtattggctatcaacgatgtcggcacgtcagcgcgcaccaatgcagaagcggagaatcaagtggccaccccagcccagcacatcagagccgtcgacgctatactgagggaaaccccctacgatcccgttctgaacgacgatctcgcgcgttggacagaacgactacgggaatcagtgaccaacctcagcaatgcgttcgaagaggccgctgccgcagcgcacccagagcagccaccaactggcgatgccaatggtgaaaaccctgaacggagggaatcgcctcatcgggccacccctccacctcgcggcaccggcgatctccgcgatcacctgaacggccaccaagaggcacgacgcacacgagacaacgagaaccgttcccggcgccatgtctcttcacggcatcatgataaccaagatcgaggagactattcaaacgaagaccgagaccgtgataaccgccacaactgccacgatcacaacgatcgcgaacggcgggcgccaagcgatactggtcgaggacgtcaccataatgacgacgatgatggagaccggcgccgagacaacagcggaagactacaataagattctcgagagccaggccgacatcctcgtaatcgtacgccggaaccaagcgacccatcgtcatcgtcatcatcctcgtcttcctaatcatcagacagacatccacgaaggacacacgatcgccgacaacccaccgcccctagtgctgggtgtagagctttcagtcgttccctgcgtgatgtccgatggcctgagagattccgacccggagcaatagagaagtacgatgggagcaccgacccaaaagagttccttcaagtctactccacagtactctacgccgccggagcagacgacaacgcattagctaattatttgccaactgcgttaaaaggctctgcacgttcatggctgatgcatctcccgccctactcaatctcttcgtgggcagacctgcggcaacagttcgtcgccaacttccaaggaacctacaagcgccacgcgatcgaagacgacctacacgcgttgacacagaactcgggtgaatccttgagggaatatgtttggcgcttcaacgagtgcagaaatacaatctccgaaatcaccgacgcttctgtaattcacgccttcaagtccggtgtcagagattgctatactacccaggagttggcaacaagacgcatcacaactactcagagattgttcaagattgttgagcgatgcgcccacgcagatgatgcgctaagacgcaagaacgataagccgaagaccgggggagagaagaaaccagccacggacacacctgagtcaagcaagaagaaaaatcgcaagaatgggaaaaggaaagctcaagcggaagtcctcgcagcagaatacacgaaccctcccaagcgcccagacccacaaagtagcgacgcaaagaaaacatggtgccccatacacaagacggacaaacattctttggaagattgcctttctttcaaaaagtcgctcgagaagcacattgcatttgaaaaaggcaagtgagtacgcgtggtcgaaaaggatgcggaagtggctccccaggaatcggactcagcatatccagactctgacctccacgtttcacacatcttcggaggttacacaacgtactcctcaaagcgagaatacaagaaagtggaacgcgaagtctattcgacatggcagggggctgcaccgaagatgaagtggtctgaacagaagatagaattctcggaagaagaccaccccaagactgccgtcatcccaggacgatatccgatcgtggtcgaacccactattcggaacggagcagatcacctttgatgtcgctaaattcgatacagcttataatgccatcatcgggagaactgcacttgcgaagtttatggctgcatctcactacgcatatcaagtgctcaagatgccgggaccgaagggaacaatcactattcaagggaacgcaaagctggcggtgcaatgcgacaaacggagcctcgacatggtcgagcaaacccccagcccacccgccacgactgagccacccaagaaagtgagcaagacaaacaagacgctgaaatcggacgacacaatcaagatcgttccactctccagtgccaaccccgacaagaccgtcaagatcggggcgacactaagcgagaaataggaactcgcgctcgtcaccttcctccgcgacaatgctgacgtgttcgcttggcagccgtccgacatgccgggggtccccagggaggtgattgagcacaaactcatggtgagacccgatgccaagccagtaaagcaaagactgcggagatttgcatcagaccgaaaacaagccatacgagaagagctcgacaaacttctcaaagctggcttcatcagagaagtacttcatccagagtggctagccaatccagtcatggtgcggaaggccaacgggaaatggagaatgtgcgtcgacttcactgacctcaacaaggcgtgtcccaaggatcacttctctcttcctcgaatagatcaactgctggactcaacagccggctgtgagctgttgagctttctcgacgcttactctggctaccaccaaatcaacatggcaaaagagaacaaagagaagacagcattcatcacgccattcggggtattttgctatgttaagatgccgttcggactcataaccgtagggaatactttccagggcacggtccagggcgcacttagcgaccagctcggcaacaatgtcgaggcatacgtcgacgacatcgttgtcaagaccaagacaagcgactcattgattgacgatctgcgggaaacgttcgacaacctccgacgatatcgcctcatgctcaatccagagaagtgcacgttcggagtaccgtcgggcaagctgctcggattccttgtctccggcagaggaatagaagcaaatcccgagaagatcaaggcaatcgagaacatgaagtcgcccacaagactcaaggaagtacaaaagctaaccggatacatggcagcactgagcaggttcgtcgctaggatgggaaaacgagggcaacctttcttcgctctactaaagaaacaagacaaatttgtatggacacaggaagccgaagaggcattcgttgtactcaagcgctacctatcaaacccccctgtacttgttactccccaacctaatgaagaattattcctctatattgccgccatgccatattccgtgagcactgtcattgttgtcgagagagagaaagtacaacgaccagtctattacgtcagcgaagctctccacgacgcaaagacaagatatccacatatccaaaagctgctttacgcggtcatcatgacatcaaggaagctacgccactactttcaagcccatagagtcacagttgtctcctccttcccgctcggtgaagttgtgagaaataaagacgttgttggccgtattgcgaaatgggtagtcgagctgagccaatttgatgtccactttgtgccatgaacagccatcaagtcccaggtactcgccgacttcgtagccgattggactatgcctgataacaaatcagacaaccaagtcgacaccgaaacgtggacaatggcgttcgatggtgcactcaacagccaaggagcaggggcaggatttatcttaacgtctcctttcggagatcaattcaagcacgcaatccacctcaacttcagggtgaccaataacacagccgaatacgagggactacttgccgggataagagctgcagccgcccttggggtaaagcgactaatcgtgaaaggggactccgagctagtcgcgaaccaggtgcacaaagattataaatgctctaaccccgagttatccaagtatctcgcagaagtcaggaagctagagaaaaggttcgatgggatcgaggtccaacacgtctaccgcaaggacaacatcgagccagatgacctagcacgacgtgcgtccagacgagaaccgctcgagcccggaatttttctggacatcctgacaaagccatcagtaaaagtggttagcggcgaagttagcccggccgcccccgacattagctcggaggccacaaaggcagaacgtgccgttgccgatatcgagaccacagatgactggcgcatcccactaatcaaattcatcgacagcgaggagttgcccgaggacgataccgaagccgagaaaataacccttaaagcaaaaatctactgtatggtcggcaacgatctatacaagaaagcgccaaacggggtacttctcaaatgcgtctcatctgacgacggcagacacctcctccttgatatacatgaaggcatctgtgggtcacacgccgccggtcggacattggtcgggaaagcttttcgacaatggtttttctggccaaccgcccttaaagatgcatgcgacatggtccaacaatgtgaagcctgtcaattgcacagtaaacacacaaagctacccgagcaagcgctccagactatccctcttacttggccattctcgtgctgggggctagatatacttgggccattcccacgtggacagggcggctacaggttcctattcgtggcgatcgacaaattcactaagtggatcgaagcagtacccacgggggaaatcaaggccgacaacgccatcaaattcatcaaggggatattttgcagatacggacttccgcaccgcatcataaccgacaacggctcccagttcatcagcaccgatttccaggattactgcatcgggcttggagtcaagatatgcttcgcctcggtctctcatcctcaaagcaacggacaagtcgagagggcaaacggcatagtactacaagggatcaaaacccgagtctacgacaggctcatgtcacacgacaaaaaatgggtcgaagaactctcatcagtactatgggctgtacgcaccacaccgacaatgtctaacaaggaaacacccttcttcctcgtgtacggctccgaggccatgctccccagcgagctacgacatcagagtacacgagtatagaagtattccgacgaggatcaggagaagcagcgaaacgtcgatgtgaaactactcgacgaacatcgcgaacgagttgccgtccgagcagccaattaccaacaggccctccgtcgttaccacgagaagcgcatccgagcacgcatactttcgaacggcaactacgtcctccgatgggttcaaagccaagcagggcgaaacaagctctcacccaaatgggaaggaccttacacgatcacacaagtcttacggctaggcgcattcaaaattgcagacggtgatggtcgcgagttggcaaattcttggaacattgaccaattacataaattctatgtatgagtcaatatcatccatatctgtaagacaccttacagcatcaataaagcctattcttaggcgcatattacaatcaaagtgttcctgcccgatgatcccttacccagatgacacctagcgttgaaaccaatccttatgtccctttatgtcgtctcgacaagacctccgaggaacctaagggatattcggctggggacacccagagtcgataaggacttgtcagatcctgtagagacgaaagaccatgtaagacctggtcgtgtaagagttctcgccgtgcgtattaaccaagccgtgtaatcggaaattaacttattcaaccaaggcaggtcaaaggtccaagatccttatcctccgagaaaatttctctgacgacaaggctaggggctagggagaatgtacgactcaaacgaccgactaaagtcgtgaactgagaacacactctgacacacgatatccggagtaagaaagatctgttaagatagatttcttttccatttcacaaaatactccttataatttttacaagtctaaggctatattacacttttccctaagatgtctatcacagggtacaaagactaccaagaaggccaacgccagtccatagattggaagaccttctccgccaatggcgccatcgacttcgccagttggtctatctccgtcggagtcctccgggaacgagcaaaaccttcacggagaaaatcgaggtccaggcgcgggcgatgatctcgtaggcaagccaacacgtgccctccggcatatcggctcgatcgacgacactcctgcttcaaggcctcgtcgatgcgtttgccgacgccatcgagctgagcacaggccccgttcagccacgagatgtatccggctgccgactccttgggatccccacggggtactcggagctctctacaaaccttggccatggatgtgcagcaactcttcaagtacgagttgaaccacacctcacgacctcggagcgtttccacagccttctttttcttcactgcaagcatggttctctcgagttcccgctacttcaaattttgtcttccaatattggatacgacgatcttggccagcaagagcactctcgagatctgcccaatgtgggaacaactaagtcaagctgcacgcctctttcgagaacatagctgatctagtcggaggagcaataagggatgaatggaccactaacctaaggaagtcgtcgccatccccgtccccgtagctaggatctggtctacattgtctggcgacgcatgtggttcaaacgcgagagccgaaatgatcgccggtgactcaggctgcccgcgctgctggacatcctcatcatcaacatctctacaagggacaaaaagtactcaagatcaacatgcaagagtaagctaggataatagctgcacgcacaaaggcggttgaggtccatcaaagttttacacagcatgtctgaggagtacaagagatcctactcttcaaaaagagggagaacagattcccccagatcgccgacttcttccatcacctccttacgcgcatcgctagccgccccctgatccaagatctcgcggagatcgagttcaggatgcgccagcttcacacacgcaaggacgtggcatgtcccggtatagattccgttggacgtctcctccccgatcctggccgcatgcttggaggggatctcctccatcgccgccgccagcttcgcaagagaagatgtcagtgaaaactcatcgggattcgccgggatggtagacttgatgccgcactccccggcgagctggtgcataccagtataggtgacccgcaacgagccacggattttcgacagattgttcccgagctccgacatgcggtgctcgagcccctgccgttgtcgctcgttgccagccaccaactccctcatcttcttgaggtcttcacgagcctccgccaactcgtgtaccagccagttggcgcgctcgttcgccgacgccgccgccgacctcgcctccgcaatctcgcgaccaatgccacgagcaccagcctcgaggaggcgccccatttcgacctggagctcctcccaggtgaggacggcagccggtggaccacgaccagccgcgggatcgctggctgggccgcttggtgttgcctcgcggctcccgggcgcaagcacgacatccgtcgaggccacagcgggagacgcgccggaagtccctccggactcatcttgcgccgccttcacccacgccgccctatgagacagccatggttcagacaacgctcgaacaagatcacggaaacttaagttcatccacttacttctcgccaagtgtcacaagtcgttgtcgtcgtggaggcgggggagacgcgtccgaggcctggaaaacggttgatgcgaagtaaggcgaaattcttctggctgtatgatcagacaacaggatagcttaccgagggggtagatgccttgcgacgatgtccgcttacagaggagaacttcctcccctttgtcggaacattgccaccacttgtggtagcagcagcagcagcagcatcggacgcctccttggcgaccttctccttcagtgacgccaccacctgatggtcagcgagcggcccgatgatgtcagtcagaggaagagcctacgcttaatcaagtcacaaagcgatctcggaagaaaaacgcagaatgcctattgagtacacttacattgatggcagtgtcacgttcggctgcctccttctcacaaaggggaacatggatgttactcgccgttgtcgggccactgatcatcacctggccgacacgacgtcccacggtttcgctgttcagacctgtgaatcgagaaccaaattttgataaatcaggaggaacgtgaacacgatcatgtcaggataaatacaagaaagataccccgaggagaaacccgggtcgcgtcctccggtccagaatagtcaaaagctggatggactcgagcctggagcggctggatccgtctaccaacgaagtcggcagcgacttcatacccagaacaacctcgtactcggagatcgtcgacaatatcgatgaacgactggagagaaggggtcaaggggggctttgcggtccaagacgaaatcttatccggttgttcctctggaacaacgaagacagggtccgaatcttcgatctgaaggtagaaccacctcgttcgccatttgctgtgagaggaagggcactggaaggggatataacgcgacttcaggcaatcccgaagtcggaacccgacgcatccagacaccctgttggactccatccaacacagctcgtagtagaagcgaaagagatcgagaaagggctctaccccaatataggcctcacaaagatgagaaaagatgctaagaaaggcgatagaattgcggttcagtacctcctacttccctctccatggttccacgaccgggaagggcgccgtcttcctgaagcttcttcagcgacgcgctggtggaggatgatttgccaagatccatcaccgatcggagatcgccggagaaagaccatagaagttcaataccaagagaagaaattcggaaggtgtagggagaaaaccgcagagaatgtagtcctcgatcgtaaccatgcgacctaagacgagctagggtttcttgtgggagcggagaagacgaagaacgcttgcaggcgggatgttttcttcacaataggcggacttcaaaatggatccccaaaattcctttaaatagacacactaccgacggtgtgaattccaaggaaaggagagagatgcccgccggaaatttctgggtctgttacgcgcggcagttttttagacttcagtttaaattcaatcgtgaccattgggcttcacatggtgttctcgactacgtcatgtctctacggtcctcacactgggaacgacaacagtctcgacacaagaagtcgcgaatggttacacgagttcatttaagcagaagtcgggggctactgtcagggttacgggttaggtataccctttacccttcgatatacgtcgcatatcggtatggcatacccacgcgcatacggataccctctgcatatattaaggaaatccttcacggagtttacggacgaaaagagtcctactcgaacaagactaggtcgtcaatgtatcgtgtagggtctgatgtctccaagttcgacttggaaaccgcctgacctgtgatataaaagggacccctggggaggacctaaggcatcgaatctcagagccaacacaacccccacagcctacgaagccagagcctgcaggagccaaaccgccagggatctagtcgaaccaactcgactacgatctcgccggatccctt

SEQ ID NO: 63601 - DNA, 4526 bp, Oryza sativa
aaaaaataaaataaaatccaaaattagacaaattaaaaagagagttcaagtaggaatacaattttgaaacaactgacattgaaaataaaaaataacacaatgcaatattagttaaaattcaaaacaaaaaatataataaattctgaaattagaaaaagaaaaataagatttcaagtaggaacacaatttataaataactaaatttggtaataaaaaaataaatactactgaaagaaaaggccatttaaaacacatgacgaaattaattaagtaacagggctataatggagtagaatggtggtggttgatgggacatctaaatactattaataaaacacaaaatagaataataatgacaattaaaaggaatgacgacgggcagatagtcaagcaatcggttatggcggtcggcgggacttctagaaagcaaaaaaaaaaatccaatgataatcatatttgatttttaaaatctcaatgacaataaaaatgagaggcaatgggcgagtcatacatgagtacaatggcagagccgccgatggttggtgggacttttagaaagtaaaaaaataaattcaaacaatagttatattcgatttttacaatcttaatggcaataaagagtaagcggcggacgggtcgtagaggagtatagtgcagcgtttgacaggatttgtaaaagttataaaaaatgaaatccaacgagacaataaactctaaaaactataggtccaatttttagaggtaaaagtaaaaaaaaccaataatactcatgtttgattttaaaatctcaatgataataaagaagggaggcatcaagcgagtcgtagagaagtacagtgacaaagtcgctgacgttttgacggaacttctagaaagttaaaaaatgaacctaaatgataattatattcaatttttataatgccaatgacaatcaataggagaggcagtggacggccgtaaaggaatataatggcaacgtttgacagaacttctagaaattataaaaacgaaacccaatgggacattaaactataaaatctataagatccaatttttaaaagtcccaagaagaatgaatagaaatagtgctaggtcgaacaagcaaataaagaaagatatgacagaagtaaggggtacggtgtgacttttaaaaactataaaattagaaacacaaggattataaggtttggtatttcaaagtcttaaaacaacgagataactatttaataaactttaagtaaaatcatattaaaatatatataactttctatgggtgctagccgcgcaattgcgcgggtcacccagctagtttagtgaacacaagaacaaattctgacattcattgctttaattttttttatacaattacaaagctacaaactgttccactcacttccacagagtaggcatttagctcagcgacattggagatatacaactttgataaatatcatctagctatgtgaaactagaaactcctcagtggaaaaggacataacttaaaacttcacaataacatcaaagccgagtttttcatgtgagcttttctatttccaaggtttcagatctgctacaggccccgcagtccagttgagatgcttctcgcctggctttaatatacactgtctgggtgtgggagcttccgagcaaggccgttgaggatctgatggaatgcatctctaggttgtgctggctgcggaaacaacatggcctgtttcattgatggattggcgagtaatctttgcttccttaggatatcatcaattgggatggatgtgaggattgagtctagccttggaacatcctcctcgtcaacaaaaacaccgatttcgtcccatgggattgcgtcagcaaacggaagcacaatatcatcagctatgatgactggaatgcaaccgaaaactacagcctccaccaatctagggctccatggtgcccatcccaaggggcacaagcagaagactgagcgctgcatatcttcatagtaagtagctgggtgttccgtagaaatgtcgaagaggggattgttcttgaaattctcccacagtgaagctcgggcacctctgtataacaagttcaacagagtcaataaagcaggaccaagtaccacaggagatgtatctttcaaggttctgcaaacattcttaccttgcataatacccaccctcagggtcattcccattgtcatagaacaggcctctgaagtaaacaaagattgaacggggagtatcaggaggaatcaagtgagcttgcattttctgaggaggcgcatatggtggtatagtgatagaaccctccttaagcacacatggttcttctgtccaaaagtttgaaccaatgtggcacggcggagcaatggaagtatcccacgctcaatagctttctcttcctgtaaagacatataaccattgcatatgcagtttcagaatagatagggactaaaggtaggatctatcctgagctacctatttcttaaaactattgtggaactaaaatcatgactagctacaacagtgacaaggacttggcaggtaagaagacaaataaaccaatatatcattacctgatagtgaaagcatgccccaaaatcatgtggaacaacaaagaaatgatctgctccatcagttctattccagaatggccattttcttgaaagaaactggattgcgctccgcatcatcctaggagacttgaatggcaatggaagtccagcatgagtcaaatcacaagtagtgtaaacaggggcatagaaccaatcagcctgttcagggttgagcgttcgaacagcactagagagcaagaaacgatgcataaatatctcagcagcaaacatgtggttgaggcatcggggatccttggcgactatcctcttgttatacttgcttggcaagtcataaacaaaaaccttcaaccgcccaactggattgtcttctagcacatcaccagcacttcctgcaggtcaatgatcttggttgagtagaagcacatagtactatcttcataaaactgataagcagattccaagaaaaccagtcatgaagttataatataataaggggacatatccagcgaaaaccatcaaataagtgaaaacccatgaaacctaacctaaaagtttcataaattcatgaaaaaaaatacttgagatggatgtaggcatgaaatacattcccaccaaatatcaagttcaaactcaactttatttaggagtaacagaaaagacattttgggtgaatggtaacatgacactattcacctagaatttctcttttttgtttctctcaaatgaagctaagtttggacttgagatttggtatgaatgtatttcatgtctatagctatatctagtatttttttcatgaatttagaaaagttttaggtatggttttcacgggtttccgcttatttgatggttttcattggatattccccatataattaataagtaatatttaaggtggaaataaatgttaacaagaagaaagaatgtaaaactcaatacaagcttaggggaattcattttcaataaatcatgaataattgaacgaaaattctgttgttctctgaaacataaactcagaatgcaccactctcctaaaaaactcaggtagattctcctctcttttatttggcacaattgcatttatggggtaactgtttatcctggaattattgtattaaatagaaacaataattggatccaattccattatcggaaaagttatatgcacaattggattggctccaagcagatcacagtatcttgacaataactaacgttagttggataggactttgtcaatgagacaatgacataacaagtgtaggtctgcaggtagcacaagcatatatgattgtcttaaaactatcaaatgttaactatgtaacaagtaaaagaaacggaagaggaggagaaataggtgctaaatggtaattcaacatttctatatgttcacacaaccctttgctggcgcggagagattacattccttcgataagcacgagaatcagcgatccattgcagtcagtactgaatttacatcaaactagtattggacatccggatttccttttttatagggggaaaaaagcatatcagtgcgaatgtgcgattctaagagcacgggtgttgttgtacaatgcacattatcaggtcgaacttgcaattgcatatgaatatccatggttgaagtactactactagattagaggagaatttcggcctaagaactgagtggtgttaggctgacacgtcctcgcctagcaacagcatcccaactttgaatcaggtaaagggaaaaatatttacaaacaagctgagccagttgagcgattcccctagccaagttcgtgaacaaatccaacacaagaggctacaactgaatcactcgcatcacaaattcacaatccacaagctaacattctaacaacccagcaagtcgaacgaatcgggtgcagaagtacagctcgctcacctgagatgcgctcggtgttcccctgagccgctcccccgaccacctcggcgg

SEQ ID NO: 63602 - DNA, 16128 bp, Oryza sativa
cgtggaagcttctagaagtcgcgagagcttgatcgctggaggaggaagcaaagggaggcagcaaaaaaagggggaagagagaagggaaaatgcaaagtggtgggggggattttgttgcttgtgaatgcaacaaaaaagagagagagagagagggggaaaagaaattgtcaagtcaaggtggcaagcgtaggtgagagcagcgcctccattgaccaaatgaccagctgcatcaggacatcaggaggcactaatcaagatttatgatgttgctaattcgtcattagcatttacttaattactacattattaggaatttagggttagaagatactactcctatttaagaagcctcaaaactaggtgggagcaaccactaactgcttgttgagttggaaggggattactagattagatctgaccacttcagtctgttaggtaccttaggtaggtagaactgaaatctctgctagtacgacggcattaggatctagcaaatcagatccatttacggtgttactgttgcgttttttcatattagccgggaagtaaggttttgcttgtactatccgagtacaaaattcagggatgaacatgtatgtactcgtgtagaggacaatttcgtcttaattaaactgatttattgcatgtttgggcattaattaccatacccaaaaacagatcgttgttccggcacaagggaatattattatgttttccgtcatttcaggttcttgtttaagtacagctactacagtttctccgacggcgagggttcagaaactaatactctcccgtctaaatataaattattttggagggatatgatacgtaggtggtgtttgaatcttctaaagataaagataaaaattaaatgtttcacgtaaaacgaggtaataacatgtgactaattggattttaattactacaaacttaaaaaaatggattaatatgatattttagaataacctttatataaaaagttttcgcacgaaacacatagtttagcagtttaaaaagcgtgccacgagtatttaaattttcatccacctgttacagaggaaacgaacgagaccatactattcactccttcccaaattgatcatcgtataatagaatttaaaatttctcaaattagtcatcatataaccgcatggacacgaatttcatcataatacaattaatacagcatgagagaatgtgtgcatgctaagatataattggcacggtgttttaatcgatgcatgtattatgggagaatgtgtgcatggtgtcttgattaatatgatttaaattattcttagtcttggtgcataaatttatatgatgatcaatttaaaaagtagtgagtataaatctggacagagaacatatcccttcaaaattgcttatagtttgtgatggaaggaatactactaccttgtacactgttgtgccagaaagctatagatcgccaaagtgcaatgaccaaactgccatcggatgcaagtgtggttgagggtccttgtcggcgtggatcgcacgacactacgacagggccatctgattccaacgtgtgtccgctttcaagtatactccacgttgacaccgacggaaacggaagagaggtctcataataagtttaatttttcatctcttttaatttgtctcgaaataagttaatttttgaagtaattactataacgaaattataaaaataagatataattatattgggaatagagaaaatttttgaagtaattactataacgaaattataaaaataagatataattatattgggaatagagaaagtaaaaaataattgtattgggatttaataacgtaagggttattgtagtttttttttgtttatattaatatgtgtgagatggataaacaaatttagagtgaactgcaacggcggttctcaaacttgccgcggtgtgtcatctagatccatgtactctcaaattacactttaacctctctaaacttgattatgcgtccattagtggtctaaaccagcctcgggatgactttttagccgacgtgccatcgtgatgtgaagggtgctagacaactatggggtaatgttgcaaaggggcccttcatttaatccaatcgtcacacacatctccctagagtcccctcgagttcttcgcgtcagagaggaggggcggcgaggcaggctacacaagacggtgatcgccggactagattgttcataatatcatcccagttaatacctccaacttttccctcatgattgaaatagacaaccaaattcatgcacttttcaaccactgaggccatcacatttgtatcagtgttacatgtaatcactctgagaccatcagaaatacccttgcttgataataaccagtaatacttcaagctgggagtccttaggtaccctaaatcctcaactaattgatccaaccacagtggagaccaagtgtctatcttaatatgatcaaaccaactgactttgccatccacgtaagaccgcaaattaccatgaccaacgaaaaaaccccatggtgaaccttgactgaaaactcatccgaatccatacgtacagtccaacaatgcaccaccccatcaattatctaccatctacaaacaggattacccgtgcaagaaaaaaacctaactttacacagaaatagacaaatgcatctacctagcagccaaatcctggaatttctaccagaacacacgtacgtgactgtataccgttgctctaaaggtataaacaaacacagattgctctaaaggtacaaacaaacacagattgaggatcgatggactcaccataaacaggcgcagcttcatcttgccaccatcgtcactccacagtgtcgtcgtctggtccaaattgagaacctcccccaccctctctacccttcatctgaatgaatcgccaccaatcgccggcgatcaccgccttgcgtcacctaccttgccgcacttcatctctgacgtgaagaactcaaggggactctggggagatgagtgtgacgattggacaaaataaagggcccatttgcaatattaccctcgcagttgtctagcaccctccacgtcacgatgccacgtcggctaaaatatcatcccaaggctggtttggaccactaatgggtgcataatcgagtttagggaggttaaagtgtaatttgagagtacagagacctagatgacacacctcgataaatttgaggaccgccggtgcacttcactcaaaaatttattttacgatataggtagttgtagaactggacggattgatccaaggtatgtgctatactgccacatatgctagggtaacacgtgtaagtggaagcaagtatttattccgtttctaaatattttttaaaaatatattataaatgcagacgcttacaatacacacaaattcatccttatgagattgacaaagccaccataagcgtctctctgtcgacggtacgtcgcccaccactgaagaataaatagccgtaaacgcaagaaactgtatcaactctaatatttgaacacgggtagattggttccaccataaaaatacctaaccagttaagttagactcacttcatcgtttctaaaatctaaataattaatacaattgaccattagtcttttttcttgaaaagcctacatggatactaagaaaaaaacaccatattatcgaagtgtgcgaagtaacaaagatcttattttctctatcatattatggaagtgcgttacgtcaaaaaaaaaagattcaccgtagtctcatttgagaggttttagtgatcaaagcttaaacaactaaagtctaacataaatacattacgtaataccatttttacacgatcagttacgtagttttctttcttttctattctttatttcgatagcgagagaatatctagagtcaccttgtttccttggcagagaaactgccagtattatatgggggagtcgtgtgcgactacgggcaccacgctgtccttgtgctgtgcacgtccaaagaaccattttcctaaacataatgaaggaccagggccattcgattggcatacatgaattcgactcgaattttgtacagcatcttaaatatttagaagatccattgactaagcctggcagtagtaggtgagattgtaaagagtatccatggaacattggtacgcattcatcgcctgcgtgctcacaatcagatgccacacttgcttggaacatacccctccgtaccaaaaaaaaaaaaaaatccattcctagccatgaatctgaacacatgtatgtccagatttgtagctacaatttgatttttttgggacagagtatgtccagatttgtagctagagtttgatttttttaggacagagtagtacctcaccagaagtcttcagttcaaaaactgtcccagatgtcttcagaattccataaaatgagtcttcacaccagaacgctaaattggaactcattctacagccattgcatgcaaatgaagcgttcatgaagagccactttacggcttcacatcgatacgtgtcatcacaacatatataaggacacagataaaattaaaatagtgccaagcctacaacagcctatgaagaattgaacagctgagggcaattctatcatcatgatgtcacaaatagtattggcaaaaagtttctcataacaaacaaatcaactacattcaatcacatacacgaagattgaagagaagggatgtcagttgacaacatataagcttcactgtgccagcttgtaagacaattacaagataactcctattgatttcaggtaacagaaccaaacttggaaattaattaacagtagccaagtagcagctcattattctttactagaaggtgtccaacaaagtagagcaacaaaaaggtgaaacgtcaaaccaacagagaatagaagtgccataagattttaaaccctgtggtcaatgtaatctcagccgatgagcaatttgttctcttccagaaatgagtaggtcgggacttcgaggttgtatggtgcagggcccttacggattctacctgatatatcataatgtgatccatggcatggacagaaccagccaccaaagtcaccagcgttgggaagtggaatgcagcccagatgagtacacaccccaatcacaaccagccactcagggttcttgactcgttccgcatcctgctgtgggtcacgaagagatccaatgtcaacgctgttcgccaagttgatgtcttcctctgtcctgcgcctgataaaaactggcttgccccgccacttcacggtcacagtggtgccaggctcaatactagagagatccacctcaagggaagcaagagcaagaacatccttgctagcagacatgcttagaacaaacttcaaaacgagcaagcgcagaagcgaagcataaataaaccttccaccactcaacacaaagtatgcaaacgctcttttacttgggtcacctggctggtatctttcatggttatattcatcatatacaatctttgcactgggattcttcacagctgacactgttgctggaagctcagtcaagcttacatcctggttccttggaacaagagtttctgaggaaaagcctgcaaaagggaactactgttacatgacatcatcaaatatcaacgtaacacaaaaggtgatatgaagataacagagcattattttatcttaacacggtatcaccaataaatttcacacttgaaaatcatctctatatattactatgcatagagactgccattgtgataaaaaatcaaatttattttagtggtaagtgttcaaactccctgatctcagaattgcatgcttgattaatgtatggttacgaactcatgatagcttatgttctgatcaatctgagttgttccaaacaaggaagaacattcaatgttttctacccaggtttctattatcaaatgttagtacatccaaccagaagtcagacttcaacagtaacataagacggtgcacattgtgatctgtaaaacatctaattgcaaaatgtttgatgagcgcacaagcaaaaggtaaaaatggaagtgctgactgctgaacaaccaaactacaatactggatatttgtaaagcattctagaaatggtcacatctaaatatataatgcagcatactaatgcgataagaattatgaggttcctttcaaagtaagtaaaaaactaaagcatgcgtaatctttaccagtcaaaactaataaagaaagcagatcaaaggatataaaatccaaacaaaataaattcatgggggaaatataagttccactgcgtaaaacaaggtatctgaagacaggattcatatttttaacagattctaagcaaacatgtttgcgatagttagaaatgcatactaaccatataggaaaatagcatcaacatctaaacaatcaagagcgctgatcttcataggttgtacggaattggaaatggaagcataacaaacttatagttcacataatgttggccaaggaaaatgccagaacaatgtgagacaagatttatgcgcattttagggtaacagcaaatccatgctgacagcattaggaacatagattatcaatgagcaaagaggagtgatcaaaagtggtttgcataaactaaatgaaccatgtggaatgtgctttcttgggactgtgttaatgaaaataaaacagactggacagcacaaaccaaaatgatattagcattaatcatgttaaatgaagaaactcaattctggcacatctttcccaaagcacaaaagaacaggagcattagcagtccgcaactccacaaatgtggtaattaaaccagaaagaaattttactgaagtatcaaaaagaggcacaaatctaactatggatttcaacaactacctaatgcctggctagattaattactaataaaaaccataatactgaacactatagcaagctttcaaacttgcattttcaatattatcataccaagcttatctttgctcagaacagtgatcatgtagagaatcatctaatatttctgtgctgtggtatgaacaaggagatctcacacatgagtatacataacaattctaagatagcattcacaaggacttacctaaaagttgctctatctgagtgtgggtcatcaggaaagtttgcgcgtgaagaaaaattgcacataattatatgatccagctatccactaaccaagcccacacgtgttcagatgaagcatctcatatgccacatagacattacgcatgactatttacgtatctggagtgagcacaaatcaatcaaaagagcgttcacaacgaattcgactcagttgaataaacggaaacacaccaaagcataagcataacatcaatcgtggaaaacttctaatatccaatcatccctctagccgctaaactaaaatacaaatccaatcatgcgctcgcaggctaggaacaaacaaggtatgaacagagaacgcatcaagcatgcatggattacatagagatcaacgagctccggaagcaggaaagcatccaaaaaaaactaatatcaaatcaccgatcaggaaccaaacaaccgcgactaccgggatccccctccgaaaccctgggagagcaggaagaaaagctggatcccccccccccaccccgaacccacgcagatcagagggcgggaggcatgcgggccgcgtacatacccctcgaagcggcgaagaacggggaatccacggcgaagcgcggcctctggggctcacgcgagaattcgtcgtcgccggggagggagcccccggcgagcgggcccctggcgccggccgccgcggcggggcgccaggcgagggcggtggtgaggcgcctcccggcgaccctgagcatggcggcggcggcggccttcctctccggcgggtggatcgggtgggtggagaggagatcgggtcgaggcgaggcggcgtggtggcgtcacggagtggacgagaattgcaggaggagagagagaaaaaaaaaacaagaagggaaggggagcacggaaggatgctggcccaggcccagtactcgctgggccttgggctacttgcttacgtcggcctgattaaccctcgtgatttttcttttttttttctttttttactggttctatctaactagttgttgacttgtttccttggaatttaatgggttcagatcggaatggctcaagtgatcggtttgcgttggcgtggtaaggaacgtgccacgtgtgtctgttgcagcacacgacttggccacgtgcatacggtgctgtttttctgtcaaacgaagcatctttttcttatggttgaaaaatgggcatatataacgtgcaaaagtaaagttgactgagcacaatctacatgaaaagtctgtaggtgatcacacaatattatttttataatggatcttttcttccattaaatacatgcattcattatcactactacataaaagagattggtaccgattaaaaattgatcacaggtaccgggtttccaaaccaacacccaacaagtgacacctttaaggaccaaaggtgctagtttaggaaccaatacttttaaggttctagtaatggaaaaaagaaaaaaaaaagctaactcaatgcatcggctcgattcgagaaactctccatcatcactgagatcaatatcatccccatctaccaaacacaatcaaaatcatcattgagatcattatcatcccataaccaaacacaatcacaaaatcaacaaaatcgcaaacacaacacatggagaacgccaccgtcacggcagcggatctggccccgtggtcgcagcaatgtcggccggttggagaagaggaggaaggaggggtagcggcggcggctaagaaggaggaggggcggcagatccagaaagaggagaagggaggaagaaggaggggcagtggcgggtgcttaggaggaggaagtaggagtggcagcaatggataagaaggagcaagaaagggcggatacggttccgatggggtttcacgagtagataacataagccggctcaatgggcagatttttttaaaaaaattaattataggtgtcggttttttaaagaatcgatacatataaaattagtataggtgtcagttttgttttttgaaaacacaagtacttataggtaccgagttttatttagagtcgacacctataagtttttggaggtgtcggtattttttatctcgtgaaggtgggaaacggttaataggtgtcagttttaaatgaaccgacacatatgagccatcacctattaaggtttttaagtagtgtataaggttttggctcaatagaaccactatataaccaacctgacaataagtttggactcatatgcgctcacacatatataacacgcgataaccctacatgtttgataggcatttttcatccaaacaacaatgggttgtgtgctctcgacgggatgaggcttccatgactttatgcagtttgtagatgtgccactgatatatacatctcacatataagtcagaggatccacttccgcttttgacacacattgttatccttggcctatttccaatgccctcatgatgaatcatgcaggataaggaaaaccatgtagtggaaatatccggtagcacaaatgttatctttggtagtcttggtagcacaaaggcttgggaaggagaagatacttaatttcactggtgaacataacattggatgatcaattgatcccttttctctcctctattcatagaagtgaatatgttttcattggtaagaagaggggctacaaatcaatcgatgaagatcaattgatgaagagtagtccatgtataatggttgtcaatttaatcaagtgaactaattttactaattttgtgggctgatctatgcccatctcttacactacgcaccacgactatatgatcataatattgaaggtcaaagcagagagaattagattccctccgtcccaaaatataaacatttttagcataatgtaaagtcaaacatttttaactttgactattaatagcaaaaaaaaatcaattatatcctataaccaaaattattacgtgttaagtataaaaaatacattactacgtatgaataagtctacaatttttagtgatacgtaaagttagaaaatattcattgaacaactatttatctctgaaataaagggttttgttttaatatggggtgaggttgatgataagatccagtggctacaatttcagactaatgaaaaaagaaacccatgacaatatgcaaagatttcaatcacctgtaagctagtctctccaacataagaaaaatatatatgtccaaattcatctctgaagttgatttttattttggtcaactagaaatctccacaaccttgaaaatccctaaatcatttaaacaactattctcattccttgaatacaaatctaattgatctcactggtaataccttttctcaacagtccctttcctccttagttaacatgttaaacattttcacatagacataaaatatttacaaaaattttgatatgaaaatattcataagtgataaaaaataaagcaaaaccatacacatcaacaaaaaaaaatagtaaatactgtaaaaaatgcacaaaagttatatcttacctaggactacaatttttagaattagtagtgtgttaccttaggtgacaagaaatcaaaagttttaagcgtaaaatcgagcaaataccttctgaaagacaaaggcacaaaccaaattaaactaccccgttgcaaggacatgcacacgcacacagcacagatgctgaaaaaaacaaaaaatatggccgccacccatgcatgcccacgatgacacgagcgtattcgatctctctcgcgcgcgctagctcccgtggccgccgccgtgaggccacgcgctcggcgacgacgccgcggtcgtcgtcgtcggcagcgtcgacggcgggcgcggcgccatcgccggagagaccccgacgagccgctgcgccgcgaagtccaggatctgcgccgccggcgccgcggtggccgcaatgccggccacggcggcggcggcggcggcgtcctccccgctccgcagcagccgcgcgtactggatcaggtcggggaacggcgccggcgccacggcgggcgcgggagcgggaacaccatgcggcggcgggcggggcacagcgggggagacgaggaagccgccctggccggtgcggccgcggacgcgctcggggaagttgagcttggccttggcgcccttgaagcggagcgcggcgtcgtcgtaggcggcggcggcggcctcggcggtgtcgaaggtgcccagccagacgcgcgccgccttgttggggtcccggatctccgccgcccacttgccccacggccgccgccgcacgccacggtagtgccgctccgccgccgccgcacctgcagtcaggcacacgcgcacgttcagaattgcgttcttcccccttttgctttcaagaagaaaatttgctttaacacgagtagaaatcactcgcaagctactctatttttcaagaatcatacagcaagttaatcactctaagttattatcaaattatgtgggattattaaacagccgatacgtgattatagttgctctatccgttttatattataagtcgtttaatttttttctatacttttagatttaataagtttatagaaaaaaatattaacatctataacaccaaactagcttcattaaatttaacattaaatatattttgatataatgtttattttgtattaaaaatgttacattattttactacaaacttaattaaattttttagtagtttgattaagaaaaaaatcatacgacgtattggaggtctggaacactaatttaaccatcttaatctacacgaaataggtaaatttgattgcccgaagtttctaataaatagataaaccgatggatctatactcttgtagatagcttacggttaatcatagcgatcatggcagcttaattacgtacttggatagttggattacgtgtgtgcaactgtaacacgtacgtaccttgcgcctccacggcctgcagggcagcggcggcggcggcggctgaaggccccaccggccgccaccgccggtcagctgattccgacgacagcgtcgccccggccggcgcggcgaggtaggctgcggcggcggccacggtgaccacgtcgtccaccggctgccactgcggctcgacgtcgtgccaatccgggggcgcgccgccgcctccggatcctatcggctgccgcgacgacatggctgagctgccgctgccggcccaagcttgcggcggcggcggcgattggtccggccgaggccgacgaggctgcggatggtcgtcaggtagaggccgcttcccatgcctccgatgctccaccttaattagtttgctgctttggagatcttggtcagcttcgcgctagctctctgaatcgatcgctttcttgattgattgagctaattatcaagctaaaaaatacgtagtactagataattagtggagccacaggagaaatataatcgctcgagattaattcgaagttggatactgggaatggatatgatcgatatgggtctcgtcgggagaatactatctttttgctttgatatggaggaagaaaagaagcaaactgaagcggagaaagtctttgagtttgccttggcatccctcttacgtgtatacctcaaacgtggttgttaatttccctacgtgcacatgccttccggcgcgcgcacacacactcttctttttacaccacagacgcacgcaccgctacacacacaacaccacactctcacccccgtgaatacttaacacaaactctaaaactctaaaagacgagaaccagcggcacatcctagatcccacctacatgattagattgtgatttgtgagctattatatgtacgacttgcaaggtataggatcatttaaaaaaaaacaagggtatgaatgttttttcatgttattaattcctcatggatttagctgttcagagttgctctgagataacatgcgctgctatatagtggaacggtataatacatatctattattaattaggatataattgaagaatattcaaatgaaatttggaggattttgatcattagaaattttttcttcatttctcctagctcgtcagctcgtgcgctctcttgatttccctctcgagcatctctcttgcatgaaattaaataacttccttcaaaatttctataaatgttttatgtccttcttccagtgcacaaacccaaaatttatgtgttctaaaaccctataggaatccaaagcttgtgacattcaatttagattaaatttctatttacaaataaataaacacaataagggaaccatgcaccaaattctaaacccaagctagatcaaggcgaactcaggtaggtacttcattgataccctttaatttggaatatgaaagtagctctgggccatttggaggactccgtgtgattttcttttcacgcaagacggcctgtcacgattgagaggggaaactcttttaattacctggtggatgttcacccgtttattgcatgccatctaaacaattataaaaaaaattgacaatataaatcaatatgtaatatatcactccacaaacattaaaattcaacttctacaaattgtaacaaaaataaaaaataaaactcaaattagtaaggtatatttgcaattatattttttatttttgttacaacctgtaaatgttgaatctgaacttgcatgtttacagagtgaatattacatattgatctatcttgtcaaaatttttttaaaaaaaatcataaccatttagttgacatgcaataaacaggtggatctccacccaagtgattagaattcatcttccgatttagaggtttaaattaaggcttttcgccgtaagtttgatatttcataacatcaacttgatcttgtaaggtgatctagatatatattttttataggccgggcaagcttaaaaacagatgatgattaaagtagatataaaataaaattcattctactctatacaccatttaccaagcaagggtggaagttctgaattaggagagaggaaaaccagtagaaggtattatcaatgaatagtcgtacacttgtgtattattgacaggctacatttatatacggagcagtcaataatacacaaatttacaactatttatataagtgtagtctgccaataatatacaagtatatttagtcggatataaaacggatggttgggtcatatgcatcaatttccatagattgctatgcctatgacacggtgaggacggacaacatctcatcatgggaccaagtagatgaaatcatgaaagcatgtatctgcggcgaccctaaatcatagcttgggtgtgttcttttggaggggttgggaatctctcccctccgcacgtaaaacggagcgataaattaaagcatgattaattaagtgttagcagaaaaacttgaaaaatggattaatatgattttttaaagcaactttcgtatagaaactttttacaaagcacacaccgtttagtagtttgaaaagcgtgttcgcggaaaacgatgaagataaattgggaactaggggttaagagtccagcaactttaatttctaagtggtgtatgatagtgtatataatcgtttagagtcaattgcaacttaatttgcaaaaaaacaagttgcccgacaggatggtgcctagacagatactgagggggttgcgttcactgaaagaatggccggcgccggccaaccggaagccgatgatccatcacgctcagcaccacgcaagagatatcgtgtggtccacacgattacatacgatcgatctatgcagcggccgggccactagtcaaagatacgcagtaaggagtacaattggtcgtccatctccatgatcatgcacttacgtgcagtgtaccaaacgggtcatactggctatggctgtctagagatgggccggacgacggacgtgacggctcgatcgatgccatacggtgcgaggggagctagcttttgcacgcgtcgcacgtttccatgcagattaattgtcacagagaggaatgcgagcaacacacggttaatttagctagctcacaattatataatactacatattaatttgtttttacgactatgtattactactattatactttgaccgtcaatttatcaatagctataaaaaaatacttttagatgcaaatctgatataagataccacatgtggtatgcttaacatatgcattattaattagttaaatgatataaatattatttttttcatcttatattttcagacatagggaatttataatgttattgataaataattatatcagaagatatatggtctcttgaaatggaagattttcagagaaaaaattacaagaattaaactagtttatatggagccttgtaaattcgtgtgttctaaataaaccctaaggctgagttcaggtaactccacctccccgcacgaaaaatggtgttccccatcaacatgtgattaactaagtattcgtctaaaaaaccttgaaaatttgattaatataattttttaaggcagctttcctatagaaaactgaaaaaaaaacatcatttagtagttagaaaagtgtgtgcagggaaaacaagggaggtcagttgggaaaaaaggggaagaaaacaacctaaggctcctttgaagctcacggttttgaaagcatgggaataggaaaaatcaggaataaagtgtcctttggaactccaaaaacaactctttatttgaataagcctttcagctcctttcggaacaaagtaaaaatatcaaaattatagatttgtattctgggaaaaaaatctttatagttttttagaacaaagtactacaaattcctttgaagttactatggaatgggctattctaaagtaattttagagtaaaataagcataagatctcaactaatgttttcttcttgtatcttgagctatgcgtttctcctctgtcattgaatcgataattacattttccccctattttttgtgttttggcaatctttaatctagcataattctatgctcattaatcccttcatctcatagttcttttattacacaagacacaacaagtgtgccccgaacaca

SEQ ID NO: 63603 - DNA, 770 bp, Oryza sativa
cccccttaatcatccagaattccatatagaagagctttccgatgcatcatgcggtggcattgacatcgcaatagcaggggaagtattgcaagctactctggcttcagaattatgtgaagattgagaactgcactgcactgacgcacagccctaagtggagtattcttggtacaagtttctgagattgtactaatactaacaaatatttaaacacatcaaagcgtcagtgcaggtaccctgagacaagataatgatagttgtaacgacaatgcaggtataacaacaataaatatcacgacaacgcaattggtacaaccctcaataagcataattaacttctaacagaactatatgtaacatcaatataacaccagaacatggtagagttactgacaaaaatgttttttaccaggtacgcacaaagagtcaacatggggttcaaacccttaatttcaagacatgatcttacacgcaggtatgaagaagacgaatcccagatagaaaccgctaatctgaggaaactcagcaccataaccagaatatagaagaaaaaaaaactaccactcgcttgatttgagcagcaagttcgaaactacgaacctttgacctttacacgaatcatacacaattcaaatgtttcttcagagacaacagtttccaatctgcagtgccaagcaattcatgcctcaattcaattgccctgcaccacattgtcaacatgagtagcaacaagacaagtacggacaatgcgccactggggctgcaggaat

SEQ ID NO: 63604 - DNA, 1153 bp, Oryza sativa
caaaaagcatggtgagatacgattaatcagaaaacaaatgggaattcaacaattaatagcctgggatctaaggtaccatagaacatactagtaaagggattaaagtaacagcaaaaaataaaaggacatgcatttatagtgtgcaaaaaccatacaaaaagagaataattaccctattaggtcatgtttgccgttgctactgaagttgaagcactctatgattaaagggttctcctgcaacagaatatacctggttagtttcatacaaatcattggtcattggccaacataaatagaaaatgcaaaaggatgaagaaagttctcatgccttacttccaatctgttggagattcaagatcactggcttccacttgggattgaggtcgttcttccttacttccgtcttacaaattggaacaggcactccactctctgatattctagatattagtaaaaagggatcctgtaacaagcaaacttagaatggtaaaaacacttacaatacacagaataaacaagtcgtgtttaggtacagagaggcatggacgaactgcaggtacaacaatggtaaatacatacaaaataaaaatgaacaaggtaatagaaacataagcttacactttttgagagaaggtccttgatttcaagatctgaacagcggaataccatctccattattgcttttgaaccagcactttcttctgcctgaacatttagttcaccaaatttactaggatttggtaggttatgttcggaaacgccaagctttagagtcaacagtctgttttgtttagtgataacctgcaaaaacatcatgatcttgtaaaaaattaaaaacgccaagcatctaacataaggagtaatcttcaaacagactaataatacaggcttttgaattggcgttactcttaatctgatacaagtgtaactttgcaatcatgaaaagagatgtgctcatagtaaaactacaggaatttatgggtgttgttttgtagggcaccaaaatggcagaagctatatatacatgcatgtgacaggatgaacctggtctataacagaaacagtacagaacagttaagttttccttcacaggttaagtttccttttacctttaaattatcaaaacaactccaatagtgtataaatttcatat

SEQ ID NO: 63605 - DNA, 6844 bp, Oryza sativa
ctgtgttgaatatcatattagagtaagtattgtaaagtaactgaaagaagaacgaaagaagaatgtgctcaatagtccatacatcagatgctctaacatcctagaagaatcaaacttctgcatttaaatgtagcttaataacatcagcacaaggaaatgctagggactagaaagagcaaactaaggtaattcaaatctatagttatcataagcacaagcgttaattcttagtatggagtttattttatgttaggcataaaattaagacttcattcaacctaactcacaaataactgaatttacgctacatttatccctgctgaccaaagggtccctctaacatgccagatcttgtcatctttggactttataactggctgaatggacaaaaagatatttgaaagcaagaacgaaaacaactaaccaaattaccttttcattgacatcatgaaactgtggatcaatgtcatatacctgaaacctgtaaagaaagttagctgttaaaagaatagcataattaatgggtaccatgtgacaattttacagtaaattgtaacagacgcttacacaattggttgaagaacctcaaactggtagtgcacgttgattcttgcattccaagatgggttcaaagaattcaatattacttcagtacgcccaagttcttcaagtgctccttctttgcttttagaatatacaatgaccatgggattgctctgagaaaagatgataaaatattaagggaagtataactagatagcacaagcagaattcattaaatattcaggatggcatgcatgtcaaaagaaaggtgactgcaactatttctgcacaaatattcaccgaggcttccatgataatggcatgggcgctctggtttgtaaacagatcaatttgtaatttgcagttatatggactatgtcttttggatatggatggatatttactgatatcacgtattcacgttaaatttggttgggtgtgaattatgattggatataggcacgtagcatggacttccaaaatattcatctgtaggttttacaaaatagtctccggacggtaggagccaccagcatgaaacttataacaggtaacttagaaggcagctcaggcagccaacaaactagtatatgcaactgttcaagctcaagtatgatcattgccaacaattcactgggtaagtcttagtttgccaaaataccaccatggtatgacaatgtcaattgccacaggtttgtgtgtttgggagacaggaactgaacggaggcagtagtggagtagcaggttcaaaggaggacaagggtgacaccctcatctccccagcaccatggaaagctaaggggtaaggtattcagggatagcatgcctataaaaatatgtcaagttgtcaacacaccaatgaaggtggaaaatgggatgagaagtgagtagtccagtatggacagacatggtagcatgttgacaactgatgtggctttctgacagaattgcagtttttttttacaagtattgctctttaacatggtagctctcagctatttggaattcgaatttgagtttgtggttccttgatagaagtgaaaataaagttatgggtttgcaaaatctattcacaataatttctctaaaaatctaatgattcttaactaatcaaaaacagagatgtcatgcaatagtaatgctcatcgtagatacctaacagaccagaataccgatcagttataaactgaaataagaaaatagcaaaactaacaaaatgcaacaagtgaaaacctggagcataccttggtaaagaattcttggtcgcccaaatttgatgcagagagagataactgtttcaacaggttatacagagttcttgtcaaaataaaacacaattaaacacaccctcatcagttcggtaattgcatttctatcagtaaatccaaacaagacataaatttatacaatgcacatgcatcataatagtcatcacatgaagcaacatcacagtattaaatatttgaagtttttggattaactaccaggtcaggtagtatgaaatgacagaaatacttagccacacaacttgcagactcccaagcgttcaggcacaaaatcttactaataaaccacaaatacagtaaatcatcttttacgcaacgttatcaattagaagaacatcagcagccaactgctgcagccgtcagaacatcagaatgttcagtgccgtgtcaaaccaagagcacacggcatgctcagatttcacgcccgctcccaatcatcgtcgtgtaatggttttttatcccgatcaacacgaaatccctcgggttttttctcctttttttttgtttgtttgtttgcaaggctgagaacaggtagcggagtaaattagctgaggcacagaccacacgcatccgctagtcccgtcgctgcaaggcgcaaaccacgagactcacgcagaacggcgcgaaactggagaaccgccagcgacgcacgcaaccgaagcgcacccggcgcaatggcacggccacccacgcgcgctcgctcgcgagcacctggcggcgcgctactactactactactgctatggtgtgaagcagaattaaaccgcatggatggggcgtgaggcggtgtgtgcgttgtgtgtgggttttccgcacctcgacctgcgtggacgcgccggcgccgcgggagcggaggaagcggtcggccgcggcggacgcggcctccgccgccgccgcagccgcggccgccgcggggccgacggagtggcggcccgcgtggccgccgccgccgcccatctcgtcggagcagcagttccccatggctagtggctctcctcgccgtcgagcaggagggggaggaggcgagcgagatctaccgccgacgcatcgatctggaggtgggaggaagagggagagcgagagcgagaggagagcaagtggagtcgtggagacgacacggagactttggacccctcaaacactaggcgaggccgagacgcacgggaggggaagggacggcacggcacagcgaaacggggcggaatttacggctttgtccctgttccgccggggggggagtggggcccggcgtccacgttcaaggagagaagtttgactttggttttgactggcccggggagttgggacttcggacttgggaggactggttcctcgtggcaattagggatggcaatttcccccgcggggccgggtcccctgcggggacccacccctacgggggcgggggcggggccaattttcgacccgcgggtgcgtcggggacggggccccgcatttgggcggggaggggacgggggactgatttcacccgcgggcccccggggagtacatataaatctcaaaatatagatcaaagaaagcccaaaaagcccagcccactaaaaaaatccttaaccctagcagcactgcagcacagcagcagtgcagcacatccctcagtctctctcctccccacatccattcccctcccctcccgtcatccactcatcccgtgcggtgcggctgtggcgtcgcctctggatctcgccctctcggcgtcgccggcgcctgccagccgccaggccaccatctcctctcccctcctctccagtctcccatccggcgtccggcggctcgagctcgtcctctccctccggagtcagcggcggcggcacacagggcggcgccgcggcgggccggcggcggcgcacaggcgcggcggggaagcgacaccggcagcaagggcgcggccggcggcgcacagggcgcggctggcggcgaggttgcagcacatcacaaagagtgagaggtattgctccatctccaatactccaaatgtgccttgtgatttgtgaatgaaattatgaaacagaagattgtgatctatttcagtgtatatttcagtgtatatttggtagatttggtagtacatagcacatagcagcagattgtgatctattattgaattatgttatttgtggacagaatgtcgaaccctgctgccaccgttgagtcacaagttgcattgacaccatcttccacttccactcccactccaaccaatgctccaagcgtcgaaataaatgattcacaaggtacagaagtagaacatgataataagagactgaaatctgcagcatggcaagattttgttaagaagaaaataaatggtgcgtggaaagctgaatgcaaatggtgtcacaacaagcttggagctgaaagtagaaatgggactaaacatttgttagaccatattaaaacttgcaagtctaggcatgctagaaaaggtctaacacaatccaatttgaagatgggaatagatgcagaagggagggttaccgtagggaaatatgtctttgatcaagaggttgctaggaaagaacttgcactgatgatatgcctccatgagtacccactttctattgtagaccatgttggttttcgtaggttttgtggtgcattgcaacctttgttcaaggttatgaccagaaacacaattaggaaggatattattgacttgtttggggttaacaagatttctatcagtaattattttcacaagcttcagagccgtgtggccattactactgatttatggacagcaactcatcaaaagaaaggatacatggcaatcaccgctcacttcatcgatgatgaatggaaattgaagagttttcttttgaggtatattgaatatgtgctgcacattatgctatatcatgcttcttacatttgtttaactctatactaatgttctcttgtggtgttttatgttttgtaggtttatttatgtaccagcacctcataccgctgatcttataagtgaaattatttatgaggttcttgctgattggaacttggagagtaggctgtctactatcacacttgacaactgcagcaccaatgacaagttaatggagaacctattggggacaatgctagataagttgcctgctgatactcttatgttaaatggttcattgctgcatatgcgttgttgtgcacatattttgaatttgattgtgaaagatggaatgactatcctagataaaatcattgagaaggttcgtgagagtgtttcattttggacagcaacaccaaagagacatgagaaatttgaaaaacaggcccaacaaataaatgttaagtatgagaaagtaattgcccttgattgcaaaactagatggaattctacttatctcatgcttagcactgcagttttgtatcaagatgtctttacaaaacttggaactcgtgaaaaaatgtatactccttattgtccatcaaatgatgattggaagtttgctagggagctttgtgatagattgaagattttttatgatgcaacagaggctttttctggtagtaagtattgtactgcaaatcttttctttcctaaggcttgtggtatttatttggatatgagaaaatggtcaactagtgttgatccaaacattataacaatgactaaattgatgtcagccaaatatgagaagtattggaaggatgtgcatggtattttggctattgctagtgttttggatcctagatataaacttcatatgttgaatgctatgtttatacaaatctatggagaagaggtggcactaagaaaagttaatgctgtgaaagaagacttgtataagttagtgctacaataccaaaatcatgttgaggagggtgttggaacttcagatggagttaatgcttcttcaagtgttgcccctccagggggatttgatttggtggatgatatatttgatcagtatatgtctggacaaactgttgcctcttcctcacagattcgcactgagttagatttgtatttggaagagaaaccgttgcctaggacacaagattttgatattatcaattggtggaagtttgggggcattaggtacccaactttgagacagattgcccgggacattttggcaatccctattacaacagtagcatctgaatcagcatttagtactggtgggagggtgataactccaaatcgtaatcagcttaaacctgatcttgtggaggcacttatgtgtgtgcaagcatggggtcgtgctgatatgttaggtaatttcatttttgcttttgtatcgttcaagtttaatttgtcctttcatgtttcttccatttcatctaattgcaaatcacattatatgttgatagctgaaattgctaacaagaccaatgcattgaacacggtacttgacgatgaatcagaatcggtatgtcctacactcccactttattgtttttattactataacatacaatgcttagttgcttcctctaattttgatttcaggaagcatctactgtcactgaagcttgaggtggagatttcataagtgaaggattgggctagaaagcctgcattgcaaactatctacctatatattttattatgttggcaatgtaatagtatattaagacttctatatttctgtgagactgaatttgcttgctgagttgctgtgtgtgatgtgttgaacaattcaactgttgaactttgaaggcttgattcgcttgaacagttgaactcatgtgtgttagtgtgtaactgtgtgaaatgatggatatcatcaatgtgttcttgctgaatttttatgatgaaattgaagtattcatgctatttttgatggtgtgttaattatgtacaatatttcttttgatgaaatgatgattgtgttgtattttttgagctgattggatggagatgctacccaatgcggggccccggtcgggttgcggggccccgcaggggtcgggggcgggggatgttttcaacccgcatcactggtcggggccgggggcggggggtgaagtcgggggtcggggtcgggggcttt

SEQ ID NO: 63606 - DNA, 1669 bp, Oryza sativa
ctttggctcataattttacactacaaacaattaaaaatggttcttttcacttctttaaaaagaacttctttatcactatttacctaggttgggcgtaactaagtctagtatttaagcaaacaatcataaaaaaataaaaaatgttttcaaacttagataaatgtgacatctatagttgtaaaatgttacaacttaaagtatactatcttatatgaggagagaaaaagaaagataaatattattaggaagtcgagtggaccattttcaatagttgagggtaaaataagccaaaaatggtttaaggggttaagcatttttaatggtctggtgtaaaataagctaaaaatgatttaaggggttaagtaatgcaatgaaataattttggggaatgaaaatgaccaatctttaattcaagcagatattagaccgacgtagatgctaaatttacgatttgctacatcaaatttgaattaattttgttgaagaaaagaaaggctaaacagaaaaaggaggctaagcatatgcacatgttacctttataaatagcctcctgccttcctggaattaacaaccacgcccttggcacatttttccttcaccccctcgcatcatcaggaatagcaaatcagcccccgcctctcttcccgcctaagcttttgacgccgccacgatggcttccacgtcaggcacagcaaaagaccagccggtccatggccgcgccacccaacgtcgcgagtccacctccacctccaccgctgcagccgagggcggcgccgtcgcctcgcagccgccgcgcccgcctcagccccggcccggcaccacccgcccgccattatggcgtccgccgcgttggccatggggctccagctccagcgccgccaccgccgcggcacccggtggtgcttcgaccgccgctgcagcccagggcggcggctccgctgcctctcgcccgccgcgaccgccgcgcccgcctctgccgccgcggccaccgcgcccgcccctgccgcctcttcgagagcccggagagggaggaggccgcggcgacggccggggcgccaccggcaccggatcgagctccgccgctgcagcggtcgaccggaaggggaagaagaaggtcgacgaaggtgatcgggatccggaacaggtgaatggctcctaccacctcgcattcctgtgccatcatcgcgttttgggggtggatttcgatcctgttcttgagcgtttcttggtttggttttcccttgaaggcgctaaggaagtctggtccccttgaagggaagttactccagagcagcattcgtgcgtatcaagggccccccgccgccgagaaaccatccggcgcgccgccggcagcaacaccccccgcccgcaacaccggccgtctggggctctccgaccgtgaggcagatgatgccttgaacgatatcgacctggcgatggtgcgtatgccatcgattattctgggcatcttgggagctttgttgttctaattgttcttgagcatttcttggttggtttctctggagtaggccaggcagctacctgttgttgataccactgttcagaaggaggaggaagagaaggagaaagagaaggagaaggaggaggaggaggatgatgacgacgatgaggagggggagctgctgtcgcacgtttccaggagaaagaa

SEQ ID NO: 63607 - DNA, 2415 bp, Oryza sativa
attcctgcagccccttttgcagcaacttgtgattcttttgcatcatacatatgctgtacattctttctttcttgtgtttgtgcccatgggtggatcaattgtaatagttgtgcagttttctgaaactgtgacaaggagaagagaaacatgtgttgtaccggcgtttgagtccgtgatgtgtcctgtgatcatatgatcatgaattattcttctgaaacttgtgattaagttctcttaagagcctttgctgcagaaatttttttcccttgtagataaagaacactatattggaatcctgattagtttcgttgttctaataaacttatccacatcattcttgtccatatattgaatatttacctggacttgtctggttgggagaggataggatagaataattatcattcactgtttgattgcatttataaaacatcccatttttaaaaaagttgcaatgattgtatagatcgtatatgattaagtcatatatgatcgcattggctatgttctttgccctgggttcccaacccccctctctctcgttttccgcgctaaacggtgtggttttttaaaaaaagtttctagacgaaagttgctttaaaaaatcaaattaatctattttaagaaaaaattagctaaaacttaattaatcacgtgttaatggactgcttcgttttccgtgcggaggagatgggttcctaacccccattagcgaacacaccagtgaatgatgacgtggatgatgttttgtcacaaaaatcggctgcaaagagcaaagaactggaactcgtagatcacaactagcctcggtctcgtctagttgcccatcgtattatttatcaaaattgtataataattcgccattcacattaatgtatataaatttgattttaatacgattttgaagtattttagagtaatctattgtttatatacgtttgtatgtacactaatgtaatataaaaggcacgatttggaaaatgggtgaataaatagcacgaatttaaaactgagtcattcaatatatgggtaaaaaatacccatctctaaaatatatatatggatatccaagttagctaataactcagttagcaaactaatttcctgacgacattgcgggtagggggatttggtttgtttgccgatgggggtgccagatccactccgacaccgccggggatgatatgggatggtacgagtagaggtgaaaacggagcggatttggatggatagtagttataccatatcctaaaccatatttttttaatcggattcggagcagttgcggatagtgtgtggatgtggagcggattgttttcggatgtcggaaatggtgcagaatcggttcggacacggattaaatttatcgaatgttacgtgtatatgcaatcaatacaacatcgagttagcaatgcaatggacaataatacaataaccaataaatgacccatcgtaataattatatgcttaagtactaaacaacataaatacatgatgtccataatataaaaatacagctacgcaagtataacatgagacggtgaaaatctcagactaagaaatttaggttaattgatgaattagaccgttggatgaaccaacttatgttatatgtaatagatacagtggttacatgtgttgataattttggattatctagctaacggtctatcagataatccgcatccgcatgctttcagagataccatatccgcatccgctccatatccgccggatttctaaaagcctataccatatcctcgtttcggatggatttggagcggatcggatcggatattatccgatccgttttcacccctgggtacgagaaatagtgcgttcatgaattagatcgtaaaaaaggtgagacatatgtctggtccattaatttttatcagtcctactcaatactataaaaagatcaatcgattaaattaattttgtattgaaaacaaacttcatattaagcaatccttcttgacctagcgcactatgatatcctggcccaattaaaatgagacatgtgtaatccacgagagttgtttgtgcatgcttagtaccaccttactagtttagcaagggtggaaccagcttataaggcctcttgcctccaacggtatcactctcgggttaacccttttacatgaagcgatgatgtaagtataagtgaagtggtatatgtaagtgggcccgtttgtcggttaggctgggctgcgcagttctagagggacgactgttacacatataactaacacatggtattttctaaagcttactaattttaaaataaaaaatacttcagatttttatagattttggtatgaaaaacaccattgttacacatataactaacacatggtattttctaaagattactcattttaaaataaaaatacttcaaattttatagaattt

SEQ ID NO: 63608 - DNA, 5478 bp, Oryza sativa
  unsure (1)..(5478): unsure at all n locations
attcctgcagccctaaatatatgattgcaacataagctatattttattatgtgaatatatacaaatggcatatttatctatactggtttattaaaaaaataaaaatcatatattgttatgtttgttaggagctcgagcttgactggacaaagctcgcaagctttggtatacgctcgggctcgactcgtctggaactccagtcgaggttgaaactagcctaggacgaatcgagctcaagcagcctgtgagtctctagcttttctgatagccctagtccatgtaagttactttatgggtaggcggcacaatactatagtatacgataccaaagatgtctcgggcatgacccatggttataaattatctgaaagaaaggttccaatgaaagagaatttatgattgactcatatgctatgggtacccttcgtgtttgctacttaggctggttataaaaataatactattagatagctgtttgagagaagataattcattttggaccgactaaagtaaagggataagaacacaagtatgagcaataaaatgctatggccatgcataatgccttaaaaaagaaagagtaaaatgcatgaatgaccatttaacttgtttagatttatcatgcaggtcattctacttttagaatacacatttagatcactattttaagttaagctaactattcatatgtcatctatgattggaaaaatgcttttggacttggcaatatacaaaattagaagaactaaatcatatcacttgggcatgttttaatgagttctcttagttcttagtcctctctctcacttaccatcaatcccgccaacggtagcggccgataggctgaatataaacagcgatggaaacaaaatcttaggaggcaccgactaaagatgtccaggtgcaaatttttacaattcaaggtggcatgctatgcgtaccaggtgtgctcatatggatagttagatgattaaatgacacacttaactcatgttagtgattaagatgtacattttaaaagtagagcaatatatatgacacatccaaacaagttgaatggctctccatgtattttactaaaaggaaaattcaagaggtttagggccaacacaaatattacatcaatacaagtcacaatatgaatgaatttctctcgaataattgattttcttttacacttaataagtatggttaaataacatgaaagaatgttattccatgcaagtgaaaagagaatgttttcataaaggagggtttcatttgaaaagattaggctgatatagtaatataaatgctaaatcaactaggattttgccacatcggatttaaattacttttattgaagaaatgaggaaaaactaaactgaaaagaaagaaagaaaaataaaaaccccgtctgctggactccataggtagcaactgcctacgaatgctacatttataaataccctcctgcctttccagaattgacaaccacacccttgaaatatttctcctccgccccctcgcgtcagcggaattagcaattcagcccctgccactcatcccgcctaagtttttccccccgcccgccacgatggcgtccgcgtccgacccagcagaagtagagctccatgggcagcgcgagccccacgcctcgagctcctccaccgatgcttcgatccccgcgccgacctccgccgccgccgccgccgccgatgtccctccgcctccgtcgtcgtcgtcgtctccgccgccgccgcctccctcgtccgtcgagggccgcaccaagcagcccggaggcggaggccgcggggccgacgccgcgtcgagcacctccgccgcggcggcggtcgagcagaaggggaagaagaagatatcggcctcggatgatcgggagcaggtgaggattcctaaatcttttgcgttcttgctgtcattgcgtttgtgcctggcatcttggggttttggtggggttttttcttttttttgttcttgagcatttcttggttttgccctgaaggcggaaggggatgaggaggagaggaaatctgattcccagaagaagaagctagccgggaggaggaggaggaggagattaaatcttgctgcgtatcaaggcgacgccaagaaaccatctgatgatgtcaacctggtaatgatgctgcgtattttggcatcttggagttttggggggcttttgttcttgagcgtttcttggtttctatggtgtaggccaggaggcccgggaagctaccttgggatgatcccagagtttggaaaccgcatgtgacgcccgtttccacggtaaagaagtcactcgggattagcatccttgtctatatcagcaacaaggtaaggagaagtttctgtttctgttcttggctgggctgagcattcttgcgccaaaattttgtgccctgtttgtgggattggttcctgccgttcttgtgaggaaccatggaaaatcttgcatccttgcttaggtgccaatttgcttgttggaaatgttgaactgggatctttgccctcgtgtttctgtttattcgtgtgaaatcttggatgatttagtgcaattgagcgaagatgtcttagctgaaattatgatgcactctaaatttgggtagagatcattagtgatttcagggaaaatttggctttctgttgaaatacaggcaatgacctgcttgggaaatacaggcagtgatcttcttgcttgcattggttcggcttgctgttaatgtgacgtacttttcatttcactgtaaaaaacgagcaatgtaggaaactactgtatcatgtcattattactgcgatatcatggcatgttcactgttattgaattgtgttgtaggaagtcaatctagatgtatatttgggattgcattactgaacgcaaattctatattattgatcgcctgtatgtaaaaccagcgatcatactttagtgttcagttgaatagattcaacctctgattggttgctacttgaaattggtgggaaaacttaggacataaatggcaagcgcagaccaattctagaaatatcagttttgctctcttgctatatagttttttacaagttccatgcacaaaatgttttatctttgatgtaaattctttgtagtcagtgctaattctgccattctatataattttgaccctttttttttcttgtgggttagtttttacgtagaaaaggaagtccagctgggttctccaatctaaaatacaagcagcaacctcttgtgcaacatcaggtttgactctttttatcctttgataatgttgaaattatcctttgataatgttgaaagtggatgtgtataaattataaatgtcaggattagaacccttaaacatgatattgtggatactcacgaatttttgtttgccactaactgtttgatcaggctaccttttcttgtctagatactatcatactagttgtgtttcacatgcaattgattgcactggattgccgtgggacattaaattggcctagtgctctttaattttgtgagggacatgatttattgtactaaccaatgaccgttctgtgtcaactatattcgtgagtgatttcaagcatttgtcagatagtgcagaaaccagaaaactggaatgcaagattacattgcattttagttctacatgatcaaatgtccataagttgaatcccctcatttgtgtctgttgtgcagaaaattcccctggcttctgcccctgaacattatgggctgcgatcaggtttgcggcgaattatgtctgcgaatttgctgatacttctcaacgagtattcagattttaggccggtgcatggagatggggaatgtttctacaggagtttcatattttcctatctggtagcggaccagttatcctcctccctgttccttagcatagcatcgtatgcttcatgtttggtgatttattcctttatttggcaggagcaagttcttgacatggtgggcacagatgaggaaaatcgcctccttgctgctgttggagcaattgatcatcgtcaatgggcctctggattttctcagagccacaaagtaatcactcgccttctctgtattgtttttttgttcattctgattgaaaaatgcgtttcagagacgactctctccgcgaatgcttgtaacgttttttcttttagttaggccctttacttaatgtttaactatcacagcttctcagacaagttatcctactatcttcattcttttctaaatatcgatgataagcattttgcaagcctcattgtaacctgttaatctccagtctgtgtgcgaaaaatgccagctgtttgtaaggtttaacatgcacggttattgcattactgactctcaggtatttgagaagctgatacagaacgtgatgagatggaagaggagacagaagggtgtagcatcagctgacaggtgtttatatgcttggttcctacagttccaacagagtgttgtttgtaaatgcatcccatcccactgaccacatatgggcgcttttttcagccgtaggcagaaacttctcgagttcttcagcagttacagcaagtcggatggcagtaagaacaacatccttgagtctacgttcctttgattcatcctaattcttggttctgaaacttcttttttgtcagttttggctttcctcaaatatgcagcagctaactggatatgctcgcacagagaggagtatgaaccgaacatagctgggcttggaggtggctacaccctggaagctgttagtgccaatatcacttcccttgctcgtttctgaacttgcaacaattccttaacacttgatactcatttcactgtacctgtttgcttgcaagcagtggtgcgaaatctatcttcttcagcctcgtgagcaaactgaccatattcagatgacggccgtggcagccgcgcttggggtgcctctccgagtggagaacctgcataatggaccagctcaagatatctacactgccgatggcgttaacattcctcgcgtcaccttgctgtacacaggcgtccactatgatatcctttacccacgccatccttctggtgggagtgggagtaagagctcgacacaacgggctggttgctttcgtcccttctggtagggagagagctgagtttgattgctgcagatgagtatgaacattgccgaaataggtggcagacaaattttgactttttggtgacaaggagaagagaaatgtgatgatcttgattcttttgcaacttaactgtgattaagttctcttaagtgtctttgcagcagaatattttttcatgtagataaaagaaaattatattggaatcctgattggtttggttgtgctgaccaacttatgcacacccttgttgtccatatattgaatatttgcctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63609 - DNA, 1042 bp, Oryza sativa
cacttttatagcggtgcagaaggatgttggtcaatagggaaatcagaaaaaggtaatgtcaggctgcagaaagaatatgattaataacaacatgctatgctaaagataaaaggtgaagattcagccagcattaccatcattccaagaactgtagcaacagaaccccctaaagaatgcccaacaactcgaattttatatccatggcattcactgccttcccccaccagtgcaggaagaaatccaactgttagggatgacgaattatctgggttggcattgtgacaagagaagagcagattagccactatagtcatttattgtacttaaattaacaatattaacacacacattgcatctaatcttctaatatgaggtactagtttcctaaaaacaaagagtacatattctgctgcaaacagtcaaatattgcaatatcagacaacaaacagtaactagactagcacctcctgtgcagtcgttgagttgcatgaaaagctccctggcggactctagaattccaccatgtccataatgcggaaaggtagaaataactctctcccttgtagttgcaggtaactgttcacatctgaagaattagcagtgtcaacaaaacagattgtggacagtagatagcacaataaaatggccagcatataggtttgctccctgaaaacgttgcacagtttctaaagtggtccctcaacctcatgaactaattaattctcatccttctatcagttttacttcaagatattatacactcatacactgtactaaagtaggtcaaatagggatgcaagagtatctggtttggctgacccatttacccatcctaggccatttacttcacaaacaattcgaggatgtaaacaaagtggactgccaaattaaatggaatgtgaacagacaattaagtaaggtagatcaactggacaacttacgtccatcactaagatcaaattatctgatttgattaccagtaacataaagcttgggtgtacatgttgtggactttgacaaatggtgatatttcagatgtatt

SEQ ID NO: 63610 - DNA, 4684 bp, Oryza sativa
cattttgggattgttcatgttcttctaatcatgtgaatgctaatcagagcaccacagggttgaccattggtatttaactatcagcaaatggcttgcagcaagtagtccgtgaggaaaaaaaaagactaattttgaccacaagagtagaaagattagataagaatagacgagatggctatcaagagggaattactttactagtccatccaaatcctccatagtaaatgcacattctctgcataatccatcggttatgagatcttctggtgtttcagttccacgaactccaataacaactgtctttttgtcatggaggaccacgacaaagtaagcagcttccctcttgctctgcatacataaaaagaatcaaatcaagttcaatgattttactgaaaaaccaaccgtgctatgctctttatcaagtatggctgggtttcaatgcctcccttcaactgtaagcatgtctaatgtaacaacaaaatcagcacagtacggcaaacatatttggtcatccacattactctcaggctctcagttcgttgcattcccagagggcatgtatgaggtaaatgtggcaatgtgtgcgttgggcaaaggcctcaccagccaggagccatagatagtgaactggtaataacatggctagggaggagaatgagcaggagggctgcaaaggtggtaaagcatgatagagccttcaatacatgatttgcctctattgactaaaacatagggatgcttatctcttaacctctatttatgcaggcccatttgcctgggtcaccaagcatggcatgtatacatgtgccgcacatgacacagctacttaaggtatgtgaagtacattactgcaacctaaaggatggcttactttaaccaattcaccaaataacgtcgaaatgtacataattaggtacaggcgggatccataaagtagatatcaactatgagctaaagtaacattacatgtggcaggttacaaatgtcacttggaacgattgcataattggctgaaatatatttttcatcattgcaattttagtttataaattccaattttatccaaactcgtgttacctggcaaacacggccccgtagaagtgctgcagctggtatgtgaacaaatcgaaagaaagcggcagcatgcccttcccaccagttgtcaccatcaaatgcaggggcgctgcatgaagaccaatatgtggatgtcatataaggcaagaacagcataagatgttcaaacttatctcaatgtaacagttggtccagttcaaggaggattaagcaaaataaaaatcaaatttagcttgcttcacattttaccgaacaaaatctccagctgaactggccaaaaagaggatcatcaaccatagggtatttggcaataaacacacaactgagaagtataagagagttcaggagatataccttctgcgcgaccatggagttaaaacaccttgtctgtaaacccatgcacatggaaacaaaatagggtttctcccaacatcaaggagaggtccctgaaataataccacgtcaaatgcaattatacaaggaagggaggtattaaacttgttccagttagatagtgtttccaaccgtgtaacatgcttcagcaaagggatgaaggatagcagcttcttgcataaggttcagtggcgcttccgtaaggtcagtttgcaaatgaggcaaattttcatttttctgtaatagtgcaagccctaaaacatgcaccgtaaaaatggatccttagtatgctctcaatatagtgacaataacaaggaattccataaaaaaatcatatgtgatgcttgtacactcataacagtctacattatactgataaaatagtttgtcataaagtgacacggcaatacaacccatgcggagaatctggtcctgtttagtcaactatccatggtaacctaaccgctagcaggcaactactcaaagtagaaaagatgaaagcatggtgctatgtaatttaactccaaacagagcagcactttaagctctgtactctttttgcaatattgaaatttccgtggtctatcaagtaaattgcaccaaacccatctatatcctatgaagaatgtaacttatacatattcatttaaacatctgaattcacaatatatgtattatagatttttgcaatgagaggggtttcatcgggaacactgtattactgtcttacaatttactcacctccaattttctgtgctaaatagattcctctctagattttgtacataagtcatgtttttaggaggtggacagattgcacacatatgactacaagtaggtggtaacaaaaacggaagtttatgttggagttctgaatggtacaattgagcctagtagaatttactcactgcttattgaaaacctaaacacctacatagctgtgcacgtctttagaaggtaagtgacaaaatttagaatattcatgtcatcatgtgtgttggcatcaaatttaattttgaaagtccaaataggacacagaacatattcaatgtgaaagcaatgaaacagaaaactgacctgctaaaagttccaaatgtcctgtcccagaagcacgatatgcaaccaaatcacccagaagtcttgccacagagtaaacctcatcctcttccaatacggttctgcatcagtatgtaagacaactagctcatataggtaaataaatagtgatatttctcagcataaaaagaataggtagtgacctacagatactttgcacgccctaggcagcataaagcttctcgaattccatgatcgaacacttccctgtaatgagctttccatgccatgtcatgtgttgcatagaacgacctccaccttaatatatcagaacccgtgaagcattggacaacgaccacaacccaggaaagaataagaaacaaagcaattaatgctcgtttcgagacatgatcagcttcatcctgtcctagattgcgagcaaggcaggccaattattgaacagaattgatggagcaggacaaaaaatcataagcaagtaggcagtggataaaatactagtgccatcaaaacctatcataatttagtactatattaagtaaaggcaaaagttattgacactttttacccatatttttttttcatttggaaactctaaggggagaaggctccagtaatgtttatgtataaagtttacttggcagaaagatttcatctaacaaaggttcaccattcacagctgaaatgcactacagatatatgacaggatctgatcatctgactcaaacataccaaagaaacaggaagtggctcttctttcatttgaaatatctctgacaatgacaagcatgagataaattgccccaaccaattgcattgcacccactgccatgccgaatctagtccaccacaaccagcgtttatacctcacctgttgagcaaaacaaaacagaaatagcagtatgataaataagtgctcagtagaaattctactcttcttacacctactctagcttctatggcagaattcaaatatcccatcagtacccataaagaatattctgagccctcctcactgatacatcttaaaggatggtatccagattacagatttataatgctatgctagagagttaagaactatgaatccatgatcctcactgatatatcgtcaacaatattctccagatttataatgatattaatgcgtgttgtttattgtaaaaagtttatgattacctatatcaatagattaaatatgattacaaagttaatgaactcaatttgaacaatgcagaatgccaacaagtggcaggaaaacaattcaaatccacaaatatgatattagattccaattcgaaatcttaaccctaaaccctcatgtcaggtctctgtgatctaataaaaaggtgctcaagctcacggtcacagtgtaacactgagtcgcttcatagtgtttggctataagcacattgtcctccagccatatgcatcagataaaagctcttaataagatgtattcgcagttcatctaagcttaatacgctgtatcttagcaccattgacaactcccgtcagttacacgcatttgcattaactcgcctcaaaattctgataaatggtgaaatcaagtccacttgttcagattgatcgtgtctcaaataatcccgtattgtaaccatacctagacaaacaaacaaaaaaatgcgttggtttatccttgaacggttgaaccaactgaaatcaaagcacaatttatcacgactttacgatacgtcagagttaagccgagcaaatcacccaactaaagtggcctaagctagccggcaaggagctcgagttctcaccctgatctcgtggcgcgcaacggcgtcagcggcgaccgacgctgcggcctcgtcgaggtggcgcctcgcgatggcatccgccgtggcgtgctgcgcgcgcgcggtgccgatcatggcgagcacgcggatccccgccagcgcgggcgccgcggcgagcgcgagccccccgccgcaccccggtgggagcacgccgtcgatgaggtagagcccgagcagcagcacggccacgttgaggcccccgacgaggaacgagaccacccgcaccatcccgagccggaaggaggcggcggccgcgccagccgacgacgacgccgccgccaccgcagcagcggccacggggtcgccggcgcccgcca

SEQ ID NO: 63611 - DNA, 10162 bp, Oryza sativa
aggaggcgacgaaggtgggggaggaggagcgggggacgaggcccgcgggtggcgaggatggggaggaggggctttctaggcatctctctcacccggccgcggcggccatggaaagcggagagggtcgcggcctcgcgggtggttggaggcggccgcggaatagaaacggggaaggctttcgggtcgcggtcgcgggaggtggattcgggggcggacgagacgactagaggagtcgcgcggcgtccgccgcccgctgtttgttctggtgcgcgagctgatgtgatgactggcatgtgacaactggtttaaatctcctcctttttttttctccttctgaagctgtccttcggaattcgctttttagatctaggcttaaatattcgtggaccacgtgagtacttgacgttcattctaagcaatagtctctctttgtatactcctgcaatactttgtttgttgttactagcaaaatacccatattttactatggttatttaaatatataatatttgcttgttcgaaaaataaatatttgactatttcataatattaacaaatattattggccaatttgtaaaaattgcaaaaggaattatgggatactgggttggcagtggcagatccattgtcaccgctactaatacttcatccttcccagattctttctaaattgatcatcatataagtttatgcactaagactaaggataatttaaatcacatcaatcaacacacccattcttccacagagcatgcgtcgattaaaaacccatgccaattacaccctatcatgcacacagtctctcatattgcatcaattgtatttcgatgaaatccgtgttcatgcagttatatgatgagcaatttaagaaattttggattctattatatgatgatcaatttgggaaagagggagtatctttttaaaaggagtacataattgagattttgaaatgagtcggctgctaagggtccattcgatttaaaggatttttggaggaaaagtgaatgattcaaattaatataagtaggaattaacactattcactcatttggaatggagggttagggtataagagaagtggaggatttttccctttgccatagattttataggcataatataggaatctaaacatccactgtaacctctttttttttcttttcctttgttaggtccaaggaaaatcaatactcaagtgactataatttaacaacaacataagaaagtttgtttaatttaagaaaaaagttcaaatgtcctccaaaactttgtctaacaccctgaacattaaaaccaaacatccaatcccctaaattctacaatacccttcatattatcctccgaggtggttttagatggtggtcttccgtatttctaagcttaaactagtggtttttaaataactaatataacaaaattaggtatcatcaatataggttgtcagtttataccatacagtgatgccatactgctgttatgttggtacttgtgtttttaagtgagagcgaacaagtggtaaaatgaaatatcaaagtggagatctcatatatgtccaatatgtatatcatgtgatcaaactgattcaacttatatacaaattagataaaaataaacgctatccaaaatcacccttggggttatataaacaatattgtaaagtttagagggttgtatatctggtttcaaagttcgggtgctagatgggctttcaatcgaagtttttaagaaaaggttagtgcaacgtggaatgtatagacacgggagaaagatgggttaattcgctctgccaccatatcgaaatttttatgacactaattttttttggtgtagtagaagaccaaataattcaatctaaaactttgacctattgcgaagtgagcgtagttaaactggttaggttcccttgtgatggaaccaacccacctgagttcaaatcctagaattgacacggctaattactttttcggtggtagacaacgaggcgagataaggtgtgcgtgtgtcttcatagagttgactgtctaattatattttcggtggtatacaacgtatctcgaggtagggtgtgcgtgtatctttatatatgtgagtctcatagagttgactgtctaattatattttcggtggtatacaacgtatcctgaggtaaggtgtacgtgtgtcttcatagatgtgtggtatacgacgtattccgaggtagggtgtgcgtgtatcttcatatatgtgagtgtcaacgaggcgaggtaggatgggcgcctgcctctgtactgaattttggtatgctgaagcttagatggggatttggtaaagcgtcaaactaattaaaatcagcctaatacatcaatgccacttacaccaacaaaacattttgttatgaagtaaaatgattaaaaaaaacagtgatcctaccaataccagccaccctgtttcccagctttttctgtgagagcaaggaccacgtttttccaccttatatatcacatactatctagtcacaaaataatgtcattttagactctaatttgataagacgtaactttaaccaattattttgtttacagaaattaagaaaaattacctaacataaaagtatgtcaagtgtttttttaccaaaaaaaagaaaaagactttgatcgttgcttaattataatcttccctattgaccaccaatatcaccttccctatctatttgagttggctagcttctactccctcgattttaaaatataagattatatcttctggaacaaaaggagtaactagacaagtcaaactggtttaatttggactttaccttcaggtaaaaataccatctgatagtaatctttcctccattggctgaaatttaaaacattttaaccattttgactatatgatctgcatatataattcgtttttcagcttgccaaaagaacttgtcaaccgtttctaaaaaaaaaaagaacttgtcaaccctatgaacgaattaaacttctagacaatactattcgtgcttgacggcttattttgccgcgagccgttcaaaggaaaaacaagagtggcacgtccctggtatatcgccaacgccaattccctgtcgaacgaaacaggcgcgtgtgggccgcggcccatacatatcatcgcgtcgcgcctcgagtttgaactcgcgcgcgtcgtacgtacgtgtacgtggcatcgtttgtctcggctctctcagagcatctccaacagcctctccaaatctaactctccaaacacctatatagccaactctccatttgatttggctagtcaaactagttgttcactccaacagcctctctatctaccctctctactttgactctatgacgccgggacccatatgtcagcatctcccttcttctttctccccttccttcccctttttctcttttttctcgcgttggctggaagcaggcggcgccgacaagctgggagcgagcggacggcggccgcggccgcggcgcgcgggggccaacggccgcggcgagcgggggacggtgggccacgccgcgcgggggacggcggccgcgccgagcagagggcgggtggccacagcgagcggaggccggtggccgcaccgtgggcggggaacggcggcggtggcgcgtgggggccagcggccgcgccgagcgggggacggcggccgcggctagcggaggcggcggccgcgccgcacgggggccggcggcggcggcgagcacctcctcctcgtgctccttccgtgcggttgtcgtgtggggaactggggatggtggagatgggttgtgtggggcccaccattggctagctaaatagagtggccaaatttggctagtagagggagggttttggccagccggatggctatcggttggagaggctgttggagcatgattttttattagaatggctaaaatttagcttggagagtggaatggagagactgttggagatgctctcattaagctgaacgatcgtgctgctgtgtatgcagccgcccaatcgaagtcacgcgcgactcagctctcacacacgaagctaaaacacaagtgcacaagttacacaacaagccaaaacacaagtgcaccagttaaggccggagagcctgagagcgcgagcgacctacccttgtctcgcgcttggcgaactccaccgtcggcccctcgccgccgccgccgctgccccccgcggagacgacggcgagcgcggtcacctcctgagcgcgcgccgtgccgaccatggccacgatcctcaccgccgccagcgcgaccgccgcgccgaccgcggcctcctccctccgcccgcagcgctcagtcacacccacccactcggccgccgccccggccgccgcgaccgccacgttcacggccgccagcgccgcggacatgcggcgcaccccgcggatccggaacggcggccgcatggtttggcgcacgcgccgcgagatcgaggagaggcaggccgggcgcgcgcggcgccgttctctgagtgcacgcgtgcatgtgcgggcgcggccgggcgacgtttttgtagcggcgcgcgcgccgcgcgggggtgcgaggcgtgcgagcggcatcagccaggccagccaggccagtaggacgacggttctttgcttgggcgacgccgaggcagaatagaatattagtatcacgtactgtacattgttttggccctgccaattggacgaggcgtttgcttgatcaggggtgcattgcatgcatgactgcatgccatgatgcattggccaacgtaaatgccaagccggagggtgtggcagtgtgtgcagtgcactcttggcaccggtacgtccaggcaggcaggagatgctgggagggcgtggctggcagcctggcactggcagctgcccgggcttcgcgtcggtggttggaggctgcttggagctcgcggagtcgcgggaagtgaggcatctattctaccgcgcagtgtcgccacaaaagctggaaagaaaaggaggaagcgtctttctttatctccgttggggcctcggggccgaggagacgctgacatgttagccccagtttagttagatccatgccggtttagcggtttaggaccataccggtttaatacaatagatggatgggccagcccgcctgcctattccattgaaatagtcctagtactaccaaaaacacagcccgttatccacagatggacgacttgagcagcccatttggcccaaaaacctattgagattactcctagtactaccaaaatcataacgaactgttggaatcgaatcacttcgccattgaaaaggtttctaaaaaaacaaacgtcaccattgaaaagggctggtgctgaccacttgatctacgtcggaacttggaagaacactgatacattgatcaaaaatagataaattaagacactgataccaaaaagatctaactctgcaaattctccaatactggcaagttaaaattagggtgtcgatgccattagctgatggcagctacacaaattattttctttttgtgtgacacgtcggtagcttgcgaatctctgcttatggatctattaatccagttgcgtcgctttcaaggtctcgtcaacctaattaagagcaaaacagtttgaagttcggctgtgccatcatgatataataataatctttgcgcattccgtcatagaaaaggggatatagtattatactagccggtgtcgttctttgttgatctgccttttcagatggcacgcaagggtaactttcgtaagggattctttcagctgaattcgcataatctatatatttcctttctttgcatgcgtttgctaggttacgtgcatgctgatgcttgtctccgtcagctccgatcaatctcgtacccttttcccttactcccccccccctcccctcttctctacaaagtgcaaacaaataatattcgatctctggcccaagctttctttcatttgcttggcttagaatttaaggtttgcatctttcagtgagccatgattccggcgtaccaatcacatatcctaggacgttcgaggacgacgcctccatatgctgcttggcccagttctccgaactttaacttttccatcactggtggagaaatgctttttagtcccggttcgtaaccccggacaaccgggactacgaatccgggactaaagatcgctatctttagtcccgggtgaaataaccgggacaaaagatcgatctttagtcccggttggtaactccaaccggaactaaagataaggtctaccaaccgagactaaagagggaataacagcagtacagatggtcatctttcttttttttcttttttattttctcccgaattaagtggcatgcatatccccaaatcccaaatcaaattaacatcccaaatccacatcacaaatctttaagttacttatacacataaatcaaatacatcgcaaatcctaaaaaaaatacacaaatcaaattacatcacaagttctacaaaattcatcgcaaatacatcacaagttcacatcgcacacaaatcaaatagatcacagaatcatgcaataaatcacaaattttaaaaaaaaaagaaaaaaagccacagaggcgccgctcggccggtcgctgtcgcctcctctccgcaccgccgcccgccgccgcgcaggccgccgtgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggaattatttatacagagcaagggtgagtacgggagtactcagcaagccatgggaaataagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgtaatgtatcagtctttagaatttaaacaaggttggcacccggccaacagctttttcaacggccacccgggccaacaacttttcaaacggccacccgggcctagctcatcccatcagctgcagatttttcaaacaccgaaccccttttcacacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgctaggaagcccaggggtcctccccgacaccaccccggcgaatccacatgtctctcggcatcaaggctcccctgataagctagttactcagccaggggtgtcccattccacccatgtggtcatacttgtcttatgtttggatgaaattccaaggaatcggtccttaagtgcgagagcgggaaaccgtacacccggtacgtttcccggtccgcggttttggaaattcatttagttcgcaagcgccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctcggaaactatacgcaaaacgggacaactcaacaaatggcgaaaataaagccctattaatgacctctaagcgtgccattagatagatctcgagatttgagaaattttggaatttgaacggagtcaaacggatttacggttgggaagatattgaatttctaagattattggatttttggtctaaaggaaaaggatttaattaaatccttttttttggaaaagaaaaagaaaagaaaaggggagagggagggaatatagacttccctcgggcggctagggcgcggcccgagagaaagggcggctcggccgagcttaacgggccggctggcccaagaaggcggcccagagcggcccaagacgcgcgcgcgcgggagggaggagagagagagccggtggaccgggctcaccatgcgcggtcccgggtgggacccgcttgtcagcggctcggctcaccgtgcggagggagtacgcggctcatgcgcgcgggtgggggagggacgcggtgcacgcgcgcggttcgcggtggacgcggatgcggcgggcccacgcgcagcctcacggctcgcggtggaacgcgcgcatggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggagcgaaccacggcgatacggacaaaagcgagcacatcgggcggttgctcgtgatgaggggagacgagccaacggctcggatttgccagaggaagcttgacggcggtgaatcgcggcggcgacaaccggcggggagggaagagggaaacggcggcgaggccacgaggggtcgattcccggcggtgagagcatctacgcggtttcgggaactcgatgctagcgtcggattggacggagctacgccgagcgaggctggcgacgtgtgggtgctacggagctcgagcggcgagcacgcggcgagcgacgacaacggtcggggcggcgccggctaactacggggagtctactcgagctactaccgaaagctagggggggagatggagcgaggaggaagaacggagggaggcatcaccgagatgaggaggggcgctgtgacgagaggccgacggcgcgggagtaatctctccggcctcgggccggggaagaggaaggagagggcgcggccgaagtccccttccgcgtccttgctcgtgccgactccttcgacacgcgcaacaacgaacggcgacggcgaacagagcacgggggcggcagctatggcgaggaggcgaaaacgagggagattggaggggaaggagctggggtttaaagggggcggcaatgtcggtttgggaaccgacttagggcggtcaaggcgcgagctgcgctcggcggtcgcggccaaagcggcgacagggaggatgacgccggcgggggaaaaggggaaaaaggagggggagaaaggggcttgcccttttgccgattcggaaaaaagaagaagggagccggggccactccacaaaaggaggaggggcgctgcctccgtcccttggcggcttgcgcgcgaagtggcggggcccaaccggtgacgacgccgatgacgccggcggcgaccgggcggtcggccactcggcacgcgcgcgcggcttgcaacgggcggtgtccgcgcgggcgtgcgcacgcgaacacggcgccgcgggaagtggcatcgagggagcggagagggaggacttggctcggcgcgggcggcttacgcaggcgcggcagagcgaggagaggggaagggggcgctcggcgcggcggctcacgcgcacgcgcgcgggcggagcggaggaggaggagcactcggcgcggctcttcgcgcacgcgcgcgcggtgagcggggggggggggggagc

SEQ ID NO: 63612 - DNA, 5115 bp, Oryza sativa
gatagatcggggattgagatcttaagatggcacggacactagacaacaagcaaagaaacaaatttcgcaattagggtttttaagagataattttcccgctaggcgccacgacggaacgggcgctacacgccgccatgccggccgccgccccaccgcgccgccacgccggccgtcgcacaggccgccgccccgccccacggcccgccgtgccggtccaaatcttgtgcatgtccaaatcttgatgagatgcgggcgtgccagtcggtttgattctgcaactgacaggatatgcaaatagtagatcaaaacagccgatcagctgacaagccgatgtagtgattctagccgatgccgataatagccgatgccgatagggtgtaagaactcggctatatgtccaatgtagataatggtataatggcaatcggttgttgatgatgtaataaaataacaatataatccagtataaaccaatcggctagcattgatatgatagaataagcactgatccgaaggttaaagcacacatcggctggaggtccaatgtcatgaaatccacaagattagattaaacagtgaaacctttgttgtcatcggctaaatccaacttgtatatatatgtaatccttataagccgatgcaacgtcccgataacttatcggctagcaccccgataaaatattagcatgaacctattagcttagcaagacttatattatcaacacaatctagtaggtcgaacctaaccgatgcagcacgagattgtatatgataatctaatactcgatgagccgatagatctgtctaatgtgatggatataacaaatctatttagaacagcattgtaattgtagagatatatcggctaagacagaagatcggacctaaccgagacagtcccaactaaaccgatgcgtctctaaacacaatggaattagagatagacttgagatatcaggtaggcaaatcaatcaaccaaaccagagcgatccaagagatcgaagcgatgcagccttgaacgatgccgacgtagatgacagattcaccagggcccgacagaacgtaggacttaccctttcgccggagatcgaactgaaccaatgcagccccgcgtcaggtgcccaaatcccgccggaagataagtaaaaacctcgggaaagatggtggcgatgcgctgagttgtattgatcgtggagatagattacatagaccccgggtgtacatatttatacccatgggttgatacaagtccttgtcggacaagaaagaaacttttctaaagataaaagaaaaagataaagtccttataagacactaaacacactttcctagagataaaaggaaactaacaaactattcctaattaatagataacttaccatgccgcattctctttgaactcggtctcttctggataagcttcctttagtagatcaatttccttaaccgaatatagcaagaatccgacaactgacgacttgacaactctcatcggctaatctcaggacttccaagccgatgctgactctaagccgatgactactccgggcttaccaaatttcactgttaacactcgttcgatcaaaaaaaaaagagaggaaggaagaaagagataaggcaggagttagagaggaagaaagaaagaaagagacagagtttgttgcgtgaacgagagaagaggataagtaatagggattatatagtacgtgttgatttttattcccggttagtaacaccaatcgggactaaagttagatctttagtcccggttggtgttacaaaccaggactaaagatcctaggcgcctgacacggtctgacatggaaccaaccgggactaaaaatcatctagtcctgttgttcttataaaccgggactaaaaatcgtttttagtcccggtttttaatgaaactgggactattgtagatttgggtcgaccgatcaatgatggtttctccaccagtgcatttttcattagcacacatttcaaactgctgatatgattttttcaaaaacattctatatagaaaatgtttcactaaaatcaaacaaattatttttaaagtttgtaattattaaattttaattaattatatactaataaactttctctcgttttatgtgaaaaaaatcttactttaaactcaccaaaaagactatatatgcgtctcaggtcctgtttagatcccacctcaaaatttttcatcctgtcacatcaaacatttgaacacctgcatgatgtattaaatataggctaaaaaataattaattgcacaaattgtgactaatttgcaagacgaatcttttaagcctaattgcttcatgatttgacaatgtgatgctgcagtaaacatttgctaataacggattaattaggcttaataaattcgtctcgcggtttactgacgaattctgtaattagttttttattagtgtccgaacaccctcatacgacactctatataatacccgatgcgacatgccaaaactttacacccctgatctaaacaccccctcacatgcatggaatttctatgatgcacgcagagtgcatgctactaggaatcattcttaccggctacttatatcgttttctaatccatctccgacctacgacgatgaacgctaaccctgtgacctagttggacagggccaacctatgcgactgcaattatgcaagccgatgccactgtgtcataatccctccatccaaaaatctaagacttatttttctatcaccaaaatcaagaaaagaaatagctcacttagcttgcatataacgaagaccaaagacacgcaacagtaaatattaagataggtacttgaatttcgatcaataatttaatttagcattggaggctataaatatgcctaattcatttgaaaaaaatagaaaataaaataagtcttaaacttttggttggagagagtatatagatagtgttatagctagctaggtaacgtcagagagggattttaatcacccgggtggacgtttacctatttattgcatgtcaactaaatatctatgaaaaaaaattcaaaaaaaagacaagatatattaatatgaaatatatcacttcataaatatataaattcaaatttgacatctacaaattttaacaaaaacaacaaaattaattgtgaatatacgtaaactaattagattttaatttgttgttttcgttacaacttgtataaatcaaatttgaacttgaatacttgtggagtcatatattacatactattttatcttcaattttcattaaccatggaaaattgaaaccgtgttattataattttacaaaatttgatatatgccatcctgacccacatgtcatcgactcatatgggtcctacttgtcattgagataccgatgacatatcttaaactttgcaaaattataatggtatggttccaaattacccttttattttatatgcgataaatggctagatgtccaccccgttcatgagacgagcacataccatccgttcattattcaagctagcgcgcggcgccggtgatcgcacggaggagagaaacatgcgtctccccgaaccaaagcatcagcagctagccactgcacccacacccacctccgctccgcgtcgcgcgcgctatgtatacacgggagagataatagtaggatatagggagaattccctatatgccatgccaaattagccttatcccttctatgccactgaaaattgtctctttccctctatgccactagtttgaaattgttccaccctcatatgccactgccgtcacccctccggctcatcactgttaataggatggggttagttgtcagttttttgcataaatggcaaaaatgccctttggcccaagttgaggatatggcccaaactaaccgaactcccgcaccagccatccccaaactgcagcagctagctatcgccaaaccctagctatccccaaatcgtatcgacgggcgacggcggcggcggcgacggcggcggcggcggcgaggtggctagggcaacggcaagggctcacgtggtggtggcggcggtggcttcggttcccgtggcggctgctgctgctgcgcgaggtggtggcggcggcggtggctgcggttcccgtggcgccggctgctgctgcttgaggaggtggcggcggcggttgcttctgctgcttgaggttgtggcggcggctacggctgcagctgctgcttgaggtggcggcggcggctggtgcagactgaggcggcggctatggctgctgctgttgcttgaggcagcggcggcggcggctggtgctgattgaggcggcggcggcagctactgcggcttgaggtggtggctgcggcagccacggcggctgctgctgctactcctcaaagctgtggcgcccgcgcggacggctactgcggctcccgcggcagctcccgcggtggcggctactgctgcggcttgaggtggtggctgcgaccaagacaacagcgaaagatgaaggctcaagcaagcaaatcgcctccccaatcttgggtgcctgaagggtatgtgtccattttccccttcccgtttggcaatgatttttgttgcatacatggtaggatgcacttatttttttggcatgcattttggataggatggatcctggtaaagcatatctgttgaaaatcaggctccatgggcaccaaagtagagaaaactttacatttagaacagaggaagtgatatatagcgacagaacaaacttcaaggattttattgatcacattagagagaagtacccatggggggtgaatgaatttgtaacaatgaactattttgatccagtaaacagaaactaccctcaagtatgctcagaccagtcaatgctagaaatgtttgacaagaatatgactagcaaggaaatatctatgttgattcaaattcataagaacaatgagcaagctgtagttctgccacttgctgattggccaacacctaaaaaggtagttagtggggcagaacctaatgcagttaatatacatgaggtgccatgtactccatctcttgcaatgccatctcaggctactatatctcagcctagcagcagcacacaaccagttgttgatatgtacttggaaaatttatttga

SEQ ID NO: 63613 - DNA, 19605 bp, Oryza sativa
aaaacgcaatgttttaacaaagacccaatcatatttctaatactattaacatcaaattgtgattatatatatatgattccgtggaaagaaaaatccataaaaaaataaaagaactgaacacaagcccagctagcaccttgaatttcaaaactaggcatgtagcctcttttactttgcaatactccatttgcataatctttggagtgatttgccaatcttcgatcgttgaatcgactatacatgacacacatgtaggcattgtgttggttcttagttgtctcaggagaaaaagggtacaatggagagagataatggaaaatatcttgtactatgtcactcagagcaagtataatagtgagctataagcttactatatacttaggtggaggaaagaggaagtaaaaaatcaagggtgttggctctcatgcaagagctaacttatcacaagctccaagataaatacattaaatatataagtgagagatagagagaagaagaaaattatagccaaacttatagttaatctactatatatattagttttaagataagctaatagtagaaagtgggctctactattattcttgctctcgggcatagccatcttaaagggttatgtagataatattgcaaagctcagagggccaggcgacaactggtttaaatgatcacacaatgcttacttcctaggaactatcaagttgggctcctttacgatgcaagttcttcatttgattggtaattaataacagatggttggcttcggatcggctagtctcttccacagccgagtgcatgccatctttgagatcaaagtgatgaaactatacaacacatacaattgtctctcgtgtcttttgcaagctgtgtgtacttcccttctcttggagatggggttgcgctggggttgcatctcagccaacgacagttcatttttcaggttggtggtgtgtaaagccatcaatgaagtttcaaaagagatgcgcaaaggactaaactcattgattattctagtagcataggagatttggaagaaccgtaacaattgtattttcaaagcttctctaaatgttttggtggtagcacgtgcagtggcaaatgacagtatttgtggtgtttagccggaaactcgagcgctctgtaagctttctttgtatgtaggtcaattaatttggacgactaatgatggctttctgggtaacgagtttatgtgagtgtggccattttaatttgttccttatgtttgtaattatttttcccttttttttatttttctcaatgaaacgaagcacaaacctcctttacttttgagaaagaaaagcttgaagtgttaaacatacttttttttttgcgggagtagtatatagagggtttttttttccattgtggaataagttgctgttgtgtttttcttacaacagtatcatcgtctacttcgaaccgtaagtgctactctctgatgaaccttgtgaaacggatttaaaacacatgcatgcatggaacaagttcatttcccagatgtgcggaccactgctgcatgtttagcatttccaaaaaaaaaaaaaaatctgcttagtcaccaactcacgatttatacatcttcttataacaatatttgtggatatagagatcggattaatgaaacatccattatctaaaaaacatcttcttatggcaataggtttctcatcgagtgctagaccagcaggatcatcactcggtgaggttcgccatggcgccatgagcagcagcagcaacaacaacaagaagatgaaggccccactgagcttcgctagcagcaggcagggctccggcggcctctcccagatatccgaggacggcatcccggacctcactgacagcatccatggcgccgctcatcatcatgggcgctccgaggagaacgtctccacccacgaccacgtcgtccgctccttctcctccggtgggttctcgatcgggtcatgggaggactccaactccatcgtgttctccacgtcgacgggcaaatcaggagcgcacggcaacgacgacatcatcgccacccttagcaactacgaatctcaggtgtatatatatatgcgttttatctttatttttcatttttcgtatttatagtttgatttattagtgtgtgtgtgtacaatgtgagggatgatttcatgtctaatttgtatatacatgcatctgcgatgcagcttgttgcgcccagggagatggctggcgtagagaaatacctgcagatgcagcacgaccaggtgccattcagagtacgggccaagcgtggatgcgcgacgcacccacggagcatcgcagagagggtatgtatagacgacattttcccttgctaattctacgccccatcatagtaccaactttttatgtacgtacgtagcgggtcgaactatatactgtaatgtcaactagcatggaagcgtatcctagatacatagacctttaacgtgtatagtatgcaccgtacatcaaattaacaaatatcataaaaaaattagaaaaaaaatcaatatacatgtatttttagtattatatttacacataaagtcatgtcttcaaattcattacatagatagagcaacaaaaatgataaaattctgatatacttattgtcttaaaactataaaaaaattgttacacctatgatataacaaatttgaggttaagattttacacaaaggtgtagcatttttgaaattataatatgtattttttaaagaattttttgtgatatttgtttgttggtgtgtatagaatttgcatgcgaaacttgtgtgcacatgatatgttaccaaataagaatattgataacctttcaagatgttcttcatatgcatgcatctagccagtagcattcttgttgttcctccttggatcgtgcatgccagattaatcttcaggcatatgatcgatcgatgatgacaggagagaagaacgaggatcagcgagaagctcaggaagttgcaggccctggtgcccaacatggacaaggtgtgtgccatacgtgtgttcttttcatgtatataccagtccttgtctgaactttttcgtcagacaacaatcttcaggttattgagttggagttcaattgatgatctttctaatttgttcttcttacaaattaatgtggcagcaaacgagtacttcagacatgctggacttagcagttgatcacatcaagggactgcagagccagctgcaggtataatgacgtatgcgtgttactaatttgcatgttcagaatggcaaaactgaattgaagccactgctgcctaaagaagcctgataggtcgatgtaccagtccagttacaaagacccccgttagcatcagaatatatatagctagatggaataccaatatatggcactgtaaaacagcagctcagtatgaggaatcaagtatccctccatttcaaaataaatcaacttctatgacaaacatagacatagctgaaagttgatttattttgggacggatatgagggagtaacatatatatatatatatatatatatatatatatataaaagcacaacgcaacccggaaacaacactgagtttttccctgtgtgcagactctgaaggaagacaaggagaaatgcacctgcagctgcaagcaagcatcaaggaacagaccagccgactaaaatgggatgtgaagcaaattgcagtgctggctagtttgatgacatttctccttggtcctcaaaacatgtttgcctggcgacaggaaattaaaggtatagcaggcagcatatagcgtgacaagagcaaagtaatggaggtcatcagtctcttccaaacgaaaggtcgaagtcgtctgatcaaacctttaccagtgaatcgatcagtccagtcttttttcttttgtcagtgtgaccaaccccttttgttgagctgtaaaattaattgaaactagactagaattgttccttcctttaacaaggagctctgctgctctggatgttaggcttctagctgtcctgttgctgtggtaaatagtgattggttcacccagcggttagcaaataatctggttgctggtttcagggtattctccggccaacattagacaagattcagtgatgtgttatgattcatacagatcattagacattatccagaaaatttacagtgttggtccggggtagcaacatgcatgggtccttggaaaggacgatttaccactctggctggccgttctgtgctggtccagtcggttctcttctccattccagtccatgaatctatggcgatcggcctcccagtctgggttattaaggccattgacaataagcgtcgcgccttcctgtggacaggtacggactcagcccatggtgggcagtgtcaggtgttttggacgaatgtttgtcgctccaaaaccggtggtgagttggggatcactgacctcaggttggcagggtttgccctacgtgttcgctggctttggcttcagcgctcagggcacccctactaggatggcctaaaggccccagtctagcagaccgtctccgacatgttcgcggcatccactttctttgtgccgggaaatggtgagtctatgctcttctcatctgaccaatggatcgacggccgctcggtggcgtccttggctccagatctcctcttcgtcgttccccaacgtttttgaggttcacgcacagttgcttctgccctagcgaacaactcctgggtctctgatattcgaggtgccctcactatcccagtcatctcccattttctccttatttgggatgcggtgcttcacgtacaactctcgccaggtgtcgaggattgtctcatttggcgctggacagctgaccagcgctactctgcgcgttcggcataccaggcattcttctatggccagcattcctttgcctgtgctgatcttttttggcatgcaaagggtcctgccaaatgcaggttctttctttggtttgcattccagcggcgctgctggacggctgatctcatccagaagcgtggcatcgatagtcacttgggctgccccttttgcgttcaggatcttgacacggcgaaccacatcctcttcgactgcatgttcgctcggtaggtctggcttcgagtattgtcgcctcctggctgggctgccctctctccccccgtgacagctggttccaagactggtggtcgtccttcagggcctgcttacctgagcacctctacgacagcttcgactccctagtgttcctggtctcttggcgtctgtggaaggagcggaattctagggttttcgactccgctctctcttcgatctcagtggttctagagttcatccattcggaggggcatatgtggtctttagctggcgtcgtcgcttttggggatttgttgggagtctagtgtggcttggccccttcccgctgcttggagtctgttttcagccaccatagtttctctaagcttcagtttttttttcttttgctttttcttcctttccctagcattagccggtctggctgattgcgtagagtaactagaactctttttcttctaatatattgacgtgcaatacttttgcgtgttcacgaaaaaaaactgaaatttgccggaacataacatagcgctattggagtcccgaaattgctttctctttgaatttaatccagaacgtagcgtaaattgattcagaacgcgcatgtattgcagtcccaaaaaatgttcaaattttttgttcaacatacttccgtacacatgtatggagatcccaaaattggtatacattttttgaaaataaacttgtattgctgttccaaaattgttcagaatcccaaaaaaaaaatgttgcccaaaattgtacagacgtatgaaggtcccaaaattgtccacattttattttaaagaaataaacttgtattggagtcccattttttgacaataaacttgtattagaggcccaaaattattcaaagatacacttctttttgaaaaaaaatgaataaacttgtattggagtccaaaaaattcattattgaaatataaacttgtgttgggtcccaatattgttcaaaaatccagtttttttccagacttgtattggactgcagaaattattaaaagaaactaaacttctattggggctacgaaatatttcaaaaataaaatccagtttttgataaaatcagaaaaataaattgaaatagctcaaaaccctacttttcaaacttgtattggacttcaaaaaatattttagaaaacaaaatttctattggagtaatgaaattgttcgaatattgcagtttttgagagaaaatcagaaaaataaattgaaatagttcaaaaccctacttttcaaacttgtattattgttaaaaaaatgcagattttgagattttttttaaaaaaattaaatattgctggctgtggggttcgaacccacgcgcacttcagtgcagaagatcttaagtcttcccccttaaccactcgggcaaaccagctgatacgttaattttcgcagcattacggtatttataatcaggccacaaactaacagacaccgtaatcgccagcaaaacctgcaccccgtttctgtactcagccgaagcgcagccatatgtctcacaggaaaacaccatccgtgctctgctccattgctggcccgatcaccccagccagagctcgatctggcaaagaacgaaccaacatttgagccacgcgcgcgcgcggattcactcgccgccctaaatttgcccgacccgcgttcgacgacgacgaggacgacgagaatagtagcgccacgccaaccgccaagcctatgctttggcatggccatacgctattattcggcggctctggacaaattaagccaccgtttttcctcttctccccgtgttatctccacctcctcccgcccccctcgtgcctctcccaaaacaaatcaatttccttcctcccgaccgagcaagggggcgaaaggacgagctacggaccgagccatggaggaattcaaggctcgctccttcgtcgccttgtctccctcgggtacgagtacggacgaacgatctcccgccatatatgattattcctcagcttattcagtagtaacattatggttaatctctgttcttgagttagagtctttttaggcgaacggtgcaaatttgttttctacgttgacattttagctagctgatgttgctctgcctaatttcttttccttccgactctctgcgtctgccttctttgacaccggtggccttcatgtagtatttgaattttttgtgcgagattttatattacatatgtccaaacattagtgttgattacaccatgctacgcaaaagaaagccaggccaccataatagcagcaaaacagaattctacagagtatgcagctacagcccttttctaaaacatattctcatttggtttgcgtcagcataagcgatactgtttatatcttccaattcaactagttttgttcaagcagttcacagtaggttagtattcaatttatttcagtttacacgttgccagcatgtttagcatcagcaattcagcatgaggccttgaacggccagtggatctgggcttggatcgatatcggccgcaatgccgcgttgccaccgggaagcacgcagcccaacctgatgattttttttttgactaaatcaccggcaggggggggagtccccacctgaatatattaagccaaatgagcttacacagggcaggcttcacctatagaaacgcagaagccctggaggataggagaacagaatacacggggaatacaaagaggagagaacagagaaaggaaaacctcctaaaatataacaattgacaaacgacatctacaaaattacccggccaaaaccaaaacctaaagctaacaccctagcttatcaacatccatttcctcacgcagccacaagcatgccggaatagaagaaaggccaaagaaaggttgtagaagtcctaggccacccgcatgaagtcatcaagaagctaacttgatcttattgttgtttggatcaaagcccgccgacgccctctgggggaaggaagccccagaagagggagggcactgaaagatgtggccgaaggccacccacaatgagttttcttcaatcaaactttatcgagttgcttgttagatcaacacactccaacgtccttcaagggaaggaagcctaaaaggagggagaaacgctgaaaggtcttggacggtctcaaggaagggggtgaagatgagcaggagttagacaaaaggaaaatggctaagggggggaattcactgatgaaagatcatcaaccgcaacctcagcggagggcacagagcagaggccagccaaggtgctagaggagcacaaatcccagaacaaacatctggaccaattgtcaagagcaagctgaaaatgagaagattttgaacggggaataacaccagcaaaccaaagaacaatggaataggcccaggtttggagcggggagggaagaaggcacaatatcgagggcactagggagaaggggaagaggtttgttgcaaccaaggggacgtgtcggcagccaaacgcgcgtaggaggacgtccgggcttccgaagccagcccctccacgcacaaccccggccggcggcggctggagggtagagctacgtcgccggccctcgtagctccacgtgtgccgtcccagacccaacgctgcacgcatggacaacctgtggggggggggacggggacaacgggggaaggagcccgccatcgctaggcgccgccagctgggggcaccgggcccagcccacaccgccggcaccagggggaggggggcgcgacgatgaggatgctgagccgaggccctccgtggtcacatggagctgcaacggcgagggtgccgcaccgcggagagaacccgtcgccgtcgccaagggtccgacgaggtccagccgcgaggacagcggatccaaccgccgccagccggaagcgccgggctcggcctccaccgcctgccaaatccctccgccgccaacctgatgatgggttgataaatctccaaagcgatcccttttaggactccttgccagtggtagcatttccaaattatgcattttggtccctatttaacgccgtgtttaattccaaaataattcttcaaactttcaacttttccatcacattaaaacattcctacacacaaactttcaacttttctgtcacatcgttccaatttcaactaaacttccaatttttgtgtgaactaaacatttaggactgctagcaatgttgttagcggtctgaaaatttccatctaagtccctacgcctttgaattgtatcgcccagcccccactctctcccctctgccaatgccaattcactcgctgtctctagaggcagcccacactgcacccatgccccttccgttgttctcctccactggaatctaggcccccaaacggcttcgccatggcttattgtctcagcgaccgcgcgaaagttgggggtttgggcagttggttgtttgcgattttcactgttcgccgtccatggtgccatggcaatggcagcccgccaccttagcttgaggatggcatcacttggggcgttgatcacggtacgtatgtttgccctccgttggatctggtacaaccaaacaccgctcgacgtccctcaccaccaaaagtcagtgcaaatgagcccttctagtttttgaattcacgaattgataagtatcactatatttggtcttggatttgtggataagtatcaagtcagggatgtccggcgatgaacttactaacaacatctgtaaaccaatacaaggtatatcatcctgtaaacaatataaccaagtctcttaactatgtaaaggaaaaaatgttggttcagttgaatttcatggcatactttttttctttatttttttgtgactttacatgtcctttaacatgtggtttgattatgccatgccatgcagaataatccctgcggtcgcaacattagtaagaaaataatgtgcacaaaattcattcttgatcaattgatttactatagctatgttttccagggggaaactagttgtcctaacgtatgtttagttgttcgaatgataaaatttgcacttttagttattattccatcttcactttactatgtgttggccccctttttgggttaaggttatcaatcacatctagaggttaaaactctatctattggctccatttgctccttttctagatgtgccaaactgccaataagagcagtgcatggacttttggttcttcatttactgttggggtgtgtgttttgaattgcatgtcaaggtttcatcatttgatttgtgcttcgttgctaatatgctttatttctggctatatgatcaatgtaatttattatataaaggattgtaatttttttatttattaaatgatctttattttttttatagtgataagatatgtaacttatgcactttgcatgtttcaggtgaaatttcatcaatataggaaaatagattataccatcagtttttgcacacggtgagaaatttaaaccctttatttctaatgggggttacttcagttcatgcatgaacacataatgcactatcttgattccgcagcacatacttgaagttgttcatcttgggttgaaagaaaaaggtcaaaccgattgtattaattttgcagcaagccaacaaactaattgactggtggctatgctaatccttagcttaattgaggttttttagtctggttttggttggttccggcggaaccgtggatgatcgcccttgccacatacttgtgccgaaactattctcttctaggactaataacttcttcattctatgacttctcttatttctcagcggatgaaatttgactaggagaggcaccatggagaaagtcgaggtcgatgggaacttcatcggtacgggtaattggaaggtaattcacctgacctcatttcactaaaagctaattgttctacaatgttaatatgattaattatgttgatctgagatcattttataatgtagggaactttcagaacaatactattgagtttttgtgatacttgtgtacatattatatagtcaccctttaaaagcaaaggcaaatgcctcctgtaaaagtataaatatcacaatactaccactagttgacaaaaagttagaagaaatcataacatagttgcatcatatatatatgataattttttatatatgaagatatttgatctcataaagttaccaattattagttggtaaattgtgataaataatagatctcatccaccttctttctttctttttaattttctttagctccgctgtttgatatcataattttgccccccccccccctctttggggaggaatgatttctatttattaataatgtgagtattaggatggtagattaagctggtttgttcctacctctttgtgcagctgcatggagcactatgtaagcaacttcacaaagtagttcttgaagtattggatgttattcctgtccttgaagctacaaggcctggaaacagttctggacttcttgcattgagttccttgcgcatagctgttgagaaggccaagaatctacttcagtattgctcagagtgcagcaagctatacttggtatgcagttttcataagtgcaaacatatttatgtttcctagttttgagaaataaaaatgtgtgaaatatggatacatgtctttgtgctactgtatataattgatggtacttggatatgtttcatcgtatatggatatcaagtactgccaaatttatttgttattatagaaatacaaaatttcatacttacacatcctaactgcatgcaggcctttacagcagaaaatgtcctggcaaaatttgagaaagcaagatatgcgcttctggaaagtcttcaccaattggaagaaacacttccagaagcagccagttctcaggttgccactggttatacaagaatttgtccttgccggctctgtcttaaatagatacctataaaatattgcggaaggatccttctttatcagtgttatatagtttactaaattaatgaatgagtttgacgtattgcagctttcaccctaattgtaatcgcatgatttaatttaaccttttcctctaattcacacttatttgggaaattttcagatactagatatcgcaaaagatctggagaaagcagtttttaccttggatctgattgaaaagcaagctggtgtggatgtgaatcaattagttcagaatgaggcaaaatccaatggctttcttcatgacaatgaacttgaatttttccgacaaactgcatttcgggtcggcgttgcgtcatcggcaacagctcttaccgagagaagagcacttagaaggcttcttgagagggctcatgcagaggaagacataaagaaagaatcagttgcatcttatctactgcacctaatgaggaaatactcaagcatttttaggagcgaaacgacggatttcaccaacacatccatgtgctcaagcccttcttgctcttcccgttcattgtccagctcgattgatctccatggaaatggtcatgttattgaaaagtcgatatctagggttggctccttcaatctcaggcagatcaaaggcttatcaggtagcatgccattgccacctgaggaactaaggtgcccgatctccttgcaactcatgcatgaccctgttattatcgcatctggtcagacatatgagcgggcttgcattgagaaatggtttagcagcggcaacacaacctgcccaaagactcggaatgaattatcccagctctccatgacgcccaactattgcatcaagggtttgatagcttcatggtgcgagcagaacggggttctagttccatcggcgccgcctgattctcccaagctcaagtacctgaggatatcatccttgaatagtagcaaatgtcttgtgaccaatggcgttagcacggtcttgtttgaagacacatgcgcggaggatgatattaaggatggtggtaaagttgcttcggaggagtgcactcggcagaactccggagaggctccatctgagatatgtgaagttgatcaggcctcaccagaaaaacatcctcatgagaactccgagaaggtagcagaggcgacatgtgagctttggctgcgtgtgctgagcaaggacgacgatgagtgtgtcgacgagcaacgtgaggtgatcgagcagattagattccttttgaaggatgacaacgagcttaggaaatacgcgggtgctaatggtattaccgagctactcatccactttgtgaagaaggcagtctgcagagatgatgttcagtgccaggtggttggaacaatggctctgttcaaccttgctgtcagcaatgataggtaaaatgtcacgtatgctttgttccttctaacgatgttgttacaatagtttattacacgtacaacttgcagtaacactctataggtagatgatttaattgatcttagttgccatcatctcacattttccacctctgcatttgattttccaggaacaagaaacaacttctctcaggtggagtcctccccttgatggagcagatgatacagaagcctgaaacctacgaggctgccgtcgcaatgtacctgaacatttcctgcctcgccgaggcgcaggcgatcatcgggcagagcgaggccgcgcctctcctgatcaagggcctgcaaggagacggcttccggatgagcaagacctgctgcctcgacgctctcctgacgctgtacaacctgtcgctgcaatcgtcaaacatcccgaccctcatctcctccggcatcatgcagagcctccacgacgtcctgacgccgtcctccccgacgacggagaaggccctggccgtgctgatcaacttggcgctgacccgcgccggcaagaaggagatcatggccgactcggacatggtgggcgccatcgtcgtcatcctcgagaacggggaccccgccgagaaggagaaggccgtgtcgtgcctgtggatcatctgcagcggcgatgacggcggcagccagatggtgctccaggaaggcgtgatcccggcgctggtgtccctgacggccaacggcacgggcaagacgaaggataaggcgcagaggctgctcctgctgttccgcgggaagcggcagcgggaggtcgagcagctgcagccaagggtgcagctgcacgaggtggtgagccaggcaaccgcgcagcacgagcagcagcagcagcagcaacaagaagaaagcagcgagccaggcagcgacaagatgtcgcggctgcgcaattcaaagtcgaagttgagaaggttcacgagggccctggctaggttgctcaagaaatggggcatccgctgatctgatctactacagaggaaagaaccacgtcggctagtgtgaactttggcaaatgcaatatcaatgttatcttcccgtgtgggttgactcactcgttttcgtctccttcgcattgccgcgatatccatactcgtctcacttatgcgggcattgaccgtctctctgtacctattaaccttgtgctaaggcaaaattagtaaaaagggtttaagcttattgtgttttgccaaaatgtaagccaagatgtgttaacaaggattaagtgcgatcatcaaagtgtgtaacaaggattaattcaggtcataaatctaattatataatacgtaacccaaattaaagatttttaagaaaacccaaattaaagatttttaagaaaagaataggaaacccattttattgaggtcgttttagcctaattctatttggaacatacttcatctgtcaaaaaaaaaaaaccaaatccttactaaacatagggtatgttcaaatacataatcatgatttctttttttttcggatttgctatacaactggcgacagttaacagggggtgaaaactttcaaattttaagctgtctaatatgctttgagatttgtgctagtgagggaaaacagcttaaaaaattcaggggtgaaaactttcaaattttaagctgtctaatatgctttgagatttgtgctagtgagggaaaacggcttaaaaaattcacacgcgtgcagtagggatcaaacccaacacctccaacttggaggcttgttcacctaaccagttctcccatcgggctattttgagttacacttgagttacatattagttatatagtagttatatagtagttacaatgtaattacatagtagtcatatttgaaagtttttcatcccaaaaactgtcgacagttgtatagctactcccgtttttttcgagacgggagtagtcgcgtacgtgtgcgttcgttccaagcacactttctgtttttttaaagaaaaatctttggaaatgttgctttaaaaatattatattaatctatttttaaattttaaataattaatatttaactaataaattataagctaatgacttatctcgttttttatatactacctccgttttttaatagatgacgccattgactttttctcacatgtttgaccattcgtcttattcaaaaatgttatgcaaatgtataagatataaatcacacttaaagtactataagtgataaaacaactcataacaaaataaattataattatgtaaatttttcgaataagacgaatggtcaaacatgtgagaaaaagtcaacggcgtcatctattaaaaaccggagggagtatttaatcttctctctcggacaaacagtgcaccctggtatttgagcggaaattcgcatgaaccaaattgtgggccgtatgcacgccaagtctggctgaccagttgggccttggcccgtggagtacaatactaaaaaaaaaggtcaaaactgcgtgcgaagcctgtgggttttgacctcaagcctcctcggcgactagtccacgcctcccactcccagtccacttctcttccttccttccttccccaccggctccgatccgaaggacgaaccccgcacaagacaacaagtaaatccccatccatagctatccaagagccccaaatcagatgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcaggtgggtggggagccgcgcgcgctctccgtgggttcagttctgccctaggtttggggtgccgtgtgcgtgtgagtggggaggttgttttttttgatgattgatgaaatggttgcctctctgcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatggtgagcgcgctttggtgtgcctcgctgcttctgtttgatcacaatctcgggctgtgttggtctgcattgctgcaaatgctgcttctgtatgttttggattgtggcgcactggcgctgctgcggctatttgagggctggagcacactagcgagtagtgctccttggtgcgcaggctgaggaaacttgtgtttgtgaacgaaatgcaagctgctcactaatgcagacagttgttcctgcaaatggagaagtgttttcttctgcattcgtatcccacaacagacgtgaaccctttctgctatgagcatcattgaacaccgttatgtaacttatcatagcctgattcgatttcattcaccatgatctataactattatacttaccatattagttactttgtactactcttagtaaaataaataaattattttaatactccactgacaaaataggttaagattgtttcattgcttgggcacatgtgcaatactagtcgcattttttttacctgcgtgcaaatcttatcatgcctgcttgattcaatttgccgttctctctgtaatttaattattttgcctccagacagagagtgaattggaggcaagcaggcttattgacgatcttggcctacaaggcaaacagcagtatgtatgtgctaatgttatctgtgatggttaactgctttgaatgtcttctgtttcataatttacactgatatgtttaatatttcgatatcctttagcctaactcacaacacaagcgttacattgtcaaagatggagcaccaacactggtaaatagacttttcatgatatgatgcattttgttttgttcttcctatagtatgcctcacttttgaatatatttttttgtcacataagattccctcagatcccattgcgctcatgaaaagcactgttctttctacaaaatcaaaggtatgtaagttattgagtgctaattgctacaacatatcatgacctcctgacctatttgcaacaagttgcttgttgtttccacttgtcactgatggattaaaattcactagtgtagaaacaatcatattaaactgatcaccgtgacttgatttacttgttttcagttcactattacaaatttgtacatttcctgatctttcgtgttcaagctgtgtgatcgactgattgcaaccgtcatattatattactgtattgagtttagtaaaacatggtcttatctttgcagctcaagctatttctggaaccatttctctatgagaaatctagcagaaggacctcgggaaaagtgtctgatgaacatttaagtgagaggtgagccttcatactgatgttattttgagttgttgtaaacttgaaccactgataatatagttatatgtttttttcctgtgttcttccttcattctcatgcccttgtgaaatacaaatatatacttcatatcacacactccctttggtcatttttcatgtcaaacttttaaaactttgtacataaaatcagttcaatatttagattgaacgcatgagaaagtattttcataatattatgattttaccatttttttcatatacgttgcaacagaatttagtggtcaaagctacactttgaagaccttattgatgtcaaaaacagcatgttttctgaccagagagaatacatttgcagtgtgatttttctgtgtatatgtagagataatcaggtttctcttttgcagtgttgcaagtttctttgaacgccactttggaaaagaggcaagttcatttttaatgaagaaatttatggattgttaagtgaatacaatcaacactttgcaacttacatgcccattataatcagtagagggtaagaatttataactttattacaggttgttgattatcttattgatccatttgtggctggaacaagcggaggagatcctgagtcattatcagtaagttattataacatgtctcactatttgcattttccatatcagcacctttgcatttctacagtaaattgtagtcataattatttttatgtaaattgtgcgtataaacaacatatgtgcttgactttgtgatgtgttcttggggatgataactgatacggctagaacttttgggggctaatctccttgagccgtatcagtaagtcataacaattctcattcataatgatcaaaacatatcaccttcttgtgtagaactgttctggttttgagtaatattttcttctgtgcagattcgtcatgcatttccagcattatggaatttggagaataagtaagtttgtagtagtttgtttggagaataagtaagtttgtagtttgtgcattgatgttcattcaagatttaccttatcaataattcacttgtccacgtccatatgctcgtgctatatcctgtccattcaaatgtcaacaccgccatgtgaatttactgcatagtgcattttaatgatttcatttatccttgttgcttgcatctcttttttgggctcctgctgttagcttgtttttggttcctgctgttacctatttcttttctatcattttttcattggacagatggtgctctcagtccttactgcttattatttgttaacctgatatgcacctacttgaagttaatgttatgatttttagtattttatagtcatggtatcattaatacttatttttggcaatcgaaattaaaaaaacatgatgtcaaaataaaaaatcatggcagttgaatgcagtgggtatatgtatcaagaatttaagatcttgaacataagtccaattgctatatgttcaattcgttggagcataacatgatctaatttgtaagttaaatttatctgataaacgatggaaggaaattctggtaccactcatgcaactatacaagcttcaaaggcttcttacatgtggaccattggacctagaatagaatctaaatttattcataagtatataattttttttccttcatgggccatgatagttaactatatgagcttgtagagtcaaaataggcataattgcttctttgggtttccacttaatttaccctacaacacttctattgcaataaatatggtcaacaacatttctttacggtccgtttggttggagggagtttttaggagggattgggagtttagag

SEQ ID NO: 63614 - DNA, 49009 bp, Oryza sativa
ttatatgcaggtcgattatctaccactatctctcatggtaacagcttttaagaaggaagatgtcaaaaaaccattggaaggatttggtgccttgataccctataaggaacagcaaaagcatggtctcaaaacccttggtaggttaattcagctttacacttatattttatccagcttgtagctgcttatattttgatttgcgaattaaaaattattaaaacagccttgaaagaagaaaccatgttcgctgtggagactagaaattcccacattaattggggaaagagaaatatttacaccctatgattttggcaagtgcaagttttaatggttgagattgatggattgaatatatatcatatttggactcagtatgaacaaataccagatacataaatagatagtactaattcaacatggatctgaactgttgatcagaccaattgagcacttggttgtaattgctcgcggactacacgcttactgcctgactagggttccatgatgataaggttcgattttctaaaatactattacaacaagatgactatttaataaaatttaaagagaataacgtatataaaaatttagataaatttggtgcaccgcgcaattgcgcaggtcaccctgctagctgtattgaactcaatatacaaatcaaccttgctacattgctctactttttctcaggtcttatttactctgatttctatttattctaatctatacatgtcgtcttgtacagggaccctcttctcctcgatgatgtttccagatcgagctcctaatgatcaatatctatatacatctttcattggggggagccataatagagacctcgctggggctccaacgtatacttccatattatgatcatttatgttttggttgttttttcttttcttgctagatttttctgatatatatacttatgtagggctattctgaaacaacttgtgacctctgacctaagaaagctcttgggtgttgagggacaacctacttttgtgaagtaagtgataagaaactactgccatggtttagagtatctatatgttttctcttgttgtgcttgtgttatggttttccatcactatggagttttgaggattcattcaggtttttgcactaccacttgcgaattcaatatgatgttcttttacacaggcatgtacattggagaaatgcttttcctttatatggccagaattatgatctggtactggaagctatagcaaaaatggagaacaatcttccagggttcttttacgcaggcaagtcaatgaaggcacccctattgtacaaaagaaatcttagatatttgaaacatattcctgttgattgagtacgtgaataatttgctgtttctagtaagtcaatttggtatttctcatgcaacttatggggctccttgatttgctgagaatgatgagtttcctagagcaagccaggaactgtaatcccagcatgtaatactttaccttgaaattaacttcaaaaaaataattgaagctttttctgtatctgtaggaaataacaaggatgggctggctgttggaaatgttatagcttcaggaagcaaggctgctgaccttgtgatctcttatcttgaatcttgcacagatcaggacaattagcatttaaggtatctgaccttaagcaatttcagacaaatttgctcactttatgtaaattgaaaaggttcacatgatttccagtttcatatttttctcttgctatagtatatccactcatgtaaagatgggaacatagtcctaaaagacattatggtcgcttgagatgctcatgtttttttgaacagtgattcgtgacttgtactattttttgacaaccaaataaatttctcaatgtttccgagaatatggcatgtacaatttgacctgttggttcttttagcagtacaatttctcgtattgttgaggcttaagacttttgttatctcacaatcttagacgtccccttatcattattattcctgtatagcttttacgtagtactctatcatataccctctgaacagtagtcatctcatccttgccttactgaccagattgtataattttttccctgccattgtcgtttgtgaagtaaaacatacatcttctacatccagttgacatcaatagccatttctgactgactttggtggtgtctcatcaatccatctgggataggcaagagaggtcttccttgtcatgatacatctttattagtactagtcatatactacatgttactattactatatcactactagctttaggccatagataaccacttgtagccacagtttgacaccccaattaaccaaaggtcgaaaaggtcagttcagcttgcaaacaacactgggtctttggagaatccaggtaaagatatacttgtacgatatgcgtgctccactggctgtgtgcattattatgatgtagtctcttttatctttggtgtcctttttgaagtctagagtactccataattaccatgggccacacaggattatatgatgcttgaagcttggttttggtccatgtatatgcacaataggtacatcatttatctaatttttgagagagatgttcatatcaaagtgcaaccgaccagttcaatcagaaaaagaacacattcgagacaaggtttgcagtagtgcaaccacctaaaaggaggagacagagagtgagagatgagtgggaatgataggagacattggggcaaatattttgtcgtctgaaatgatatttgcttgagcttggtgtaaggaaaaaaaaggaggggcatttgcttagccttgggaactttagggcacaagcaaacatgagtagggtactccttgaggctttatgtccttcgttgcacttttcttttgggcacacccttcctagtattgtatgagcatggcggtcactggccataaaggagctactccataggaaagccaaaggcaggcattgcccttgtttattttctccatgtctgaaggactggaatggatggaccttatccatggggagaatgaagcttctggtgtgttttgtacttgtgttgcttgtctgaaactgaagctatgcattttagtttgcattgcgacttcctttggttccttgaatcacaaaatcctgcttgtgtttgacatttaaacattacaaagataaacatgctgcttttataagcttattcatactcattctcacccaatgccgtcctcggcctgggttttggtcaagtgccaatggttccttctctgttgtgatacatattgtaagcaaaacacgaagcatcatagaagtacttaaaagtaatcttgcgtacgaagcctatgtttttatttaatccaggcaaattttgattagctcaatggcaatgaccaagaacagcttaggtctcagaggctagcgcctgcctagcaacaaacgggtctcgacaggagttgagcttggtggctaaccatttcgaacatggctagttggagaggacaagcaatgcctatcagttataatatcaagctacacatgacttgaattggttagtgaacacatcatcaccgtcctatatatcccaaaaatgtactatgtgtgattatgtgcatgaatatcctcagccccaagctccttgtggcacatggctacaagtaatgtagcctcccaaaaaatgcacaacaccccagctaaaaccctagaaaacggcagctaggatcgatgctctattgcctagagagtagtagctacctagccatcttgccaatgacaaggagataaggcctttgaactgtttgttgcacacataataattgggtatgtgctcgaggactagcagttcttgttatatgtatctgcgagcaatttgttggtatatgcatggtttggttgtttttggactgaagcatcctcgactccttgtacaggtttctcactgttatcccctcttgctcctgtctagacagtgcgctgaaatgtgcatatgcatctcttggtcgcacgtgtagtcctatcaatcctgcctgcttgcaatccaatatatatgcgctgccaatattttcatccagttgaaaaaccatactccatgtatttcatacaacagtagtacaaggtatcttgaaagaaaatgtgagattgttagggtatgatgtttttttattaaaaaaatggagaagaaagaaaagtatagtcatgctagcatttggtatgcttggctggaaaggatccaataaataaataataacgatacgccaagtacctgcagcttaaaacactggattttcccaacaattggaccgatttctcagtcagccttaagcctgccctttcaacgttgcttcctcgaagattcggaccgtatctatcgatcgtgcacctaatgcaactatgcggtcgtggcagattaacaaactgtaaatgctacctgatagccgctgcaacatgtcaaaatgcatggatgcagtcatgctcatgatgattcgatccacccatgagctagctagctaaggattttggcctaatacacatgaataccacttgacttaacagaaaaatttgagtagctaaagcacgcaatccatgcattggccacacctattatgcatttcttttttgctctaaccattcatcactacattgttaatactatttttatttatccgtgcaagcacttgaacaattctcgtaaatcacggccttccaattggagacccagtaatcgatcgttgaatgctgcgtgactccggacacaagcaagcagacgattatgatccttcccctagcaagagttgactcgtgccagtttctgccacgctgcaaaaaaacctgcacaaaatcacccttctgttccatcacataatctgcactccttttttcactttctactgactctccgtactcggcagttactagtactactaccatagtgtgtgtgcattgctgagtggcgacctatcatctcttccatttcacacaaaaccaaggaaacagagcaaccaaccagatcgaaatacgtgatgaattgcctagacactcgacagcctttctccctttatttttttccccttttcttttcgtttcctcttttctttttcctctcgttggtatagcacacttgtatgtgttgatcttggtcaggaagagaggccgagaaaatcttcaccggaaaagaagcagagagaaagcgaaagggtaaaaaaaaaaaaaagaaagaaagaagttgcgccatgcacggatcgaccagatgggttaccggtacggcgcagccagcgcttgtctcctagctctcacactatttgcatgcacgttcctcctcagattgtgatctctaaccacgtagagtactacggagtactaatttagttactcctactaaacaagtggccggcacttgatgctacattaacactccagcttactacgcatcaatgcacgagtataatagagatcagtacagtataaaatgcagctatacaagtatttggttcgatcgggcaaagggcgagctctccgaggcttgtttttttggggcgcctcgatacacccttgccgtcgccatgccgtcgaacaccggcaagtgcgtgtatggagtacttgacaagttgacaactgcaagtaggtcgtgtagtttcccatcggaaacgacaaaggcaaaatggcctagctgtacgtacgtagagccagacacgtaggagtaatgtatagctagatcagcacacatggcaactgggtgccattttactactcgacctgtaattaaccggcccgggttacacttccacctgagaaatgcaggcaccgtgttggtgtgcattatttcaactttgctgatgagcaaaacgctctaaattcagagtagcaaacgaagttggtgtcaactgtcaagaacaaagagaccgaagaagaaagaaaaatgtcagcaggagtacacgacgagagagagtaaagtggtttttttaattaagaaatgtattttatctctgtttctgttagtatatttttttaaactagtaaacggtgtgttttgtgaaagctttcaaatataaaagttattttaaaacttagttaatcgtgtgtaaatgactttcttatttttttttcatgtcctaacatgaagtttatcttcgttagaccagaacaccaactaaagcaaactgtctccatggagaaaacagccaaaggagcaaccagagaggggagcagcgaacgcaggcatgatcacgagatgtgggagtacgtacatacttacacgtaccgccgctacgacaacatcaccatatcctttctcctgccaactccatccgctgcagaggcgacccgttcctagcttcctcggcaccggcttgactccttctcgctccctcgatcgatctcctggactctggatggaccacctgcacggccaggccggatgcagatagcgcagcagggcagggcaggcagcccggtggtaaggattgcaaaaaacagagggcgaccgttcggctccggcacgtagtactcccccggcccgcgttacagccacgggaaagcacgtagagcagcagcagcagcctgcattcactcatacgggatcggctctggtagcgatcaatctgacgcatcggcaggcgaaacccatactacgctccaggctctccagagatcgatctgggtggtaaatcagccgggctccagagagcctgtagtggccggagtaaacgagcgagaaatacgtgctggtactactggtagtataggtggggtaaaaggtgagcgagacgagtgaatgagtgggtgctactagtagtacgactgtgtaactgtccgtatgtatatctactagggagtaatttttccctttttttgataaattgaccctttttaaaaacttaattcgaaactaacccctgccaaacacttcaaccaaaactaggccgtcggctcagcgccaagcgcattggcgctgaggttggccgtgtcagcgccaacgggactggcgctgacattgtgccaccgtggcagccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggcggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatggtaggatagggaagaaagaacttatagaccttaatgaaagtccactcatagaatcacccattagctgtcacgaactgtcggagaggtgtagtagaaaggaagaattgattgaggaagacgtggaggggggcgagggagtaaatgatatggcggatgtggaggtcagggaagagaatgacccagtaagggaggaagtacatgcagaggagaatgtgccgttaagtgggctggcgctgagtgtcccacggtcagcgccattatggctggcgctgaggtcccagcccgcaagccatccagaaggcttgctggtctgggccttgggggttgcggccaagtcccacctcagcgccagtccggttggcgctgaggtagctgccacatcagctggggatcggcccggccgccacggtggcacaatgtcagcgccagtcccgttggcgctgacacagccaacgtcagcgccaatgtgtttggcgctgaggcgacggcctatttttggttgaagtttttggcaggggttagtttcgaaataagttttccaaaagggtcaatttgtcaaaaaaacgggtaatttttacctgagcatagtagagcaagtctaataatacagccgacctgctggctataaggttttttatagttttctcttagcttatccaaataatagtagctctttataactaatacaaggtccacttgtcactctcaaagtttattggttcttgtgtttaagccgactgtaaatttatagcctgcttcttcttctctctcctccatctcaacatttagcctatttatagcctactattatactctctccgtcctataatataagagattttgactttttacttgcactgtttgactactcgtcttattaaaaaaatgtgtgcaaatataaaaaacgaaaagttatgtttaaagtactttggataataaagtaagtcataaataaaataaataataattccaaaattttttgaataagacgaatggtcaaaaagtgcaagaaaaaaagtcaaaatcccttatactccctccatccctaaatgtttgacgccgttgacttttttaaacatgtttgaccattcgtcttattcaaaaaatttaagtaattattaattcttttctatcatttgattcattattaaatatacttttagatatacatatagttttacatatttcacaaaattttttgaataaaacgaatagtcaaacatatttagaaaagtcaacggcctcaaacatttagagaaggagggagtattatggggcggagggagtatacattgtaaaactgtaaaaccggcgtgacgggaggaggacagacacgcggcagcttttgtggcgacaagtgtgtttgttttcttttctgaaatcccagcgaaggcggcggcactcgcgccatgccagcgggagcaaagcagcgcggagtgcggggaaagagcgatcgacagacaatattgtgaggccccttcccctagccttgcgccggcggcagcgccggcaccggctttttttatcgggcgccacgtcgaccgcgactgccaagccacgtatagtaatgtactgcatctcctcgtccccgcgacgcgaatcgctcgtgcgccgcgcgcggtgcggagcgggcgggcggcccgcccgccgcctcacgttttcgcgtggttgcgctgcgtcgcgccgtgatttgctaggccgtgtgcgagtggtgtggtcgcggcgcccggcgcgcatggtggattcaaccgagagccgctgagccggggaggcgccgagccgtgaggtgaggagagagtgatggatatcacgccaacgccatcacgcccggcccaccatactaggggaggggcccacgcacccctccacgtatgcacgcacccccttttagagcaggtacaatagcaggctataagccagctgcaaacatattttaaagagataaatgaatagagagaagggcaacaagctacaaatatatagccagctgtagcacggactccaagacacagtgtgtgtatgatagatgggactatgtattaatagtgtagtatgtaactattgtataaatgagctattagactggctatagttgaattgaagatagtagttggctgtactattgaacttgctcttaccccaccggagcagcagcacatccccgcttacaggtgggccccccgtatttgcacctttcagtttcacccacgcggtaactctaccgtgccggcttcctgttgttgttgctcgccgagagcgaccgagtccccacctatatattgctccgtcccgtcgcgccttgccgcttcaagtttcccaaggaaaaagctcagagtcgcagccgcacagggagatcgcggagcgaataggggggagagagagtggaggaggaggagaggttgttgcccttcgagaagctctcctagggatggcagtgctgctgcggccggcggcggcgatcgccggcgggcggcaggtgtggccggtggcggaggaccaccaccggcagctgcgggacgaggcggaggcggaggccgcgtcgcagcggctggtggaggcggtggcgcgcggggacgcgagggaggccggggagctgctcgcgtccggccgcgcggacgtgaactacgccggggtggtgtggctcaaggcgcggcgggtggcggaggccgcgctgcgggacggcgccgccgctgagctgcgggcggcgcacgaggagatccgcgccgacgtgtcgccgctcttcctcgccgccggcaacggggacgccgcgctcgtccgtgcgctgcttgtgagtgccctcccctgtttcctgctctgttctacaacttcgccgcattactatgctctgttcgtcgcatgttgaatgctctcgtttggtgcggtttgaatgcttagccattctcgtttttgtgcattcgaactgaatacgtcgcattccccccataaaattagcgtctggtgtcggtggcgaaatggcataaaatttgcagagctcgagcacatttaccatcaatttagttctcggaaggaagcactgaacactcatgcttctcgaaattcacttaacactagtttcatttctcctgaagcattcgagttggtggaaaccttggacgacatttcaaatgggcctagcgggcactgccaagtgccatctccacacccaataggtgctagataaaagttgcccactgttcagtctaatgatctcttttttttttcatggttgctcaggtagtagtattgtttttctatgtgcccatgatgattttaatgtactgtataaatgcacgcgctagacaaatatcatccttttttaaaaagttttatcgccatttttaataagcccaaattatgagtagaagtaggacttgttggaaagaaaaaataagtatacttccaaacttcgctaacttttattgtcgctctctatgatattggaacttcttttcatttttttggtgggaaaccataacggaaaaagttactcatcatgagatattttccaaagttttagaccgaattatgtgcttctttagcaaagtttttttttataggcattagcaaaatatttttatgaacttgtatttttacagttatactactattagtttctagaaggtaagttaccaagtaccagccccgcatggctgcaaatctgcaatgggaccatgctttgcattgcagatttgcagttcgtttttaatgcgtacggacatatttgttctatataccgatgataaaaatctggaattgggacaagcaaataggcagggaagcttcctgggcactctttattgtctagaaatacgtgtacgcattgatcaaggtgtacacgcatacatacggtatagtatgcctgtattttagtaccagtaccatcaaaagcatctcctattagcaaatgtggtttccaagcatttcctataagcaaatgtaccatcaaaatgcatttcctataagcaaggatacgatgctgtgcgcgcatttcctattggcgaatgtggtttccaagcatttcctataagcaaatataccatcaaacgcatttcctataagcaaggatacgatactgtgcgcaagtaccctgctaaagattctgatttccagtaacttctccctgctgcttccagcatcatgcatgctgcgactagaaggtaagcctaattatatacactgcgtgagtgagagtgtttttagctcgagaggactggtgcttgggggacaggggtagatgggtttgactttacctgaccaaagcctctttgtttactgctgctgataatataatgaatcattcctttagcaaaattgataatgtaatgaatctgtgtaagcatcagagggcactggtgttaagtactcctccatagtgtaccgggcttaagtacttaagtaccagctcaacgctttggtagaaaccaatatattcccctcgtgagcttggtcgggggtgggatcacgtgatctgcttggctctgctcttccggtctcccctcgtttgatctctcctgttgatgcaggagtacttactcccggtaatcttgagagtgtagttacgctttggtgctggatcctatggtactttgcattgggccctgtcaccctaatcacactcacgactcattcaaccccctcggggtcccacatgcccgtcactcttgtgatcctgatcgcgtcaccgcgatcggacggctaggggtactttctgaccatcggagaagtagtgttggtggatgatggctgacgagtggagaggtgtggtgcgcggaccgggtgatccgccgatgtcatggggcagcattgaattgaatgggagtggcaagggactaggggagtggtttgcgctgcgacggggcgtaggggagcagccgggcacggccatgcgtgtacttcttcttcttgtttttttttttgccttgcaggcagatgagctcgcacgggccacggccatgagggcctctgtacgactgtaccggcgcgttccatggcctctgcaaaagatcaataaatgccattgccaaggacggcagccaccatagccgtggcttttatcccaaaacgcataggaggtgaaaatgtggaggatctttttttttcacagaggaaaaaaggattgaagaacccgtttggtgagcatgaaatgcatgcatgcatgtcatgctagctgtccatcactaatcattgctccatgcactctctgatcttcattttgcggggcctcctcttcttcttggaacgtcaccctgactcccacaggccacagactgtggaatcagccatgaactgctcatcaataatcacctctcaatgcactctttgttctgcattttgcggggtcttccatcctcttttctgcattttgcgccggggtcttccatcctctacactggaatatctccctgtctacccacagtccatagactgaactgactccgagagtccgaggtcaggtggccatccaaaggccagcgtcgctcggcagctcagctcatgtcatgtctcccgggctctggccatgcgcaacatcatcagtgagttcacatgttctgcacctgggtacacagccaagtaaccggatccgatgtccgccgcttccaatacgtccaagccgcaccagctgtatttgatcacgccttagaaatgaaaaacccaactcctcaccggagtatagccccgatctggccgcggcctcctccacggcaggcagcgccaagggcctccctattaactgacagcaacgcgcacgtcgccgcccaggtgcgacgcatcgatgtgtgcccccacaccggcgcctgatcgatcggctgggccgacgcgggtacggatggatggctgctccttcgctcgctctcctcgcgcaccccgtatgtgtggacggtgtcgtgttcttctttgccctgtagccatctgcttcccctgccaccggccggccgcgcggccagctgtatcctcccttgctgctgcacgcacctggcgcccatgcaacgcacagcgcctctcgcgtacggcccgtgggggcttcgccgatcgggcatctgcgtatgccggccgctgctcagccccgcgtgtgctcatggcctgatggcccccggtggaatattgatggtggcatggggatgccagtgtgccacgtaagtgctgtttgagaacatcacctcggttcagagttttcagagtggtaaatagcagcatgcacagcactgtactcgtggtggtgcgacgaatttattgtgtgatgagaatcctggatgtggaattgaatgcgtctcttgtcttgttgtccgatggatcttgataaaatgccaagggttggttaagcaggagtttacaatttgtatgatgtgtcctgatggtgggatcatcagaatcagaatgtaggagtagcaaggaccaaaggactagcatcttttatttctgagcctgcattgttcatttcttgctccatttgtctttccgtgaacttcattttctctaagagcaaatgttcaaggatgggtagttaaatattcttatatatgatgttgaaagagataaatggttccagtttagataattttcagttagctgtggccaactactgtattcagcgaggctgagctgacattgcggtgaaaccacacatcaagatttcatatatcgatggatagcatcaccctgcagaattttgaccagattccttcttccagtaggaggccccttctgtctcttgctatatgaatcatggcacagtgccattgccacaggacttgcacagactggctagccagtccattggttaccaagtctccacatcaccgacctgaccagacatagtagtaacagcgacatttgttactcggccagctatgtttccaagtcccgatggctgttgttgtgccctgttctgtgctactgtgttggtccatcctgatggtaccccttatcccgcggtgtgtggagcaatgtaggtgaaagagagagcatgcggtaaaaggagaaactgtactaggcatatcagttcttgtttgctgagttactgtccaaaatctgagaaaattgtttgatcaacttgtgctaacattatcgttttggctatgttcatatcattacaagcagaaacttgtgtctagagcaaccagaagtacattctttagcacagtctaatgtttggcgcaaatgtgcatcgctcctgcaggcgaagggggcggacgtgaacggcaaggtgttccgtgggtacccggcgacggccgcggcgcgggaggggcgcgcggaggtggcggcgttgctggtgcgcgccggggcgtcgcagccggcgtgcgaggaggccgtcgtggaggcggcgctgcaggggcaggccgccctcgccgtcatcttcatgggctccgacctcgtccgccctcgcgtcgctgtgcacgcgctcgtgtcggccgccgcccgcggcttcgtggacgtggtggactcgctcatcaaggtaagtgtgtactttgctccatggcttcatagccttcatgcatctgtagagacatcgttctcgttccatgagattgcgcgattaaagatgtgcaggacgatttgatccccgatagcgagcgttgcgggtggtgttgtactgttttgcagagtccagatgctgtcgagcccagtgtgcctagtcacatgggccgtggcccatagggagaagcagatagccgtgttgtggtttagtcccacctcgcttattcttgctcgtttgcactggtttataagacgaagcggtaacccatctagcgtgttcgtagaaaggagagacggttggcatctcccctgacagggacgggaacagtcttcggactttcctctagcacattgcggttaaggctacccgcttcggcggatcttacccaaatttttttgcatccgtgcccttcaattttttttccatttgcacttgggtccttcaaacatactacttttgcacttcgtagttcgtacacggtacacctgtggcattcacatgttttacatttgcatctgggttctttaacttgtacacctgtgcccttctcccttcatatgtttcacatttgcaattcgtttagagtacaattgtgccggcgttcttgcttgaattagtacacgactaaattgctgcagctaatatcgtctgatcttttcgcagtgtggagctgacccaaatgctacttctcgggtgctcctgcgctctctgaagccttctctgcatgccaatgtcgactgcacggcactcttcgccgcgatcgtcagccggcaaatcgccgtcgttcgtcagctacttcaggtatgcaccactccactggtggcgggctggcagcacacgcacttgctcttcagcagccggagctatactaacaccatcttttgatctcatgtccaggccggagtaaagagggacaccaaggtgaggctgggagcgtggtcatgggacacggccaccggcgaggagctgcgcgtcggcgccggcctcgcggacccctacgacgcggtctggtgcgccgtggagtactacgagtccaccggcgccatcctccgcatgctcctccagaacgggtactcgtcgggcgccacccatctcggccggaatctcctccaccacgccgtcctctgcggcagcgccggcgcggtgcagacgctgctggcgtccggcgtggaccacgaggtggccgtgaagacgtccaggagctccaggtccaggcctgttcacatggccgcgcgcctcggccagccggagatcctggagatgctgataggcaagggatgcgacgtgaacgcgagggcggagggcggcgacgttgcggccatactcgccgcgcgccacaagcgcgaggattgcctgaggatcctcgtgtccgccggagcggacgtcgcgctgttgaactcggccggcgagtccgcggcttccgtcgcttgttccgggggctggaaggccggcttcgagcgcgccgttcttggcgtgattcggtccgggacgatccctcggtcgagcgaccggaacgtgttctcgccgatgatgttcacggcgcgctgcggtgacgccgccgcgatggaagttctcctggcccagccagacgtggacgtcgacgagcaggacgtggacgggtgctccccgataatggccgcggccaaggagggcaacgtcgacgccttccgcgcgctcgtgttcgccggcgccaacgtgaagctgagcaacaagcgcggcgagacggccatcgggctggcgcagcagagcaagaagagggacctgttcgagcaggtcatgctcgagttcgcgctggagaagggcatgccggggggcttctacgcgctccactgcgcgtcccggcgcggcgacaccgcggcggtgcgccacctggcgagcgcgggctgcgacgtcaacatcccggacggcgacggctacaccccgctcatgctggcggcgagggaagggcacgcggccgtgtgcgagctcctcatctcctacggcgcgcggtgcgacacccggaccccgcgcggcgagacggcgctctccctggcgagggccaccgcggcgttcaacaaggccgaggacgtgatcatggacgagctgggccgccagctcgtcctcgggggcgcccacgtcaagaagcacaccaagtgcgggcgcggcaagccgcacggcaagtccctgcggatggtcgccgcggcgggcgtgctccggtggggcgggtcggggcggcgcaacgtggtgtgccgggaggccgagctcggtggcagctcggcgttccagctgcaccggcagaggcggggctgcgacgcgtacgagcccgggctgttccgcgtggcgacggcgacggggagggaggtgcacttcgtgtgccagggcggcgaggaggaggcggagctgtgggtgaggggcatccgggcggtgaccagggcggtgtacggcaagagagggaaggagtgagacgcccctgtgttttgttgctccccgtaggctttggtagttcgcagcgagcgtgcctgtaaagagtaggggcgtagagggagtgggagaccgcgaagagtgtagtgggtgtgcccagctgctggccttcagctcgaaggctgggttgggtacttgggttggcttgccatgatgtctttttggttcaggggcctggagtttgtatagcctttggtggttgtttgcttggctaaagttgttttagctgactgcttgtagttgctttccctctgaaatatcagtatcatttccaaaatttcacggtgcgtctcaccactttatctactgagaattggacatatagaacatataagcactgtcaatgtgattgatcaccccaagaaaggatagaagaaattctaatgatttaaggtaaacaaactcatcaatgcgcagttgcacacattagggtaaactcattctcgattcgtgaattcatgagtgccttgcaaccgaatcaatgttttgtcacaagctgggcaggccgcccttggtatcacactgtttcgaatttctaacatcatagttagaacgggcacaaacaaaaaagatatatcttcccggctgctgcagaattgcaacccgtgaactcgttggcatcaaagttgtgtaagtaaaagaaaaaacttctgccagattaacgtcctcagtttccagagatttccttctccttagccttgcacatatcatctgctgactttatgaacttcttggtcaattcttcaacctggtacataacaggtacatgtttgttaccatgtggacttctttatttccaggacaccaaaattcagttactcacctccttctcaagtcgttttacatcatccttcggcataccagacgcagatttctttatcgtatcaagtgcctagaaacaaagaataatacagaattcagatatagtacaatgcatcatctactccatcagcattgatgcacctaatccaattatgatatgatagtccaagaataagtgtttattctacataatgtaggatgttgaagaaactatatttggtgtcaacaatcagaagctataggaaattctatcttcagaactctacaatgagagttgaaccgattttataagataaatagatcagatgaaccttaactactcaatctaaacttgttaaagtaaagtaatacttcccattttaatggatggcaaaatgctatagagaagagggtatacaataatacaccaaaaattatgttgcaccacacttgtctattagatgtcaatttcaaatggaaataaatatctgtggttgtattaacaaaatgtatgcctcacacctagaaatgccaactaaaggcttgaaaacattaatcaactaaaaattctgaacatagcataatagtaatccagatccaccacaagttatcgttttattaccttttggcgcgctcgtctaatactttgtttgaaatcctcggcagatttagtgacaaccttacacagtgcctatattgtggatgcagaaaataatcagcatttcagctatataaaagaagttcaagtttagaatctcacctgtatattctcctttgtcaacctgggagtgcacaaaaatcaaattagcaaaagaaagaaaatttaagagtagaggaatatgcatatcatatactggaaacagaagaaaagtgctactgaatattaagtccagcaattttttgggccatagttaaccaacagattaatcgttgaaccatttctacgagtacaaaatgaccatggaaattaactacattctcacatgctggtctacaagatccaagttgctgatttatcaggtggtcagcactcagcagaacatcactagcatggttgataagaaacaatccaacagcaatacatgtggagtagaaaaccacaataaataatagttagaaacagtataggcgtcacttacggtgggatgtttgctatgatcctgttgccatcaggtgttggattgatgcccaatggagatgagatgatcgcatgctcaatagacttcattgactacacgagtatactagaacaagtcaaaggaagccccaacagaaacctaagtacaaacagcgatccaatgtaacgctgttcctccagagagaaaacatataataaacacatttgtacgaaggctagtatattggacttctgtataacttgtgattaaaatgacaacgaccaagcatgatattttgagaaaattagtcacaatcctctacatataaaatatggataaaaaagaagtgacaacaaaatctattggtttgtcaaagcaacaattaaggaagcaagaaaaactcttacactcggatcataaggcatcactgatagggtatgtgcatcaaggacagaaacaacggccaagcgattcaacgcaaccttaacacctgtagtctccaccatgatgtgatcaagcatacctgcagaagaaattcgtcgcatcttctgttcaagagatagaactatccgaagaaacaatgacatggtaaagattgagattacgacgatacggtaccaggagaagctcttcccgttcgcaatttactaagctcccgtgacaatgcaacaacggctgcctccatctgctgagttgcagcagatttgacagtcggtccaatgtcaggagcatcctgaactgtatcgcctcgaccatcatcctctaatcacatacaacaaaacaaatatgggtgattcatcagagtgaatgctttcatttaagccctacaaagctatgttgcaaatcccacgtcaactgcattaacctaatttgaaaattattaactcaataaaactacatctaatacaagtagtaatcgacaggcaggaaagatttttttttcaacaaaaatctaatgaggaatggggagtggggagtacacgaggagagcggatgaatatcttactcgatttcttccccttcgcgaagcctctccgggcctccaggaggaacagcttcgtgggggccaactccctcgcgccggcgagggatccgacggacggtaggcggtggacggaggtggaagcggaggatgcggcggctgcgcggatggagcgggcagcaagggccgcgcctcggcgcaggaagagcgccatgagattaggtactcggtttctaactaccagggcttaccggagggttcaggggttcttcgccggcgagcggcggcggcggcggcgaacgagggttttgatgggttttgttcttcctttgcggtctcgcagtttttttttttttttagaactcggtcgcagacttgacacttgagagatggggttcatctcatagaaagacaattaaaagatagccaagtacccagggttctttctgcaaatatccctcgcctgtcaatcctagtcgcccacttctctatccaacgggtaacggctgctcgacgtcccgtactggaactttgcaaatgagtcccttattctgggaattaatttggatcgcggtctgtgtttgagatccaaaacttcatgataaaagagtccatgatgtacgaagaactttctataatttgaactgaaatcactagaagaaccctaaagctggattcatggatgtctaggagctagactgctaggagttgtgccaaacaaaggtgtcgacaattgaatttaggccttgtttgtttcagcttaagattattgtaatctgaattattaaatcagattactctaagctggattataataagctgatataaaataagctactagttgtttgtttttctggattattagaggcatctaagggtagtaggtctttagccactcaataatctggaaaaagctcctctagaggagattattggattatagtaatctggcttatacattgtaataatctagcataataatctacttgtttgtttcagcttgctcataataatgcagattataataatcctaagcttaatcaaacaggaccttagtactagtatatacaccctccgttccaaaaaagtccaatcctagctatgaatctggacacatgtgtgttcagattcatgtgtccagattcatagccagagtttgttttttttgacagactagtatgtagtatttgttcaacaaggacacaattcttttttgctatttttgatttgaatagtccgctgcaacacacaaatatttggccagtatagtactccactactccctccgttttcaaatatttgataccgttgactttttagcacatgtttaaacgttcgtcttattcaaaaacttttgtgaaatatgtaaaactatatgtatacatataagtatatttaacaatgaatcaaatgatagaaaaagaattactccatccgtcctaaaataagtgcagttttgcactggtcacatccaatgtttgactgctcgtcttatttgaaatttttcaatgattagtatttttgttgttagtagatgataaaacataaatagtactttatgtgtgactaactttttttaatattttcataaatcctatcttactataaagttatcccccactaactccttaagcttaacatgcaaatatgccacattatcatccactaacaatcatcacatttaaacatcatgcaaacatattatatctttatagtttttataatttaagagcatttcaaatacaaacatgttaaattatcatccaatataattcacgtaatgtttcaacgtatatctttattatgttttatgatatcctatatacttatatagttcatcctcactgatacttagtgcttaaatgattaatctatggtacaaattatatttctattttttctctaattaagtcatatcatatcaattgtccaaactatctccctacttttcttcttctataaagtcataccaccttactttttacatttgaatcaccattctacatactatttaaatttaaattagcataaaccacattaatttacttaatctgatgttatctagttatctgacacgttattttttctattgttatcatattaaattcccgcagcaatgcgcggggtttcacctagtttttcaaataagacggacggtcaaaccttcgacacggattctcacggctgcacttattttgggactgaggtagtaataattacttaaattttttgggtgttgctataattatgtcgacacattttgtgagtaatcacagttgatttcttgttcaatttgatctcccttgagattcatgctatgattgcaataccatgtgcattgaacgtctttatgtgtttcgtgttgcatcgtgaagccaatcaattcaaatttcttatctcgtcagcatgtgttttcatgaaaaaaattacatatctaatttcaggacttacatatgtaattttagaacttacactgtaaatatactaaaattacatatgtaatttagggacttgcaatgtaaatacatgctgactattttttggtgaaaaatatggcgccataaatatagttactctcaatttttttaataagatgaacggtcaaatatattgaaaaaaagccaatggcttcaaatatttaagaaacggaggaagtaaaatttataagatatgaaactgaatccactcaaaatttaatcatggattcttgattctttgtggcatctcaaccttgtttccgaggattctgatactgatgacgaaactcgtccgcgtgtctaatctgccgctggccggtttccatgcaacgtgggatatgaaataccccttgttggaaaggaattaagttgccgatacgttgattgtccagcacattggaatatggacagtgctcctaactcctaatacttgtcctcatctttcgagtgttagtcaactaccgtgagacatacacaggacccaaattaaactttacaacaaataggaatggtcggtataagtaggcgtgttagtccacctggctgatcgtagcctgccgtgcgttcggagttcagatcaccggcgctgcctggaaagtcacataccagtacagaatagtactccggtagctggtataccgtacgataccgtctacggagtggactattccatgtctccgtcaaaaaaaaaaaacgcgtacctatcgtagatcctggctgattcggccagtgaagcccccaaaaaaccgagacgtttacgacggcttcgcgtacgcgccggagagacgggctccacaccacaccaccgcccaccgcgtcacgccgtcgcgtgagattggcttacattccctggccgccgcacgactgacgcccgtgccgtgcagcagcgtgcgcttccgcgacgacaagggctcacgcgcggggagctggggaggcaggtggaaccaacgaacctgcatgcgggggggttgtggtcgatcgatccgccacccgcgtgcggtgccgcaccgccgccacgaggccgttgatagagatatggcccgcgcgttgctacgaacgtttgccgtgccggtgccccgctgcggcgtgttggccgcggctagctctgcctggcgacgcgcacgcacgcatacgcagacgcaggccgaaataacgtgcaaccgcacgcaaaagcgacggtgaaacggtaacaagctaggccccagaccgggaccggacgacgtacgggtggatggaagcagcgccagcgagcgaagcacacgcttttcccctcctctgaaacgctacgcgtcaatgtagtcatcaaagtctatcgatcgatcgggataacataaaaggggtaaggtaattcccaacccaatgaatattgttcatagcattaaataaactgtcacctagaataaaaaatgatgtggcaagtgaataaatgagaaaagagaaggaaaccatatcttgcatatcatagtttctacacaacatccaagacatcatgtgagataagtagtattaaatttaagtatggaatagtggtgtttgtattggaaggataatgtctcgtactagtttttcaatgatgtggagtttataaaaatcatatctagtgtgttgggttaggaataacgtaagatcgagtaggacgaatcccggtgtcccacctagcaaacagcgacgctaccgcgccaacgacagcgtactacgtaccgggcggttcagggcttcaggctgcagtgcaagcctatcgagagctaatttgcccgagacttggtcgttcaactccaacgactgtagtagagctgatagccgggccccgctacaagggcgggaagcagaagaagaagaagtccgcggcgagatgtcacggcggctgggacgactaaatatcgccggttcacttcaaagtctcggaaatttgtctacttcctctcgccctggcctcccttgcagcgatatcgtccacaggctaggcacgaaacttcagcaacgcgatcaatcgatagatttccgtgcaatacataagcaggcgactactttccgcagcttagccgccctctcgagctcgtgcaaacctaccccagaggagttaattatagatagttaactcgtgctgcttgctagctgatcatcagttgatgccggcgatggggttgtgggagagcgtgaggagcttgttcggggagggaggcaacggctgcctacctcggattgggaagaaagagtccgaggatctttactcttatccagtggatcatggtatgtaattttgtttttgtctctctgtgtgtgttgttgttgttgtttctttctccattttgttgacaattggaccacgttgcttttggtgctgaattctcaactgtttctctactccggttagctgtaatttgattagctcaattctgggattctcatcgtgtctgtcagcaggtagacaggccctcgatatattcttttgcgttcttgtgttctttctagctctgctttgataagtgatagtcgacagtgattaaacaggagacaatcgaccatttctactagcatgcgtgaaggattaacagcgaaatctttgcttttttccactgtgttcagataaacggaaaggagcggaccgtgcggccgcggaggaggtggtgacagtggaggtgccggaggtgcccgtgcgcgagctgaacgagatcaccaactccttctcgaacgagaacctcatcgggcagggctcctacgcgaaggtgtacagggtcctcatgcgcggcgcgaggcccgccgtcgtcaagaagctcgagaagccgtccaagcacgcgtccaacgtcgtcttcctcaagcaggtgcgtagctcttctcggtgctttttaccaatgctcactctgctactacttaccatatatatctgcagctgtcggtggcgtcgcggctgaagcacgagaacttcgtcaggctgttggggtacacgatcagcggcgacctccgcgtgctggtctacgagtacgccgccatgggcaccctccacgacgtcctgcacggtacaatctctacttctaaggatcagtcactccctctcatttttttttacaactacgcttgccgaactgctaaacggtgtgatcagcctgggactgaaccattggtgtgtcgtcgtgtgcagggccgagggacggacaggggtggggcggggaggcgaaggcggtggtgagctgggagcagcgggtgcggatcgcgctggacgcggcgcgcgggctggagtacctgcacgagaaggtgcagccggcggtgacgcacaaggacgtgcgttccaccaacgtgctgctgttcgaggggttcagggccaagatcgccgactacaacatgttcagccaggccgccgacatggctcgcctcaaccgctccactcacaccctcggctccttcggataccaggcgccggagtacgtgcacgcacgcacacacacaagcccagctgatctctgtctggccatggctgatcgatctcgtcatggctttcttgttgttggattgggtcgtcgaacgattttgctgaaattttcgttggtttggggatgttccaggtatgccatgactggtcagatgaacgataagagcgacgtttacagttttgggattgttctgctggagctcttgacggggaggaagccgctggaccggacgttgccgcagggtcagagaagcctggttaactgggtaagcatttttcttttctggttttcacatttccttttctttgtcttaatcactgcatttccctctcagttgtaccagctaacccaaagaacattaatatattggtcacctacctcgtctattttcatccttggtcttcctttctcacctaagaagcagctgaaaagctttttagtgaaagatttatctgatagctaagctgtggaataccgaacacgtacttatcaattatcaaactgcaattcgtctgccaaatttcaataaacctcaaaccagaagcttctagccccttgattaaaattttatggaggtcactttccaaaggcgataagacagtaggagatgcatttgtgctatgacgcaagaaacaaattgcatcagtttctttcctaaataaacaacacaatccaacgaaaacaaaaacaatggcagtacgagcatagtactagtatatcttgaaacaaagatgatgctatcacacaatgttcagactctgacctggcgtatctcctgccccatttgatatgctaggcaactccaattttgactgaagacagggtccaggactgcatcgaccccaatcttggcgacaagtatcctcctaccggagctctcaaggtttctctcttaactattcacctgcattgcatttttgcacccaaccattaccatctctatctatgtatctctagtaggtttctacttctaaccgtcagggtgtggcaatgtcacaatgcagctggggagaatcgcggtgcagtgcctgcagtacgaccctacgttccggccatcgatgggcaccgttgcccgcgtcatcaactacgccgtcgtgcgagaccagcaaggcgtggtctgatgatccacgaggattttttttttttttgcacttgttcattttgatttgttcgtgtgaatcaaccgtgtatatgccttgcgttgtgcaggctagttagacatgcaagagatacaattcttgcagtaatagttgaagagagactatatccaaaaagcctctggttgatataaactggtaccggtaaaactttcccaaagcttaggagtccatagggggaaaaaaacagaacagaaggccttattaaggccatgtgtgcaagctagttagacgtgcaagagtatgctagtagtacagtaaatcgctcaattttggatggagttgtttctcttctttttttttctcctgaagatgcatcatctaaggaaaaaaaatgtactgagcagaacactgagcttgttaggaaaaaaacagttcagtagtataaatggtacgaatgttcagtacaattgtgtcccgttaacatacatcgattttgccaaaagaacaaagggaactttgtatagtatgagtgtatttgtatagggtcggaagtcttgccatccgaatgtttgccccaaaaatgttggggtaaaaaaaagagaagagaaaataggataacctgaaacggagctatgaatatttcgtttcattctatagtttacaactgtttattttactcatcatgctacataaattctgtgtgattcatggcaaaaagaatttcttctatacctacctgcagaatcaaatggaagagtttatcagagctattgagaatgaacgtcttacaaagctgttgattgtaataccaacaaacaggaatagaaattgtttgcaacaaaaaataggtagttttgggttgctgtaagcctaggctctcaaatagttttctttggtgctaagggcttctattccatgcccatgagagtacctgttgttttacaaccatgaactggcttactagtagtgatagatagtaccaatcttagtagtagtcatataactaagatgaactctgattccaactatgttacacccaactgattatgcactccttgccttcaaagtcacaagcatctgctctaacatccatctctactctaagcaaaagagaagctactgacaatagtacataacaccaaatcatcaactgtctctgtcagtctcactgatggcagctgcaggttgccgcaaccaggtctataaaatcacctcctaccatcatagtctaaactttctaataggtgacccctcacccacccaacccatgttttgaatttcaatctgaggtaactaacgctaacagtaatacagaaactgatcgtaagcagttccttgcgaatgcagtttcactgacagatagcttacagttgtaacaaagtgacattttcatccaacaaacactgaaatgacacagcaacatatttgtccatgagaaaagtgtgtgagattcacctcaaacagaaggctaaataggcaacaatggttttctctcatcggttgcagtaagatggcttgcctgaaaacatagtcagcacaagagataagtccatgagaaataaagttgtcattcttggttttattcaacaaaacaatgagtcacttacatcatcagcagcgccagcagtcatatttacaaaagaagagtcggatgacctgccacacaaaattgttttatgagattagatgttctgaaatatttcataaaatcatgacactttcacttcaaatgtcattaatatgaagtataaatgcaagggacaagcgatgtttacctatgattctgtgcatcttccggttctaatgctccagctggtttgtcatctttgacctttgccagtggggagaaaaactgaacaagaacagcacttagccacttacatatgttcaactaagacacaataagtagtaggctaaagaatagacaataaaaaatcacctggtgcatcgaaataaacactattgagatgcctaggagaaagttaactgtcaaggtatgtcccaaaaatgcagcagatgctagaccggtaaatattgtggccacggttgatgaatacttcttcaaaattgtgtctgcattacgattttagtcaattgttactaaagcatgggaaatcataacatcatgtaactgaaacacagaaacaaagaattggaaactcaagattgtgtaagagagtaaatcaggtataccatcctttacctgcatacttaaagaagaatgaagagagaatgccttgtgcagcattgttacaaatgagaaacattgtggcccttgaatgacctcgaaggatgtcaaaactctctggccctgcaaacaatggggcaaagttatatcatagacatatagccaatagtccaaaacaaaacataagacacggtacgacactaatggaaggtagtaagatttggccaactcgacagtttgtgagacacagagtattaaacacgaaatacaaagtaatgcccgtctggctgcttggaagaggtgatgcatgcataggctatatgggttcccctcttgaacggtactttaaatataataacaaaacatgctacagtgcatgattttcagtttctgactggtagcgctataaaaatttgcaggatgaaaagacgcactgatttcaaagtacatattcaaccatataccaagctctaaacagacatccaatttcctttgctttgcaacacaaaagacacaagagtcctcgggtaccacatctgttgtttgcaacacctgaaatactaatgagaatattgcatgcatgccattttccatcaggcctaagtcaccccacatgttgactttcaaatactgaaatacattataatgcataacagcatattcatcaccttagaatctaagttgcttaccttgaaatatgacagtccccaggatgccaaggaagttgaaaattgcaccataaccatatagaaacaaattctgcatgttgtgccaagagttagtgtgaatgaagggagagagaagtcaaggaaaaaaaatgtgaacaggtaagcatcaaaaaccaagggactagatcttatcagtttattgttttcagtattatatgcgtgtgttataagtaatttgaaagagttgtaaggcaaacttttttagtgcaaatcacctgaagatagatgcttgtgtcgaactggcttttcaaagcatactcattgtagactgaggcaagtgatgggacagtaacctacaatctcaaatgaacataaatatgaacatctcgattcaaaatttgttcaggtggctgaaaaaatagtgaaaactacacagatcaagatactatgtaggtgagtaaaacttacaaatataagtgtatatatgtatgcaatagtggtgactgcaagaccaaaagatttggttccatcaggtatggagcttagttgattgacactgattccaataagcaacagagcaagggcttcccactgatagccataaaaaaagaacagggtcatagatcagcattgttggaaacatttgaagaacatataattgctctacattttccctaggatttgattcagtttaagttgttgtaccattctagacttcaagtccatttttaattaatttggcactgcatctaaaagtgtcaactactcaaccatcattgctagttacgattctgcattggtactaacagagtttgtgaaaaattcaaaaatatagtcagcaaaaggcaaggcaaaaaccttgagaaaagaggcgaatggtgcctattgatttctaaaatcctagcagtagtaaaacatggaaactgcatgcactatattcacaataacaaaccaatagcctaataggaaaaaacatctaaatgagagaaattcttagctgaattatagagactgcatgcactgtgcagtttaacatgtaatggctaattgtgttttttttttccacaaggaagattcaggaataaaaggaccacaatactaatctcagtctcacctgaattatagagaatttccttctcattatgaattttaggaggatagctatgacgagtaccttgatcaggaataaaagaatatgatattagtaaatcttgcttcttgccaaacatagggaaaatacacactcgcatcttgcaaaaccacatgaataaagcatgggaaaaatggcgaaagagggtaccttcaggttgcttagcatcttcacagttgcagggctgaagtataactgcatgtgcagtacagcagattaaattaaaaccaagaccaaaagctatatcagattggaagactccaaatccgaactctagaaaaaaatcttaaaacatcattggtctctcattagatagattcctactgcaatggcttggaaacattgataagtattaaaattcatattaactaactcaaatgattggacaagttgcaatgacaattaaacagttcaagaggccttgagaaacacttaaggccatctcttttgcattcatattaactaaaagtttctaaatagtttactagtagctgaataattatatctttttgaacattagcttatcatcatatgctataaactccttttcagcattatttcacagcattgtatttcccttgaaacacatgtatttaacataagcataaaatactgatacactgcaggaaaacaagatttcataaagttcaatgaacatttacctgcatgatgaactttaggtagttgttgatggcatataggagagcaggaacagctaagagtgcattattacgtgctgcctaaaaagagaaggattcaagaatcaaatgataagttgccataactagaaagctggaattagagcaatttgatgcataaagttataaataaataaaggaaagctgaaggcaagtcattaaggaataaaaactacaaatgagcttcttctaaggaattaaaaacaaatagacaaaaacaatttgtggttaacactataaacataagtcatatatctaatctgtgtgcatgttgagcacagtcaacaaagagtgcatgctgtgctagcattgacaagataaatcacctgtacaaaggttgaaagtgacagaagtggcttctccccaaccttttgttttctagactgtcaaacacaaataacaacattagggcgaaatactaaaacaacaagactacaagagccaggaaggctgccaatagtaaatccatgactacactgttggtctactgaaaatggtgaattatgtgtgcaaaacaaatgctttgattagccattccagaaattatgtgtgcaaaacattgatattacatagaaggatcatgcatgctaacaagagatggaacatttaaaaaaaaacacttgtagaaagcacggatcagctagaactaacctggattattagcattacaatagcaaatataacttttgtaacctctgtcaaaaagttgacactgataggactgaactgaaacttcccatcaaccttggacataaatactagaataggctgcatatacaaagtaaaaaattagcatggtttgaaaaggttggcaatcagatatgtccaataatttggcagcatattggcattgaagtcaaacactttcaagtagagtggagtacctggaggccaaccaaaatgcagtcccctgacacaagaaggaagttaagcgcgcggtacttggacgatatcttgctgcggtgcttgtcatatgccctcgacacactcctggggctcggagccaccaccttggagtggcatacactgcattccatcactccgttcctctgcatctcctctaactaagcaggaccggaggccccaaaagcacagcagcaagatatatgtatcactctatagccgtggcctctgatccctttgcatgcctgcagcaaaaaaatacatttgtgaactaagcaaactaatcgatgaaaactgaacacatttctctctaaattcacataatctcgcaaattcatgtgtagcaccgctacccagcccatctcaccaaaacacatcatagccgacagcatcaaccgaagtaaactacaaataccagcactaaacttcaaatcacccaatcagctagataatccatatcagatcactagaagctaacttcgccaataaacatccaaaataaatcacgaccaaatgcagcaagcgcgtgcttctatatactagatcacacaatcagcaccacacacaacaacaaccaaaaaaaaaagtagcacaatcacaggtgagcttgaacgacggagagatccgagaggacctcgtatcagcgaccgtaccacgggggagggtgggggggccgggcggcgggatctaacgccgcctgggcgctcggcgccggcacacgcgcggggcgaatctggtggcccctgtccggatcggcgcggtcgaggctcccgctccgcacccccccgcccggcgccgcacggggagatcgggcggtggcggcggggttctcctccccctcctccttggctcgcttcccagatttcgtcaagttccggcgggaggaaggtggaagagggagaggagcaggaggacggcgaaggcggggcgtgcgcttcgcgtgtattttattcacgtttctttctttctctttttttttttgtttgagatgttcgtgatttctcttgttcacgtttgtatttgtagtaactttttttccttgcagctgtctgtgatgaaaaattggtaagtttggtcattttacgccagaatttttttatctgtaaaatgaataatgccatgctataactgcaccatcacactataatgtgtttccatgtgcaagctatggagtaatactctcccctaaaaaagatataaaatggagtaatactttactaacttccattctcaaaaatagcacattcaagttatgtatacatgtatttgtttatgtatctggacctacataatgtctaggtaaaattcttatatatatttgcggacaggtgcattatctatttactcaagtgaataattatcattgttacaatataaaatcaccatatgtgttgctatttcattattgaaagagaagtcatcataggtgttgttacttatccatgttactgtaaatgttctgaactatatttgcgattgattacataaacggtggatacgcaaattatattcaaacgaatcctacaaaatatgtgcgagggagagaggcccaaaacagatctcactcatattcgaagttcgctccatatgaattgggaggtggcgactagtctgaaggaatagtctctcactctgttgaccatttcctttgcgattcgtgctacagtgataatagtaacttgttgtgtgtcatttactcgcttcctattggagcacgttgccagcgtgtatattcaaatctttccattcgacgcatgttaggtccaggtccaaacacactggcaaattctcaggcgaatattctaattgattcccgtctctttcgcaaggaagagcagctgacacgatcacaccagctagccatcgttacagtggcattttgagtttattctttttctctatgagagctcgttgaattgagcctttagcgttgcttttgatagagagtggtcatgagcaatttgcttggaccactgtccaccaaaattttcattagtgaaagtagatgcaaaatcctatctacaaaaggtaataatcactgctatatagtgtaatacttactgaatttgttgtaagagccatattcttctactcatatttgtgtcgtcctggtatgaaaatggtgcgattttttttgcggggaaaagcactcaattactcagacatggggtcatcactgacaacccatgataaaaaaatacaactgttccctggctacaggcctgacaaatactcacaccgagctttattcgctaacctacgactagctcggttttggctccgatgagctttatacaggaggatctcccctatcaccgctgaattaattcttgatttccctgagaataaacgccatctccgacaactccctctcctttcactgaatcattgcatcgctacctgacagtcagtttcaaccacaatcggcctgagaaaccattaaagaggaagagccagtccttccttgagagcaaggatctccgactctagtgcatgacatgtgtccggaattcagttatggttactaatatgtgtccgtactttgaacaaatctattttcggaattgatcccagtacatgacatctccggtaccctttcattgcatttatacaactacagctgctatagcagctgtgtttcttataccatagttgtactataggtgcatcttcagcaatttgagctgaacatgttcacaattttgagcggattctttataatatatcgattaacttcttatgtcgtgcgatcaaattttgaccttctaagtagagttattttccactgtttttggtgaccccatataccagctatagaaagatacaaatccaaaagacctagtaagatgactttttgagtggacaaaggtactaataaaagttttagattgcatctttgttggagttgtttgcagtgggatgtaggttgggcaagagtgcacacaactattggcttatcatttgctcttatattattgtttcatatccttttgtaaaagctaggtgaaaccctacgcgttgatgcgggcatttagtatgataacaaatataaataatgtgtaatatagctagatgacgtaagcttacataagttgatgtgatttacaataatttaaatagtatataaaataacgattcaaatgtaaaattaaagtgatgtagctttgtaagagaagaaaataagggagataatttgcatcatagattaattatctatgggcaaaaaacaattgaggtgatatgacttaataagagaaaaaaaaggaaggagataatttggaccatagattaattatataagggctacaaacaattgatatgatgaactcaagtaagtttttagggttttcttaaacaaattttactgttttaggatctattagatagagtttgccttttgtacatagaggtagatttatttcgagtttgtcttttctatctcttcgttgatgtctatttgttaggtggatcctccacggagacctataaaggtttgtctattgggttgctgatgattcaatccgtggcactggtagtattgattgctaacatgtcacaggaacggagatgtcagatgatgcttagtcatgttctttgtgtgtgcttgcgtttttcaacggtgttattgtgcttgtctattcacgttgcagcaatccaacatatggagctctttatcttttttgtgaggttttatacttcttgttcttgtgacaacaaggttatagttatatttcttattccatccgtcccacatagaccttgtttctagaaattctagaacaaatcagtagtgcggcgaattgatcaaatgtttctcattaattcatggttacaattcttatgttctagtttaaatgtgtatctggagcatgtataacttagaattaaacacctcgtggacggcggccagcgggggaggccacgcgctgctcctccgccgcccaccgacagctcctcccccaccactgccgcgttgcccgttgccgccttcatcgctgacgcctgccaccgaggctggtgcctcgcagagaagggacatagaagggagagagagaagaggggaaaagagagaggaggttgatgtggcctcgctgacatgtagggtccatgtggatcgcacgttgactcagccgccacatcggataaatcgggttcaaaaccaccgaatgacctaatgtgaacggttttgtaaattgagagataccatatatctagttttacggttgaggttaactcaataacaagttgaggcatcttgggtgtactttttacctttagcataatcgaacaaggatgctaacatggcatacaaacctttccgggctccacatatgtccacgggccgacttgtgacttggagcacgtacgagtgcacgacacggaccgagcctgaactctgatgaagtcgactctcaaaaagggtccgtctcctccggaaaacagaacacggctcggtggagaaaaccgaaaagaggaaaaagaaaaaaagaaagaaaaagaagaaaaatcctagggctagcctccgcagacacacgccatccgaaattcccgtatcctctcgagtctcgtcttcctcggcgccgccccatctcagccggacaccgcggcggcggcggcggcggacaggctgttcgcgcagaaccggccgggacgcattgttccgtcggtcgcgcgatccaggccggaggagaggggaggaaggagggggtgggtgagtcaacccctctctctctctgatcggaggtggtagccctcctcctcgtcgccgggaggcggctgatgcggcgcccatggccacggcggtgctcacctacctgcagagcctgtggccgctctccgctctcctgagggaggacgacctgcgggcgtccgcgcggctgctgcggggcgtccccgtgccggaggagacgaagcagttcgtgctcgcgctccgcgaccgcgagcccggctccggctcgcgcgggggcgtgatctacatcctcgcggcgcagaacctgtccgagcggtcggcctccgacgccgactccctgatcaggcgggtgcgccccgccgccgtggtcacgcagctcgcgcacacggcggccgacgacgtccgggccgaggaggagtgcctcgagggcggcggggccggcggcgtcccggcgtccccgttccaggtgatcaagaggtgcgtcacggagaagaggagcaaggatcagtacgtcaaggcggcggcgtgccaggtcttgcaggagattttcggggtcgggttctacggccatgtcttggccgcgaagagagccgcggaggagacgggctcgtgttttcttttgctcgagtctccgtatgagaggaattgcaatggcggcgcatcgggtggccaatctaccatggaagaaggctcaggtcagcaattggcgagtcgctgctcgctcgctcaaagttcaacggatgatggcacgggtggacagtcacagggtagctgcttgctcactcagagcaccagttcaatcgtaagctcgcatgtcaggaagatatgccttgtggatgacattgggggacaactcgtgaagtcgctagcgccgaccgttaatttgttgatgtcccaggctatctcttctgatggtgtttcagagtgcaaactggctgaatgcaagccatcggacagatacgaggctccaccttttgcacagactgtttatccgttgcttgctgatctttatgatatatttgtggacattccgtcaattggaaaagctatggcttctgctcaggaattgctcagacaagttcatgatgggaagccaatttccactgaaatgctgtctgatgtgtatgtatttaggatcgcaatagaagccctcaggataggtttaaacaacgcaggaagaagccacattgacaccagagataatcatggttcaaaaaaattggatttttcagaactcaactctgaggagaaatgccatattcttcttgtgcaagccctcagaagccaggttagggagtttggttctgtggtggctgtagtcgatgccagttgcttagctggaataaggagacactgggatacccctgttccttcagagattgcacaattagccagcagttgcttcaagcaatacggcaataaaaatgacagtgaggacaatgagctgccatcatcagttgacagcacagataaaaagagttgggtagctgagaaacctgtggtcgtagttggtgcaggaggaacagcgattctgggcttttcatctttatcaaaaactgtacaggcatctgcctttcttaagctggctccctataaaacaccggtggtcctgaagtatggcttaatacagctgcaaaggcatgcttccatcgtgttaagcaaggtcctatcgaatggggtttttagtgctagttcaaacgcatccgttttacaattcacagcttcatcggagaagattcgagcagttactcacactgtaatttcatcagcaaagagaactagcttgatggctatgcgaacttcgttctacgaaataatgcagaagaggcaaaaacaacctttcaggatcactccttgggcaacatttggttgcagcatggctgcatgcgctggtctcctgatgcatggagacgggattgagtgtgctgctgaggtcgcaccttctgttcccatgattgccactctgggacgtggtcttgagatcctgcgcctcacatcgcaggaagtgaggcaaacaaggggccaacatataaaggaagctttgggcgcgctgatgagcaacttaaagaaaacagcaaaataaagacataacaaaaaaataactgagactgtatagatttccatcatgcaattttgttgttagatagatttttttttgttacctctgtacagtgcattcttcttgcttttactgaggtaatcgaattcctacaatgtgttttggggcggttctacttctggagcatttcatccatatcagcccaccaaccttctgtacatacatgtatacaacatatgcctaattgacatctctaatgctttcttcgggatcatctttaatgctttagtaactcttattgaatcagtgctgataccgataagaatgtgatgcagctatctgtaatgttctaagtgaaataccacctggagatactgccacatggacagtaatgcttatcttttgtgaatcatcgtcttggctgttctatttgtgtttatattttcccaggcctggttcagccttgtgaatttgcatatctctgattgccccattcatttgctcactcaatgttgtcttcaagcttatctgtgtacttgactgcccttttctttattataaacaattatggttgctcattgttgattttgagctaaggacaagtggtcaatagtatccattgtgatatgcacttgtgttacatataatagtgtataaacatttgtctcatggttacaaaacaatgtggaaagaaaaagcatccttgtgaccttagttgctaaaaattggcggatgccgcctatacaaaagtaaggggcctcgcccatctgtaacacatttacttcccatttcttcagacagttgctgctttgagggtgagaaaatcagaaatttggtttgtgtagaaatctggctggatcgagttgtcagggctctgaagcatctgtacagaagtgacacctgcaaaatgcatccaacacttggtgcttgtactaacataaaatcagcagagcatgcatagttcagaaggagaggaggatcaaggaacctgaaaggaccagaagagttttgcaacctccgttttggccaaacaagatgtcggtatccaaacggtcaccaaccatgcatatctgggatgttgtgatcccaaacctgccacagaggtaaacgagaagaaaggtaagaatctgaaaccatccatccagctacatttctgataccgatggatgaaacatgactgctgctgagacagttggcctctcacttctttgccaggtagtccatcatgaatgttgacggcttcccgacaacgagcggttcttgtttagttgaaccaagaattgcaccaaccattgaccctccacctggtgaaggcaaaatcttcatcatcttaagcatttatccatcatattctaatgtaggaagagctggaatgcctgactaacctgcccactcttgggcatcagtaagatgggtgacggcgtcccggtttgtggcaatgaaaaggcaccctggattctcacgaatgcacagtgtcccgtaccttcagaagttgattagttgtaacttgtaagttagcaaatcttttgtattggttttggttaatgccaaacttatttacatgaacacgagagctaagatgtgatttggcaacacaggcagacagcattggtcaacattggtaaagaactgcaatcatcaattcatcatctgaggcatcttgcatgcatcaattatcaaatggatgcatgattatgatagaactactaatctgattctgcttgccttacatatatgttcatgtcttcttgacaatggaggaaagaagaagaaacttactgtactttgtagtagttaaaatagcgatcgaatcccacaacaactgctccaacctgtgacaaatccaaatggttctcagtgcaatgatcgcattttactgcaaaccaaagtagggatcgtagttacatctttgtcatgttccatgtaaaatccaggcttcagctctatcttcttgtctccatcagactgcaagatgattgttatgtgtgttaatctgtcccaggaatgcagcactgaacatgggttcagaaattttataacttactggcccgccgaggtactgaaatccagccagctccagctccttcagaatcccgtcctctccaatcacataaacctgaacaataaaaatgttaaccttgcgcaaatattatttgccaaaattgctgaacatgaacagtaaaaatggtaacgttgtgcgcgtatctttgcaccaaaacatgttaaaacttctgaagatgatgatatagattagataccttcttgtctttggggaaatcgatggactgcaggtacgcggcagctgcgaacgacgaagcgaagatctcttcctgcgtagagcgttccaggctcatcagaccagattggttggacaagaaaatttggcaaagaaaaattggcagttcatggcatgaatcctacctcattgacgtttagtcccagcgtctcaaacttcttcccgtattgcttcctcgacttggtcgagttgttcgtcacgaacaccagcctcttgccctgcaacgccacaaccccatcatcatcagcttcaactccagcagattgctaatgctaagttggactcggagttcgagaagatcattgcagtttgcgacggacctttgatctgagcatgtcgagcgtctccggcactccgtcgatcagcttgtcgcccttccaaatcacacctacgcaaacaaaaagaacgcgaaattcataacaaaatcacaatcaatcaaaccatcgagcgatcagtgtgccatctcaccgtcgcaatcgaatatgaacgtctcgacggagtcgatgagcgcgtcggcgttctccagcttcgccgcggggaccgcgccggccgccgccatcacggacctcctcctggcagcacagcgctgaccggccaccggagaagaaacggagaccaatccacctccccggcggtactggctcctcccgaaggtcggggaggacggcgcctgctgcggcgagggcgaggcggcggaggtggaggggaggaaggtgggggaggcgcgcgtcaggagcatcgcggctgctgctgctgctgctgctacgtgcgtttttgtttatccggtggcgtctgtttggttggttggtgtcgtttcggtttcggcgaatgtaacggtcacgtaggagtatgtgtagtgtagcaagggaggctgctgctgctcatgtggcgacgatgatttgtggctgggagcagagggaggagggatcagggatttggggtgtggccggctagtgttgtggctgtcaataggcacattggcacggcgtctgtgaggctcaggtgagaccgtgaggagaggaagcaatcaagcaacatgtccggtccggcatatcaatgtaccaaatggtctgttcgatagaactttaacttttttaaatttagcttcagaagttaagtctgtagtggaatcgtacagcagtctaaactcctaaactcagctccatttctttagttcattttgtaagaacgctccacctagctccattttcattttaggtgaagctaaaactgtttgactgtgttttagttctaggagagttgaagctgaaactgtgctaaacaggcacttattgttacttgggatttagcatttgaaagaagctcacgtactccctttgtaaaaaaaaagataagatatcccaatacaaagaactggacatgaacaaatttttcatttttcgtgcgcatacttcttaacgaactaaactatacatttttttttaaaaaaaaactaccgaaaaattgctttaagtaatcatattaatctatttttaagtttaaaataattaatactcaattaatctaaattaatggctcacgatactatttttgtctcccctcaaacacactttaatgctctctttggaacataaatttttggtgagagataatatgatgccaccaaattcttactcataggtacaagtaggtacttctagaaattgtacagaatttacttgtgctaggttagatgacaaacagggactacaaaagcctgctacatgtacaaataaatttctgctaattttattggtgtagttttcatgctatgtttggaatagatgaattttagtaagagccgatatgccttcttacctgcaggttacacgtgaaatcggaggtgttatataatatacttgctccgtccctaaatatttgacgccgttgacttttttaaatatgtttgaccgtttgtcttatttaaaaacttttgtgaaatatgtaaaactatacgtatacataaaagtatatttaacaatgaatcaaatgataggaaaagaattaatccttacttaaatttttttgaataagacgaatagtcaaacatgttttaaaaagtcaacaacgtcaaatatttagggaaggagggagtactattttgtttgttcaacaaaaaaaattttcatgtataacaacatgtgggtttgcaattaaaagattttgtaagcctgctttggtatagttttcatattggtttgtatacgtcaggtgttgcttatgatgaatttaatttactaataaacagtagaccttttgacataaaaatacagtagatcgatcatttgtgtatttgtttttaaaaaatatttatataattcaattagacgttgaatggtagttaatgccacactgtgtgccattttctaacccttttgtgttataaattattatattatgatttttctacttataaatattgcattatgtttcatttggcttaatttacttacatggttggggcttggaagccaacaagtgttggctaaacttctctgcagtttgcactcgatatgtttgagaggaataagatgtgatccacacgattaatctttttgaaactcatcatcacaatatcggtgaatattctcgatttctcctttggctctatccccatttctctatattttttaatcgtaatttgaggtatcttttattattgtgtgtacacacaccccttatcagtctgtcttctgtttcgtaacttctgctagttttttcgttgcttttaatttgtttgtagttgcttcatggaagagttttttcgttgcttttaatttgtttgtagttgcttttctagtctttgtagtcgtctcccatttgtagatgagaaagatgaactgtggttggtttctcattatattagttggatgtttgacttgtaaatcctgaatttgttgtgctccagtcgtttacttatgttcagttgtcattattgtaagctcttctgaattttgttgagtcttgacttttttcaccagtactttggtgtaaaaggttatccttttatatcatccttaattttttgttgcttctttgtacgcgtcatgtgcttttttcatgagttgaatattaatttgagcccctctccgccgccccctaaggcttttgattgtggttttgttcttttcctccctctgttagaccattgcttttgaactcttcttagtttcttcacagtattgttcaacctttttgaatttctttcgattgggtcaatggagtaattcaaccaggagctaactatccataccttgccgtcttcaatttatatagcattttatttgttcttgttctttttatttcattatctatgccaactattgtatttatttgaggtgcacctgacgcccaagaggttgaacctgaacgacatgcatctccaccaaagctatttacctagtgagtgtcgctcaacttttgctctaccaaattcttcattcgatgaaaatgcatgatgttggtggtttgaaggtttctgtgctagggaaaaccataagggaaaaaaattaccgtaagagagcgcggcaacaagtgttgggtatattgagctgggaagtcatgacagtggatgttggaaatatgaggtgttttgccatgctatctagctactactagtagaaccattctagatcattgttttttaatccaatggatcatatttattatattactggtagtagaatattatttttctactggtggtagaatttataaatcaatgttggatatcatttttctagcacgaaaatactggtagtataaaattaccactattttttgatttttttttgaaaaagattacctccactattatcactagcttgttcctattctctggaaaaagagcaccgtaaaatattagttgttcttgttctcttggttgggacgtggagagttgtttgtagatcgagttgaaagttggatcatccatgaagtttttttatgtgtaaatcattggagtatgcttttgtgttgcaacttgtttatacatatactccatatggaatgttgaacgcaaggccatggccaccgtacctggcaaaggcctgcccgtcaaatataatcaaaggtaactgtaatattattcaatttaaagcaccagggcacatatagtttaggatcggatgctccccactttctgctagaataggtccttcaatgtattatgtatagaatctattctacgttgaaaagagatttcctcataacaaaaaataatcactacactatgctaaaaatgcgttttttttcccagccacacttagtgctctaatagtaataattacgtacttagccaactatagcaatatatggctgtacatattgagctatacagtggtgtatagtatatgtacagaatctattctacgttgacactagacaagttttatctcataaccaaaaaaaaaatcactacattatgttaaaacatgtgttatttttctcagccacacttagtgctctagtacacctcataattacgttagccaactttagcaatatggctgtacacgttgagctatagtgatatacaataatgtcaaacttgctgcatccaagtatggcaaggtattgctatacattgccacatacgataggcttttactccttcattaaatgcgtccacctagtaccaaatcactttcagctttcaaatctcaaactctttaaattcccagccttgaatccacctgacctgtgcctcgtactcccataatcccatttcgcatccggttctagctttccttggcttcccatttcctcgatctccagcgatgtcgctcgccgacgacctggccgccgtcgagcgcggcggccacatggtgccatcgaaggcggcgggtgtcgacggcgacggggagccgcggcggacgggcaccatgtggacggcgagcgcgcacatcatcacggcggtgatcgggtccggcgtgctgtcgctggcgtggggcgtcgcgcagctggggtgggtggccggccccgcggtgatgctgctgttcggcgccgtcatctactgctgctccgtgctcctcgtcgagtgctaccgcaccggcgacccgtacaccggccagcgcaaccgcacctacatggacgccgtccgcgccaacctcggcgggaccaaggtgaggctctgcggcgtgctgcagttcgccaacttcttcggcgtctgcgtcggcatcaccatcgcctcctccatcagcatgctgtacagtaaaccaaaaccctttctctgatctctctccgccgccggcgccgcgcgccacatctcgccgtgaatctttacgctttctttcttcgcttcttgtgcgtgcgcgcgcgcgcgcgcgacgcggcgaacggcggcgagcagggcgatcaagagggcggggtgcttccacgtgagagggcacgaccagagggaggcgtgcggcggctcgagccggccgtacatggtggtgtacggcgcgctgcaggtcgtgttctcgcagatccccaacctccacaagatgtggtggctctccacgctcgcctccgccatgtcgctgtcctactccgccatcggcatcgccctcggcgtcgcgcagatcgtaggtgagtgaggagcgaggggctcgttgtttcgttgtggtttttttgaagtgcttgacatgtttgagatcgagtttgcagcgaacgggggaatcaggggcaccatcacgggcgtcttcgtcggcgccggcgccggcgtcacctcgatgcagaaggtttggcggagcttccaggcgttcgggaacatcgcgttcgcatacggcttctcgttcatcctcctcgagatccatgcaagtcaccgttcatccggatatcactaattcagtatcccgtttgatctttcttgattgcttattactatgcatgtgtgtttgtgttcgatatgttccattcaggacacggtgaagccggtggcgccgccgtcgacggagacgaaggtgatgaggaaagcggtggcggtgagcgtggcgacgacgacggcggtgtacctgatgtgcgggtgcgtcgggtacgcggcgttcgggaacgactcgccggacaacctcctcaccgggttcgggttcttcgagcccttctggctgctcgacctcgccaacgccggcgtcgtggtgcacctcgtaggcacgtaccaggtggtggcgcagccggtgttcgcgttcctcgacgggcgcgccgcggcgggcgcgtggcccgggagcgcggcgctgggcaagaggaggcgggtgctccgcgtgggctccctggccgagatcgaggtgagcccgttccgtctggcgtggcgcacggcgttcgtgtgcgtgaccacggcggcgtccacgctgctcccgttcttcggctccatggtggggctcatcggcgcggcgtcgttctggccgctcaccgtctacttccccgtggagatgtacatcgcgcagcgccgggtgccgcggggga

SEQ ID NO: 63615 - DNA, 5032 bp, Oryza sativa
  unsure (1)..(5032): unsure at all n locations
gttacaaacaaaaacttaaaatcccttatattatgggacgaagggagtaaatcccttcaaatcccatcaatcccatgagagggattaaacgaatcaagcctgatagtcaaaactgaccacctgagccagaacttgtatcgaatcttgtactgtctaatattgcaaattcgcaactgcaaacagtaagatgctactagcaaagtaatagtagcaaagtactagcaattagcaactcgtgtagtcgaacgtgtgtcaattgctcgtgttcagttcagagtagagttcagagagcgttgatgggctagggctactaaaatttaaggcctagcatggcacgaggtggcgaggggcccagcccatcagtactcctgttatttcccccattttaggcccagcccatcagtaccatctcttctttttccattgagtaaatttcagaaaactgtaactttagtgataaatgtatcagtttgctgcaactttagcgacatgtttcagtttgctgcaacaatagcacggaaaattatcataaaattgcaatttttatgttatatgctgctacagttgtcacatatatgtactgtagcagcatataacgtaaaagttacagttttgtgataattttccacgctattgttacagcaaactgaacatgtcgctaatgttgtagcaaactgatagttttgtttgcagttttaaatttactcttttccattttactctctcctcgaacactctcgatggctcgatctgaacatcaggcacgagagacgagagcgtcatggcatcactctcaagcaccacctctctctccgccatgcagtggcggagcggcgaggcggcatccgctccgggcaagacggcggatggaggtgcgtccttttatacttccgtgtacgagaggagagagagagagagttgggggcattgaggtgaggtgggtgctgtctggactctcgggcacagggggcgtcgcgccacgcacgcttggtgtttgaggaaatgcccgcgctgaccaatagatgactggtcaatcggcgacgtgatctgatggagactaatggagttcgcaatctatttcagacttgcaaagtctgcatttttgcgattactgtgtcagtaactccaatggccgtagcaaaattacccataaagtgcggctgtttgattttaggcataatgacgaaagaactgggggggggggatgggttgactttttcttccttacaggctactgcagattctatcctcttcttttacctggagtgtggaagaactctgtgggtgcctgggtggcgttcagctgagctagtacgttaatgttctgtatgtttgtatttcagcttctgggtctcggcacacccagaaggttgtacgtttttgtttagaagttttgattgtgtcgtgtttgtactgttttatccttcgttcttagtaaaattctaatgcaaaaaaagtacgaggtaccatgcgcctccaatatttggaaaaatataaacttcctctatccaaagtccaaacttgtataggtctgtttcatctggcaataggacaaggaggcattgaaaatgatttaatcatcccctgattatatatcaaagtgttccaaaaaatctctatcttgcttaaaatttctctaaatctaggattaatcaaatgcatgtatttgtatgtacaaagtaaagatgggcatttctcagggcctcggcatatggagggaagaacacacttattttactttgaatataaatgaggtgtacactgatagacaagactattatcaaaaacaaaggaggggtactccattaaatatacaagttaggacatatttgcacatgttccataaataggaacacgatcaattagaaccagacagaagcatgatatctcaaagaaatttgtctgcaaaaatgcagaagctatgactggtactaacaatgttatgtattcattgtgtatatattttgttacatttgttgcataaacatttctgtccaaaagtggaactgagggccttcactctagactaatctcgagattcgacagattattcaaactcttgggtatgtgcagctttggacaactagatatgtgcaaggatctcagagaggtgaaattcttcaaccattctgggaaagtttccaaatttgtgcactctgttattgtcaaggttcggaggaatgacaaatgctgcatgccatggggcaaagaaatcaattctgtgcaccttgaaatatgaagttcctcaatacctcgagttctctcagcccctcacattctgaacactctaatagcccgtcacacagggaaaccgacagagatttcaggttttgagagaaaccttccagtgctcctctagatccaatcaatttatcgttgttcaacaacatgattaagcttttgacaactgggagtttcacatgcactgctctaaattttgggcattgggtgatagtcaattcttgaaggtttgggaaaattgcttctctctgtgatggaagccatatttctaggttgcgcatgtgaaagaacgagagtttctccagtgaggcgaatgtgccatcatccccatagaattcgtcacctacacgtgtgacagcatttattccacttaattcaacaatcttgagaagaggtaattgccccagtggaggtaggcattcacatgccaaattaactagcttgatctcagtaagtgattttaagtatgctggcatgcttgttatccatgatggaagcttctttgctggacatgagaaaatgcataacactttcaaaccacggtttggcttaagaagttcaagtatttgctgtgcttttgaactaatcataggatctgtacagcttcctgtccaacttaatgccaaagacacaagcctatttttcttttgcaggattacattccttgcgtcatcaaaagaagcattttccatattgcaaatactgagttccttcaaactaactaagggacgcaactctgagatggtgtgctcgtgattttccgctgcaatgtaccttggcaatatctcgaggtttctaagttggttcatctgacagggcatttgagttagtaaaggacattcaagaacgtttaggtaggcaagacttttcaagtttttcatgcttcttggtaaaatagcaaggtaatgacagccttcaaggtttaggatttgaagattcacaagattgcttacagattcatgcaaatgaagaagtttttcacaatgagatagatccaaaacttgcaaagcttgcatctttccaactgattctggcaattcagcaatctcagttcgtgaaaggttgaaattcttcaagaactgaaggttgcatattgaatctggtataatctctatatcattgtgggagagattaagataggctaattttttaagcataccaattaacttaggtactcttttgatcctgcaagattgcatgtgtagtacacgcatatctatcagacatttgcagaattcttctgggatgtctgtgattgagcacttcttgtcagacaaaagcatcttttcatctctgagcaagattagtgtcctcagatttcccatttcaaacaattctgttggaagctcagttgtcttcgagtcaacgagtaaggagaggcaccgagcacttttttttgcattttctacaggccaaactaattccttcctggcatctattgctaagtgaaatcccctgctaatcatttgtgcaagaagttgcatcccagggtgcatcttgtaaatagcgtatgctttgtgtcgaggtttctgcattacatcatagtagtgttctgtcattatcttggagaagtacatatgcatgtcagatttgctgcttgacagttttatgagatcatcagcaacaaacatgccagtcaactgttcgggagtaaagctatgaactgggaacagtgaacagtatagaaagcattgctggatattggaagggagttgttgataactgacgtaagttgcatccaacagaagtgggtctgcgtagaaaactaggtcaaatctgctcaggacatgctgccatgcaacttcagtcttccgtatgctcttgagcttgtttgatgcactgagtagtagtgagggcacgccacaacatgtgtcagcgatcatttttcttattggaattagccgcggcggcaactctgcagaattttgcatccattgtgtgagaaggtttgaagaatcgattggtaagagacgcttcanagtgtatggtctgagagagttggtcattgttacaacatctggaacgcgactagtcacaatcatcttgcttcctgacttggcactctcaaggacctcaatcaatagcttccatttctgcagattctgaccccaaacatcatccaagacaataagaaactttcgcccgcatagtcgctgcttgacaaggcactgaaggctctcagagtccactgtgttgcattgcctggtgtttagaaattctgctagtctgctcaatattatcatatcatcgaaactactagacaccacgacccaaattcggtcatcaccaaatgtcttgacagcccatggatgtgagaacactaactgagcaagggttgtcttcccaattccagccattccggttatgggaagcactgacaggccagctttgccatgatcagcttgcatcattgttagaacatcatccacttccttttcccttcctagtatcccttctggtcgtatgctatgtgctccttggcaaaccataggtgtgctgatatctctatgtttggctgggaatcggattctatatgtctgtgcatagcattcttgcaattcaactattgattgtttgatcttatggacaatgcggcgtcgaaaagggagccttctaaggatgaatgagctgtgtacctgaattgagaagacccttgtttttggtagaaagcaagagaccttgttgagcatgtcatcaatgtcaagtgtgagagaccagagcttctgtagaagctggtggtactgctcgttgttggcgctgatcatgagaagtgcactgtcgttgatgccac

SEQ ID NO: 63616 - DNA, 10015 bp, Oryza sativa
atttgagccacttgtgatgcgtatttctgaaattgcgcaacactattttgggacagtgggctcatctgaaactggtgagaagggtcctacagtgcctgaatttccagagaagatcaaatgggaagtgcaacatctcgaagaattgtttgagggcattaaagaagacaaggaggaggtctatgagggttttaagtctgttagccttgcaatctccgagtggcagagaagattggctatagcataccaaaatgcagctagagatcctcgaccttttgagggaatgaaatgggcaatggagtatcatgagatgtgggttgaagacaataatataataggagctggtgatgagatattggattttgatgaacatgagctttttgaatcacttagatatgtcaagactgcacaaggtggttcagaagctcatctcctggaaagtatcaagagtgggatgcagtgcataaagaatgtgttagccaccattcgatcaagaaaggaagcagacaacaggagctggtgcattgtggaacaggtcttctccccgctactgaaacttttgaaaactatcaatcatctagtatcagaagcggccgcccgcaacaacaagtgtgagaactataagatccttgtcaagatcgatgctgaagtcaactgcttacaggatgcactagatttgattgatagaaataagaatgaggtttatgagaacttcagattaatagaagatctcatactaccattattaacattccttaaggccacatacaatgatcaatcagaatctttgagcttcctagatgcagtcaaacacggagtgaattacttggaaggtgtacttgacaagattgagcagaagcagcgggatggaaatgataatttccacattgtcaaagcagccttctcaccattgttgacatgcatgtacaccttcaggcgcatctcgttggaaaccttagcccatgaagataaatcagatgcttttattctgttggacaggatcagagatgatttgtcacagctcaaagatgtacttcagatggttcaagagaaagagaacggaatatacagtaactttgatgcaattgaagaacatattgatgagatttatgacggacatatgaatgttgaaggttccttaaaacttaaccagatgggtggtctgcgagacaagctccagttgattcatgaagagataacaaatatacggggaaaggtggatgactctttcaaggtccaggaggtctcatgccatgtcatgcgcatggctgcagcacatgaagcttcatcttctcatcagttgtcagcatcaaataccttctgcattaccatggaaagtgcgcagatgtggcagctcaaagttataattgatgaactagagacaagattgagacactgccttctatgccttgctgtgttcccagtggatgccatcatcaagaagagactgttaattcactggtggattggagaatgttttgtaacttcggtttctgaaggcaagagcttctttaataaattgctgctgtccaatgggttcattacgccagtaaagaaataccactgtgacaaagtccactcgtgcaaggtgcaaccttggatccgtgggctactgattgaagctgcaaagagcaaagcatttgttgagctcagttcagatggcagctccaggaatgactttaccaggacccgccgtgcatgcttgcatgctggaaagatccttacaaacttccatcctgatgttttgacgatttacaatatcaagcaacagtatgtagagttaaacaagacatggttttctgaaaagaaccgtttgaccactttgcagttaggacaatggcacgatgcaagttatgaccctcgggcacatcacgttgagattaacaatgccaagttcctaaagcaggtcaaatcctgcaagcagttgaagtacctgagtttgagaggcatatcaagaattgaggcccttccgaactcaattggaaagctctcaagacttgtcattcttgatctcaaagcgtgccataatctagaggatcttcctaaagaaatagtaaaactagtgaagctggagtacttggacgtttctgattgttacctgctctcaggtatgcctaaaggactaggcaagctttttcaacttgaagttctgaagggatttgttctatcaaacgccaagagcaaagatctatgccatctcaatgaacttgtcatgctaaaaaagttacgaaagctgagcattagaattggttatagcatagatagcggtcagtttgcgaattttggtgagctctgtgctctccggtcgcttacacttatttggggggcacacccaatatctacacacgggagttctccaagtcatgctgctcctcatgcaatgccttgtgttctccccttaggtcttgagaagctggagctccgttgttttccccttgtagaattgcctcactgggttagtcctgaaaagctgagaaaattgaagaagctctacatcagcggaggtaacatcagtgacctgggtgatttgaagtcctgggaggtgactgtacttcggctaaggttcctcaaacatatgaactattcatggactgccctgcatgattcattcaggaaactcgatgttttggaggcacatgaatgtgaaaatctacagccctggccttcctgcggaaaagggttatggcggaaagaaccgaatggaacgattgcacctgtgttgacctgaagtattgagctgggtccaatagggtgcagaattactgcctggaaatgggaatattgaaggatatatttgatcagcagtatatctgaattctgaagacattgccaatcactgtctggtaagatggcaattggcaattgtcctgcagcatatataaagatattaaacttctaactgtgttacatttctaagcacaaatccttgcatactttcacattgtcgaatgtttatagacttattgggcaacataagtcaaaaaataaaatgtactcgtcgattggttgcataggcttgaaagctgcaagtaacaagtgatcaacttgttttgaagttggctccatgactccatacagccatcctctcccgtcttcctggcatcttgttgtaaacctcctactgatgagtgatgagttgaaagaagatgcacacggatattagagtaccagtctgatcaggccagactgtgttgcaatcaacttcatcctgctgcagtctgcagatgttgcagatagtgaaattcaactccatttttctgaacccttgtaggatgttgaatttcatttcttgagcaaattgcccgatttataaactcatcagattatactagtatctacggttcgggatcggactgtatcctgccggtaccgtacacaaatcgaattcgttagaacctccacaaatattagtgccaccaagaactcagaaggcccggaacacgatggcaacgaaatccctccagcggccaaggcgattcatcatggcgccgatcgcctcttgcggcagcggcggcatcagcagatgctacaccgcagccaccaccgccgcgacgatggccagcggcggcgtccggctccgcaggagaggcttcgtgctgtgcgccgtggaccaccacggcgtgaggcgcgccgtcgtcggcggccagtttgtgaggaagtccgagctgaggcggcaggacgagctgctcgtctccctccacgagctcgtcggcgtcttccgagagctgcagcgcaagctcgggttccggcagtgggacgagttcaggcgcgcgcagcctgagctcgacgtgctgtaccagcaggctgcgcttccagggcaagcggtacaggagccgcatctatggcgagcccatgcccgatttcgacgacgccgtgcacgccgcagttcgggctccccgcattggtgatcgccgtgtctgcagccgttgcagcagctgcgactgttggtacagcgatctggctaacttgcattgcctcgttcgcaagtttgtgtagagatgaagcccttgttttactctcttgtatatgaaactccgatatgtcttgctacaacaatgcttatccatgtttaaatcagatcttacatagctttgccacggacaaccatacgtacatgctatgatgctaaacacagcacacacgacggctaccttctcataacatctcgctactgcaaattactaggagggataaaatggatggaatccaacagatcatcactaccaaatcaccaggattgctatttagcgcacaccttttcatatgaaagttttcatatatttttttttcgattaaagttttttttggacgaaaatttttagaaaaaagtgtgtgctagtaacggacgtttgactaataatagcactataggcaaaatcacatctacgcaaaacttgactaatcctttggcacggtttgaccaacactacaggcgcggtatttttcaaggtgaatcgtgatccgccgatggctcgacgtcgacgacgacgcgtgggtcttgccggtatatgtacctgctcgcccagtagaggtagttgacgaagccaagcagcccgacggcggcgacgacccagtagaagaggtcgaggcggctggtgttgagggtggcgccctcgagccacccgccgccgccgccgccgccgtgccgcctcgtggccctgttcaccacctgcaccagcagcgtggcgagccacgacgagaggccgagctcgcaccagaacagcgccgacgcgatggacttcatgccacggggcgcctcgctgctgaagagctcgaggaggcccgggaacgacgtcacgtcggagacgccgagcaggaagaactgtggcgccagccagaacagcgacatctgccccgccgccgcggcgtcggcccgccgcttcctctccacgacggcggcgatggccgacgccaggatcacggcggcgaacccggcgccgacgcgctgcaggtgggtgacgccgctggcgtagcccgtgcgccgccgcaggagcggcacgaggaagcggtcgtacaccgggagcagcgccatctggaacgcgctggggatgatgaagagcgtcgccggcgagacgtggatcctccccagccgggtgttggtcaagccgccctgctgcacggtgaaggtgaagaggagcgggttcgacatgtagccgatcagggagctgatgaagacggggagcacgcggagcacggcctttgtctcctccacgttcttcgtgctgcagactgaccaggccccgtctttgcctccattgatgcaagctttgtcaaggaatctgccaagatgcatgcaaagacaaaattttagtattgcactctgccaagaggacaatgctcaattgccaatattttctgctttgtattcaaagtagtctagaaaaagtactcagtatttcgttgaacatacttcagactactgtttgtttgagaagctatttcagttacttcagtagagcctccttgctcagtgcttctttcttcctgtgcttcttccagcttctcaggaagttgaagcttcctgttcttgaatgcaaccacaagaacctgggatagatagatcagaatgcagtcaactaacatgcacaggatctcttttcttgagaattgatgttgacatcatgttttgacccaacaaggagcacaacctacctggagtatccgagttagcggacttccttcgggtacatggttgcggtacaaagggagaccagcagcaaccacaagcagcccaagcaggatcaggaacgcgcacaccccaaacccgacatcccaccctttgctgttctccagccaaactatgaggatcaatcctatgaaacccccaaaggagattccgaaggtgtaccagttgaagaagctggactgctggcgggactcggaggggtcttcatggtcgaactggtctgctccgaggggcggcatacaagcacgcatgaagccatcgccaaaagcgctgatgtacagcgctgcgtaaagtaggacggcattcctgccatggacttctctgcagctgcttgcctctgcttccgcgttgcaaggcggtggacggagagagggaaggtaagcttgcagtgcgagcaaaccgtagccctgcatatatgattgccaataattcgttagatggttgaatagaccaagaagcagattaccagaaaaaaatgccaatttctttattattggtaggtttgcgcacagtaattggcaacggagaattaaacaaaaatagtttcctttgatcatattaggcttgatgtagatagttgagtaaaccaaaaagcgaattaccaaaaattccaatggaccaaagaggagtattgttctagctcgagttatgtaagagtctgagaggaaagctcctaacagagcaaacccagatgtggcaccaagaacattagtgactgtagttgaagagcttgagattcccatatgcattgttccatagagataggtaaccatattcagcatgtttgggacattgactgtgcttgtcaccacagtcagaactgtaagagatcgaaacatgtataaaatgcttcagcgatttaaagaaagaaaagaagcttgaaatggaaagagtaactcgtcacatgtctgcatattactagtaactagacaaaatcacataattcaggaaacatggataaagcaagtcaactggcaatcacttacaatatacaaaccatgctgctctgactcctccatgcacctttctattaataggatttcccctccagtccaaaaagcctccgactgccatggtttttctgatgagttcaaatatttctgatgagttcaaatatttctctcttgattactgcctggccattgcagcataagggggtataaatcatagtagatagacagttgaagtcagggactcaggacccaggggtattgatcacagatggataagtcaaatttgaagaagtcagaaaaacaaaatgacaaaaaaatattcttgaatagtatagccgtcacctaccacttgcaagcaccaacagtccaacactaaagttgactatcagattcagagttcctactccctactaaccaaaatatggaggtgtatcctgacaatttttttaagcaatctgtcactggcatgcattgacactgatgtacaaatatcttagataaaatgcatgtcttcaagtccaagccatcattctggactatcttgaaactaagctcttaatttattaattggtctgagaagtcgtctttaaagacgcttcctatgagaatcattgctgctcaaattatgagcacgaaatgcttatgcatgagttacataataaactctaccaattaggttaacctactattactcttgattatcagtccaaaactcaggtttgtaacttacagttgatttcctccatattaaccatcatggaacaacccaattgtggttttaccttttaatctaagcatccactactctacaatgcgtcttcaaggagatggcatcagctcgaacaggatacgcatatgaaaagtataaacaagagaaattaaaacctaaaaccctaaaaattattggttaaaaaagataaccaaaacatatttgctactcccattattcccttttacttgacactgtttacaagtttgattttatctttgaccaataaaaacttttaagttatgatgttttgatgaatgcaagtagttaattatatttaacatgcaaagtactttgataatataatatctccttaaatatttttaaatattttttataaaaaagacgaatggtcaaagtttgtacatgaatagtatctagtgtcaagtgaaagggagcatagggagtagctattatttttaatcatgggccgatgcaattaatacagattgtctgaaatgcacatcagtagcaaaaagaaaaggtttcaaattcaaccacacccttaaccatactagattagagaggtcatggtggctaaaacaatgatttacttgtccattggcagctgaatgggtgattgtccaaaagcaattaaatttcatcaagctgaacttcgagcatgcaacacatatacagagaaaatcaacttctttgtattgttgattggtttcaatttgaaagaaacaaatataattttctgctaaggtttgtggtgtcctgctgacatccttgtttcattggaaggcattcattgagcacaatgttttcaacttttcattcttagtataaaattacatatttttattatgacatgacataattgaagcttgaagaccaagcagaaatgatacttttatgtcagtacagtacatactctcattcttcagtaaactagtcagctatactatttttacaaaccttgttagtcatcagtttaggtaccacaaatattgatgttcttcctaagacacagtttacgcaactactttcaatattgaaaatctattttctggccttgcaagatagcgacagatagagataacatcactgtacgctagattgcattgattgtaacttgtaagttctgtcaagctgccataagccaatggagattataggatatctttgttacgatctatacaacacagacaggctaacaaaagaaaattaatcacaactctttgttttctcttacctatctattgcatactgtttggatctttaagctccaaaattgtcgccgtctgatctaacagtactgacccttttcttgttggcatatctcctagcccagaatgcataattgataaatgccaccagctcgaaggttgccaataacaagaagaagcgatcaaggcgtgtcctgttgaagtttgttccatctaaccatcctcttccattgtctccaagccttgtcattctgttgacgagctggacaaaggcacatcctgaccaggctgctattccgaccagaagagactgcactgctggtgcaatatgctttgcttcaggtgcctcgctctttatgaactgaaccagcccaccaatatatgctatatccatgatgcttagcaggaagaactgcatcaccagccagaagacggacattgggacaccgtcagctactaatgttagcccttgctgctccacgaccatcaacctctttgcttccaccaacatggcaatgcatgctgccattatcccacacgcagaggcaacaccgatgtgctgcagaggggtgataccattggtgtggcctgtgaatatcctcagcagtggtatcaagattctcctgtagcacggttgcatcagcatgtgaaatgttgttgggattgcgatgagagaggcagagggtatctggatcattcctatccctgagtccatcgtgctgccaacctgtatggttaacgtcatgagcaatgtgaagggcaagtaggcgaatatgcagctgatgaagattggaagcatccgagtaatagcctctgttttctcatcaactcgagtagtgctgcagaaaatacaaattgttttttcccgtcatgtattcaggatttgtccacaaatatattagggtattatggagattatgatttccacaaaaataggaattattatactcttggttctcaacatttatttaaaagttaaaagttcatacattgttttcagaaatacattgttttctggggatttttttattatcagggaacttaccaaatatttttgctgtcacatttgtcttccccgtcctcatctacatgatctgatgtactgatctcttgcagctcaataacatgaataacagcagcctgcctcttctttgatgatgtgacaagaacctggaaaggtaccagtaatacaacttcaaaacaatatgatcttctgttttccttgctttgtcttgctacattcaattttgttttagattgatgtgtggaaggactgccctaatttctttattgcttgtaattaatctgttatctgaaatttctagaaataggcatggtgactttccagcaataagcatggaaggtagaataatgcaatgtaatgctatcagacaaaagagtataaaacataacttggataacagcatccttcttgtat

SEQ ID NO: 63617 - DNA, 3394 bp, Oryza sativa
ttctactatggttcaaactaatgctgaatttgctgaaaatttttagcttttgggactgaatatggtgactccacatccaacattacgtacggatcctacaaagttataactaaaaagaagatctacttacgctctaaacttgaagatttctcctctttcatatccttaattcttagttcttaccccctacagagaaacgcctagggtctttcggctaactccacaaggtgatgggctagacgatctgagttcgaagcatcacctcttctaattatttgatattagatccttccctaatattcgtgtttttttaacataaaaaagaagcacagaaaaggttgcaagaacacaatatccaacaaatatgaaaacaagagacagactaaatgaaaacaactaattcattttccatgcatttacccaacaagacacaatatacctctagttacattctcaaggacgataaaattacctatacaacaaatttattttccatgcactacactatatgaaaacaagagtcagactaaatgcatctccctaaacaagaaacagaaacacaaattaatgtgtagctatatattattacaagaaacgattagaaacaatagacaagactaaatctacttaaagttaaaacacaaatgtgtagtgcatgcatgcagtggcttaccatagagaaagactgttgccttggtgcctccatgcttccttgcatccactgcgttccctctccaatctacatacccttcatcaagtgccatctatatatgcttctccaaatcagccttaatgcacatatatatacaccgttgtgcccaaattacggaccacacaagaccgcggctgctcctatctctctatatgtttggagagtgttttcgaatctcagaagagacaagtaattaatatcctggacatctcatgatcaggagacgatggctaatatatataagtagctagctagctcttggtgtatatactcacgtggtctcctgtgcatttcccacatttttcttcaggtgacgcggcgtatggactgcgcgcggggctccgggacgtggccaaagatctcgtcacgtttaggctgcgttggggtgagggttttgggtaagctaatactatatcaatatacgcgcgagtatatttttcaaactattaaactgggtgtttttataaaaatatatatatataaatatcgtaaaaaattatacaaatctatcttttaaatttataatagttagtatttaattaattatacgctaataaaacataataatcagctaactctcgatcaaactcagcctaatgatgcatgtgtttactactacgtggcttgtcccgtcgctagctggtcagatctccgctctccggttagcctggagcttgcctgtcgctaccgctgcagatctcccccgaataatttggattttctgagtggtcgccacatcttccccgcgcgtgtcctgcgagttgaaattacgagtgtcagtaaactgaaacggcttgtaaagctgtgatgcacatgccgctttgacaaatttcaatatcttatgtccacgtgatcctctattcaatgaagttttcatgtgctgtaaattagtagacatgaaatatgtttttcaaggatgttctgtgtgtaaagatgattaaaataacagtgcatcactgattttgttgtgtgccagaagattcagaagatcctctgaatgctgctcttgatactagtagtctcttgcactgggggcagctatatcacgactaattccatgaggtaccaggaaagtaggaagagatataattgggcattagtaaaattttgtacggtcatagacatacagttgtattggagttgtctctgaatgatatattttgccacagaaaacgaccacttttacacacatttgggtcggaatggtacaaaatgtacatttgagtcgaaatgatcaacgaccaagtccagccaatcaactgaacacaaacagcatgatacaacttacatcagtacatggttaccttttgctttgcatctgtgaagtaaatggtgcttcaagagcaatcaaatctatcacggtgagtcctgatcagctgatggggtgaccatgcgtggattgtgccggtaggcatacttcttcgcccagtacaggtaattcaagaagccaagcagcccgataacagcaaccacccagtaaaacaagtcaaggtggctgttgttcaagcttgtaccctcgagccaccctctatggtgtccatgcctcgtagccttgttcaccagctccaccaggaacgtgcccatccatgaagcgagacccagctcgcaccagaacagcgccgtgccaatggacttcatatcctttggtgcttcgctgttgaagaactcaagcagcccgacgaacgatgtaacgtctgacacgccaagcaagaagaactgaggtgcaagccagaagagggacatctgcacagctgcctccttcctctttctctcgacgactgctgcaacggccgatgcaactatcatggaggcaaagcctaagccaacacgttgcaggtgagtgataccgcaggcatatcctgtgcgcttgcgcatgaacggaacaaggaagcgatcatagacggcgagcattagcatctggaatgtgatggggatcacaaagagcgtcgcgggggagatatgtatcttgcccagccttgtgtttgtcatgctaccttgttgcacagtgaaagtgaggagcagagggtttgagatataaccgatcatggagctgatgaagaggggaagcattcgaagaacaatctttgtctcctccactttcattgtgctgcaactgaccaggctccatcttcaccatggttgatggaggcttgtcaagaaatctggcaaaaaaaaaagtgtgcagaagagtttataacatttactaaagaatcatattctcttaaaatccatgcatgatgtgtgatacccttaactgaaaaaatgtgtgtatcttgctgaagcttacttcagaaaatttgtaggacgtggtacttcaatagaatccagtccattacggttttcttgtgcttcctcaagtttctcgggaagttcatatttcctgttcttgaatgcaaccacaagaacctggaaaaggcaatttttcagataggcggcagatatggaatggtgattttctcctgagagatggaaatctattatatctataaagcaatagaaaaaagagccaccacgttcgctctcgcggcctaaaaattaccacgttaatcaaagaaaaaaagaaaaaaaaacaaacggacattattcttttggaaacatgacatactaggaacatactcacgcacgcattgtataggtttaggaaactgatcacaactcttaatcggatgaaaattagaagca

SEQ ID NO: 63618 - DNA, 5163 bp, Oryza sativa
  unsure (1)..(5163): unsure at all n locations
tatatatgaatttagaactaattgaaagtcgaaaataaaaataagaaaaattaaaagtaaagtttagagtccatataaaaatatatttagaaataactgaaattcataatttttttaaaaaaaaaagaagattggaaaaagagtctagagtccatataggaatataatttagagataattgaaatttgaaattaaaaaaaatattggaagaagaatctagactccaaataggaatacaatttataaataacataaagtcataattaaaaataagaaatattggaagaacagtctattgttcatataggagtacaatttaaaaataacagaaatatgaaattaatagataagaaatattgaaagagaagtataaattatatatataaataaaatttagaaataactaaagtaaaaaacaataaataactttcacgcatatacattacagtatgaatattgcgcattggttagttttatcaagttagtacataaataatttaaaattatgttgtcatttcaatctattttaataataaaatgtgaatatatatatatggtattttatgggaaaaatataacgatgatgattgcgcgggccaccatgctagtttaagtttataacctgcagtatccgagttagagggcttccttctggtacttgattacggtagaaagggaggccagtggcaactatgagcaacccaagaagaattagcagtgcacacacgccaaatccaatgtcccaccccttgtagttctcgagccacactattagaatcaatcctataaatcctcctaaggagattccaaaggtgaaccagttgaagaaactggattgttggcgggattcagagggatcttcatggtcaaactgatctgctccaagtgatggcgtgcaagcacggatacagccttcactgaatgcccaggtgtacaagcctatgtgcaatatgacggtgttgaagccatgaacctcttcgcagttgcttagctctgcttcaatattgcaaggtggtggatggagtgaggggaggtaggcttgcagagcgagcaatccaagagcctgcacaagtagattgttaccttggaacttaaaccagtatgaagcagaaactacttgttcggtggctgtgagcaaagatagaaacttatatccagatattaagttttaaactagtgaaagtatctataagttaattgtctgaagaaaatcaatgctaatttaaccacaagcaaacaagaagatgccgatgtacttttttacatagaggtcctttaatatctttatcaagtaggcttcggatcaaggttatgccacagacccacagtaggtgatgaccaaaccatagttaaaaattcaacagaatatattcctttcaaaaaaaaaaaaaagttcaacagaatatgatctggtgttttggcttaattcacacctaactaattctgaaggagatataaaattgttttccttagcaacttgtaagaatcttgttttgtatgtatcccaagttcccagctactttgagcttgggaaaacgatttagcaacctaagcttttgaagtttcaggcaacctgcagctttttcgatatcggtgtgattacagctgagaataatgttagaagaaaaaacagaggcaacatgtgaaataattttcatgggtttctttcaacatctgatgtaactatatgatgctattagtttacattcattagctgtgattaaaataactgcgacgagtactgtgttttttttccccttctcttggcaggctgtcactagtaaagataaaaagaaagtgaaatcaagaaatttcaatggatgatacccagaatatatagaccgttgaatagaccatgaggcaaattaccagaaactccaacggaccaaagagtagtatggttctagagcgagtgatgtacgagtctgagaggaaagctcctaataaagcaaatccagatgtggcaccaatgaagttagtaactgtggttgcagagcttgaaactcccatatgcatggttccatggagatatgtaaccaaattcagcatgtttggaatattttccatgtttgttaccactgacagaactacaagagagaacaagcataaaaaaacacttcgatttcaataggaaaacctactgttagtgagtaattacacaaataacgcaagaagccaggaacaatatattaatcaatggactcagtagagcaacttacagaacataaaccatgcagctctgactcctccatgtacctttctgtctatcgggtttcccctccagtccacaaagcctccaaccaccatcagctacagatgaattagcgtcttcttgcacttgattactacttcttcattgcatacttccattccatcataggaggtatatatagacatatggtatactttttttttcctcgcaaagtggccccagctaaataaagaaagatgacaagtgaaagatcattggctattctatgcaatagattatagatgttgcccccaacagaaccaaccacagacgattgttgacttatagagtcaccactgtgcagcccaactgccaagaatgcagtaagcaagatacgataattatccggcgcactgtatttttccttctctcaggacatcgcgcctgaaaaagtgccaggcaggaggctacaggtgaagcatttcatcgaacatctgaagtgccttccttcgaggccgcagggctgcaatgcaacccaacccagcaaaccacttaaccacccccaatgtaacagatgactcgctcaatcacttcatcggtgcatgggaggactacgagggaataagcaggaggccatgctctcctatcgaagaggaagactgagcaaaatttcaatggacatgctgcaagaatggtaggcaaaaaaaggtgaaaattagactgctacttcagtatgaaacagcaatggtaaaatagctgctctttacgcctttacggtcttacccatggacatgcacaaccgccgtggcaggcagcccagcgcattggctcgccgcggggggcttcccatggaggctggttgttgatcactattcactactcttccccccaacccctcctacccctgaacgcgagcgggcggcggatggttcgggccgttcggctcgtcctcctcgtcggcgtcggcctcggcctcggcctcagagcatcacggtcgtggctcgtgaggagaggcggcgtcgccctcgaggctcgccgcacgccggcgctccgggacggtggggggcggtgatctcgcccgatgggcctcggttgcgcaagctgggccggaaaaggacagacacgaacgcgtctccgcacggttgggccgggccgaaaaacaccggacttgccggcccggaacgggagggcggaggctggggaggcggtggcggacatctccgagggagacggggatccgatccgacccttgctgagctgcgcctgagatgccggccaacacatccactggatgatcctcctcggctcctcgccgccgccggcgacgacgacgacgaaaaggtagcaacagaggtgtgggggaagcagacaaatgtacaacaccttcgtccgcattcagaggaaagatcggacagtatcacagtactgctggtttgtacgtgtttcctggtaggtactcctatatcgtatctgaagttctgaatatatgcctccaagctagtcgtgtgcttcgtctgaatcagtagtggtgattactaaaagtggaatatcctaatgcatatggtaacataaaaaaaaatatagctcttcgccagaataatttatggtgatcatcttctatgtaatgtcagctcaagaagcctcctctgatgatctatgttctgcttaacaaaccatttcctggcaacaaatcttgcgccatactagatcctgtcagacaggtaaaaatggagaaaagaaaagaaaattccattgtacagacacattagttacaaaatacatcatctgcatataactctcaaggtttgccaagtcagatacacctggtggaggaataacgagcaagaatattaaagcgataattttcattcctgtttctgtccataacaggtttttaaccgtctccccggcacatctagcaccggaactatacacttgtgacggcaatgcacaaccagtatagctcgtacagtccttcccatgtatacaagattcgacaccaacacaacctgattcttcacccacccaatgctgaaattatcccagtttccaccatgagaaattgacaatacatgccaggtgacagaacaatgatctagtcgctaccacgtaataaaatttggtctgcatccagatcttcctaaaacttcccagctagagagagccgatagaaactgagggtggcacggccatcttaaaaagggagccagccaccgacccttgccagcaagggcaagcaggatgagagctggctcactacggtgcagcgcccaaaaggctctggcgattgccctggtttccccatgctctctccttccacaggagctcaacctgctcaaagctgaggcctttagtctccggcacgtagagagccacgaagatgaaggccagcaccgctattccggcgatgatcaggaaggtcaggccggtcccaaccaacccgacgatcgagaggaatgtttgtgccacaatcaggttagatacccagttgacagtggctgacatgccaccacacattccacggtatgcctcggggtagatctcggagttcactgcccatggaactggccccatgcctggggagaagaaggcgatgtatagagcgagtcccgccaccgcgaaccatcccagtgcaccttggcaggcaccattgagtgcattcgaacagatatctgatgatgactgcagtatgaaggccattgctaggatggcgagggagaccaccacaccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63619 - DNA, 5917 bp, Oryza sativa
ggaagccttggggtaattgatcaccacacagtgctgaataagttgagattcagaagactattctttacactaaaaccttgcatagatggttatcgagaaggttgcaggccatatgtagcaatagatagcacttttttgaccggcaagttcaaggacagctatcaactgcttgtgctgttgatgggcatactggatgtacccagtagcctttggagtgatggactcacagaccaatgaaaactacaaatggttcatggaaagactttagggatgctattgctaatacagaaggtctcacaatttgtacagatgcaaggaaaggagtacattctgcagtacataacatttttcgtgatgtagaacatagagaatgcatgctacatttggtgaataatttcaaaaagaggtttcatggaaaggtgtttgatgataacctctggcctgcagcatactcatataatccatattttttccagaagcacattgagaaaatggatgaagcaaagccagaggctatggcttatttaaggaaaaaccatgttaggctttggactagaagccaattctctgggcaatgcaaggttgattatgttacaaataatttggctgaatgtttcaatagctggatcaggccacataaaggattgcacttggtggatttcatggacaagattaggcacaagttaatggtgaagtggaacaggagaagatcaatttcaaaaaagctagaagggaatatactaccacacattatgaatgaattgaatgaaaagagcaggggtttgaaccatgaggttacaagaagtgatgatgcattagcagaggtggagtgcaagggaggaagtggccacaggttagtttttttttatgttcattgcaacttaattgccaagtttgtgcacttcctaagtataccatgtttgttcttttgttctggtggtaggtttgttgtcaatcttacagataggacatgtagctgtagagagtggcaggtttcaggcaaaccatgcacacatgctatagcttttatcacatccatccgaggctgcaaacttgagaattttgtagatgagtgctactctgttagtaggttccaaatggcttattcaaaagtaatccctcctttggttgacaaatctcaatggcccaatcctacccatgacttcttgcatccaccggttctaaaaaggtagcaggcaggccaaaaaggacaagatatagaggttgtagtgaaaagggcaacccaggaggagttaacaagggcaagcattagtgcccgttgtgtaagggttatggtcatcattggcatagttgcagagagggtgatcctgctgattaccaagcaatgctagctgaaaggtaacctttttaattgataataatgtgatatattttatgtttaccctcattgtaaattctgttatacaacctactactcgtttgcaggggacctccaaaaaaaaggcaaaagtctagtaatgcacatgctgaaactagcattgtacatgttcctagtgcatcttctgctcaaaatgcaatattgtctgcaacaatgacatatccaccaagcaaaagttgtcaaaccgggaaaaaaggacaggacctcagtaatacttcatcagggtcagttaggtatattagttccatctaccattgcaataatgacttcctcatatgcttacattttcctttaccatttatgtcaatgtcagatcaaggtcagtgacaggatccaaccaacctgaacctttgagtgtgttgatgccactagcagcgcctggagagaactctaaggccaaggctaagacagaccaaaactaaagccaagatagctcctaggaagaatacaaaggatagcgctgctactacgcctttggcacaagtcaaacaaaaaggcaacttcattcctgtgtctcctgatagtccagccatgagtacaaggagcaaaaagaaatctctaaattttaattagggatcctttttaattaacatgtgctcacatattttggtactgtgatctctggttgcacggtacttatgtagtactccagttaatctagcgttttggtactatggtgctgatgcattttagtcatgtatatggtgatggtactgtatgtggtgagatggcacttctatggcactgcaagacatgcatatgtgatggtactgtatgtggcacttaatgatagtgatgcattttggggttgtatgcaaatctgtgatgagagatgatgcactgtatgtgctgatttcaacatttatgtcatgaccatgttatttcagctgtatgtggcttttggtggaaaattggatttttcatgcttttgttacaaattcatatgtgatgatacattggtactgtacgtggaaaatcggatttttcatgcttttgttggaaattcatatgtgatggtactgaatgtggtgatgcaaaaattcatttttcacatccaacagctatattagcactaaaatgtacatacatatacatatcaaccaactttactttgtcatgcacatatcttgccaaatttcacctaattgttataactggttctatagcaactagtaagggcaaatatgtcattctaacatcctattaacagtgatgagccggaggggtgacggcagtggcatatgagggtggacaatttcaaactagtggcatagagggaaaaagccaattttcagtggcatataagggacaaggctaatttggcatgcatatagagaattctccctaggatatataggtggccgcacgttggcgtcggatggttggccgcgggcgcgctgggcgtcgtcctcctgtctgtcccagtgtccccctctcgcgctcgccaacttgggcagttgggcgttgtttatcgcgaggcttccgtaccaggtgggcataaatctatacgccaacttggagcggccggtagaccacggctagctaggggggatgcatggagactccaaaagcgcggccaagttgcagttgcttgcttcccttcatctctgtccgtgcttggatggcaatgcctgcctgcctgcctgagctggctgcctcgtccactcgtacagtcacagtcatcgtcggaagctagccggtgatctctcaaatagtactagaagttgtacgccgtcgtagcaagtgcggactgcatgtggccgtggtgcggccgggagcagcgctcgtgcgtgacatgaattctgggcccttctgcttttggatgtgcagtatgcatgggggcgattataagcgcatcaagtgcactgtgatagtactgtagtacgactgtacgagagacccgactcctgaggattcttggccaaaactggtactaccacctgaatgcgcagtagcttgtttggaagctgaccgaggaaagagagggaaaaatcacgcgcctgtagttctgaaagttttgggaaagagatagattgaacagaagagagtacacaaacggagagttagcgtaatacacgagaactagcatacaaagtacatacggtctcgagagacgattgaacagaatttcccgtcatgcatgtacggacttggagtgtatatagctaatgctaaacttgccacttgaccagcttgtaccacaggagtacgtacatgctagtgtgctactgtcatcacatcggtcctagatgctcgctggtttgtgattctataaaccgtatctagctcaaacaaagccggccgctaaacacgcacgcgcgtatgtttaattaactagacagagtcacaagacaaggacagaagaccacgggttgcaagtaggagaagacctacttaaacaactcttccattattacaagcttataaatacgataacaacaggtgacgtacaactgagcaactgtcgatccaaatgcaacgaaccctgtgcgcattcgaggcaccgatcgatctcatcccctataacgcccggacccacccgggccccgatggctgatcgattaaccactagctggatcacccaaaccgtcggcgcggttgtgtatagtccgagcagcgcggcgccggtgtggtggtggtggtggtggccgactggccgcggtttcccaaatgcgcagcgcgcgaggggtcccgcacgcctcccgcgtccccgcatgaccgagcgcgcgcgcgcgtcatcgggacgagagagagacgacgtcgtcgtcgtcgcgcgcgcgggccagcgccccagccagttgccgcttacagtaagaggggggagtgtatagtacgatccacttgtcgtccacgtcgtccgcaccgcaccccatctcgctacccatcccccacccgcgcgcgcgcgcacggcgcacggcctccacacgccccggcccccgagaccgtatcacgagcgcgcgcgggcgtccagcttttctcccacgattccacgaagccaccaccaatatttccggtcgtccgatcccccctacccctctccgctgatcagtcgctcgctcgctcgctggctgactgcgcccgcgcccgctttgctgcgctcccccggcacgcgacgacgaaaagaccggcctcaaaagcgacaccacgcagcagacgcagcgcccccgcgcggagaagctagctaggtactcctgtctggttagctagctagctatagctagaagcctagcacatgaacccggcgccgtcgagggcgccgcagcggcagcagcgcggaggggagatgtcggcgcgctacggcggcgggctgcagttcttcgctgacgccccgccggcgggggtggaggggggcgccgcgaccgcgcggacgttcttcccggtgccgggcgggggaggggagcagcagccgccggagcgcgcgatgaggcagcagcactacggcggcggcgggagtggtgcggccgagatctcgctggggcacggccacggccacggcggcaagcaccatttccatcagttcggcgtcgaggcgaaggacggtggcggcggcggcgaccagtcggggtttctgacgcggcacaacagctcgcctcccgggttcttctcgagccccgtcatggacaacggttactgcactctctgctcacttaattacgtgtaccttcgatttgccgtcttgattcgtctcttccattactatcgagtttggaatgttccaattaaccaccgttcttctttctcttgactcattggagtattccaatttatttctctgtctttatttcttttttttcttcttttactgcgattttttttcttatggtgcgatgtttagtcaagtgtgatcttggttattttttctctcattttcttgatatttgagtgcttttgatgaatgtttctgggtctactgcacaggttacacgtacatcagcagctgtgcaatgtagtcatccaatacatttgcaacagcgccttcatttttctgttatatttacgccgcatgcatgttcattagcagccgcccaccgattagtgcaatattctttcgggggcagcaatattttactccattttatgttgaaaaaaaaggctgtatgatcgttttagtaagggtttagactacaaaacggatgttcgatgctaccaggtttgataaattaaaataaagttcactctatatatctgaaggtagaccggcgccataccctttttatttgccgcaggattttttttcgaggggaaatttgccgcaggcttaatttcgttactgtcgctctgtcgttcatctttgtgttcgttttcaaaataaactcaagtttaccatgaataaaatacttatttgaaaccccaagttccttttcggatcaaaataaattacctacctatgcaaagtgaaatatgatcgataaatcttttgtttgtgatgggttacttttgcaacaaaatcacaatatcgtaagcaaattacttcagcaaaaaatatgcaaatactatttttgtgtgtccggtctacaa

SEQ ID NO: 63620 - DNA, 1561 bp, Oryza sativa
gtgggacgaattcgcgcaatctttttgcccctgctaaggcccacaggctagcctcctcttttatttttgctaggagaaggcctaccgccatctctttgtgatcgaaaatcctacgatttctctccttccagatttctcagactactagtaggatgagggaccgaaggcccttttttgggatgttgggagtatttgctaggctttcccaccattggcggactgaccgggcttcctcccactgggacggctccaattgatgatatcccacccatccggcaacgtggtgccatattctctttgtgtatctgcatgtggcgacaggatgcaatcccgtcttagcttcgcaacgacagagggggcaatggccgttgttctgccaacctcttattgcaagtcggtcggacgtccagactctattctggatgatgagccaggcatgaaatttgcatttccccagggcccatgctttccaaatcaaagagttgaggtttgtacttggcgcccccaagcattgtgcatgataggccgaagaggctgtataatggccattgcctgtgaatttccaaacaatctgatccggctcttcactgactaactgcacatttcggaccgcttcccacaagcggaccagctgttccactaggttgactgtgatggttgagcttgcgtcaaagattaggtcatgcacccatgcgtcgtcctctttcccttggcgtagggactttttcctatttttggagattgcgtagaccaatggcataagatcttttggcctgcgcccatcaatccaagcggaatcccagaagcatgtcatattcccatcaccgacggttatctttgttgaggcagcgaagaggtctttgtcgatttcatcacaaggcgtgtccaaacccacccacggcttgttcggatctttccattcgtgccaaagccatcgcagtctgaaggcccttgtgaatttttttaggttcaggactccccaagcctccctggctagtcggcaagcacgtctttgtccaattgaccttgcattttcccccagtgatatcgcctgtgccagcccagagaaaatgacgtctctgcttatcaagttgctccagggattctttcgtcacctaggcagtcaggaggtagattggctgcgctgagagcacagacttgactagcgtagttcttccagctgctcccatgcttttccccctccaacttgcgacctttcctgagattttgtcaaaaacaagttgcaagtccatcttccgcaatcctccaagaactagtgggaggcccaagtattttaaggggaaacttgccatcattgctgggacaccctgtagcacgtctgtcagatctatgttatcacatctgattgccgcaacttgggatttctggaggttggtacgagcccagtagctgtaccgaaacggtgtaagatgtccgcaaaggccgtgacatcgtctcgggtgggatcaatgaagatgacaacatcgtccgcatacatcgaggtccgcaaccgagttgttcttcctcgcaactttgaaattgcgcccagctctgttgcctt

SEQ ID NO: 63621 - DNA, 1822 bp, Oryza sativa
tatttgagatattgtagatctttagccattttgtcaagtctgctgaatgtgtaacacatttggtcaccgcgttcgagtggtttgacgggcacatctcaggctgatgttgactggggggctaaagacccagcattgtctccaatattcttctctcgagacgtcggatatttcattatgtctgcctgtgacagtaattagttttttttgtctatatttaatactccatccatatgtccaaacattctatgtgatagggtgaaaagtttttacgtgggaattaaacggggccaaagttgcattcagtattgtgtctacagctgatccggattccatctaatcatagggtgctcagctgagccagcgatggttgtttgccacgtttaattctaaacatcgtcgtacaatcttaagtacataaagatgatcaccaatcagtctcaactcccagttacttcttataattgtcgtatgataatctagtgcgcaactgaacaaaatatattttttcttttttaatatgtgccaaagctattagctatttttaagtacatacagatctctatacatcccatcagcgttgggctaaataaaaatgctactaatatgtttagcattctctcttgcatttgaatccggttaggaatgcatatgctttctactggctagttttgattccaatgtcatggtgtcaggatggcatgcagcagatacaattaatgtgtccgattcaaaaatcacaatgtgtccgattcaaaaatctctctgaactttccaaattgtatgaggacgccgagtcattgtaaatcctatttgaattctattttttttattcgattaatgtgagaatttctagcctccacagcgaacgtggtgccttctttcaagtctgtcttaataatataatagatagatagatagatactccatgcatgtgtccaaacattcgatgtgatagggtgaaaagtttttgcgtgagaactataacagtgccctagtttaactacctaaatcagttgaagagttggctatctgagtatttggagagtctaatttagagatgctgttaaagatgctcttactagcagtaaattttgaccaaacaattcagtcacattactacggtgtcagttgcatgtgtagcaatttccttggaacaaagtactcgcacagcggccacgaccaccgttcggccccgtttttcttgggaacgagctacgcaaaaccctacccccttctccgctattggctcgcgatggaggccagccggccggcgcacgcgcggcatatggagagcaatgcggcacgcgccgccgccgccgccgccggcgagggagtcggagaccatgacgacgacggcgaggaggaggaggaggaggagaagtggcgggaggcgctcgccgccgcctggggccagagcagggcgaagcgggaggcgatccgggcgtgctacgccgccgtcaaggacatgatacgcggtaagtgtgcggtcgccgtcgcgcgtcgcttgctgcgtctctctctctgcttctactttgagtttctcttgatttttgtttaatctgactgatggcgatggcgattggtaccgtgtgcgaacgtgcgcgcggtaattaattaacggcagcggagaaggacggcgccgacatgcgccggctcggcgtcgccatgggcgagattaagcagcttcaccacaaaggttttggctccctgcgttcagctcatcctcctcttagcttttgctatgcgctcgtgttcattagtcattaatctagtcccctcgtgttcatgtgcccgttgtacatttcgtgtgattaatgattaa

SEQ ID NO: 63622 - DNA, 2170 bp, Oryza sativa
  unsure (1)..(2170): unsure at all n locations
attcctgcagccctgcgcatgcatgtgtggactgctcgaatttatggagaggaaaacaatcacttctttaattaattgtacacttgattaattaattgattgtcatttcatcatatttgcacctgaaaaaagaatctgatatgtccaacatgcgtaattgcgtattacaatgtactctatctacttgcttgttaaccaattaccagtgcaaaggccaaaggaacaagtcgcagatggtgaagctctgctggagctcgtcaattccctggccatcaccgccaaatccaagaagaaagatggacctaccccttcagagttcgtcacatcactgctgacgaagtttggtgtcagagcttctctcttggatgcttccatcgagtctttctcttgttctgatcttggcgccatggcgtctccattgttcatgacagcaactgggtgccaaacaatgtagggttctgtttcccctgtgacatgaaaatgttgcaagaattgatcgatcttttggtttgtgtgtttatgttcagttgctcatgaaattcttgtaggaatggtgctttgaatcttgccatcgaggaacggaggaagcgtgtcgctagaagactatttgaccggtttcctagcaaacctgcaggggtgcgtttcatcattcctgcttctgaaaactttagctattcgcttctgatttaacaaatataaaagcaaggttctcgagccatttgcttaggtgaaaagattatccttatatttagtattttagttttttttgctgacaccttattaatcagcaatggctaaagtgttcttgcagtttactgaactatttatatttgaacatgcttttgcataaatgaatgagttcaatgtgtcagatgctaactttgctcaattgcgagtaggcattggcacacctagacgtatatatgtttatcattgatcccttttcgatatgtttttttttttacttctgccatgtttaataagttttcttccaagatttgaaatcgcacttactttccagctttatgagaccacaccagatctagatgaaaggaatgatactgacaagaacatggctgtcatgttcaaactcttgaggaagaacaaatgtgtgaagctggaaaatctcatcctaaaccggcaatctttcgcacagactgtcgagaacatatttgctctctcgtttcttgtcaaggatggaagagtggagatagatgttgatgataagggaaaccattttgtcggtgagtgctcctttgatgatccaccgacacaaatttcagtttgattgttcaaattgtaaatcaaagtagtaatgctcatgaattagtagtgatttgtgtctttcatgtttgctgtgcagtgccacggaatgctccggcagctgaactgataacctcaagggaagntgatcaacangccaatatgtattccgatttgataccaaggattggaaggtaaaatacttacatatttttccctattctagatggataaatcttgagcttgatctattatttctcccatctgtatgttttctccttttctttttttttatcattttgcaatttttgctcatttacagataatggaaggcgttgtggagcctggagatgagctaatgcctcatagacaaaacaacattggagaacactacaataatgcaaaatcatattcagcttcagaaccacagagaaaacgagatgaatttgctcagggagagggaatggatgagacactcatcaagccttgcgctgaagatgtcatcctgaagaggaagaggagatcagaagcagagagcttgaaacattggttttcttcatgcaaatggcaatgatcatgtataattttagggttagttcactggtagcaaagcagattaagcacgcttttggcatctctgcaagaaattgtttaaaaaatactaaaacacaagtaggcattaacagcttctgtttcttctattattaggacttagaagtttaatttgacaatgttggaactttcaagatcctttctgcaaatgttcttgactacccgaatcacttgagctgaccgggatttggattagaattcacgatccaattctaaatgcgcaaaattcggtagcacttacaattcgtgatccaaattcgcatgggcttgataggctctaatttataatcagaac

SEQ ID NO: 63623 - DNA, 775 bp, Oryza sativa
catggtggtgttgttccggatcatgttgcatttgtaggtgttcttactgcttgcagccatgctgggatggtagacgaagcaagaaaatactttgactccatgtggaatcattatggcatcaggccaacaatcaaacattatggttgtatgattgatctcttcagtcgtgctggtcgattggcagaggctgagggaatgatgcaaatgatgcctattcaacccagtgtcaccatgtggggaagcatgatgaatggttgcaaggtacatggcagggctgatattgctgagagggtaggaaggcaggttgctgagcttaatcctcagtttggcgcaatatatgtgataatgtccaatatatatgcggagattggtaggtggcatgcagtggagcacaccaggagattgatgtggcagactggattgaagaaaattgtaggctcaagtggcactgaagtgcaaatgttgtgctcctgaatatagtttcctctagcatctgtctatggaactttttgaagtgaaaggaggagaatttgttagacgaatgttgtagaaatttgacaaccatgaatgacttaaacacagttctaccaagtgttcaattgttaactctgtatgttgcgtggaaagaaagaggtaaatataccaactgacataattcaattttgggcttatccatttcctgaatctaggcactatataattatttggtgaattggtagaatatatttgtggattattccgttgttcattagctaatgcctttcagttgcaatag

SEQ ID NO: 63624 - DNA, 860 bp, Oryza sativa
attcctgcagccagacgaagttacaagcccatagacccattacaggtgttgcaacaccttgtttcttcagttgttgccgactgagatggaatttggcaatgaggctggatccattggaaagagaactttgagagctttccatcaagtactcacgggccaaaaacggaggtcgtatgctgattcgccggccgtttgaagtcagcaatgtagtaggtggccgaatcggattccagcacttggaggacttgatcttcatatcttcttgttcatccatgatgtgagtaatggttgtatctgtagtagccatggtcacatcatcctctccttcttcacggaaaaccgtcctcggtttttccatatggtgctcttcacgtagtccatttaaaacaatctgtttcttccaatcaaaacaagccaaactcgagataattttgttagcagtaacatttctctctagttttcttgttttatgcacatgtacagaaggttctaaatccgaacatatgtaaactctatgcaccaaatatattcctctatcattatattcgccaaagatataagaaatagcattagttggacatggcaaatcagatttagcaaataatttctccttcaaattttcgagctcacaaaaatcatcaaaccaaacataggtatttaaagaagatagcaattcatgttcctctacttcatttacaatgtgaacaatatgcttaaaatcagcacacaaagaaacactagaaatagaatgttcattcactagttatggcatgtagaaatagaatgttcattcactagttatggcttggatataagtgaagcattatcacacaactcttctttatcacaaggaacagcaa

SEQ ID NO: 63625 - DNA, 4763 bp, Oryza sativa
tacagtgcaccgatactaataactattattactccgagcatgtctaaattcgtagttcttgaataagtcatatgttactatattttagaacgggggagtacccgttatgaacaggctctgatgagtcaccaattaagcgaatagacactagttgacttgcatcactcgatgatgtatatatatctcatcaatattaagtctaccttatctaattatcacaagctaccgtctgtgccgccaactgattggtggatttagcggccattcatttgctgacatagtttactgtagattgtacagtgcaccgatactaataactactattacctccgtgcatgtctaaattcgtagttcttgaataagtcatacgttactatattttaaaacggagggagtacccattatgaacaggctctgatgagtcaccaattaagcgaatagacactattgacttacatcgctcgatgatgtatatatgtcacatcaatattaactctaccttatctaattatcacaagctggtagcagcgtcgccaactgcttggtggatttagcggccatccgtttgctgataccactactacaaaaaccatctttcgtggcggccattttgggtttccgctggtggaaatcgcagccgccacaaagcaaaggccagtgaaaatgtcgatcttcgctcgtggttatttaccgccagccaaaatacatcttcgctggcggctgacaaaggaacgtccaccagcaaagacatgtcttcgctggcggtagccttaggattgctgccaaagaagacatgtctttgctggcggcagacataacacagccgccagcaaagaaatatctccgcttgcggtagccttaggtcggccgccagcgaagatagttctttgctggcggctcacattattttaggccacgtggcatgctaggaaaaatgaactaaggcttctatagatggacacgtggcccgacagcgaagatatggaccgtccttgttccgacacatggcccgccagtgaagattctattttttttaaaaaaaataaaaacaatattagatatactttttttttctattgtttgtgcgcgtatttcagagtcacacgtggatgatataactaatcaagctatcgatagagtttgttatctttcacgtattttacagccacagagtatgaagcagaataatatacatatataattcggaagcacctatatatatgtacattgacaaattaaattcgaccgacgacataacatttacaagtattttgaatgaattacaaaaccttagctatattaaacgcctgctccagttagacagggattcgttctccggcaaggccaaaactccttcgttgtcgaaaaactgcccaagctggtgtgcgcactcacggtggatgaagtagcacatgtcccgctgaatgtcttcaatggatctatcatcgagctctctttcagacttggggaattttggaagctgcatcagatcatgacagaattaaggaaattaattattcacaataatacaagttagtgactaatttaacaagtgtgtattacttacctcgtcgtaattcgcacaatatttcccattaacccttaagaactcacaacagtaatatccgcatagtattgttcccaccggttgcttgtgacactttcaacatcaaataattataaggtctattatgctattaaatggaaacacacaatcatttatgaaaattaactatcactagttggcatccatatgtacccaccgaccacttattgaagacaaatattccttctcttgagtttctgcgttatccacctcactgataatacctcttttaaatgcactgtttacacatataattaattcacattcatcatatattaaaacacgtcatgctaatatataacttacagatcgataattcttagaaattcctgataggtcttgctatctttatcgagagaatccaagacgttgacttcattgtactttggatagagaagaaagactatcaaatggtcactgcaaacgaaattgttagtcgagccatgattatatgtatatactcttagtgcatattacaacttactcaaaggcatatggggcataaacacactccttgtcctgcgtagattcaagcgccatagctatgtacatagcgacatctagcaccttttcctgatgcctttgtgctatgtaagatttcctctcatcgggagtcatcgccttgatgtgttctggtagcttcttttcgtctagcgtgtatgtgtggttcggcttacttatcctgtgtcacaccccaatccagcaccgccgtacaacggcacctgataggagcgtgtcgtaggaaaaacagcgcgagccgcttcctacgaaaccgcgatctcagtaccagtcccaggatgtagcgctggtacccacggtgacaaatatgaatcattgcaatccttaaaataaatagtggacttatttaccttaacttaggttgcagctcagacagcccgagaatgcaaccgacgacacggacgaggcaaacaccaacaacagcggcagcagcggaaccaacggtctaacacccaacaccacaggcagcagcagggaactaggacaaaccctaatctttacttcacttcaacttcatcttcagagctggcagaactatatttatatagagcaagggtgagtacttacgtactcagcaagccatgggaacttaggtggttaatgcaagcttcaagggaaggctggttaatttagcaatcaattttgttttcaagattttcaacaatttaagtgtgtgctttccacaactagagcgagacaagtctcagctcggtcggggtgagaagtaacaaatttatttatcaagatctttcaaatctggtttattttttccaaaccaaaccaacttttccaaacttcccgataatagtggtccccaaacgaccaatcacttccagggactcccggtcccgctgtcttccggacagctaattgcttcccaagcattaggtttccctaaccttaacaccttttcataaaacagggtaaaacaaaaactacgctaaggaatcacctcacatccgcccatgaccgtgggcacggctgttcgaatagtttgttaacctctgcagagaggttacactttacccacacgacattactaacccgaatcacccagcccgtgcagaatggccacgtctggtgacctaagggctttcatgacaaggcatttcgagagcatacacagggttgccatatgccgacgagaggggtcccagaccaacaacaggttaggtcccagaccatactatgccaggaagcccgggggttctccccgacaccaccccgttgaatccacatgtctctcggcatcaaggctcccccgattagcaatttactcagccaggggtgtcccattccacccgtgtggtcgcactattgtatgctcggatgtaattccgaaggaatcggtccttaaatgcgaccacacatgcattccgcccaggaatggccttgtgtcgcgagttttatttttaaaactcattttctttcacaaggcaccgactcaggcgtcgggttttccaatccttttgtaaactaagatttacccaagaagttactcaaattttaagtttgaaggcgaccgtcgatactcgcacagagtgcacgaatatcgaggcgcaactagatggttacaagggaacatgatataacaatcacaatggaaggatcaaatgcaacaagttaggtaggcccgccaatctgccttgcagacgggcaagcagattgagtgcaatcctatcaatgcataatatttttcaagcaatataattaaattcaaatataggctcaagatgttcaaaggtggcttgccttgctcagggtcttcacagagcttcgcgaatctatacgcaaacaatcaaaaacctaaacaaaagaccaagaaaaggatcctatttagactaaataatagtgccattaaatagatctcaattttacggaattattggaagtggaacggggtcaattggagttacggatcgggagatatggattttggaagtttaattgaaatttatagaaataatattctcaagaatattattgagtgtcactggtgtgcgagaccaaggaaaatgattcatgggattttggaatagagaaatgatttatggaataggggaaaaagggtttattaaatcccttgaaaaagaaaggaaggagggatgccatatagacttcctcgggcggcttaggcgcggcccgaggggtttatgcagcttggccagacctaatgggccggcgcgggcgcgggaggggcggcggctccacctcctcctccactgccttccttctgcgcggatctagccgccgctccgccccacgcgggcagatccgacaatgtcgcatcagatctagcgcgggtgacggtggaaggcgcggtggcgggcaacggttgtctcggtgctgccgccatcgaggcggtggccaggagcgggctggcgggaggcgtggctccgtcagctcgctgagcaccgacggcacgcgtgcggcgtcgtcggggaggtagaaaagggctagctcagtgatgctgccagactccttggagcagaagacggcgggctcccaggtgctgcaattggtcgatggctgcttgacagggtcgcccagctacgcggggcggcgaggacggaaagaaggaagaagaagcgagaagggcttggccggcatcggaggaggaaagaagacgggagaaaga

SEQ ID NO: 63626 - DNA, 2957 bp, Oryza sativa
ccacgcgggccggcgggaggaggaagaaaggggaagccgagatggatggcggacggcggccgagttcaccgaagccttgcgcgacggatttggtcttcggggagcacaccggagtgacgatggagtcaagagggagcgacccaacggctcggattcgccggagggaggtcggcgacgatgaatcgcggcggcgcacgccggcggcgagaaaagggggaaaatccaccggtgcaatgggagttcgattcggcggggtgggagcatctccggtgttcaaggggtgcattcccggcatcggatggggcagaggagtaccgaggagggccggtgacgagcggcggcctccgggatcggacggcaatggcagcggggctatgccgggcggcggcggggcttggggcggcatccacgcgcgttcgggagggctaccgagccactacgcaagctagaggggaagaggaaaggcggggagggagaacggggctaccgcgttgggatctcctcggcctcgggccgggaaaggggaagaagacggcgcccggaggtccccttcggctccgcgcgcttgccgactttccggcatgcgcaacggcgaggaaggtggtggcggcaaggcggcaagaacagaggaagagcggggagcagcttggcttttataggcggagaagaggcggtttaggagggggaaccgacttagatggtcaagggagctcgaatgtcgcgtgtggtcaaggtgggggtggcgaacttggcagtcacgggcggcagaggggggggtcgatggtgccggtcggggaaaaaagcaaaaaggggagggaggaaagggggctctgcccatgccattctgggagaaaggaggagggagagagagctctgcctccgggagttggacgcacatggcttggagcggccgggcatgcggcaacagggcacgggcggcgtctggacggacgcggcgacaactgagcgcggcgaccgaccgagcgtggttagccacgcgcgcgcgcgcgggaaaccgacgggcggcggcgaaaatcgaatggtggcggtttgaatcggcggggcgctggtggggagcggtttgggcgcggcgagggagagtgagagagaacgagagagagaacgtccgagagaggggagagagacggcgctctctcttggtggtcacgcgcggcgcacgtggagagagaggaggaaacggactgagagagagtgatgggccgagggagaggaattcggcccacaaaagcagagggaggcaaaatagacttttttagatggattgaatgtggagacaatttgaattggagggaatttaaccttgatacttggactctaggaacaataaggaagagtcgaagaaggattcaaaacgggaattgaatatttttgtagtcggagcgaatattcggcaaggattcaaaggaaggatcgactttctggattgaattcaaattggatatttgagctcaacaaagtttggagaagccaaggaggggattcaaagagcgaatttgatactttcggaaatgggaaggaatttcgatgaggcatgattctcgatgtcgatgggaagttggagttcaaagcgagaattgatattctagggatatatttgtatttggtggctcaaggattattgagagggggggtttaaagaaatcttgtaccatgggacaaatatttgggaaggagttcaaggatagatagatagacagagagataggttgataggtagaggaacggatagacagatggatagataaacagatagataggtatagtagatagatagatggatcgatagatagatagatcgttaggtagatcgatgtatagatagattgataggtagataggttgataggtcgagacccagagagagacgggatggaagagaaggaagaggtggaccggaaaaaggaagaaggaatccaacctatgggggaggttaactagacttttacagagagatttaattggaaggttttagggttggagtctggacttgaatttcgaagtcgatactcggtcttgggagaatagaaaggagtcaaggaagagaacaatattcggagacgagtcaaagggagatggataatttagagaaagagagtgtaacttgggagtttgagtttgactacttgacgagatatgcgggtgaggattttgaagagaagtctgaatagaagggttcggacttcgagattatttcagaacggatatcattttgggaagagctcaaggcgaaagggattgactcttggggtttagagttcaagggtggaagtgatctcgatttgcatattcaaacttgggtcagaagttcgagaaagagaactagggtagattgacgaaccaatacagagagaaagatagatgaatcaaaacctgagaagttgaattcgaatttgagaatcggtttgaaggaaccaaggagagagtttatgacgcgaaggtgaatccttggacggagttagggttcgggcattcgacaaagttcacagatggggttccaggaggggattccgaatagaaggaatcgagcttcgggactatattgggatggaaattttgaggagacgatttttgataacagggtatcgggaccagggagggatttaaattgagatctttggcacaacttagacttaacactcaaagaacaaaattttcgcaattaggattttcaataaattagcttttaacgtcccgcagaaagcggagcgttacatcctgcacgggtttaggtaggcgacaggttttttcatctcttcagcttccacgtaattcatcctgccaacaatggatgatcaaatgagctacgcatataggtgtagtgatttattaacatgttcaagtctagaacttacagacaccagatggcaattaaattggcgtccagcctcttcctacggtagaggggatgcatatcggagaaatggacttggagtaga

SEQ ID NO: 63627 - DNA, 1062 bp, Oryza sativa
tccaccaacgaggtggacgacgccgccgccggcaagggcggcggctccacccgccggaccttcagccaggcctacaagatgaagcaccggacgccactggtaaatacgcagtccatttccgctgatttcatgcgccattcttggtgttcttctcctccttttgtcgatcgattcgatctgcggtttgtggttgatgtgatcgatcgatctgtggattgggatttggggaaaaaattgcaggagttcacgtggaggcaggtggcgttgctgagcttccagtcgctgggggtggtgtacggagacctggggacgtcgccgctgtacgtgttctcgtcgatctcgctggacgaccccggcgaggcggacttcgtcggaatcctcagcatcatcctctggaccttcaccatgatctgcctcgtcaagtacgtcttcatcgtcctcaaagctgacgaccatggagaaggtatatatctgcactatacactccgtactcgtaaaggaagttgttttggactgtgacacggtctccaaaacacaactttgacttcttttttctataaaaatatttattgaaaagtgatatatgtatacctttatgaaagtatttttcaagacaaatctactcatataatttttacattttcaaactcaacgacttgagtgttattcatgatttatattaccaaggtttgacttaaacattgccctaaacgattttctttatgagtatggtgggagtatatcactatatatagatatataattcggatctatttgccaatcacttcttttttactactagatcaacgctcaacaattcgcgtgtcaatccttttattgtcatggaataaccttttgttggaagaaaactgtattttggtgtaccttgataagtatagaagtgcatccgtcccaaaatacagaaatctaggattgaatgagacatatcccagaactatcaatctaaacatacatatgtctatattaataatcataagatatgtctcatctggttctagatttttatattttgggacgaaaagagtagtagatgaaaaacaa

SEQ ID NO: 63628 - DNA, 708 bp, Oryza sativa
tccttgcgtatgccgggcaggcagcatttttggtcaagaacccttcaaagctcagcacgacgttctacagtagtactccagagccactattttggcccatgtttatcatagcaactttggctgctattgttgcgagccaagcattgatatcagccagcttctccatcattcgacaatcaattgctttgggttgttttccaagagttaccatgaagcatacctcaggcaaacatgaaggccaagtatactctccagagatcaattactttttgatggttgcgtgcatcttaattactgttgggtttaagggtggaccagagatagggcaagcctttggtaagcaatctaatcatatatactcttgccatttctaattgttaatttctcttttactttttgtatgaaaatgttgtagttgcagagacttcaaactcatgaaaaagggctaaattgcacccaacacataacattataaatgtttttaacatacatatgtgctcgtgtgtggttggttgtcaaaacacagatgggtattgcataaaattaaaaaaaaaagtattctatagaaaagccatgtctaaccagttggaattatcaagttactagaaacaccctgctggtaccatacaaacatcaaggagagcacatctctatttggacagatgtaaatgacaatactatgtgctaaaaattaaggctgcaggaatt

SEQ ID NO: 63629 - DNA, 4741 bp, Oryza sativa
tgtagatggcagtgaacgccagcttcagttcccacggttttggtgagggtcaccacgtcgctcagcttcgtgacctcgcccgtttccttggcttctcgtgtcccgagtacacggggtactccgtggaccgtgttccccctcactgtgagctctctgtgtacctttacccccgtggaggtatacacggagctggccttcgcccacaccacttcactgtagccaggcccactctccagatcgcgtaccaggacctctcctggactgcgcttcgtcgcctggcccacgactacagccaccgtctcggaggctcctccttccggcagcttccacgccttccttctggccactcagacgccaggtacccttgtccatacagcgagtctcagccagtgctgactcgcatggttgagctttcggaggctcaggccactcagcacgacctactccttgaggcttaccgctcccttgcccgccgctacgccgccttggaggcccgtctggccgaggagggtgtcacctcagttgacactatctcctgggactcaggccgcctctgccacgccagccacctgtcctcccacagctcccgcggctctgcccgcactcccagtggcccgcgctcccccaactcgcgtgcgccgtactcaccagtgtactcgccctacccacacccagttagcccttcctacaccccaggacacaccccagttgcttcctcccgccgtggcccacgctttatccgcactgcgcggaagcgtgttgttggttctgccactgtgttccgtttccactacccagctcccctaccgccagcggcccgtgctgctgccggccctcgacaggttccgccggtcccttcgcgccagccgatcgacgtttcttcgactgaggagccgactacaggaggcagccaggccgacgaggagtagaggaggcagtcttcagcagccgtccgtgtgataggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgccctcttctgggagtttagatggctagccgcccccgccgtgcagctcgtgcaccagcccgctttggttttgaggatggtagagttgagccagaagaaaatcatggatcagctaatgagcagtctcaccacagcaaccattcgcatcgtactgtttcccgcaatgcagaggttgagcaaccccgccacagcagccgctcgcatcgcacagtttcccgtgatgcagagatgggacagtctcaccgctctcaccgcactgccagtcacaattctggagaagaacgcctcccttccccacctcatgtggaaaccaacatgcaacacttaatggcagttcagacacaaatcttgcaaggactaaacacagccatagccagttttcagcataatgcgcatggaaatggccaccctcacatgggcaacaacagatccaagctgacagactttctgaggtctcgtccgccagagttctctcagaccgtcgagcccgtcgaggctgacgattggttgaaagatgttgatagaaaactcaacttagtgcagtgtactcctgttgagaagacgctctacgcctctcaccaacaaagaggacctgccgcagattggtgggagaattactgcaatgcacaccctgaacccactaacattgcttgggatgagttcgctacggctttccgtgcagctcatgtgcctgaaagcactattgacatgaagaaagaagaattcaacagacttaagcaaggcaacagcagtatcaatgagtacctaagtcagttcaacaagttggctcggtacgcccctgaggaagtggacacagacaagaagaagatcaggaaattcttgaaaggaatcgcagttggaatgagactccagttgcttgctcatgacttccccacttttcaacatatgatcaacaaggcacttctacttgaggatgccagaaaagaggctaccgaagaatacaagaaacgcaagtctaaccatcagggaaattcttcccgaggcgcacctcgccctcgctacggtcaacccatgcaataccaccagtcggtcactcaggctaaccgccagccaggctacgcccctcgtcctcagataaaccgtccggcacctcagccacagcagcgtgcccctagtggcaatactgcgcctaacagtgttacctctttcaagtcaccgcagggaccgtcagcagttcagtgtttccggtgcaaccagatgggtcacctgcgtccaccgcggaccgcgcgcatgcaccgcgtcccttccccgcccgcgcgcgtgcgtcgcgtgctccctccgcacggtgagctgagccgctgacaagcgggtcccacccgggaccgcgcgtggtgagcccggtccaccggctctctctctcctccctcccccgcgcgcgcgagtttgggccgccttgggccagccggcccatttagctcggccggaccgctccatttctcttgggccgcgccttagccgtccgagaaaagtctatattccctccctcccttcttttctttttcttttccaaaaaggatttaattaaatccttttcctttagatcaaaaattcaataatcttagaaattcaatatcttcccaaccgtgaatccgtttgactccgttcaacttccaaaattccccaaatcttgagatctatctaatggcacgcttagaggtctttaatagggctttattttcgccgtttgttgagttgtcccgtttcgcgtgtagtttcagagcccgaagacccgcagtgcgaggatttcgaggatcaagctccagatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctgtgcgagtatcgacggtcgccttcaaacttaaaatctgagaaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtctgactactgcttgtgaaattgctgttgtgaaactgggttcgatgtttgaaaaatcagcagctgacgggatcagctaggcccgggtggctgtttgaaatgttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataatccccccccagttgctgaagaagatgaagtggatcctgctgacgaggagttcttctaggagcaagtcggctacgatgagttatagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttgctgtgatactctgtctccctgtgataccagcactatttcctgggactggtatcgattaacaggttaatttggagcgtcacgggctagttccggtcggaactagttcggggcgtgacaagagatggtatcagagcacaggcttggccctagggcgaaacccgacacttaggacaaccctaaggataccaagttcaaaactacttgcgaaaaggtaaggtttgttttgtcttctttattttcaatagtttgtttctaaaatggttactgatctttctccctctttcaaaattgtagatggc

SEQ ID NO: 63630 - DNA, 1823 bp, Oryza sativa
taggcctagaggtgccttgggaatgtggagatgcttaagcatccaaagagcatctcttctctcctattgacaagtgtccatgacagtttcttcaggtataatgctcacaaccgtcattgggaggacgttatccactcagcgcaacttgggcttgggccagcggcctccgtcagggttcggctaaacccgagacggcttcgttggctccggttttcggcttagacactcattttgggcccctcattctattgctatggatgtttggcccatttggaggtgtttaattgggtctttgggtccaaacctccataagtttggatataagtttgattctctttttccttcatgtattttcttctcaacttaggtagtttgccacctgcatacgaatgtacaccaacactcgtggaaattgttagaaataaaccctaccactatgttggatgttttatatttatggtcttatgtagtagtgacggcgagaatttggtacttaacagccgtccactcttagagtttatgcaggtggcatttgacctgcaattgatgtcagccaaagcaaggcatgtttcgttgattggggccacctctgtacctgggcaagatatagtggtgtcttcaccatcagcaatatcacgtctttcccatggagtaaaaccaaatttgtttctcaaagtgcaacaacaatgcaaagtacatgcaacatcctgcttgatcaaatctacacttctgtggtcgtttcagctcaagagtatttttgtaaagaaacttccatagttgatccaggtgggatttgacctgcaattggtgtcagccaaaataaggcttgtttttatcggagtcttctgtgcctgggcaagagcctcagagtgctttatagaaggtaatagctctaggtggctccgcttttgaggatgtggcaactaaagatcaagtaatttagtaagttctttcctcgtgtccctttgactttctggtcccttagtgttgatggtatgctcatttcttatgaaatgtgaataaatgtgcatatgatgttgaacctgtgcataacattcaacaaccttttggtgcttgattaaataaattcaatcctccatttcacatcatatataatacatttcgggtttcatgcatggatccattgatgtgcttcatatatgtatctaagatcatatgaatgttagcgaatttagacgagggatggagagatcaaaacgtcttatgatgtggaagggaaggtgtagaaatttacaatctttagtgggtgtgggattgttgttgtgtgctggaccatttggaaagcaaggaataatgcccactttagagagagttttcctgctaatctcattgaattgatcttttctctctttccatggatttctgaaatagccaaactggaggccaggaaagaaagacttcgacgggttcccaaactactagaacaagttgatggcaggaagactgaaaagctatgaattggatattgtcgtattgaagattttggagcttggaagacttggtatggagagttgtagacttatcagactgaatacgtgttctgatttgaatcaggctctatgctctgtctgcctttgttaaagattttggtgcaacttgatgtaattccctgctttcttaaactattttttgaggccttgtatgccattgtggtgggatagcatcacaatggcaacaagaatttgcctgctgctataacttgtttagcttggtagatgacatcactatttatgcgtggtaatagttggatctttctgcagaattttccagagttcgagcaactcttgtgggctgcaggaatt

SEQ ID NO: 63631 - DNA, 702 bp, Oryza sativa
atttagaaacgggagataaatcacattgttcatgcttcctcgcatttgatatgatctgactctcaatgctacgagcaaacatgaataggtgcccaatatgattatatgtcacattatcaagcaaaacctgaatttcagatttaaggccattaaaaaatctacgcattgtattttcattgcactctttgagaccactgtagatgatacagaccttaaattcatgaatgtactttacaacagttctatcaccttgtttcagatgttctaatttctcccgaagagtacatttgtaataagatgtcacaaagcgttttctcatcatggttttgaattcatcccaagtttcaggtttattactaacataactccaccaaaataatgtagaagaggtaaacttattactagcagccttaatcatttgagcatcagaaaaatcatatttgtcaaattcattgtctactgctagttcccaatcaatatatgcaacaaaataatacttaccatcataaaatggtaacttagattcaactcgcgcaaaattatagtgatgtacctcgtatgcatcacgtggagatgttgtcatatcttgtagacggtgaagaagccgatgtctcgtattcgcttgctcaatcctgccatggttagtagcaaacaagaaacacacacaagaatatgcacgctcctatcagggctgcaggaatt

SEQ ID NO: 63632 - DNA, 1112 bp, Oryza sativa
tgaaaagaatagaggtaccagagccgggtcgtggcccgcacagaaaaatcaattttcgtgtgcaggtcatttaacaggccgctcgaccgtctcccctcctgacgctcgcgcgaggcggccgggagcggcagcgccctccccatgcccggatccggcggcggctgctgccccttgcccggatctggcggcggcggcagtcccccgtccggatttggcggcggtggcggtggggtgcccggatcttgggttagggtttccaattatttgaaattttatttttttttcggattttgattttcctgtgcgagcggcataagcggattttcgcgtgcgggtgcgccacccgcacgagaaaaacgtgattttttcagacggggcgttccagacaggcgtaaaaactgcacgcaaaaatcaaaataaccacacgcaaaaatagctattgtagtggtgagaggatggttatgattaatttgttggtccgacgggaaatggtccctggctgccgtgtgatactgcatatgtggcaagtggtgaaggaaatatttttaggcccgagcaaatttaaatatacctactatttgatacaagatttttaactttaaattaaattcaattgtgtatttgacggtgagccggacagctccttgtggtagccggacggtagctccgcccctatgtgtggcatattccaccaatagacactacaagaaactttaataccacaagatttatttctatggtataacaattttaaaattgttgtaatacataactattgccaagatgctgatgcaatgatttttttttctggcaaaaggctagttccgtggtggagttaactactcctacgcaacacttcctctgaattttttatatacacggttgacttttggacatattcatcttactatatgtaattgttatttattttatacttctatactactttaaggctgtgttcgggactccccgacacccaaaacaaagcacatattattgtatgattaattaaatatttgctaatttttttaaaaaataaattaatatgattttttaagtaactttcatatagaatttttttttaaaaaaacacaccgtttagcagtttaaaa

SEQ ID NO: 63633 - DNA, 1055 bp, Oryza sativa
taacaaaataaattacagattccgtcaggaaactgcgagacgaatttattaagcctaattaatccgatattagtaaatgtttactgtagcatcacattgtcaaatcatcgcgcaaataggcttaaaagattcgtctcgcaatttctatcagaactgtgtaattgtttttttttcatatttaatactccatgtatatgtccaaatatttaatgtgatggatgaaaagttttttttttcgactaaacaagccattagacaattatactataagtttactttactgccattgggcctaaaatacatgaccagcccacacaggacttaacccacacaaaaaaaaaaaacagtagcatcacgattcacgagcaatggatcaaaaacaagatgaaatattgaagaaagatagagcggagcttctgcaagctcaggcagagctctggtgccacacttttggctatctcaaatccatagcactcaggtgcgccgtagagcttggcatccccaacgccatccaccgcaatggaggctctgcttcactgcccgagctgcttggcactctccctctcgcggcaaacaaacgatcatgcttgcctcgcctcatgagattcctagtctctttcggaatcttcaaagaagacatctcaagggagggaacaacaacaacaacaagcgtgtatcagctcacaccggtatctcgcctccttgttgatggtattggcatgaacagcaacactgagcacacatgccaatcaacctatgtgctcgtgtgcgtctcacagcttcaagtaggggcatctttgtgcttgggaattggctcacgagcagcgatgagaacaccccatttggaatggcgcatggcatggatttctgggatttcaccggccatgatgccgagtatagcatgctgttcaacaaagggatggcgtccgacagccacttcgtggtgaacatagtcatccatgagtgcgccgaggtgtttgtgggggtaaggtcgctagttgatgtcggtggtaggaaggcgcgatggcgaaggcaattgctgatgcctttccaca

SEQ ID NO: 63634 - DNA, 2230 bp, Oryza sativa
ctcgaatacttgactgagattgttaggaaaaataaatgaatgtaaggtaaaactagcgcactgccagcttggccaatggtgaagaaggtaaattcataaaaaaactggtaccacatttaaatatttaatatgtattgttattatatattggtcctaaggaaaataaaaaggaaacaaatattgcaactgcgtcatttatttttggactcagtgagctgcaaactgcaaaccatactagtgtggcataatctggactgttgccaatcaagcgaaacctcatttcttctgcacacaggaaagagcagtcttggattctttttccttatggaatatggatgaaattgcaaagtcgttggacctaacaagacaatattcgaattcacccatcaattacatgtctctaacattctttatcttttcctaatgtacttcggcaaatgagatgtgaatttttaataaacctgctttgtacaggacaaaggcctatgttaagaaagatatgctactccgtgtgaagagacgggatgtttcgaacgaatcatttatattggttagtgttgtagcgagcattaagacatgtcctctttctttcatcatggtgaaaatctcaactagctggccgcctggataaattacttctcattgttgcaggttagtcagcgtatctgccaaataactagcgaattcagcaatcagctgtaaatgaaatgccccacgtgcaacattaaccaacgaaacctaaccgaaaccaacgaaccactacatatttctagagctcaaacgaaaaggagtaactaaatatagggaaaacaactagaccaaaaatgtcgcctcgcattctgaagcgagcaaactagccagcaacaattgacacaaagcgtgcattgacttgacgagaattcgacctctcacaattccgtggaaccacagccctaactaggggggtgagacgaacatcccgccccccactacgatctcaaaggctacaccgctacactccaccgcggctcaaccacgccgcaagggagacagcgatttcgcacgaaacatttcatagcgcgagcggcggagatcgaggggaagtttcgcttacccgtaggtgccctcgccgatcttgcggatgcgcctgaagcagtcgacggtgcgggccccggcgggggcgtagtcggccaggttgagcgctcccggcggcgcctcctccccgtccatcacgcggcgggcggcggaatcaacggcgagggcggcggcggcggcggcgacggcgaaggctaggctaggcaggcagcggagcggaggagtagcggcggacccggaggaaacgagtcaaaagcggctgactttttctttcttccgctcttgggcttgggacgcaacgccgtctcgaagaaggattgtctggttgtgggctttatttgggccgagtgggcttcatctcagaaagtcagtgggtttgggccggaggaagacttctgccctctttggatgtctttacaatctgttgtagagaaaaaaaagagagagtatattttgattccctcaactatggccgggtctgatttattccctcgacagtaagagcctgtttggctgtttggttatttggtactccatccgtcccattttaagtgtaaccataagtttctatatccaattttaatcgttcatcttatttaaatttttttctaattaacatgaataatactttatgcgtgacttatgtttttaattttttttaaataagacggatgattaaagttgggcatggaaaattatggttgcacttaaaatgggacagagggagtagaactcttaatttcaaaagttaggtgttgtgaagcagccaaaacgcagctccacctccctagtttattttgtgataacacttcagctagctccacttctattttggatggagctgaaactgtttggatgggctccagcttcagaagaggtggagctagagccagaggtctaccaaataggccctaaaaccattgtaaattggatctcaacaattttgcaacctgattttataccatactactatactatgtggcatccacaatgacccatgtggaaattgacaaggacccatgtggaattgaccacctttatttcttccttcaactatactactctatcctctctcttcttctttccaacaggctcgctatcgtcctacttggcggttaccatgccttgtggtttcatcggcaattgattgttggtt

SEQ ID NO: 63635 - DNA, 1564 bp, Oryza sativa
gagagagagagagagaagcagcggcggctctgatcaccccagagatgcggcggcggtgtcggcggcggaggcggcgcagacggcgagacgacggcgagagacgacggcggcgaaggagaaggcttatgcagtggcggcgaaggagaagccgagatcggaggaaaaacttctaagtgttggtggagaagacgagggcacatcgggaatatatatacccatagatcttttctcccggttggtgagaacaaccgggactaaagatatctttactcccagttcgtaagaacaaccgggactaaagatattttcccgctatttccaaattctttttaaacccggttagggttaagaactgggactaaagataatagcattgaatattgaatttcattacatatgtgtttctaaaatagtaaataatgcattaaaattatttaaagtcaaaaaattaatgacaaaaccttcgaaaaattattgttgtctgtagtaaattaagtggataatatataataagcacatgaatgatttaaaattgttaaaaattctaataatcatatataattagcatatgcataatattaaattgttaaaaattctaattaacatatgtaaataccacatgcatgatttaaaattaataaaaattctaataatcatatataatttgtatatgcatgatttaaaattgttaaaaattctaattaacatatgtaaataccacatgcatgatttaaaacttttaaaaattctaattagcgtatataactaagatatgcatgatttaaatttgttaaaaattctaataatcatacataattaacatatgccatacaacaattgatttatatgggtattcaatatatccaaaatagtttacatcgtgtacacaacaattacggcaatacatcggcggtaacgatttacggcacgtactttctcctcactattgttccttccttgtgatcgctacgtgagtaaggggtgtcttcatttgataggaggatgctagggtcaatcgtcaccgtgaaaggggggttgcccatcaaactgatcgtaatcctcgtcagtcttgtcctctactccgacgatttttctttttgtctaggagaaccacgtagcgcttcggctcgtcaagccctttgcccttctttcctttgctagacatgtccgtcacgtaaaaaacttgcgttacatcattggcaaggacaaaaggttcgtccgagtatccaaccttgttaaggtcaaccgttgtcatcccactgtcatcaatcattacgcctccaccagtcaacctaacccattggcaccggaacagaggaaccttgagaggtccatagtcaagttcccatatgtcctcgatggcaccgtaatgcgtgccagttgtaccatcgtgtcccatggcatcgatacgaacaacactgttctggtttgtgctcttcatgtcttgggctctcgtatagaatgtgtacccattgatttcatatccctggaatgtcacgatcgagccagatggtcccctcgccaggaaggccagttgttggttaatcgtctcgttgcccatgag

SEQ ID NO: 63636 - DNA, 985 bp, Oryza sativa
cgataacttgcaagatctaaaatcaaatcacaagaatacaaacacatacatcagtacccatctgatgcatgacggtggaggcatcgacacgtagtgcccacaggaggaggtggacactgtggcagccgccgcttggggatggaggaggcggctagcccttggaggtggctgctcggtgatggaggaggagccggatccggtttcccctgacctggatctggcatcccctaacttgcccttggaggaggcggctagcccttggaggagccggatccggtgttggagaggccggatctggcatcccctatctcgccgacgttcccgccgggcctcggcaccttgctcagcttgacgatggacttgacgaattgcgtgaagaaagcggccttgtcctgtgtgaaccgcctgacgaggtggctgcagcggccgctggatctcgcccttcctcgtctgtcggatctcgccacgccgacgctcggggatgagacgctgacgcccggccacatctagccacatctggccggcgcccggcggcatctagccgcatcggcgcccagtggcttggatcccggcgcacggaagaagggagaaagagggaggggcggaagaagggagagcgcgggtggaggcggaagaaaaaagaagaagaccgatgggcgtgggttcggagctgggaggagaggggagggttatgagagcgattttttttatcatctttgacgggcacacaaatatttggcccatcacaggtgactttacctcacatctgacgggttcctttttggcccgtgtcacaggtgaccttttttttttcggggaaatgggaataaattactcaggaataatattgtttcttacaagatatgaaatagaaacacgactagagaggtcctcacaccgacgcttattagcaaaaaatggctgaccatattctgctcacgccgaattttccagagaacaaattctctacttccattcaagaggt

SEQ ID NO: 63637 - DNA, 1428 bp, Oryza sativa
ttggggctgcatatggaagataaacacaatggccatggtgcatgcagagatggagatgaagtccgtcgcgttctggaatccaattcggccacctgagatagtgctgaattcaaacggtcgccaaatttccatatggtctctgttttgggcccacgagtacttgatggaaagctctcggaattctctttccaatggatccaacttcattttcaaattccatctgagtcatcggcaactgaagaaacaaggggatgcattgtctgtaatgggcctatgggcttgtaagttcgtctgggaccccggcccaagtggggcccaaggggggctgcgccccaaacagagggaggaagcccttctgacttcctccatcccttaaatagctagcaaccccttcagggttagttgggttttgttagattaaagtttagccattgctacttccttgcagcgcacgtgtcggctagaccgtccatctgcttgttattcagaacctcaacttatcatctgtatttaattcctatttgcaatatcagattgcttttatcttgttcttgcttgtttcttcgatttgcttggaggaatagggttgatttgcaccggcaagatcaataacccacggagaggtgtatcgatcgctaaggcgcaacgcaacgtcttgtacggttgtagtcagatcgtcaacgtttctctcaaatcgtagttatcttaactcacagaaagatcgggccaacaacagccttgagtatcgagtggaactcagggttcatcaggtggtatcagagctttcgttgctcggtgagtttttatctacctataaccagaaaattgccctaaaaaaattgcatccttacctagacatattgtgccattgcgttgttcttatcaatttttgctttgttgagttctgcgttacatcgtcgaatcgagttgctggtcttagcgtctagtccgtttagagttttgagttctagtcatgttttgttccacaatcgtcgccgccatcatgtctctattgtcgtcgggacctaagaaaacggaatcggcttgctgccacggttctatttttgtagttttcagaagttttttgtcggtcagttttggagttgcatctaggttttgcttaagtttctggtttgcccgtgaatagatcggccgtgcttgttgccggcgtagagaggaggaggaagaatttccaaatctgtttttggaagtacgagagtttaatttggaaagaaatagtagatcagattgattgaaaatcagtttctctttttcctagtggtgccgtatccatccacacgtcgcccaccaccaccgtgaggagtccgaccccctccctctcctctcggtttcggtttcggtttcaatgcataccgtgagttgctagacaccttggtgaatttttgtttggtgtcagtttcgtgatct

SEQ ID NO: 63638 - DNA, 708 bp, Oryza sativa
aattcctgcagccccagcgtactaagcaaagtccggattattgtcgtcttccacttcattttctttcatttcaaccccttgctctccgtgagatgccaacaattatcgcttggcattaactccgacttaaacaagtggaaatgaatagtcctgaatgcagaatactccttctggttcttacacttattgcatggataacaaataaaacccttatgcttgttagcttcggccactctcaaaaaataatgcatgccgacaataaactctttagaccgccggtcagcgtacattcattgcccatccatctacatgaaatgaaaaaaaaaatcgtacacaaataattattcgtacaataatgacagtcatacaataataataaaataatcacaaactcttccaaaggtcatacaataatgacatatcattattcatacaaaaattataaaatattccaccaaataattcttatttattatttttgaacttttaaactaatattaatgtgttgtacttcttttggttttcaatttagtttgttttctattatttaagattaactttcactatattttccttctcaactattttataaaaccttctttagcaaattaacaaaatttctatatattctttctttcccacacaaattttctctctcatcaactaacaacaaaattttggagacaaaaaagtgagcaaaacatagct

SEQ ID NO: 63639 - DNA, 3914 bp, Oryza sativa
tcgggactaaagatgatcaaatcgccaagttccggtttttattgcaaccggaactattgtggaattcgcccgaccgacgaaagatgatttctccaccagtggcgcatatcctaatacaacgaatctagacaaaattatgtccaaattcgtagtgttaggatgtgttacattaattactagctacattagtttttttaatgaaacggagggagtatgtaattatataattgttgaatgtatactcaattaataaatcctgcgtacgtcactggcatcacgggccctgcctgttgacgcatggtcagttccgaggcagccaagctgttgatcaaataaactatatgtatatcaggacttcagctgcctgtgtgaatatataaattcaggaacacgtacaaccacggggatgtgcctgcaatttgaaaccacaaaaacgcacgcgttgcacactagctataggtttgcacttatataatacacttctcatcagtaaacaagagaacggcatgggtctcctgacactttatgcttatcaacgtgtgacagtctcaaaataaaatgaaggccaactggctaattggccatccataatgtgagacaaaagtactcttataattgtcgataaggattttgttcttatttctcagataagctataagtattatttttgtctcacattaattgtaaggtcgaccatgttcccatttctctaactagctataagcacacttgttccctcccatgtgatgctccctgtggcagtgctcgagacacattcgtccctaggcatgacccccacaagcatgatccttttgtgggctatgtcagtgcacctcgggcgccccctcccccccaagcgatgctcggggcacattcgcccctcgggcatgaactctagaacttggcctccgtgggcggttctcggagcacatctgtcacctgttcccaagtatctggggtataccaacctagcctaggaccggtacaacacgcgacaagacaacacataccaaccctgcaacaagcctttatctctcctatgcgaaaaggcgtgtgctataggcggcactgttgagtactatgtcgcacgtttagttcacagtcatcgcacactttcttccgacggcaggcgcacggcctgacaaccgggcccagtcaccaagaagcaacaagaccaaaaagacaccttacccctatgcagggtccatttataaaaaacatgccaccgtgatataaaacgaggaccagggtcactgaaaaagagagaactcttattagttagattgattattttatgatgtactccatgtgtccaaaaataaaacaatctaggattgattggaacatcatctagtacataaccaatttaggtgatgtcccaccgaatcctagattagtttattttggaacggagggagtatatcctatcttaatgccaatggctatcgctatacattgtggaaatggaaacaagaagagttcacttgtgtgggtcccatttatatggactagttggtccatatacattggtgatgccctgcatgcatgtactattaagatgttaggacatactttcttcatctcataaaaaagaaatcttatactccctccatccataatataagggattttgacattttacttgcactatttgatcattcgtcttatttaaaaaaatttagaattattatttgttttatttgtgacttactttattatccatagtactttaagcacaactttttgttttttatatttgcataatttttttgaataagacgagtgctcaaacgttacaaggaaaaagtcaaaatcccttatattatagggcagagagagtacaacatgtaacatatttttagtactatgaatccgaatagcattattgattagttggttcatatatattggtgatgccctgcattcatatattgttcaaatgttactccctccatcttataaaaaataaatatagtaccaactggcactaatccgatgttttgaggtagtggataacttaccatctttcggaagaaatactctaataccccgatgctttgttctggcttctagccaccccggccccttcctctaggtctagtccatccccattaatttagacaatgatcagtagcattctttgccattattcacttccatgggatccttttgagcacctccactgattctcagtttaatttgcaggtgccatgacctagcctatccgccactgagtttcgccatgactgtaatggatggggggattcctaccagaagcaagaggttgttgttggatctaagcagcacaggcatagacatcatcttacttggccaaatcaatgttgaccatcatctagctagctaagctagaaatggagcttgcaagtgattaacttgcaagtgattaattaattcctttggactttcttaattatatatcccacggaagaatctgcaaatcgatgaatgcaacccaactttaggctccatttagtattgcagtgcagtatgatatagtctgatacaaataggggcggatccagcgtaggtgctagggggacttgagtcccccctaccccgctggatcaccactaacaaagggggagatgaaaggaaaagaataggaagaaaattaagagtaggggggactgaaaaaggaagaaggaaatgagttcccccttaaatcttgttctggatccgccactggatacaaccacacattttcatatttggaaattattttcttttggtgttcgatactatgaaaaccattttttcaggcgatcaaatcgctttacgcagacagcccgccacttagcatgtgtttacgaaaatcatattgttttgcaaccaggccgccccaactgaaaatacagtcagcctgtagttaatcagcctcgtagtagtaaattgtttttctattagtagttgtaatatcacagtttgaaaataggaaataaaaaaagttgagaactatgaaaaactggaagtatggtaacatatatattttaatttatttatctaactagtttaaaactataatttgatccgtaaaacaatgtacggcgattataagtatatcaacttaaaaataagcacaacgcagcgtatagcacagcaaatacaaatcgaaccttatacacaatgcactaattaattaatttcgtatcatgctgtatctatgctggtgagaatgctaatgtgactgcggtaaatatataggccgccgccatatttgtgttcttgggtaccagttgctagtagatttctaggatcaaaatctccaaagatctactgagaaaaatgtctgatccatgttgcaattgccgtcgatcatcacatcctccccaccgtcttcgcatggcgatggcggcattgtgtgcaagaacccgtacatgaaatcatccatggccgggaccagatcagcattggtactagccgctgacgacgacatcgccggcaacgtgtccatgaatgaccagtcaatgacatcatcaccgccgtcgtagtcggcagcgccgccgtcggtggagggcactgacgacatggccgtgtcgtcgttgctcgtcgaccgcgcaggggctgctgcttcttgccgctgcgagatcgagtacgacgacgacgacccgccggcggcggcggtgttcgccggaaacgggcggttggcgtgcctcgccgcctcggcctggatctgctcgaccgtgagagccgcgccggggaagcggcggcggacgtcgggagggggggactccgggaagttgagcgagccggcgccgcgcgagccgcggaggcagacggcggcggcgtcgaacgcccgcgccgccttctcggcggactcgtacgagcccagccatatcctctcccggctgttgggcatccggatctccgacacccaccgcccccacttccgcagc

SEQ ID NO: 63640 - DNA, 4179 bp, Oryza sativa
attcctgcagcccgaaaaagagatttcatctagaaatacaatttataaataattaaacttggtgataaaaaataaagactgttgaaagaaagaccatttaaaacacatgtcgagattaattaagtaatagccctatacaagagcagagtggtggcggttgatgggacatctaaaaactattaataaaacaccaaaaagaaaatcctaatgacgattaaaagaaatgacgacaggcaagtcgtgaagcaatctgtcaaggcggttggtgggacttctagaaagtaaaaaaataaaccacaatgataattatttttaatttttataatttcaattaaaataaaaatgaaaggcaatggcgggtcgtataggaatacaatggcagagccgccgatggttggtgtgtcttctagaaagtaaaaataatgaattctaatgatagttatgttcgacttttacaatcccaatgacaataaagtgtatgcggcggacaggtcatagaggagtatagtagcagcgtttgacgggatttctaaaattataaagaaaatgaaacccaacgagacgataaactctaaaaactataaggtccaatttttaaaagttcgggcttctgaaaagtaaaaaaataaaccccaatgataatcatgtttgattttaaaatctcaatgacaataaagaagggcaacaacggccgagccgtataggagtacagcgacaaagccgctgacgttctggcagaactgctagaaagtaaagatagctcgaacctaagcaataacgatgttcgactttaataaagcaatgacaataaagagaagatgaagtggacggtcgtagaggagtataatggcagcgtttgacgggactcctacaaatcataaacaagaagcccaacatgacaataaactttacatcgtgattggatccaaattttaaagattccaaggagaatgaatagaaacagtggtagatcgagcaatcaaataaagaataatatgacaaaagtaaagggtagcaactggtgtgacttttaaaaattataaaactagaaacaagaggatgataaggtttggactttcaaaatttgaagacaatgagaaaactatttaataaattttaagtaaaatcatattaaaaaatatataattttatatggatgctagccgcgcaattgtgcgggccacccagctagttaaatataaacaaaaagaaaaactaattatatagattgtgtgtaaattgcgagacgaatcttttaagcctaattgctccatgatttgataatgtgatgctacagtaaacatttgctaatgacagattagttaggcttaataaatttgtctcgtagtttacatgcggaatctataatatgttttgttattaaactatgtttaatacttcaaatgtgtgtccatatatccgatgtgataaccaaacccaaaacttttccacaaactaaacaaggctaaagttttattttcatactacatgttaagttgttgcttacgtttgaatagaacaagcacatttatagaaaacaatattatatttactgaaaatcgcgaaactagagatcacctggctgaaatcacaaatttagcattctatcgtacaacaaaagtttgatagggtgcatatcgaacggctgcacccatcaaacaacagttttttaacatgctctttgccaaagtgtggctgttcaatgggttgttcgctaggataaaaagaaaagtgaaagcgcatgcatgcagggtggcctacggaaccatggttgttcaatacatcttgctcgtctaccaccaattgtaaggttgattacctggcctcatgtacattttattgctccttcaagtgttggtgatattgtttcgataagctatgaacatgcatcatgtgcttttacaaccttttaccattcaaacaaccctgtcaaatgatagttgtggttgttcgatatgtactatgtcaaattttggttgtccaatagggtcttgtctagggttttctttgtattcttttcattgtttctctatttattattacctccgatggaaatattgatgtagaatgacactcttaaaaacaggaaaaaaataatatgactggtaaatataaatttgcatacctacataactagaaagagtagaagagtgataggacataccgagaatgatatgccttccatattgaaagaatggaagtcattatttatttattttctacctcaatgtttgctaccttgcatatgggccacaaatgggttgagaaattgtggcatccaaaacaaccccaactgtattgttggacatgaatcgactcaactctagatttattttttcagaaatttttaacgaccatttgtagggatcaaggatgcaagaaggttagggagacaagtgtttaaaatcttaagatatttaactatttatcactctttgatgtaattcatcacctatacttatatgttataggcatatgagggttcacatgtcattgacatatggatacaaatagttaaagctaaatttaagagtggccaatagataaattccttatcttttttttcttgcttactagttactccctccatttcaaattaatctacatatatttttttgaggttatttctaaatgatctacatatttgtgtttattcattgagtctattcgttatttatgtattggagtaaatggacattgatgcatgcaagtatgcacacaagtatttataacctacatgcaatatcttgatttgctattggctaaaaaatagtggggatggtgcatgcatcgagtttgttgctagagtgcatatagtatgagagagttattagcttttcttgattttggtgtacttataaaatatgtagatcaattaggaatggagggaatatttttttattagcaagtgagtgataaaccatgaagcgggtttttatgctgacagtgaaattgcccccttatgttgctaactatcttacttttgtccagaagtaaaaattacttctattgtcccaaaatataacaatttatatcttaagtataacaacttctacaccaatattctctttctaaccaatcacaaacctccaccatttaattttttcacctagctctacttatcatccaatcataatacttttctatttaattttatctattttcttaataactatgtttaactctaaaaatgtttatattttgggacgaaaggagttaatgtactactccctccgtcctctaatataagggattttgatattttgcttgtattgttcgaccactcgtcttattaaaaaaattgtgcaaatataaaaaatgaaaagttgtgcttaaaatactttgggtaataaagtaagtcacaaataaaataaataataattctaatttttttgaataagataaataatcaaacagtataagtaaaatgttaaaatcacttatattaggggatggagggagtagtacattaacatcttcctaagatggcaaaatcctaaaaaaatggtaaaaaaaatgggaggaaaaagaaataggagaaagaaaaatggcaaagatgaagaactcggcctgccccttcattcccttccatccacttccaatccatccagcccaagtccatctcccacccttccaccactacccacatcgtctcgccgccgtcgccgccgccggcgtgacctccgccgcaaatccgcagcccccaccaccgccacccaaagctctcatcccgcatgaaggcgtcgatcaagttccgcgacgacgaccggccgctgctgcgtgccagggtgccgatcagggtgctcgggctgccgctccactccggcctctccgccggcggcgacccgcgcgagctccgcctcgacctctccaccgccttctccttcggcccggcgatccgcctctcgtaccgccccaatgaccccgccctccccttctccgtctccgtccgcgccggcgtcgggcccctcggctcccccgcccgcgcgcccttctccctcgccgccgagttcaacctcctctccggcaaccccggatcccccgccttcttcctcctcctcaagccgcgcctcggcgacttctcgctctcccacaccctccgctcctcgccgcatcccggtaataaggtcggggaggtctccgatggcgatggccatgggcgcgaggtgaactacaagg

SEQ ID NO: 63641 - DNA, 3388 bp, Oryza sativa
aaggcctatgcaatgaaggagttgactagaaaaggctttatattatacagtgtcacacgataatccttccccctattgcacatctcatctttccaaagtcagcttcccaaaacccctatttatccatctgatcctcgtgaaatcacattcccctactgcctatctcggctacattgccctttgccaactatagggatggtgcggaataaccgaatataatttcagctacatcgcccagtgggttcccgttgatgcctggttgatttagtacaatgaaatcaacctaaagttccctccgttttaggttataagacgttttgattttggtcaaagtcaagactactctaaatttaactaattttatagaaaaaaacagtagtatttttaacccaagacaaatatattataaaaatctattcaattatagatttaatgaaactatgcttgtgttgtaaatattaatattttttctatatagttagtcaaacttagtagtttgactttgactaaagtcaaaacgtcttataaccttataacctgaaacacttataacctgaaacagatggaagtatattgtatattcagtgtattatgtaacagatgcagtaacctccccacgaaaaaggaaaacctccccacgaaaaatgaaaagcaaaaggcactagcccctgcactatctgtgcgccatggcgtggagactatcagccgaaagtgctgaacttaggggcaggaataggaaaatcgtaaggctgcataagaaaaatggaggattagtaaacaaaggaattttggctgagtttttttctctaagtttccaactcactcatctcgtttttcgcccgcacgctttttaaactgctaaacggtacattctttttttttcaaaaattctctttacgaaagttgctttaaaaaattatattgatccatgtttagaaaagagctaatacttaattaatcacgcgctaatggatcgtttagttttccatgcgtgggaggcgaagttcctaactcacctcccgatcacaaacacaacctttgtaggattagatgttccgaatatagggatagaaaaatgaggatttcatcttatggctgcctatgatgaaaaagaaagaggttggagtggtgttgacgaaaaaatagaacacagcggcctgagagatctgcttaactcctgtgcaggtccaaagattgatgagatgcgggcgtgccagtcagtttgatcctgcaactgacaagatatgcaaataatagacaaaacacccgatcggctgacaagccgatggagtagttccagccgatggccgataatagccgatgccaataccagccgatagcgatagggtttaagcaatcggctatatgtccaatatagataatgatataaaggcaatcggctgatgatgatgtaataaaataacaatataattcagtagaaatcaatcggctaacaatatgatatagtagaacaagtattgatctaaaggttaaagcacatatcggctggtggttcgatgtcattaaatccacaagattagataaaacagtgaaacctttgttgtcatcggctaaatccaacttatatgtatgtgcaatccttacgagccgatgcaacgtccagataactcaccagctgaaaccccgatgaaatccttattggcagtcaagcagcaggctagagattatggttctaagcacgacttagtaggtcaaacttaactgatgcagcactaagtatgaaaagaaacataatatctagacaatcaagccattgaccgagtttttagggtggtagatgtctaagctaatctaatctagcaacgcgatttagccgataccggcagaaaccctaaaatgagaagcagccgatagagctaaattgatatgctaagactagattaacagatatatatgataaataggtaaccagagcaatccaagaggtcgaatgtactgatgcagccttaaacgacgccgatgtagatgagacaattgcatgggccgatggaacattggatttaccccttcgccggagatcgaacatcgatgcagccccgcgttaagtgccaagtcccgccggaacgtaaaaaacaaaagtagaagtaaaaagggtggcgatgcgccgaattgtattgatcgtgaagatagattacatagaccccaggtgtacatatttatacccatgggttgatacaagttcttgtcggacaagaaagaaactatcctaaagataaaaggaaactaacaaactattcctaattaatagataaaactgccttcttcggactcgatccatacgtggcagtcatcatgaagcacgtcaactcaatctgacaatgattctaatatcaccttgccggaatcggctacatcggcttgccttgtccgattcggtaactgtcgatgcacactgtagccgatgcagttccgaagccgattcatatcctgtttctataatcgatttccctccaaatccacttcggccttagctccaaatccgatgtaaatttaccaaatttggttgttaacaagtggatgtttggaatcatttggaactcctatgttttcatgggaacattacaatattcttccaaaattcctttgtgtgtttcctacaattcaagaacacgtgaacagtagcaaattcaaaggaatcataaatcctacaaaatcctttgtaaattgtaaacccttttatttgaacaagccataaccaaagagataaaaacgttaacctccatcactagttccctaccgtactactactcctaccgtacaagtaaaatccaagaaacattatggtgcgccccacatgccagccgattttctttcttgcttaattattatccggcgtcttaaaacactgcgtaatcatggatggctaggagaacatgacaactgtataaaataataaatcgattgaacctctaaaaaaaatactacgacaaaatcgactgaataatacgacctgtacctggcagggtgggccccaccactccgtccaaaaaaaaatgttcccagttaaattcggacccatttcgcagaggcaccccacgaaacctccgaattacccgaagaggcttgcggttccattttaaaatccaaccaaataaagaaagtggaggtgaaaatcgtggatcgaaagggacgaagagaggaggccagggcaagggaccaaaacctagacgaaccacacgcagaagaagagagagaaagagagagagagagaaggcccaaacaccaccaaaccctagccctcacctcgccccgccgtccatggaggcggcgctgtgacccgccgccgccgccaccgtcgtcgtcgtcgtggcgtgcggaaccgatagggcggaggggatgacccgcagatcgggcgaccccggcgtct

SEQ ID NO: 63642 - DNA, 4105 bp, Oryza sativa
  unsure (1)..(4105): unsure at all n locations
ctgatcggtcggccacaatttttttggaataaactgcttattgcgattttttttatttttaaatggttaggtcgttgcaatcaaaagtgaaacggctcaaggaggagagggaaaagagcatctccggcgagacgaagccgccgccggcggcggcggcggtgaaggaggaggaggaggatgtacggaagggatcaccggaggaggccggcgccgtggaggacagggtctccggccacgaatccggccggtcatgcaaggagtcgaactcgtcagatctgaagcggccggagaacgaccccgcggtcgccgacgacgacgaccgggaggcggaggaggaggaggaggcggcggcggcgcccgcggccggcgacatcgccgtgaaggaggaggcgtcgggcgagtcggtggctgggtcgaaggaggcggacgtcgagaaggagagcagcgacgtgcagagctccgccagcccgtcccgccgccggcgacggaagggcggaggcggcggcgaagaggcggaggcggcgtcgccgtcggtgtccgtgcccctccccgccgccgaggccgagccgctcgtcgccttcctcgagtcggtccggaccagcaaggccggcgccgtgttcgagcggcggctcgatagccaggtaagaaaaaaaaaactcctcccattttcactcacagtaaaaaaatgaaaaaaaagagaaaacatctggtttgcttctaataacatttcaattacccgcactttaaatttttaactgcacattcttgcgatttattattaaccgtttggcgattagtgcctcaactaatcacgaaattatagcggctgatcagagtaaagtacaatcttaaaaggggtcagcctcttcgttcgtcacggtcgtcatgagcaaggaaacaacgtggaattttcgcttctcgtacggccgcgatttggtcgacgaatctgagccgttggatttaaatgtcccacgaggatgcggagataataataaaaactgagggtgaaaaacgagtggcgttgggagaggcgcggcgttgtttggttccgtggcggtgggcccgggctggctcagcatgggcccgtcatgtgccaccacatcatcgttgtgggggagatgacgtgtgggcccatcatgtcggccactcgctgccaagcccaataaaaatgatgcaacgatccttgaccgtctccaaatgcgagtcgcccaggattatgaattttaagctcgttttttgtcatttttttaaactgatttttgaatctttgttcattttgcaggatggggagaggtacagtggcacgatcaggcgccatgtggacctggagacggtcaggtcgaggctggtgggtgcaacggcggcggcggcggcggcggcgtgctacgcgtcggcgtccgagttctaccgcgacatgatgctgctctgcgccaacgcgctcgtcttcttcccgcgcggctcgccggagcacgccgccgcgctccagctgcgcgcgctcgtctccaagcaggtctccaaggaccggcagcctcacgccggggcgaaggcccccgcggcggcggcggaggaggaggagaagaagaagccggccaaggccgacgccgacatcgctgggccgctgctcgagaaggcgccgatcatcgtctgccggaagcggagctccatcgcgaaggccgcggcggcggctgccaagggggagaaggcggagaaggcagagacggacaagaaggagaaggacggcagcgaggagaagaagaaggctgcggcggcagcgacgacggcgacggcggcggccactgccaaggacaagaaggctcggggcatgaggacgaacaagagccggggacccgcgaggaatcagaagacggcgaagctctcggagaccggcgaggggaccaagaagtccgacaagaagggcggcggcggaggcggcagctcttcggcaggggcggcggcgggcgaggttgccaagaagcgaaacgccgtggatttcctgaaccggatgaaccagaacggctcgccgtcgacggagagggtgtcgttgctggagacgctgaagctctccgcggcggcgacggaacagcaagagacagtcgtagtcgtcgtcatccgggaagggcgacggccggaaggaggccggcggctcaggctccaagaagggcgccgcgcctcgacgccaccagggaggaggatcggtcggccaccgaagcgggcggccgcgccgcagacgccgccccgttccaagagggccaaggacgacaagccgaccaggaagcgcgggaagaagtgaacggtcgtcggaatggggaggtggcgggaaaggctgcgggtgtaaatgtttgtaggggttggcggtagaaaaaaaccttttgtttttgtgttttggcgccaattgttgtagcgaggaggtgggagaatttttgttgctttttggcgggagatgaacgatggaacatctggtttcactctcacctcgatacttcatgaaagattaagaactttggtgaaagaatcgtgttcaccttaaggctggttttgtaggatatgtttttgactggattctgtaacctacactgaatcaggacacattggtgtcaatatggcatgaatcgaatcaagaacatatggtgtcaatgtggcatcatcatttaaccgcaataaactcgagtgggattctgtaatctggtattgctgttggaagttgttacatgcatatctgaatgcacatgtctcagctgagctttaacattcttcacctggctggcaaaagttcgaagaaatttcacctgtgtttcagctttgctgtaacatttttctctggctggtaaaagttggaaaagggtggaggtttaacgtttttcacattgctggcaaaagttggaataaaattcatctggcttgcaagaaatggccaaaaaaaaaagaagattttaaatcatgcggtgagcgtggatcgaacacgcgaccttcagatcttcagtatgacnnnnnnnnnnnnnnnnnnnnnnnnnnnttgttcagtttattacacgagtaattctgttttcttcgcagaattcattaatgctgtgcccgccgtacaagatgcaatcactgagtcacatgccagatcgctttgcagaacgtgttgcaaatgagtttctccaaacctttttacacagattcatattagtcacaggattcataaaataattttcttgatacaggatagcgcgctgcatactgtacagtgccgcaatttctttgcaggcacggatggcacagaagcaaataatttacaacctactaatttatgtccccatttcctgaaggagaaagggggtttcatctacgctctatttttagggcagttatctctacatttgcaaagaaaataccattgcaacaatacaagatatggagatctctaacaatatatattccaaccacaaattcacaattcatgtcgaccaatatatctggccgaccttgcattcttcacatgagtttccatcttcacccaccgtctgaagtgggtatccagttagtgcctgcagttctaaagctcaagacgtcaccagcaagtgatgccatgaccaccgatgtcatgcaacggtagtacctagttggcttgcaacgagcacaatatcttctgttatataaagtataaacagcggttagtgaaattgatcaagatcataagtaatgtgcaatgcatcatgttattccacatgttcgctgagtagctagacagtatttgggtttggtctagcttaagacgtcccacctgagaccaaatcgatgatgtgcataacttagcatacccgaattgtgatttcattttacagcccttcatagcaggatatagtactagcatctattaataacagtttcatatattgttggaggtagaattggtcttcaatttgaataaaacataaaggttctatactatgtccagcgttccagacagactagtgagaggtaaggaccaaatttaactggtcatttcccacttttgctcagaataagaaggcaaggggattttgaaaggtaaatacacatattaagccatcagttaactcaaactagaacttttgatactttattttcgaaattttggggg

SEQ ID NO: 63643 - DNA, 2085 bp, Oryza sativa
cagttcagttattagactttctttctcctacaaaagtcaacataatgttttcataaaagaatggtaggaaggggacaattacaatttaggatttccattgttgaaattacccaagttatagcatcagactgcactttaaatgctctgagaacaccagtgtacgcttgttgctcgatctgacgtatttctctgtccacgttgctgtgtaggtttggttgaggaagtgatccatttccattgaaaatcactcttggtcctctaggttggtatgtcggaggaaggtcgtcatcagtgcctgcagtcaagggcatagtcaataccattgaaatactgaatacacacattgtcaagagtttgaggtttcgcaaaatcatatctagatattctctacatatgtggatgctccttttaagtaattaattgacaattctaccaaaatagccacgtcctaattcctgacaagctacaattacttgtatgtaatctccataacagcacatcctcaattcctcacctcatactactctacaacgctacgaatctccccttcttcacaatatatatttaacacaaggcattatacacatttaggtgagttaatacccttcctcaaagattcccctccctgtaaaatccacctccattaatccatcacttatcttccatactcacaacaacttacaacgcacaggaaaagcataataatttttttagaggagcaaaaaataatatttgcaatttctgtatgaccgagtttaacaatgtggacatcctttcatcagctaatatatttccaaacgaaatttcccataatctaacagtaaagtacggccgcaagccgatgaactctcctacaaagaatcacacaaaaacctactggcgccacacaagaacgagcaaagactttcctctcagcaattctctctcgcgtaaacaacaacagattgatcgaattagactgatactgaccgctgctgtcgaggggttggtactgcatggtctcccggttcttgttcttccggggcacaccaattgcccgcgtgacctccggatccggtgctctccgccgaccagagctcgaatccggcgagaccagaatccaccggaggctggagccgcagctattggagaggaattcgcgctcgatttgaggggtttcggggtggaatcgggtgggaaacgcgagggtggtggaggcgtcggcgacgagccaaggggggaggcgtgttcaacttctgtttttttttttttttttgatcatgaggcgagttcaactacttcaacgcgatcgtgaaattagagaagtaaaattttcgggtagactcgctaagaatgttttaaaagaaaaacttatcggcgaaccggtgagacgagtcttgaagtattttctattttctaaggggcaacagaaatgtatattacaaatgagacccatttatatgaacttacattattattaggaggagagaagaggcagagaaaactaatatatttaattctctatgggtagcccatatgtttatgggtagttttcgttatttctttgctatggactagttgtctagtttcacaatattgataggtggctgaaacaaatattgtattgcttatggaccacttttagactatattatggatgctctaagagtagattaatttcgaggggattacctacatatctactgacaaaatttccataaaaaatttaacagatataattataattcaatcgtcataaaattacactgtaactttcaaaaatctctccgtaacatactattttagtgaaacggggatcgtgtcaacgaatcttctcatatgtgtgtgagtgacttttttacttcctcacatacataaattttgaaacaaatctaacaatttaaaatgatgtgaagttacatataaattacaatgtaattacatataagttatagtataattacactacggttgcactgtaataacatcggttaaatttatcgataaatgtgtagcaaaattataaagggtttttagggtgcatattagagtaacatccttgtcattgacgctggatatataacacaggaatttaccagtacaccg

SEQ ID NO: 63644 - DNA, 973 bp, Oryza sativa
aattcctgcagcccaatggctttgatgcagtgtaatatatatagttctgtccttgtacacttcaggaggtgtgcactcacgattggattggcctgagatgaatgggagacacttatcaagacaaacctcacaggatcatggctcgtcgccaagcatgtatgtagacgcatgcgtgatgccaagctaaagggttcagtaattaacatttcctctgtttctggtcttaaccgtggtcatctgcctggctccactggatacgcagcttccaagtctgccatgcattatgccacaaaggtactatacttattactcaataattctcatcaggcgtttgtttaatgtgcttgtaacaaactatatttgatatgcttgtgcagctaatggctttggaattaggagcatatggcattagagtgaactcaatagcacctggaatcttcaagtcagagataaccgctcctctattgcaaaagaaatggttgagcactgttgtttcaaagatagtgccacttaagactcatggcactactgatccagcattgacgtcgctggttcgttttctgatccatgaaacatcatcatatgtgactggcaacatcttcattgtagattctggtgccaccttacctggtgttccaatattctcttctctgtaatattcatcattagaatttgctttcaaaaagtcatcggatctattgatttggcatcaaataaaaatcgaaactccagggaggtggaatttctatacaattgatttccaatatactctcaacctgtccacaagttgttttctgttattttcttattggcatgctactctgacaaatacattttttggtataaaatgacaagttatctacttttggtcctcttatattttataatctgtcaaagtatcaaccaagatgatgaacccattggcactttggcagcggtataattaagttaggaatattcttttttaggtgtt

SEQ ID NO: 63645 - DNA, 3549 bp, Oryza sativa
gtgcggcaccggtacgcgctggcggaggcgcacgccgcgctggccgactcgctcgcgtcgatgtccgcgtcactgcacctcgtcctcgcgcccgcggtcgccgcggggacggccgtcgcgctgccctccgcgcgcaaggacgtggacgccgcggccgaggccgctgcctcgccgccgcactcgtcgtcgcacatcaacttcgcgccgtcctccggatccgagtcggggtccgtgtcctcctcgccgagccgccgcgtcgccgccggccacgagcaactctaccaaccgagcgcgctgccgttcccgcattatgcgtacggatacgggtacgcgcccgagccgccgttcgggtacccgccggggtcgctgcagctctactacgcgcggagccgcccgcccccgccgtccgtcgccgtcgagcagcgcgcccccgcgtcggagcgcgtctacttcggctcgttcgaaccggcgcagtatcacccctacggaggcgagaccaggagggcagacagggcggccgcgccaccgccgtcgccaccgagggcgagctcgtgggacttctttaatgtgttcgacaactatgaggtgtacgacaactactgctacgatgctcccggcaccggcgccacgacgccagcgccgtacacgccaagccggagctcccgggaggtgcgcgaggaggagggcatccctgagctggaggaggacgacgcggtcgtcaaggaggtttccagcgagtactccgcgcacgggagcggcggcgctcgcagccgacgcagctctatcggcggcgtgagcagcagcattgccgaagtcgacgaagaggagaatccagtcgtcgacaagggagtggtcggcggcggcgtggcgcggcaacagacgcctgcgcatggcaacgtcgccgcgtccgttccgactccccggagagccgccgatggtgcagacgttgccggcgagatcaaggcgcagtttgtccgagcggcggacgcggtcagggcgctcgcgccgattcttgaagtcgggaggcggagctaccatccccggagctcagtgtaccatggtgagctatctctgttctttgtataacctacgcatgcatctcccgattacctcgtgcctgatcattggagccattgtttgattgctgttcggaaacagtttcatctcggatggtgtcagtgattgcgctgccgcattcaggatacggaggcagcgacctgttggatgtcggaggaggggagaaggtggtgggagcaaggaacttgtctttgactctgcaaaagctctatatctgggagaagaagctgtacgacgaggtgaaggtatgtatttacagattgaaggtgcccaccttgttaagtaggagtagtaccctattttgctgtatgatgcagtatattttttcgacagtatgatgtagagatatgttgaaatatgctagtagcatgtataatattagacgccatgatattgctcttcaaagtgttgtaggtcaggatgcaaaattgctgctcgctgagtggtcccatactcccatttgaaacaaccgagtacaggtcctgactagagagcaataccattcatttcactgtggcaagtttgcacagtgacaacgtccttaaccagtcaccaatagtcacgcctatgtagaaagatggatttgagatcttagcatggcattaggtgttttaaggctgaatcttgttgagatgttcatgcattatgtattgcccactcctcccaattccaacctactcatccccaaacaaaagcatacacccctaacagtgttggttattttagtactgttgcattgggtctatcttgaattaggtgtgctgcttgattaagaaaatggctcattgaatagcagagttgaaagtgcctttatggggacctaacagccagatttggaactgttcttttacttgctgtattctaagttatgcattttcttcataagcctattagtgagatttatttagtaagaacacttacgggttggtgccttttcctctaatggcaattttatcaagatgttgctgccatgcctttttaggttcccttgtagcataacaggacaatattatattttgttttcatatcattatcaccctacgtgtaaactaataatcctatgaggaacccatcaatgaagaattactgctcttacattggggaaatcatgttgtttgcttgagctcacccttggtagtctctattccgtattgaatgttttggtgctgttttcctcttccaggctgaagagaaaatgcggctcctgcttgccaagaactctaagaggctgaaattcttggatcaaaaaggcgctgaagctcccaagattgatgcaactcgtaatttggttaggaagctatcaacaaaaatacggatagctgtgcgagttattgctaaggtgtcgaaaaagataaacagagtaagggacgaggagttatggccacaagttaataccttaatccaagggtacactctattctttccctctgacatttattcaaatagtctgatttagctttgtctttacccattattttttttattttgtaatgtcagtccacatgtgtagtatgtctatcagaaagtaactgccttaattctgaaggtaattatgtaccagtgcactaaattgatctctgtagaaattgacacattttcataacaaaaatgatttatgcacatttaagttaatcaagttaaagcatcacaaacagtcatgtgtacgtctagaattgcttttttttttgggtactctatggcaaaagtgtatttgacgatacctatgttgtagaacaatcaagtggaatactgaacactccaaatttattttctagatattcttgcatttcatattatcttcaaatctagtttgtgtcaaaagaaaagtcttatagccatcttttacaggtttgtgaaaatgtggcaagataagctgaactgctaccacatccagtgtcaagcaatatcagaggcaaaaaacttggattcaataatttctggtggaaccagtcgagatctggcaatggagcttgaactagagttgattaaatggatcgtcaatttttcctcctgggtgaatgagcagaggagcttcatcaaggcactgaatggatggctggcactctgtcttaactatcagcaggaggagacggctgatggagttcctccgtattctcctggaagagtgggcgcaccccttgtgtttgtcatctgtaatagctggtcccaagctatggatcggatttctgagaaggaggtgattaccagcatgcaagctcttgtgtctagtgtacggagcctatgggagaaacaaaatgttgagcaaactgaacagctgattgcaatccgggaaagagaaaaatggaacaagatattggaaaggaagaccctggagattaacaagtaggccgacacactcaacagaaagctagctctagtaccgggccggcaaagccttcttccaacagcacaaacgtaccaggtccattttcttgaggcaaacagtgtgcaggttagttgggctgcaggaat

SEQ ID NO: 63646 - DNA, 1626 bp, Oryza sativa
agaaagttactcttccaattccctgcgagctttggatgagaccctgaggcatgccgaagaggaaaggttgtctagagaaagagccaaagtttcataggcattggcatagaggttccatctgacactacagtgaacacagcttgtaaaatacaagggtctcctctccaggtggttataatttatcagatcaatgcagaatgttctgggcaaatgctgcttgcagatcaaatttttgtggggaagttctgactttggagttttgctaactgaccgttgtttgtcgatgcagttcaggcaaatgtcctgtgttgatccatcataatagatatagttgtgttgaagtagcaggtacattaggtacatataggtgaagtgctcgtttcggtgctagtatgcaatgtactgatcttctgtgttgcctttttcttggcctccatacaattgaatgaatgagcaagagtgcacttggaatgaatgtgcaactgtgcaagagttgaaagagttgaatgcagttcgtggcgttgtattgagtatttttccggtgcacttgaatgaatgtacaactgtgcaagagtggaaagagttgaatgcagttcgtggcgtagtattgagtatttttccggtttaatagggaggtatatactccctagtatattctagggagtacctcatggttacttctcatggagtacttcccaagagctataaaaattccagagagcaaaataaattctgctaacaaaattcaaaaatcagaaggaaaattgtccactgaaatcttgcctccctctctccttgcacaggcaaatgagtcatgcattcatctgatattttgacgaccgtgatgaaaccattatttctgttaagagattttttttctccaactttctgagggtttttgtattttgtaagtttggtgctgccgagtgcacatgaagtgtcctaccttggcgtacatccagttcgtgtcagcgactttcacgaaattacagagggagttgtgtacttgtgttctggtacaataccttgcacttctgtaaaggaactcaattacacttggccccttgaagcatggcacaatttgtggaattctgcacttacaatactctgaccgcacctatagatagaaaacgagaaaccatgtacagtatcaaacaatcaatcacacaagtagctaagcaatctacgggagctgtacgctagcaccaaaatttaccagcgagtcagcaacccagcttgtattccgtagctcctgtacaaaagaatatcatgatttcttgatttcccagcggcgtccccgtatgacatacccatctgatgtctggtcgctgccttcccaactgtccacaacaccagctgagcttacgtccctgcggtgccgttttcctctaccgatcccactgtcactagagctcccgcatatgagaggatcatcgatcccatggattgctctctgtggcgtggaggtactcacccaattgtcatcacggctttgcccgaacttgcccttcttcttcattaatttctcaaagcgcttcccgactggtcgcactgcttgcttcatcgtgaatttgagatcttttatcacctaaagataaagaaaaacacaaaacataataagaatat

SEQ ID NO: 63647 - DNA, 1419 bp, Oryza sativa
tctaatgaccatgctcattgtactaatgtttactgaaaaataatttatgaagcaccgtactgttcattagttaggtatagaccttgagctatgcggtgtgccccattacctggtggagtggaacctgatcatgaccaaaactgcaagtgcaaaagcaaaagaattgcctgcgaaaaagaaaagagaaaaaggagatttgactgctgttgtaccctcacagctttcagcatagaagtgtaaaaaagatacgactggtgtgccctttgatgccaccttcttaaatgtatgtttaatgttttcatctgaaacaaaagtgtccaaaccctacaatgctgcttcatgtcgatgaactccagtaccataccatctcttttgattggttctagaagcagcctgttctgctctgttggcaagttgtattcctcatgttatctgatatgtcatgcttgagtcttttactcgggcaatatgatctaggtgaacgtatgtaatccacacctgagttgttaagcttatcttttgctactaggtgaagagaacggtacatcatggagctgatatcttctccttttatcagaggggacaaaacagaaattggaaccggagggagaaatggcaaaataaatgatcttatgccgacccaaactgtgccgtaagccggcccgtaacttcttttgctggatcataaactgcaacctactccactccaggccggtgtgtcctgtacttgtgtaggtttaacttgcaggtacttgctgtgactaccaagcgacaaccagttaatcaccggtaacatcagaccaaaatttaacgcaggcagacggtgatatataagctcagcaaaagcaaagaacattatggccaatgaggtacctgacaaaaacatctagaacactaatacacagcactagttagaattgcatacgtgcctgacagcaccagacgtcaaataccacgagtaaaattattgccacaactccaagtctccaatgtacattttcgacacaagtagagacggtttcgggtttcccaccaaagcttctatacaaaaccagctcactaggaatcaattatacctaatttgaaaaaaatggtggaactattactaatcagggaagcatcccccacaatccacagcaacttgcctttattagatctctgtaatagcttccccacgctgcacgtcctggtctcacgatgaagaactggaggccttaaaagacctttccatgctttattgtttccaccaaatattgttttctttcctacttaggctgtgtttagttcctgaaattgagaagaagtttggaaaaagttggtagtttaaaaaaaagttgggagtttatgtgtaggaaagttttggatataatgtgatgtgatggaaagttgggagttgggggggggggggggggaaagttt

SEQ ID NO: 63648 - DNA, 3808 bp, Oryza sativa
aggttgaggactcctagacggctaggagtcgttcctgagccaccgatctacttgtgattggccgggagaagtttgtgaaggccagatctcatcttcgcaagggaagagatacctcttagtggaaggaggagtgcttagtgcaacctatcgaggaaagggttagctaagacccagctcttagtgagctcctcaacggatagtagaatcccctcaaggatttgaacatcgggatcaactttgtgagctatatcttggtgatatttcttcatccctctcctctagctttgcttgcttgtgccgctattggtctagttgccgtttgtgccttgtttgccctgttatagacttctagatctagagtttttatcctgtgttcgctgctctgtgcattttcggaagttccgaaaattccagcctagttccgaaaattcctgcttccgcttcatttaagtttttaaattagcctattcaccccccctctaggcctaattgaccctttcagtaaagggctaattgaccctttcagtagctaagagtatgtggtcgtcaaatgttgtggcaagataggctttagatgttttactcctttccgttccctgtctcctttctctttttttccctttcagttggcatgtaaataacttttatttctatgtgctcctaaaaaaactcttaaaaccaagtcaatttacctctaaattaaagtggtttggataacgcttatgtggcactagacgcaaaaataatgataataatattaatgggagccacctgtcagtaccagtttgaaaaaaaaaactaaaacaacttatgtgactatgtgagacccacatatcacgcttcatcccttcctcggtctcttttacctcctctctcaaagaagacttggaagcaaagtggaggcggaagcgaagattgtaggcacgtgtggagaaggaggtgagacggtgctcggtgatgcgctgtgaaaaactcaaggcttgacacccttccatggtcttcctccacaccatcataggtcaaccctttcttcggttcacgtaaaaaaattgaaccagagtttcaggttatcgggtatccatatgtatagagaaaatccatgaaataccatcgacaagcgcaacttcctaaaaatgtcatcgtacaagcctatttctcccagaaataccataatagtcaaacggttgttaacaactcttcgttaagttgtatgaaaagacattcttaccctccagacaaccatttgctcacacaatatcattttgtattgtttgctcacacaatattattttgcattgatccatatttatgttagcttccaaattcacggacatcattattttgctatcaatcaaattatttcataatgcccctgtgtcgttgcctgccacctcctcgcagcccgtcacgccgacgcctgggaccgtcgggcggacgcctgcggccgacgcgccactgcctgggagccccacgccgccacctgggaaccccgcgtcgcagcctcgccgtcgtcgcccatcaagagagttaaatcgggttaggtttaggtttttatcttttcataatttttttcctttaccggtggattgggatagaataatttggagtgagagcaatttggttattattgtaaaaaaaaattctaatagtgtggactaaacggtatgttgactgtgatggtatttctaggagaaataggtttgtacgatggtatttttaaaaagttatgtttgtcgatgctatttctagaattaaaatgcttgtcgatgatatttcatgaattttctcatctttataagttggtgccattaactcttggcaagcgaggtgctactgaagtaactgaaactgagcttttgctgctgcccggctgcttactttgctctgctgccttgctgctgttgctgcctagcaccgctgctagtggctaaatggcccaaggccagctactgcagctcgctgcgctactaccacttgaattgctctcctagccggcaaagcccaagcagctagctgctagctggagtacttttcgagaatgggccaagccccagtatggcaggcagcggctgctctactttgcttcttgctctgctcatttctttatttctttctcgtttttctattttagaaaaagtccactttgactcccttaattgtacgccgaatctaattcgtacccctcaaccagaaaaccggataggacgactcactgaactattgaaaacagtgcaatttaactccctcggcggttttggaggacggttttgctgatgtagtgctgatgtggcggtgttgacccggtcttcgtcccacgtggcgcctacgtggcattagaattaaaaaaaatccatgggacctatttgtcattaaaaaaactgggtgataccgcaccagccggaatgcctaccccgccatgccacacgcggcgaccgccgagccgcagtagtggaacagcgccgccaaatcatcagcgcagcaacggtgacgttgacgagccgggcgatgagctcctccaaatcatcaccgcgccccggcgccgtcatctccatgcccaccgccgcgtgtggcgccgtggcggcggcgtccagcagcagctagttgttgctatgcacagcgacggcatcgttgaagcgggctatgagctgctccatctccatgctcgccaaggccaccgccgtcgacgtcgggccccacaatatatatttgtgtgtgaatgatagatgggtcccacatatattttttaaattctaatgccacgtaagcgccacgtgggacgaagaccgggtcaacactgccacgtcagcgacacatcagcaaaactaccctccaaaactgctgaggaagtcaaattgcactggtttcaatagtttgggagtcgtcctatccggttttctagttgaggggtacgaattagattcggcgtacaattaagagagtcaaagtggatttttttccttctattttccctctaattattctgggccatcacagtgcctctcggcaaccttgaggccgtctctgcaccgactcagcccatatcgtttcccttcatcaccaacgggcatagctgcgcgcttgtcgcatcttgcctaccatcgatgggtgggtgagatcaatggtggcggagggcggcagggctcagatcgtgtgggtgggccctaacgctaacgcaacccgacggccaccacccaaaatatttcttctcgacggcagcgagtttctcctccgcttgttattccctccttccaaatctagcacaatggttgagcttgtgctcggggcccactcatcgagtactcaagttgccaccgcctcactcctcggcggtggcctacttgtgttccttcgtcgtggctcgagcgaaacttctagagccacacaccccactctgattaatctcgtcgacgcctcactcctcatagcagccaactcactctcctccgtcgtggcttgggcagagcaacctctagagcctacgtcctcctctgactaccctcaccatcgccaccgccactagaccttgggtcccttagctcatcatctactgcctctctttcggcgctaaggtgctgatggatgaccatgactagcacctgctagagctcctcctcaaccgacgctacggtttttatatttttctaagagcggcaaatccaagctagacacctgccccatgttgactcaatgggtcaatcacggttagtttgttacttcagcaaaaagtacttcccaatccaatcagtttgcaccagtttttgaagacagggatgtattatattcgattgtatgattgagagagaagatt

SEQ ID NO: 63649 - DNA, 3178 bp, Oryza sativa
cagggaggcgtgcgcgcggataggatcgaggtctcctcctccctcccgctcctctctcctttaactcccggctcctcctatctaactctttacaccttatctcttcctctcctcctttctctcccttaaactcccggctcctcctatcctctaactagctccttacgtacaccttatctcttcctctcctcctttccctccccaatcctccccacttcttgatctgcaacgcagaggcccgtcagcgcctctcctcctttccctcccatcctccccacttcttgatctgcagcgcggaggcccgggcagcacggagggccgggcagccggcggctttgcggcggcgcgccagcgggcagagggccggtcggcctcgcggcagcgtggcggtggtcgatgctccggcgggcggcctcgcggcgggcagcgcagcagcggcagcgagcgtttctttttttttttgagaatttgtgattcggatctgagatgtatttgatttgtgtgtgatgtgaatatgtgatgtatttgtgatgaattttgtcgaagttgtgatgtaatttttttttaagattttgtgatgtatttggatatgatcgatttgaggattcaaggatttggggatgattgatttgggattttgggatggggatggagtgaaatcaatatattaaaaacaatgaagaagagaatagaataatggagtaaccggatctagctagcttagctctatctttagtcccggttgataacaccaaccgggactaaaaatggatttttactaccggttatttcacccaggactaaaaccgggactacaaagggttataaaccggtagtaaaaagcacttctccaccagtgtaaagtttgtacacaaattcaaataatatacagaatatttttgcacgtatacaaaacttttatatgtaagtagaaaaattgtgcacagaaagtttgtacaatattttttctatatgaaatgtattttttacatataaagtgtttatgtctaaagtttttctatatttttttgtccatcatattatttatttggctaaaaggcaatggcctcggttttaaacgggctaaatgtagatacataaatgggctatacgtgtacctgtgggctgcacgcggcccgggggagcaagcatcaatggctaattattgaaagaataatttcactttaggtctttcaatatgttgccgagtctgaaatttaaatttatctctcacacgaaataccaggtatagtccatcccgtaactaatagtgccatgttaactttaatctcttgttagtatagtgtctggttttggtttacgtgataagtgggactcacgtggaccccacatgtcagcggccacctcaatgatagaaaagtacttatcataccctaatgaaataacggtgcagatcatttctactgtttgtataatactactagtagagagcaccagactttcactaaaagaagtattatctctattttttaataaatgatggtgtttacttttaaaataatgtttgatcatcgtcatctattaagaagcggatggagtatttgttaaaaaaaataactagagtttataaggagtcatttgttaggagaaacctgcccttcagataaaaaaaacgtgtaatgaagttcagaacacctgctatgagcatctcaaatatagttaactgaattaaataaaaaaaagacaaaaggagcgagagagagcttgctagtgatcaaatagtactctaaatcatagtcgaattttaaattataagacttaatttaagttgatcttggagttacttttcataacctattctctaacattagcttttaaatcggtaatattacatatgtgaaagatttattataatttttttattgctttatttaattttttacatgcttatcgaccatagctcttttttttaattttagagaagagtaatttttacccagcctgtacatccaaccagatatatacagcctctttttatttttatttttttttattttgtgatatctcgaatagagtggccacgtgtcaacggaaaaaaaatgctggacgaacttggcaggggtggagggcatatggtcttctttctcatgtaaccccctactcttctttctctctgtcatcttcctctctcctctctcatatttctttgaagctacttatattttaggaccgaggataagattataaaagtggttttctttttttatagatcggagcgtgatttttgaaaggaaatgcgtaagggacaattttggatgaaacactgttcagatgcccctctttccttttttttaacatgtacgggatgacacaagaggataatgcccagatcaagacctgtttacccataggtctgcacaaggcctgaatgggccagcaattggaccatactaaacaagcctaagggcatttctcgaagtaataagtctgtcttacctccctcaacacttgccgctgatgaattgtctccctcaaccgcaatatcgagtacaatgcattcccgatcttaaaaaaccagagcaaatcgacttccttggccattttgatagcagtttcgtcatacatggtgctcataaatcccacatgtcagtgagaaaaaaaataacgccccaccccccctctttaccctttatctctatttatgattctcgccaaaccggagtcagatcagtgatgcgtagtcgatgaaacttggaaaggagtgtcccgaagagcgtgttcccaagcacaagcggcttgttgagtttctacatcgcgaacaccttgtcgaggatgcggccggcaaggcggttcttggataggtcgatcggcggtggatggtgtccacatagctccccgtgctggacccatcgacctccactgccgctgaggtctctaggaaggtagacagtggccgacatcagcgagctcgtaggggagctggggtaggatcaaccgggagctactctagaaattgtcatcgctgccttgctcctctcctgccgaccactagcctagacatcacgaggtggcatgggatggggaggatgccggccacaatagccatctgtcgcagttcggacgagatgggaaggcaccaacgatgagttccacacgtgacaaggagggccatggcagggagggtgtgacggtgaagctggatctgccttcgggccct

SEQ ID NO: 63650 - DNA, 2420 bp, Oryza sativa
aacaggctagtaacagattatttttttaatgggccaccttctatgtattgtatacttcggggcccacaggtaatccgcgggtaatttttagtccccgcccccgcccccgaaaattagcgggggcccgccctgccgcacccgcgggttagaatttccacccgcccccacccctgtaggggcgggtccccgccgggtccccggtcccactggggaaattgctacccctagcccccacgaagtcggcaaaacgtacttctacgaggttagtacaggttcgtgcgccgggggacgagcccgaactgaagctcgtagcgaggcgagtacagatttgcgctgtgcgggcatgtggcctggcatcaagtgatgcgcccctcgcgtgcctcccggctgaatcgattcctggcgcccgtgtcctcttgctggtacaaaagccgaagcccctgccgcccatccaggctccccccgtacgtgggacgcgggcacatcgggcaggatccgatgtcgccgactagtttatccgcaggctcgcccgagtccccacgacgaggcgaggccagaggctcgtcgtggtacaccagatgcaacggttggaacacgtcgtcctccttgatttcgcaaccgttccacgtcagaacagtgctggaaaagaacggatccatagagagttcttcgtggccgtcacgatttcgcggcgccaaattaccttgcccttatggttaggggcggcatcttgtgtaccgaaagtcaataatgactcgagctaaacccgtactacagactagagtgtggccccaatgcgtttcgcaggacaggacgggcgaaagaaatcaaaaggccgacatgccaccgacatttccccccacgaaagctatcatcagctatcatcaaagcgaaggaaagaaagaaaaataaaaggaaaagaactggctggaaattagagaagccccggacgactcgatctgggggtggcaaattaatcagtgtgatcaacagggataacttatcccgtccgaccaaatccaccaaccaaaccaagacccgatttgttaggctgtgaaagacggatcagtgggaccctgatctacggaccccatatgtcaccgtccaggtctctggatctctcccgtcgtcctaatcagacaccgcgcgcgcggtgccgtcgctctcgagccgtgtcccgctcccaactcgtcacaaaagcgatcacagactcttccttcctctgctgggagagaagaaaaattggccgcgatgatgccgataaagaggaaaaagggatgagaatccgatggaaaaaaactgatgttaatctatcgctactgctgcgcactaagacgaatcgtatccgaacaagaaacgcttacgttactgttcctaaatggatcgctccgctcatcacttaaccaaaaatcgattaggaaattgacggacagcgacgcccgaagccaagtgtctcgtcgcgtaggcgtcgaggcctcgaagcagagggagcggagaggcggacgcgccgcccacgcctcctctccctcggtgacacggccgtctggctccacatggcgccgacctctcccgatgcgtccacccgtcccgaggcaccgccacgtcggaaccagccggccgccccacgcgattgccgacacgcgtcgcggcgccactggctcacccgctgcctgcctctgcctgccccccatctcgtcgccatttcccgcccacgcttcttgtcctcgcgtcgcctacgcgtacgtacgatacaaacgccgcacctttcgatcccctccgctatataaggagggcatctgcctcgccaccttcttcatccgaaagcaaaagcgactcgtcacagctcaaacaagtcaagagcgaatagttcttgctgatctgttgtttgattactttagttctcgagaggctttagctgaatccatcgatcgatcatggaggatgagaggaacacggagagccaccagggtggcgaggctgcagagcaggtggaggtgaaggacaggggcctcttcgacaacctccttggcaggaagaaggacgatcagccggaggagaagaagcatgaggaggagcttgtcaccggcatggagaaggtctccgtggaagagccaaagaaggaggagcaccacgccgagggcgagaagaaggagagcctcctctccaagctgcaccgatccagctccagctccagctcggtaagtgcacacatgcatgatctagctttaattagttacagactttttagtaattatagaaggtttcatgacctttaatcgttgtgtgcaacagtcgagtgatgaggaagaggaggtgatcgatgacaacggcgaggtggtcaagaggaagaagaagaaggggctcaaggagaagatcaaggagaagctgcccggccacaaggaccatgccggtgagcatgc

SEQ ID NO: 63651 - DNA, 2842 bp, Oryza sativa
attcctgcagccttaccacaagggctccggcgaggaagacaagaccgccgccgccgccaccggcgagcacaagagcagcgcttaattggggcgtgtgtgagaccaggccatggttggaatttggaagtgtttggcgtgtgttagtttggtgctttttctgcactgcagctttgttaagttcgtgtcaagattggtcaaggcctggtcagcgaagcccgatcagtgatcgaagtttgtgtttcgtgtggggtacgggcttcagtttgctatagtcaagtactagatgttgagtttgtttaattattattggcactcttgtattggttttgggctgggcattctgccttggtattaatgatttctgcccagaatatattgttgccttgtacagttgtactgtactactctactggggtacactgcattgtgatcacattttctactagatcttctcaatcatgtgcctcatgtattggtccgctcttggttcattggtagtgtgcattgcgggccagtgtgaaacgagagtaacagacaccgcgagccaactggtacgtggattgactggcggaccttgttctcatgggcttcttttgaaactcttatgggcttttcagttggcaaggcgtaatattttcttgggccatccatctttggatgggccttgtaatcgagaagtgagagagaagacaatatctgggcctcctctccgagagacggatattgcagcgtacgcgaacagaacaagcgtgtacactttggcgcttgcgctcaagcagcaatgcgggtttgagaacatgccaaccaaacacacgccccagcgtgtcatgtaccaaacctcttggcgacggaatccgcacggtacacgagcctgcacgcgctcccgcacgcgcgcgcaaaggaacagaggagagaaaacgacgtggtggctggtaacttcgtccgtgccagcgctcttgggcctcatggtcacgttgatgccaaagcagcccatgttctacgcgatcctacgacggcctagagctctactcctagatgcgagaagatacagagagagacatactggaaatcgtacgaccgtgtgccggtgcacttgtcgactgtcgaggcttgtcgcgcgtgcgtgatcaacgaatcgagtgctctggcctgcacgtagaattgaaaatagtactactagtaggaaggatgaaaaagacgagagttctagtaccaagttggtggatacgattatgtgcctttggggagtggagaaaaaaaggcgcaataaactagagtttgcaaagatcccgcttaagtactctctgcactcgtggtgccaactcgatcaaaggattaaactacgagtactaaccaccatatcgctagcgtacgtcttggagaatagctacttgcacacagtaaaaaaaagaagtgatgcaatcattcaacctctgcagtggcacggtaaacgggtgaaaaggtgttcgtgcagctgtcagaaaaatctgaaagtgagcggagactgattagggcatccacaatagttatctataggctctaagagatccatatcaacatattttcctacttgaaagagattaaatgaagagagatagttatctacaggctctaagagatccatatcaacatattttcctacttgaaagagattaaatgaagagagagaacaaagctatctactaacctggagatagtatacagagaaaaacgagacaatgtattagagagctatagatacccatgtagacatactattgagatggtttactattaatctagtctattgctgagagatacatgttttatagatagcaccttactttaacattgcgggtgctcttagagcaagtttaatagtatagccaactactaactctaattcatctatagtcaatctaataactcatttatacaatagttatatactataatattaatacctggtcccacctgtcatacacacactatgtcttggagtccgtgctacagctggctacaaatctgtagcccactgctcttctctctttatttatcttctttaaatatgtttgcagctggcttatagcatgctattgtacctgctcttactgcccgagtctcaaaaggaaaaggttgcgctgcccactgctgtcgttttattttcgttgctttcaacaggagaaagattgaaaaaaagccatgctgtgcatgggatcttctttttctgcctgggcaaaaaaaggtgcatctggcaggctagcttcagttgtaagtgatggtaagaacaatacagtatgaaaagaactaaacgtaaagatataattattgggtgcttatttaagcgtagaagaatcggccagcgcaaacttgtgtgcccagccataaggctgcctattcatcccactggagcattatcaaatgcaaacatcgaaagtaattaccgtatcattggattccggctgcctttctctatgcttcaaggcttgtagacgtgttaaggttcctgcctgtacaaatgcatcgagtggttggtagaatatgttcctatggacaacggggttgatccaagtaatcggttctgatcaagctaagttacccccactcagtcccggcctcccggggatcgattttctgtgaaaagtagcagtaattactcttgagagacagagtatccaaaggcacttagaacatcatgccgatataattcgcctgtaggaccaccagggagcatgagatcgtggcgagtaaatttgacggggtttgctggacaagtagactgagggatcttcttggttttgtcacaagtacatgtaggagccaggatagtaggataccttgatcgatcgactttcttcgctgt

SEQ ID NO: 63652 - DNA, 1259 bp, Oryza sativa
ttcctgcagcccaggcgttggccgtacgcagctcgccatcgtcgccctttaaagtgcgccattgccgctccggtcgcggcccctccctttcccaaaagcaaacaagggataggtttgccgttcagcccccacccagagccagcggactgcacctcgcagtccggcatggctggacagatgctaccgccgattgcgcttgttgctgtggccatctgtatcaccgcggcggcggcggcgaaggtgccggcgatatacgtgttcggcgactccacggccgatgtcggcaacaacaactacctgaccggcgccgccgtgccgcgggcaaacttcccgcacaacggcattgacttccccacgtcgcggcccaccggccggttcagcaacgggtacaacggcgtcgacttcttgggtacgtacagcttcgccgcccgtctttcctgtgctgtattgcctcgcgactctgcttgccatgcgatgcgagtatacttcggcacttcgcggtatagtagcggctggcatcgttgcatatctgacaaccacgtatatagccggtgattgtttcgttttttctgcatgttttttgtcaacttcggcattgcaagttttgtaacggtgctagagttgagtaggggtgaagactggagacgattaagtcttcgtctctatactatttccgcggtccaattaccgaaggcaagaagtggaaattgctttgaaaacggagagattgtcgcatactccctccgtcccaaaaaaaaccaacaaaggttgtgccatactacctttgtaaaaaaaaaaactacggagagtatgtttagatttgtttttgttttatggatcatatcttatcttaatataacaatattttgagagggagtaaatagaacataaaaaatgttttgaagaagaaccccatacttcagaactgtgaagtgcgcaacgccagggcagtgtgccactgtggcgcacacattccagaggtcgcctatgcttaaatcgatagttggctcgttgctgcccgaattaaatttgaaaatatattgttaattcattttatttttagaaatattcgagatttattttttaaaaaaattataccgttgatcttgcacaatcattatgcgaatgtgaggtggtgcgacttcgcgggcggtatcgcgcgagactgcgcggtcttgcgaaatgaaagaacgataccagatttcaaaatggttaattagtgattaattattatgattagcaattattaagtaatcatt

SEQ ID NO: 63653 - DNA, 1027 bp, Oryza sativa
ggtgtttttccttttttttatgttgtctagatgcggttttttctacatctaaatgtagttgcgcttagcgcgtctgtagcataatcgttttcgcgatgcgtactatattttcttctcatggtattgttttcctcaccaaacctgcggtggctagcctaggtgctaaaaggactttctcaaagcgtatgtcgttcattatatattttgacatgaggggtttggtcactggtggggagggtagggcaagaagcatggcggacctaggctcattggccatggaagagaccaagaagggccttggccatgcattaaatagaaggatggtgttgtggcctagagggagaaggaaggtgttttcgtcatgtactcttcttgcctgatatgtaatgtttctcagctgagaaccattgcttacatgtcgctaacttttccgatcaggaatggttaaatatcgaattccaatctataatgcttctccaacagttagagattgatcagtaaaggtttgacatatggatgaataatggtttcatgttagttaggctttatcgggatcattgcttctatagtagtaagagcgagtacaatagcagggtacaagtcagttgtaagcacatatggagaagagaagagaagagagataaagaagacgggctataaacttgtagccagttgcagcatggactataatacattgtgcatatgagaggtgggaccatatattaatggtgtagtatatacttataagtaactattgtatgaatgagctattagattggctataaataaattgaagctagtagttggctatactattaaacttgctctaatagttagtattattatggggaatgtgtaagccacgagcacggagtagcgcttgcatttttgttgtatatctcgaggatcacaatattcttcaacctctgtcagctcttaacatgggattcaggcgcagccccccaccgttcctcgccgtggctaacaaaaccagcaacccattgttcagggggctccagggaacaaa

SEQ ID NO: 63654 - DNA, 709 bp, Oryza sativa
cgcgcgatgtataagaggtcgacgcaggcggccgacgaactcgcgaggagacgggagtcgaggctgatgtgacgtggagactggcttgcgcgcaaggagtcagaggcgagaatatgcggcggaagccggaagcagcacgacgccggcgccgctactcgcggtgatggagatcggcgcgacggcgtaggcggcgggcgaaggagacggaacgggtgctggaggaggggaggccaggggacagggggctgggtcgcaacgcaaggaggcaagaggcctattacgctgctgggtcagtggggtgttgttacaggtttgggctttttggtggctcggtctccatctgttccatctcctcccaaccccagcccggttgaaacaaaaaaacaactagggtgtgtttggaactttggggagaatactaccaatcgaacgtccgatatatcaaaaaaaacatcggtcggtcaaaatgttgcagctgaccaacaagtgaaacattaatttatatatggtgaaacaaaaaaacagcaactaaaacatttaaaaaatttatgaaacacagtgaagatacacgttgaaacatattgctatcacttatgaaacaataagagttaatagattgaaacatatatttttctttcatcaaaatttaatcgtgtgatattttattataaagatttaattaccacgaatacaacggtgtaatcgaatc

SEQ ID NO: 63655 - DNA, 1016 bp, Oryza sativa
ttgtcgatagaaaatagggagaaagactcttgatttttcggtcgtcggatttgcattaagattcgtgctagcgtgtggagggaaaaattcgtgtgaaaatttacttgtgcacttgcacaggatcaaactcaggacctcgtttccgcaaaccatgctagccacttgagttgccataagattttgaaagatttagacaagttacattacatacattctagttacactgtaattatatttgaaagattttagagaaattttctttcgaaagttctatagtaacttcttttatgattccaaacgactggtcttgtcacgccaggctagcatcaaccgttcaacctagccttggatgacttgaatggcagcctagccaagcccaaactctgtattgtgatggatattgtctgtatagcccagagttttcataacacaagggagagatcacactaagcttccccttttcgggtttgcagcccagctcgtgaggcaaggtcacgctgctgctgtaggatcgtaaatgatctttcccacctcaaaagctagccaatgagggatgggctcccccacttatatattaagtttcttgtccttctataaccaatgtggactattcaataatctccccccttcatatattggtgtccctcagccgttcaccaccccttcaccgtttccttatggtctctcaggtatacgttggtgtccctcggcctttcaccgtccattcactgtttctctacggtccctcaggtatacaggctccacaagcatccacggtccatcatgccttcgcacactttgccactcaggttagagatattgaactaaccagactcagatagcaattgtagaatcgtaaatggtctttcccacctcaaaaattaaccaatgaggtgagagactcccccacttatatactaggtcacttgccctttcacaaccaatataagactattcaatagttgcagcgagctgaatttgtggaaacaaaacggctgttcgtagggctgcaggaa

SEQ ID NO: 63656 - DNA, 1092 bp, Oryza sativa
cctgcagcccctccccccaaaaaaaaagaaaggaaaagaaaagaaaacaaatgccaaaacgtcaccaggattacaagttgtgattttaaaatttaaaattgattcattataacgctgtctgtccgtataatacaacaaaattggcactagtttgcatgtagttttgctctgcatcagctcccaccacgtgaaactgtgaataactggggcatgcatgaactgagatttttctttttgcttccacttacacacaactctgcattacaatatctgaattcagaagaacaaagtgcatttgtaatctctcacagatgcatgttcaccgaagtatattgtccccgaagcacacactcttgtgactcactctctttagttaatttcaattgccattctctcgcttcggaatccgtgcagagaaatatggcaagtgtagaaagaaattgccagtgaacaggtaaaagccatggtcccagacagatcagagttgtaagtgacttatctacacatacgtgcatcacttcctttttgcatagcctatagccttgttttgagaattagacaagagttattttaagagctattttttagcataaggaaatagccctctaataaaatagtcctaaattgtttggattcaagggttattttgagagctatttagcctttaatgcaccttcccatgaagagagatagaaagaaaagacattttttcagtgggccccacccgaaatagccccaattagcactccttgggtggaatagtttttttatgtgttatttccaaatagctctcaactagctcactcttttgaatctttttgagctatttgggctatttgagggagggctaaaaagtattacttggatccaaatagggcatataagggcctgtttacttcgtgaaatgaaaatttttggatgtcacatcggatgtttgaccggatgtcagaaggggtttttggacacgaatgaaaaaactaattttataacttgcttagaaaccgcgagacgaatcttttgaacctaattaatccaccattagcatatgtgggttactgtagcacttatggctaatcatggactaattagact

SEQ ID NO: 63657 - DNA, 5173 bp, Oryza sativa
cgccgatgccactgcctcccttgcctgccgcggggcgtcagacgaaggcgcgcgatgccagctagtgcgcgcgccggtagcgatcatcgccgatccagtgaaccgtttctattcaagcctttttttttcaaaaaaataaaggtatgaattaccccctcctagcgaactcttacggtcaaccgaattatctcctctgaacctaaaaaatataaaaaaacagacatattcaccttgaacatttaataccggacaaattaccccctcaacttaatatagagcggttttgttttacgtgtcatacgtgtagaatttcagtcaacattttctgattcggggttaatccgtgtggatttgaccataggcgtatctgattttcctttgaattgaatttctctatttttctatccaaaattccatgatccaaaggagtctgaaaaggtttcagggctctggttgcattttaaagaaattttcaggattttggtgttgttcatgtgtatttggaacacaggaagagataaaattaaaaacacaggaattttagctacaccgatcatttcacgggataaaacgtgggaaaagaaacacatccggtcaaaacctctttctttttttttttttgaaaagagagaatatattaatgactgaaattggggttacattctaggttgagtagttcagtgagttctgcaggagaacttaacaaccattcaccgcagattcctgaacttactactaatctaggtagcttatgcgctactccgtttgattctctctttatcttgtgcacctgcacctgttgtagacactccatccatcttagtgcctccctgatcgtcccagcccactccgatctcaactgagtattgtttgctagtattacaacatactccctctaaaataagttaatctaatattagatgtgatataacatatatataacactctctctgttttatattataacttgtttaatttttttaagttaaatttatttaagtttgaccaagtttttaaaaaatataataacatttccactacaaaataaatgttgtatcaaaatatattgaatattaaaatttaatgaaattaatttgatattgtagatgttactaatatcttctataaacttagtcaaacctaaataattttgactaaatataagctaaataacctacttcctccgtcccaaaatatagtaatttttaactatgaatctggacacgaatcccaaaatatagctaaaaattgttatattttaggacggagcagcataatatgaaacgtcggtaatcaacaactaaaaacatgatttaatagaagtagataggacagttctcacttatacattgtcgtgctattttttatagtcctaacatcacgtcaaccacgtcaaatgagtgatgtgcagggtttacagtaccaacggtagccggttgattaccacgaaaactattggctaagtaggatcgagagcataaaataggcagttttctgattaagtttaaataaattcaaattgaattttaattcgactatgagttttcacttctatcattgattttctttttgttgctatgaagttaccgtttcagcttttagccacgcgaatcatcgatattgctttgtcgtaggttttcatgaaaaccgagaattcttgtctcgacatcggtttggtgaacctttggtgatgagatcgttggctcaccatatttgcaagggggaaattgctgcatgccgcacggccaccgtgacatcatttgattaagagatccactttaatttggtgcggtacagtacatggtgcaatgagaggattggagtgggtgatgctcactcatgagcctggtgagtggtaactgacggcctgacggggcgccagtaactgggtgaggggatggaatggtccgaagcctacccattgctacgtgactcgtctgaagctctgaccacgggtcggtgactcggtgtaacttctgattacagattcccgaagcctacccattgctacctccctccaaaaagtataagcatttttaacactaatataggagtagatattaaaaatatatattaaaatgattggataaaagttataataattaagaaaagaaaatatataaatagttaaattcaattcaattggctgtgattggttgagagtaatttggatgtttggttgatgcctaaccttaccgtaactagttgtgtcatgatggcataagtgcaacttaaaaatagttagtcacaagtgtgatatacttagcttcaactttaagagaatgacataaggctaaaaaagtatggcataacatagttgcgataacgaaacaaatacatatataagaagctattgcataactaaaatatgacatggtaaagtacggtaaccaaccaaatacccttagatcagtggaaaaatagtttcattttaacatatgctattttattagaaatatcttcatcttgtcaacataggcgtgttcataaatggagaaacaatatccaaccttcatgcaacaaatcggcggcctatgatgggaacatggttcttggggcctgatccaaaaattgttggaaaggactatgattgcctttgttcgggagctgaagaatgtgtggcccatacccgtgaaatctctacatagtggcatagtgcggcataagtccagttaacatcccctatcttttcatctttactcctcaatttataataccgggttaaattaggtcctccgacaatatcgatggctggttttagtgaggtgggaagttgacccggtccacctgggctaactaggcgttcacgtgacaaaaacaaagtggctcccacatgtcatactcttctctctacccctctttttctcttgagatgtgccgcaacgccccaccgacgcatggggagccgctctagtccacgtgcctggatccccaacaagatgtcgccgaggacatggcggagtccattattggcttgagcacccacaattaggcgctccgctcagccagcccgtgctgcaggcacacatcggagaagggacaataccgcgttgcggcctctaccatccgcccgatggtgccatcggttgcaaccactccacccaccgcgtcgaaggcaccccgtagggagtagagtgtcgggtgtaacgacacatggccgcaaaggtggcgggagacgctgacactactgagatgcaaatggattgctgcaccacaccattagggagtgcgtccatgccgttgtcaccaccacgctcatgcacctcagaggcgtggctaaggggaggccgtgaggcattaggaggagagtactgctagctacggccgtgcagagcaataggagcacagggtgtggtggaggaggcgtgatggggttgtggcgaccaccgctgtagccatggcggcgaggagaggtgggggcgtgttgatgtaaaaatacgaggcctgtgagatctacttaactcgattaccaaatttggtcgttaacagggtgtctcggggacggccaggaacacggcagcagacaccgacgacggcacccttaatggcggtgagctcgacaatgccacggcatccgtgcctaaaaccatcaagccactaactcggtgatggcggagaatagaggggtggcagctaggtcgcatcctcatatctcccctacacattccttaagatcagtgcacagctcagtcactaccaagtaccagcggtgtcaacaaactcgtcgtaggcggcaacacatgttgaggctctttgtcggcctcgcccaaaggatgtggatgagagcgacacgagggagtgggctgtcgccgccgtcagaaagggaaggagctcgggaggaggcggccacagcttttagcggtcatggaggggtagatgttagtagggcgatgaggccgttaacaccgacgagaacctcgttgttcccacccacctcattgtggccaccgaggggaataacggggaacatatgagagagtggatagaggacgatgttaatgacatgtgggccctatatgctacgtaggtgcaacatcggctaaaagaaactcctatactgctttaggatttcttctacatcggtattgtaaattaggggttaagatttgtcttgtagtttagaactcgatggtaagatgagggatgtaaagtgacttactccgccccatagtgctgataggaattttcccaaaatatgcatttcttctttctcgtgtagaactgaacattactgtatattgatgacccaataaggaaatactccaaatataacgatacaatactcgatcatcttaaaatataacacacaattagacacacacaatcatttgaatatattattacattttaggacgaataaagtatataactaagcttgtattaggggtaccataatggtaacagtacagtaatcacaattcaagcatatttttttaaaaaataatttttaattattttttttaaaaaaggctatttttgagttgccacgcgcattaaccaaaattattgtcgatgtaagagcaagaataatagtgatagccccatcgtttggcctaaacaaccaaagaataagccaaaatttgaatttttgaagttgattttaaaatgcttttaacgtaatttttgttaatgttggcttttaagtcgctacgaacaaatctacaaaagttttacttataaattaattttaattttctaataagccaaataagccaatttggaccaaatgggcaactgatgagagcctaagtatgtatgaaggagagagaaatatattaaatgcttcaagataaataatgctctctacccttcatgataaatacatgaaatacataagtatgagaaagatataggagaaaaaaaaaaccaagtttatagctactaatattggtgtactaactttcacatgaactaatacaatgagctctatccaacagcaaacaacggacttcaacaaaggcggcaataaaccaatcggtgaagcagtgaccctgcccacagaaaggctcccgttttccatccatgggatcggtcacccaaaacccaccggatgacgacgcggccgcctcccctaccccgcgccacgccaatccatcccacccccaccgtgcccatcccaaccgaaaatattcccagcatattcccccgagatcccgcatcccccctcccggcc

SEQ ID NO: 63658 - DNA, 1248 bp, Oryza sativa
cagcgatccgcgcggcgtacgaggcgctgcctgccgcggccagggagcggctgcgcgcggtgtacttcgtgcacccgggattccaggcccgcctcttcttcgccaccttggggcgattcctcttcagctccgggtatgtacatacaacgaatcactccgtgtgtgctgcactacgattcgtgggtgaggcgctggtgtttaccgtggtttccttggaattttggatcttgcaggctgtacgagaagctgaggtacatgagcaggctcgagtacctgtgggagcacgtgagcaagggggagatggagtcccggaatgcgcgcgccggcatgacgaggagctcgagcgccgcccgctcatggactacggcatcgaggctactgaccgccggtgcatgttcgacgccgcgtccatggacacctcggcgtccctgcactcgctccggtgcatctcgtaatcgtggtggccgctcgactgtagcatccgtagctggcctcgccccggtcctatattcgtagctagcgaaggcactgccgcactgtcgtagtttgcaggccctgttgttcttcgttccatctgtacaaaatagtagtatttgtggaagtaaaagagataataaagagaaacagtttgaaatgcttccctcgttgcagcttccacacagatcttatcagcatagggtagagaaatcaaaatccaacttaacaaatcaaccagtgcagtaattcgcaggtcctcatttgccatttttaactatcgtggagtggtaaattctcaattatcctcgctgtcaaccttttaacaaatgaaactgtaagcaaaggactacttggagagataacgtgttaaaaaaaactcttatagttttatgtttggaaaaaaaatgcaattgccttattacagaagtgtaaaaacctcatctaagtatttcttcatggtcaaattccacggggagaaatgcaaccaagcataactatgtatactgatatagataagaaagcaaataaaaacatcctaacaatgaaatgagtcaaccatttcccaatgtccaatattgaccagaagcacaatgggatagcatagaacaagttctagctagaatgaaatggatggaagcaacaagaaacatatagaaagttataaagcatagtaaccatttaggatagtttcagcaaacaaacattgcagaagcatttctcaggcgtcataacttgccatgacactgcctccaaataagtaacatatatcaa

SEQ ID NO: 63659 - DNA, 2372 bp, Oryza sativa
ataaaatcaatcccatccaaattcactacacgatcagcagcaaaggaaatgatgaaccttttggctgcaggatcctccgctttagttctggtggtgaagttgtggaaattgtgtgttccaacatattttttgagaattctattaaacctctctttgacttcatgagtgtaagaaaatgcacttctcaggggcatctcttctagactgctgccttcataatccacatcttgtttcttttcatcttcagtaacaacatccatagcttgtttctttccatcttcagtaacaacagtctcaatactacctttcttttcagccacaaatgaaggatcaacatcaactgaatctgaattcgtgttggaatctgaattcaggatggggcaaacagtctcactattgctagctggtacagcttcagaacagagagtaccacctgacagttgaacatcacatttttctgcaccatttgatctcatttcagtgatttgggtattggtttcattatcagggataggtaaatcaacactacgatcgccagtgcttgcaggatcacaatttgcatcctcatttgaacccactgcagcttcctcccgggaagcctcaacagatttctcctcctgaagggcaggatcgggtaccttaccctcccggcccatgacaccgggcaccttcctacccctctctgagcactcaaggcacttcgtaagctcgctcccactcccaacgctcgccatgacggcctcacggtcggggtgcgcgctggggtcgagcgcgaacacgggcagcaggtacacatacctccggcggtcgcagaacttcttcgcgttgaacgagttggtgacgcggacgtagccgaaggcgcggatctggggcgcgagctgcgcattcaggcgatcagtgaagacgggcgggtcgacgtagaagcggccggagacgacctgcgccgcggcgctgacgcccttgtcggtgcgcgccgcgcgggcccagtcgtagcggcggggcgcggcgcggtcggcctcgggcacggcgccggcccggtagagcgcctcctccaggtccccctcgatggtgcgcgcgcccgggttcttctgcatgccctggtaccccgcgccgcagtagccgagcaggatggccaccttgcgacgcttgtaccggggggcgcggggctgcgcgccgtcggcgccagcggcggaaggcgaggtgggctcctggtcggggtcggaggaggaggacatcttgcggcgcttggggtgaggcggggaggccggtggcgaggcggcggccatcggagccgcgggggttttagatggctagggtttgggtgcggatcggggcaaagtgaaggggagaacaaaggaatcgaatcgggtcacagtgctgcagtttagaaatggggacatttcatttcatcaagaaaaaaaaaaggaaaaataatacgggaggcaaatttgcctaactgggccgaattaaaagcccatgattatatagaccgtgggccgcgaaagaacggggaggaatactcttgggattacgaaggtcggttgttgacttcttgttggcttgtttagtaccataccgattatgttggggaattatagatgcggaaggcgctataaaacgaggaggtgagcgatcgttagaactcatctttgcgcttggggcaatgacgcagctagtgaggttataccgaggcgcgtcaattgctggttgaaaactatttccaaaccccctttgcggcccatccgggcctcagagaatttctggaagggctccctaactagggtaaagcccacaattctaaacttaagtttgcatttggaaagttatcccaaagttaacgcaattttgaattcggttttgtgatatccaaagctaaatactctctccgtttctaaatatttgatgctgttgatttttttaaatagactgctcgttttattcaaaaattttaagtaattattaattctttttctatcatttaattcattgttaaatatacttatatttatacatatatagtttttaaataagacgaacggtcgaacatgtgctaaaaaatcaacggtgtcaaatatttaggaatggagagagtatcaattttttattctaatttgtgatgctacgaccaactttacctttcatacgtataatcactcttaacaaccaccgttttttgacaatttggtactttaagaaaacttatttcaaaactaaccctcgtcaaaaacttcaactaaaaatagaccgtggacttagcgtcaatcccgttggtgctatggtccaacgtctcagcgccagtacgacgctaaaatttgccacgctagcagagttgattgtggacgtggtacataataagtaggggctgcaggaat

SEQ ID NO: 63660 - DNA, 991 bp, Oryza sativa
tatttttggttgaagtttttggcgagggttagttttcaaaataagttttttaaaaggaccaaattgtcaaaaaaaaaaaacggtaacaacctcaggtccacggcatatgatccatatccatgttccagctcttggtcagcacatacactgtttaaacgcttgcacaatcacggccaaatccataacaacaaacgctagcactacgcttgagctcgcactggtagttcacagcatggagtctccaacttcaccggttaccttctcgatgccgctcatcctccagccattggcctgcggcgctaccgttaccatcgtcaacaactgcaccttcacggtgcgcgcgggcgccctcccaatcgtcggcggctaatggctcacctcaccccagggctcgtgtgggccgtcaacgtgttcccccggcgtcaccatctggcgagcaccggatgctccctcagcggcagtggcaacacggtctttgcccaggccagctccaagtccggcgactgcggcggcaggctgaattgcaccgtccctggcaccccgccggacggccggctctggagcagggccataagggcgatggcctagggcccagccaaaatggaggctccgatccaggtatataccctatataggtatttagcccaatagcttagaattgatccttctcactgattagaattgatgatccaatccattgatccttctcactagatcaggtgatgatccaatccatcgattctcttcactgattcgaattgaactgttcttttaatttattttttgttccccattaaattacctagattagggacttagggttctaccattctggttcaaccgttcaagggatcaatataagtatacaaccattcagtgcaccataagtccataagctaattaaattaagcgtatatggtggattagttttcattaggcctaggcccttgattatatagatttttccctcactgattttggctgcaggaat

SEQ ID NO: 63661 - DNA, 1114 bp, Oryza sativa
cctgcagccccaagctactcgcgggaaagttaaataggatgatgggaagaataactcacaacgtatttacgcttgcgccttgcgtggtccgtgttttcacgctgatcagtagtatatgtttgcattggtttgctagtcaggccgtctcggaccaactgccgtccggtgattatttctcgttggtttggtcgtaacaaaaggtcacggctttgtctaaaagaatccgaaaagtgtttttatttctcgagagatatttagtttaactttttttacaacttatatatgttgaattttgccttttgtggattggtatatttcatattaatctatattttcatatattgtttttaaaaaattttctataactatttagatgacataaaaaaagaggggacatcttctggaaggatgaaaatccatctacaaaagaacttgatgttggatgggtcaatcaaagcatgcttttggttaagggacgggattgggttgggtcgaacctatttatttatcagggtatttggtttaaaaataagtaagatggaattgtacccatctaagattcggattggccttatccctaaaaagttgacataccaatccaactcacttttcttccttgctggcatatgagctgcaatataaaacataggatcatcaactctctcgtgccttacggatagacggtatcaccccaccctaaaaacagtgatgaatttgatccaacccaccccacccacaaaccaaacatatgtaaatgaacttgagtaataaactttgttttttatcaggtggctcaatggaccaatatgtcaggattaattattccaccaaggatttctttattaagacccaaatttctccaaataatagatgattaccccgccgtgttgctgcgggaaattaagttgtatagtatgtacaaataagctatattatattttgtaaaagaaaataaaatgacttcctatgttttatataatttacacatgattgcaaatataatgcaaggtgaacatattttatataattgatacatatgaattttgaagaaaaaaacgattgaaattgtatggttttatgatagaagaaagaagagactattttagggctgcag

SEQ ID NO: 63662 - DNA, 4650 bp, Oryza sativa
aacaagagcaagcttgcgatgaatgaaacggttgaaaagacgagtttgcactctctgaccttgaagttgttttgagaatgccagccaaagatatgtccatgaaatatgctggaatccatgatttacgaatgtcaaacctatttgacagccactcattgtcctccaagtgaaagtccaaaatgatagatttccactgtgattcgaactcagtagcagtttctgatctccaaacacatgacttcatcatttcccttaaatcgcagtcttctctccatagtggtccgatcttgtctgacattttttccatgatatgccacatacacaacctatgcaccgtggttggaaaaactttttcaatagctgctttcatgctggcatcttcgtcagttatgatgagtgtaggggctttccctcccattgctcttaggaaggtcttaaacaaccaaacatatgctggaatcttctcatttgctaagaatgcagcaccataaaacacactttgcaagtgatgatttaccccagtaaatggtgcaaaaatcatgtcatactggttagtggtgtacgtagaatcaaatgatacgatatcgccaaagtgactatagttcttcctgcttgtagcatctgcccaaaacacatacttcaatctgccatgttcatccacatcaaaatcataaaaaaaggatgaattgacctcattttttctacatagctgggccacaaacatttgagcatccgcattcttaattttctttcttaggtcccgatagtaattctgcaagtctctcttagtgcatccaacattctgaaatcccccatcactcacgtgaaggagcctatatgcctgggaggttcctatgcttgctctgctgcatgtgaagagtgtagtttttgccctctcactaacttcacgatttgatcttatcaaatgcagcttatctggcgatacaagtccatgactatggtgctcaaccaaggaagctatcgtgtacttgttatcagaacatagcttcacgtaaatgtgtgcatcacatccacatctagtttctttcaatttaatcttttttttcttcgatggatcaacaatctccttatcattcacatgtttccatccttgccttgagcacacaaagtgcttgcactgaaccacgccatccaacttcttttgctgcccaatacgcactgagaacccaacttggtgtgcatatgacttgtaaaatttttcaacagaggcaatatcttcaaatgtcatccctaccgcaggccttatcttatcatcacactctggtgtaaaaacggagcactgcaaaatcacatatacattgcaataagcattttaaagcacctcagtcataatttttaaattgccagtgtacttacattgagtggaattcttgatattttttttggtgtactggtgttgtcatcctctattactggagaagttatatcatcatttgaataaatatctgagttatctcgcacatccaatctatttattgcctccatctgcaaaaaaaaaaacagatagcaaacaactgagattaaacctttaatttccttgagtgaacaattatgttggagttacctaccttaatatgcagtaacaacaatacagtgtacttgccaggttatggaaatctgtagctagtctgaacgaaaattagtgcaatctaatcttgtctcttgatgtatgcaatatggagcagccgcacgccagcaccagctatccctaactagcctgtatatgaacgatatgaatgagaagaaactaaaaataccgtagcatcaggttcgaagtagtggaatgattcgtctcttgatggtgtagaatgattcgaagtagtcacaaggttcggatgaacagaagacatctgagagcaaaacaacgatccccttcgcctcgatgaaatattttgccggcggcgcgccgcgcatggaaccacaagaggagctgaagaggcgtagcatatcagcgccgtgattaacgagatcagctgaagaggcggtaccagatgggctgttctgcaaaacagaagtggaggaggcgggcgtgtattcgtaaaattgccacgctaggagacttggccgtaggatgtcgatcgaacggatccggacgcacgtgtacacgagtgcagctgtactcccgtgtgcacaggatacccttcctacttataattggcttgctatttgtagagttatgcatactattgccaaatatagtcttagtcaatgaacaactaacattaacaactcctagtacctcgaggggcaagaggattggagcactgtaaaaacactaataatagtcatgggtcgtgctaatagaaattctcattttacaagaagggcaacaatcatgtttcttccgccttacacacttaattaacattggtcacacgacagcggaacagctagctcatggcattcggtccaagccaagtgcacctcatatgtacgcgtgacaaagagggtagcatatatgtctggctcaaacctcactagcaacgcccgagatacgaactcttttgcttgccctgttagaactcctattctattgcatatcaacatacttttgtttgccggttcattctatttatcctcgtcgacatcacatatttacatccttcagaaatgggttaaaggacggtgatatgaatcaatgaccaggtcgtcatagagctaggttagttggcatggagctcgagaagaacggcaggctgtttggttgatagtcgaattttaccatgtcaaatcttaggtgtagcgtaatttcttatacagtgtttgattgtgtgttacacttggagttaagtcacactttattagtatgttagctcacacattatatatactcttattttcaagacaaagtttatcacaattgtgactaaccgatagtgataaagttaacctccatccaaacagtctcagctagttaaatgaggaaatgaacataatagatagatagatagaggatgaaggaggaggagaatagttatacacggaagtattatgaacaagataaaaattaagttttagttcctccatcccacaatggggttgatcgtttgtgctactttccagctgcaggcatctggagcaacaatagtagcaatcgaaaaattaattgtggctgcagcagctgctacggctgtgctgccacagctagcacaaacaaacaacccaaatataaataactttggatggatatgacacatactaaggctatgttctttgcccagggttcccaacccctcttcttcgttttctacgcgcacgcttttcaaactgctaaacattgtattttttgtaaaaagtttctatattaaagttgcttaaaaaatcatattgatccatttttttaaaaaaattagctaatacttaattaatcacgcgttaatggaccgctccatttttcgcccggagggaatgagtttccaacctacatgaacgaatgcaacctaatactacgaatctgaacgaactattcgcttggattgagggccctcttgatgcttaggttaagatttagttaaacttttaattttctaactatcaataatttttgaaatgcttagtttgaaaccaaaagaattgttcagcatatatttgtcttaaaaaacctataatcatcataaaatttattagatcttaagcttattttgatataaaattgatattggaatttttttatgctttaccaaatctataaacgtcaaaaaaattattgaagagaataatatcgaaaataaatatgtttttattgaagggtataatattgtaaacttgttttcgatgataaatatttaggacgtcgaaaaatgatgagataccaacatcgttgtcattgatacatggttatttggccttagagcccgtatataattttctcttttcaaaaagaaaagaaacattatacttcattcgtcttagagaatttagattaataagacacgtcgtattactacgaatctaaacaagataaatatttctatgtgccatccaaaatccttatatttcagaaggaaggaaatacaaacgtacacgatcaccacgcgcacactgacttaatgtacacatttacatccctacttatatgagcacttttcaaagactgtgatgtgtcatgatgattacaatttcatatactttttacacttgcaagttggaactatccaaatttttccataaaaatgtaggaaaacgtgttcgcggtgagcgtgccattgtgcatttgtgctgccaccacattcacacgactaacatggttagcgaatgagaaattgctggacaggttcacacgacacgagtgcactccactagtagtggatggttagcgaataaagagaagagcggacggcgttatcaaatccgtcaaggaaaccacatctgaagttgtgaacccccaatccaattccaatctccccctttcatcagcgccatggctctctcctccttctccatgtccctccccttcgccaagctgccttccacctccaaatccacccgcttccttcccatccgggcctcctctgccgccgccgccgcctccccttccttcgatttgcgcctctattggacatccctgatcgccgatgtggaggccgagctcgacgccgcgatgcccatccgcacgccggagagaatcca

SEQ ID NO: 63663 - DNA, 5866 bp, Oryza sativa
cgcgcgccgtgggatccacaggcatggcggccggccaattccttgacctcgccggcgccaccgccctcggcgaggccgaggtcatgaaggttctgacgaagaagttcggcgagatggcggagtgctccgccgcctgcggcgccatgctgggaggcgcggggcccgacgaggaggccgcgctgcggcgctacggccgcaccatcggcgtcctgtaccagctcgtcgacgacatccggagcgcgtcgggcaacggcaagatgaggagcaatgccagcgtcctgcgcgcgctgggcatggatcgagcgctcggcatcgtagaggagctcaaagcgcaggccaagatggaggccgacaggttcggtgacaagtatggcgaaagggtgcttcccttgtacagcttcgtggactatgcggtggagaggggattcgagctgcaggatgcagctacaacgccgtaggcacggaccgcgcagaccaaccttgatgctaccggatatttgaagttctgagcaagtggttatatatggagttatatgctgctgagatttggtgagcaattcatctctgaaattataagtttcaatgagaaatataaagattacgccattgccatctagggcagatgtctggatacttatgctgcggttctgatctttagttagttgctgaaataagacgatgtgactaaatgaagaattcttaggataaactaccacaattgctatgccttggtgttacatgtgcttaatatatataatctgatcacaatttcaaagcctgtattgagcttcccaattgtatcaattgttcatttggaatcatcaaagcataatttcgatcctcataaagtatattactggttcttcgttttcgggtgaaattagccatgatagttagagcatttgtagttttagcttgattgacttaggtttgagttgaaaatcattgccaattgggtcaagcttatactaggaatctcaccttctcaaatcaattcttctggcaagttctattcaggtacgacgcagcacacatcacaccggactgggatcctctaggtcaggtgactttagagtcactccacaccactggtcagataatcccacatctctccacaatccctgaattacttgcacccggacccaacatggatgcagccatggctgccccctctattctagcacgcgatggaaggcgcaaccatttaaacagaaaccagccggtggccggtgcttcatgcgcaccaccagagccggcgccgatctacatctccaccagagtatcagatacaaaaaccagagtatcagactcgacgaacgacgcagcaggccattggcctcgcagcttcacggcaagggtcgttggttgcctgggctagccgtcggaatcagaaataggagttcacccattgaactttttattactgctttcaccatttggaatgaaaactctttatctctgtatctacgttatccatcaactacacagcaccagtaattacatactgcaccaactaccaagtgatgatggcttcaagcacactaacaataacaaccattgctagtttttacatgctatccactacttgctagttgttaccaagctcttgcagcgcagaacacttgctagttgccaccaggatcttgcagctcaaactcgatcaaaggcatttcctcctctctgtaatctcatagctgaatgatctggtgcattcaccgattcagtaatcaggaatagttccatgtcgttggcatcctcgtggactggatagggggcgcgtttcgcacgttcacgtcgagtggcagcatcctgtattctatgtcgaggtccttgagaactttgatcatctcttggagcaccagctccctccttacgaacctcatccccatgtcctgccagttgagtgtgtgccggagccatatggacactttcagcttgttggtgtcatccacatcacggaggacaatcattgcaccaggataccaatggtccttcttgttgtcgatgtaactgaaatttagaagtgaaaatattgattagctcggcgtggtaagatactaacataagcagcaaatgagctcatagatgcctgactgattttataatctgataggaaggctgtaactatgatgaaatgttcttatgccctaatttagtgctaattcataggccttaggtggggcaagagtgcaggcacttctttcggactccagtagacagtattaacagaatcaaattctcatagttgcatttttacattcatagttaatcattcattgttgattagatttcatgaggtcggattgtattgcaacaagataagaacactaatacataccgtaataatctttccttcataagggctaatttctccactggggtggcaacatgaacggagaagtcaattccttctcccatatcaggactcctgtagtaattcataatcggttttgtggcaagtacactgtttggataatagatcttcaggttatcatatcggagaaacactgttgtcattatattcatttcctcaacaaccacctgaaattcaagtagttcaatctttagtaaatgaatgcaaggtaatattcatgaatgaagattaaagaactttcccactacctgacaatcttctatttcgcagcgatcaccaacatcataaggatgcatcacgaacaagaacacaattgcctcaaaaattgtcttcaaagtattcccaaatacaaaaactgccacaagaacttgtgaactgaggaagacaaagaaatgtgttgttgctatacccagaataagtagccagagggcaaacacaattatcccaacaacaacattaaccatctggttgagcttgttcactgcagtctttgtatcattaagtgttagggcaagggctttgcgctctctaaatgcattcacctacagaagaatacatacaacaatattagcaagggcattttcagaactagctacgggaatgtttggattactgccattgttagccttgcccattttttgggggcaatggcaagatttggtcattgccaaaaaattttggtaaggtgcatgtttggattgttgccaaaatatgtaggtactggtatttcgtttggtgccaaagggataacaaaattttagttgcaaaccaaatgagcaccttttttttttggcaacaccaatattttggtatagttgatattggcaaagaaccaaacacaccctgtgactcgttattataaatcaatatcgtgaaagatcattaccacccagttctttagagatctcttgctaaccctgctgtgctcctgtgctccttcgaaaagatccattgttttgatggcttcttcctgcctcatgaaacgcagcaaatctgacaagtatatatacctgcagtattcatatgtttgtgattaggaatttgatcagaaatgtgcaagttcagaatttttgcaatccctgttttcaataagctttaaacacctgtaacttaatactaaagatatataggatgaaatattagcatactagcatctccaatgaaataacactgactgtccgcacgaccaccgcacgaactaacagttcctacattacagataaattgcagttgcttgtctgattatctatattgtaagaactagcaatgatggcacttgcaggagattagggaatctaaccatactatactactgacaatgaagacacttacttggagccaggcttcgccacattgtgaaagatcttcttggcagcaatcttggcttcatattcactacgaatctgtgtcgctgactcatccccctcacccgttgcctgctgtatctgctcatccattgtcgtgagcgtcccaaaccgaacaatcctcatcaaccttttcatgttccaagctgagatatttttctggttgagtttatgaagcttgtcaatggtgatcccctcctcaatctggtgctctcctttctcttttgacagctgcttgctcccttctcccttaggaatcaccccggacatccgaatactcctttgccctgaaagattcttggttggtacagtggaacggagctcagctgggatggttgctcctgcgcgttgaagctcatgcatctcagcaaggaattggttttcgtcaactaggggcggcccggagagcgtctcgatgacaaactggttgaacaatgcctcctgaatccggtcaaagtatgtgttgacatggaaggaggatgccagcaccttgagcagcagcgtcttgacgaggcggatgagcgtggcgacgaggaagcagaacagtatcttctgcacgtagggcagcacaggcgagttcgtctcccgctggacgttcttgtcgaacatgaagtgccaagaggagagtaccaggccgagccagagcgcgttctgcacggcgctgcgcacgccgtacacgaagtagagcacgcgcttgcgcagcaagaagttgcgctcgacgcagaacacggcgatccggatgacccagccggagacaaggcggccgcagatgagcacgaacacgaggagctcccacttccagaggtgcagcccccagaccttcttcccggacagggccttgatggtgagactgcacgccaatgccgcgatgatgagcaccaagctgagccactgaaggatagtgatggcgtccagcttcccgcgcttgaattcgtcggggatgtcctcgtccatgaatgggtcctcctcctcctcttccaacgggcccgacttggcgatttgcccggacttgccggtcatgaggcccgagatgaactggccggacttcgtaggcgtccgcaagacagaggatctcctctcctcgtcgccgacgggagggaccgcggacgccggctggggctgcggcggcgggtccatcagccgggatcgcgttttggctcgcatcaagtgtcccgctgcagtggaactggacgtgcagcgaacaacctcgccgtcgtcgccgccgcgcctacggctacctccggtgtcggagtcggagtcagaggacgaggcgacacgccttttcggttggaaggagactcgcgcctcgcgttccagggagtttgagaaggatggctgcgcatgcagttgcgacggcctcccgagctcctccatgtcgaggtccagcgacagctcggcgccggacgccttctgtttccgaaggaagttcccgatgagacgcgtgggcggatcctcgccgccgtctaccgcacccgcagcgtgtgccggctgcggcgatagcgaaggggacgacgcctgcgacgacgaaggccgcggcggcgcccggttcttgaagctgaacgcctcgcaggcgcgccggccaccgccaccgccaccgccaccgcctctgcctccacccccatcgctgcccccgtccccgccgccatcattcttccaaaactcaacgctcccgtcccgcctcaccttgggcggggatcgcggcgagttggtccagctggaccacgtcctgctcgccccccgcggcgtgctcgccgtggagtcggtgttcgggctcacattccccgccccaccgccatcctggccggggaacgcgaacggctcgcggcaaggcccctccccgtcgatcctcacgaccacctccccttcctcgccgccgtcacgatcggccgccagtccggaccgctcatcgaacacccccgatcccacccgcggcgaggacttgcctgagccatgcgacctcaggctactcttccgccgcacctgctccatcgccgccggccaagaaacgcccactccaaagatagctagtactagtagccactctcctcctcctcctccctctccccccactcctctcggccggcgtctctgctatacttaaccagagtttaactaagggattaatact

SEQ ID NO: 63664 - DNA, 1275 bp, Oryza sativa
cttctgtgggcgagactagcggcggggattcgggagtgcgtgtcgcaattagcattttgtaaagaaataaaaatgattgtaagtggaattagcattcggtaactaagatttagaaactgtgattaacgaggaagattatataatcagggcactaaaaaggctgtgtggtgagaacgtgaactgctgtggctagtggccatttttgtattgggtaacggcgacgggaaaagtttagcatcttggtgatggatctcagggttgtggtgatttgtgggtggcagtggcactgtggtgctgactgatctcaaggtcttggtaattgtggaactcacggtcgtgattgtgggattgctgtgatggatctcacggtcttggtgaatgtggatcacacggtcgtggcggttgtgtttgtgccggccatgtttcagagaaaagtttcgctccatagacgcaaaaaaacgatccatatacacgagcaacatgtgatctctgctttcagttccgtctcttgcctaaacactccattggcatgtccgtttcttggttactgtcatataatctcgtgatttagatagatggtcatcatttcgtcataaagacatgcactggcatgggagcacggccaagatttggaatggactgtgcaaacagctatctttgttctgtttggcaggcatgtaggaaacgaacaaaaaaacgtttagtcggtccaaatcagggtgcagcgattagcaccatatctgatcaggccaccagctaagtaacatgttagggtgggcctcaaaagcaaacagaagcaagacagcaagtacagaacatatggcatgcgaatgggattctatatatctggaggcgacgcgacgtggagcaacacaacaaatgaaactcgtgtgtcctatgttagcttcggttccgtttgcatcccgttcgtgggaaaccaggtatgatggattcgttgtacaatattggacagatcaccaattcaccatcgctttcgtcaaccgagcatcatgtgtgtgtgctccctttctactccctagtagcttgacttgagacctaaaaaaagcacagttcctacctcgcatatgttcctagatatgctcaccacatcaataccggtaaagaagaacgatacgtgtacgtgcgaaatctcgcgacagacagataagtgcggtcatacgcaagagagacgacctgcaggcaacgaaaagctgctgcaattttttttttcgtctgtatatttactgttcagtaaacgcgcagggctgcaggaat

SEQ ID NO: 63665 - DNA, 2446 bp, Oryza sativa
aggtagaaaggagattagcactttaactactgtgataggattggacgaatgtaaaagaataattaaagggataccctctccgttgtaggttacaacacgctttgactttgattaaaatcaaactactttaaattcgactaaatttataaataagtagtttcattaaatcgataattaaatatatttttataataaatttatcttaggttgaaaatattttttttacaagtttagtcaagcttgaatcagtttgactttaactaaagttaaaacatcttataacctgaaatagaggtagtaattatttacatgatgaaaaatttaaaagtaatccatagttacagtttagagtgttgtttcggtccttctttttgtaccacgtggtactagtaccatgagatactaaaatcctgaccgttgttggtcattggtgtggttagcgcgagagagccacggtggaagggtataatcgtaaatggagggatttttggatcggtgcaaggtttggctgagttggggaagcgcggcagagtagcagaaccctaggtggcggcggtggtatcccgttcgcggcggcggcggcggcggcggcgcatccttggttctctgggaagagctgcagaaggcaaaccatcggtttgccattctccccttcgcggcggcgcctcatccattcctctcgacaccgcctttttccccttgtccaaatcgtcgcgggacttcgatgtatgcgtgcgtgttcggccatggatgagtgaagcttacaatttcaggaaagtacaagaagatgtttgagatggatatgaagtacaagcacacaatttgttctagacgtttgataaatttgtcatgctcttgtccgttcctgtagtattggaggcattttataatggagtcattggactgtaatcaatcttgatgtgttttcctgtaatattacgttttcaagctgtgttttggtattggttacttctggaattgaagagatgagtttaatgacatggttgcagctagttttatatttctgtatgttttatggtacatgcaatgcttggtgatttctggaattgaagatatgatggatgtattgcaatttggagttgtactgacatggctgaagctaactattttatctgtatgtgaacatggtatatgtgaatctgaaaatgatgtacttcactcatgcatgagactgacagccacattcataattttgatgtcatttcagatgtgagaaatccgaaaagcattgttaaaattgatatgttaaattgcaggtagcaaagtacagctcagacataatatagtcaacagtgatacatatactctgaaatcttgtacataagaattacaataacaactagggaacccatgaaccaacttctagcgtggtctgcctcttttttgagctttgaaatttttttcttatatgttgcttcggtagccaaaatcctggcagccatctcaaattcaagtttcattttgtcttcctcaactttcgctctatcaatatagttagaccattcatattgccgcctggttggatttgtcatgctagtacgatccaatgcaagccaaagcttctcgaatgccttctgcactcttggatgccatcttggtctacccagattaaagtatcgcattggtcaacctcctgtaacattggttatttcatagtattattatgcaaattttcttgcagcgaaacaatggtgaacatactcaaatccggtcaaacaaaaaacgaacagcagaataaaatcaaacaaaagcttactggccactgcggcggatggcgcagaggatggcgccggccttgcagctgctgcgccggccacggcggcggcgaaccttgaagcgtatggcaccggcccttgcagctgcaccgccggccactgcggcggcggaccttgcagcggcggcggcgacgactcctgcggccgcggcgctgccaggatgtcaccacccgtacggcgacggttacagaagcgctcgccctcctcctcagatgaacacccgtgcggcggcgctagcgtgagatgcgatgggcgacggtatcgtgagatgcgatggggatgacctaaacgaagccgcacgtagctagaaacgttgggaccccacaccggagcgaacctcgcgcatactcccatccccatcgtacccctcagcaatcaacggccggatgaagactggtacctcatggtactggtaccgtgcggtacaaaacgatggacgagagaaaatctatacagtttaagggcatgttcactttgatgtcattttcaaccataccattatttgtcaaagttgcaaaaaaaatatatacgtttagtttgttgccaaatttgaccaatacataagaaatcctgccaaaattttggcaatattgccgtcttgctataattttggtattgccaaaacttgtaaggttcattttggctacaat

SEQ ID NO: 63666 - DNA, 882 bp, Oryza sativa
acaacttgagattggatgccaaaaaagcttacgctggaggatctatttgactaagaagccggaaaaccctaatgcaccggcgcatgcaaccaaccacattggattttttacaatttggtccttttcaaaaactaattttacaaataaactcctagaaaaacttatcccataaatgatcctttttgggacgtcagagttgctggtgccatggttcaataggacagcgcgacgccaaaagggtcctcgccaaggcggtgcaagatgggcagcgtgaacgcagtgtcttctcgctccccgtctccgcgatccccaacacgtccctcccctcaagcacccgcgggatgcactgccgctgcacgaccatggggctatgcatcccctagtaaatcgcacacatccactagccattgcgatagcccaagttcgacgaaggtggacagcaccatagcggattccgcggcggcggtggtggccacgacagtagggcctagttggagtcacaatgttcgggctccatgacgcggagctagggtttaggggttctagctggggctcagcttcttgcttgggtttcttcttgctggacttgggcttggagaagaggaggaaggggcgggctacgccgtcgacctccatggattgcaggcttcgtggtgatggaggcggaagagggtttctggaagggaggaagcaaagcacgcagggtaagacggggacgcacgcacgcgaatttgggaaaagcactaagaaatggtagcctccctgcccacctagaagaggcagctagcggcggtgaaggcggagttgccgccggatgcgctgggtgcgctccacgtcgaagtcctcgacaacatcatcgaccgccttcagggctgcaggaat

SEQ ID NO: 63667 - DNA, 1420 bp, Oryza sativa
ctcgagcagctgcaccacggcgggcgcgtcctgtcgcgggagaacgtcggcggcgcagtgcgcgtcaagatcgtggtcagcaagcgcgagctcaagcacatggtcgcggcgctcggctcgggcaccggcggcggcggggcggtggcggcggcggcggcggtgacggccgcgggggagcggcaccgtcagcgcgcggcgggcggcgccggcggcccaggcgccgagcagaggctgcagtcgctgcggcggcgcagcatgcggagggcggcggaggcggcgcggcggatgcaggcgaacggggagtgggagcccggcctgcagagcattcccgaagaggtttactgaatattataccagtagatggcgtcgttagtgatggttaatcacttgactaattaaggttgggttttgatcactgcctgctaagtctaagtggtagatgtacttgtacagcgctcttgatttgttcccggttactgttgagggttaaaccgttaatcctcccccaatgagtttgtgcatttttttttcactgtaaaattttggatggaagagaggggaggtggtgtttggactgcaatgcaactgctcctgatggtgtttgagtgactgtgagagtgattcagcgagtggctgaatttcttctcctttttgtttgtggcactgtaaaagtttttactgccactgcagctgatgtaaaatggttaattttgaagaattgacagtttactgtccgtgcttagtgcttactactccagctagtagcattaactaatctgttcctgctttttttgttcttttgcctttgtggtgagcatggaaaattatggaaagtattagttaggaggtgagcatacgagaaccacagtgctgagattccatttgcacatggccagatggtcgtcacattaaacaaacagatcttctcttgtttgttctgttatccactagctggctttgccattctgtgttgtgtggtagctgattagctgttccctttaccgctgtacgtacgggtcgttttctccagaattatttttcgtcaagctataaagtttttttgggctataaaaagatgagcttagctgtttgccgtgacgtcgtgtttgttgtaatctcatgtaaatttgcatccggcctaaacttttaacgtaagatcatgattcttgcagtctcatttagacaaaacttgcaatgcttttcatatttactggttcaattttttttataatggaacaaaatccggtctttactcaacaagctacgaccaattattttcaccagtttttcaagtatactgatcttagtttctcgaacacatgaactaagttataaggttaaattggcatgcaattttgtatatttccacgctttatttactctctcttctaatgtatgccggaaatgagaaagattgcgg

SEQ ID NO: 63668 - DNA, 920 bp, Oryza sativa
ataagattactgcaaattcattgataagtgcatatgccaaatgtggaagactggatttgtcagtaggtttgttctttagtttggaatacagaaacttggatacttggaatgcaattatcagtgcttatgcgatgcatggattctatattaatatgcttgaaatgtttaagcaaatggaagaagaaaacattcagcctgatgagttaacattctctactgtgcttactgcttgcagccatgctggtcttgtcaaggatggttggcgtatgttcaattccatgacctcagtatattcagttcttccacaggaagagcattatggttgcatggttgatttattgggtcgtgctgggcatctggaagatggatacaaatttataaagctatctaccttgaaggataaatccactatattttgtgttttgatctctgcttgcagaacgcatagaaatacacaactggcacttgctattagcaaagagctccttgagcatggaccacagaaaccaggtatttatgctctgatttcagaagtgtatgctcaggaagggcagtggaatgaatttaccaatacaagggccagagctaatttaagtgggttaaagaaacatcctggttctagtttcattgaattaatggagcaaggcatgtgttagcgaagagcctgcggacggcatgctactctttatagtgtgtaaactatacattatgaccctttttaacttcttactttacaaatgggcccatgagataactaatagcaaactaattgcaggaatggactcctccctttgcatgaagaacagaagcgcacaactgcccatctcgcatctctctcctctcaaatccttctcaaattggcctgaaatcaaaggtttttccgtgggacgtgtggacatcgtctaggaaggtactctccc

SEQ ID NO: 63669 - DNA, 1467 bp, Oryza sativa
gtgaggaatttactttttgtgatatgatggcttttgttttgtgacaaaccaattatcttttctcttgatcatctggcaaaccatgaaatcgtttgtcttgaacccaatctttatttttgaccaatggtcctttcctgagatctgctgggaaagtataagctttttctgcctttcacagaagctatttctccctgcgcattttactctctttatgatagctcgatttttttttcatcttacaaataaaatgatgtaatgtgcattccagggtcgaacagtactctctttatgatagctcgatttttttttcatcttacaaataaaatgatgtaatgtgcattccagggtcgaacagggttgaaatgttgttgaggaaaatgacaaagcaaaatagcacgtgaaggcgtgaagcgataaatcagggagatggcagccccactgcacgtttttctagtggaggcaaacctacctacaagatgtaaccgaagtaaatcatatccttggagaaacattatgccggtatgtaacactacgagataactaagcgttgtgtgatcatgtatttggctcatcgggattcaaaattcagacttaacagtagtatactccctccggactgataatacttgtcattttataaaaaggtaaagtcaaactttagaatatttaattatgaatcatttctaaaatatttgtctttcaaatatggtgactacatgtatagattagtcttaaaaagtactttaataaaatcatatatttgttaatatttttatacatattataataaaaaaacaatggtcaaacttatttttttaagaccgtgcacttgtataagactaagtattatcaacccgaaaaaagtatatcggctttactccccatggtaaaatgagggagcaccggtcctaagtgacttaaaaaaagtatatcggctttactccccatggtaaaatgagggagcaccggtcctaagtgacttaattaggcggtacctatcgagtaccgattcctagatctagcctttagctggttgtatccaacgatagcatctttcgcttttttattgaaggaattgtctggaattactcctcacggtgaaaacttgtagtttggtcttaactgatagtgtcatggcaatgacggcgcatgtacactttgttacttttttaaggtattgtgtcacgccccgaactagtcccgaccgaaactagcccgtgacgctccaaattaacctgttaatcgatatcagtcccaggaaacagtgctggtatcacagggagacagaatatcacagcaacagatgtctctttattatagagtagatgtacagtcatgttgggctgcagacagatcccgagctcacaactgcattacaaaaggaaagcggaagccaggacttggaccaatcaacacaggcgcgacttgggaactaggccgaaaccctaaaactcatcgtagccggct

SEQ ID NO: 63670 - DNA, 1370 bp, Oryza sativa
ggaggggaaggaactggggtttaaagggggcggcaatgtcggtttgggaaccgacttagggcggtcaaggcgcgagctggcgctcggcggtcgcggccaaagcggcgacagggaggatgacgccggcgggggaaaaaggggaaaaaggagggggagaaaggggcttgcccttttgccgattcgggaaaaaggaggaggggagcgggggcgacgcggcagagggaggaggggcgctgcctccgtcccttggcggcttgcgcgcggagtggcgggggccgggcggtgacgacggcgatgacggcgggcgatttggagcggcgcgacgacacgggcgacagacgcgtgcagaggctgacggcggcggcgaccgggcggtcggccactcagcacgcgcgcgtggcttgcaacgggcggcgtccgcgcgggcgcgcgcacgcgaacacggcgtgcgggaagcggcagcgagggagcggagagggaggacttggctcggcgcgggcggcttacgcaggcgcggcagagcgaggagaagggaagggggcgctcggcgcggcggctcacgcgcacgcgcgcgggcggagcggaggaggaggagcactcggcgcggctctcgcgcacgcgcgcgcggcgcgcgggcgaggcggagcggagctgagcgtgggggaaagcggagcgcgctggggaggggagagggcgagagagagagagagggagcgcccgggagagggagagagggagatgggccgagcgagattcggcccttcgacccgggggaggcaaaatagacttttgcggaggaatttgatttggaaggatttggattcggatttgaactcgacgatagatcggggattgagatcttgagatggcacggacactagacaacaagcaaagaaacaaatttcgcaattagggtttttaagagataattttcccgctaggcgccacgacggaacgggcgctacatattgcttacggaaagccttcattatagtctaagtgttgctttggtcgagattaaggatgaagaacacttgtgcctgtagtttgccacggcttgttgttatatcatttttttagtttttaaaaataattataggctatagaataactatgtgaagaatgtgagtggttttagagtaattgaattatcgtgatataattatctaagtaggcagctaaatagctatattctagaacagagaagatcaattaaagcttaatttatgttgaaaaaaaaaatatcaactctatgagcatacagatgtactgtatgtggtacctgttgattctatccagccaatccgatatcctaaacattggtagctccacatgttagtgttctctgtcggatcagggctgcaggaatt

SEQ ID NO: 63671 - DNA, 6009 bp, Oryza sativa
tggtttcgcttctcactggcaggttaagttctttcttgcctaactgcaattcgtgccgatactcatattcttttgttagagtttattgacacctatgtttgatggaattttgactataaactgtaatgtgctgatgagtcattgctgctgcctgtagtttgaccctgtcaggggcagcaattgttaccttcttttacagtcttggggaacatgggcttcagactgcattactggtgtctatcccccacctaatctgacaagtattcagtttcaatgtcagttaaatttaacacgaattttcttttacggttgatgtgtctgcagtactacctgaaggcacagtttggttacagcaaagatgagttcgctaatcttctgttaattgctggtgctgcaggaatgctgtcacaggtacgattgtattttttttttcagcagaactgttatatggtaggctttccagcccggagtaggaattgctttttttacattttctgatttctgactaatgataacatgctgttcagctgactgtaatgccggtcttggctcgatttgttggcgaggatatactgcttattataggactcctaggaggatgtactcatgtaacagcttctttcccttgcatttttgaaccgttatgcaataatgtcagcgagtgtgattgtaatccctgaacaattttgtattatatttcaggttttcctgtatggcattgcatggtcatattgggtacttcctttggacttggcaataattctcttgtagtcttattagactcttacccaaaagaatgcaattttggctatatccaaatgtatagacagaactacgctcttgttttgcactaatttgcaatcaggtttagttgcttgctggttcagcagtgcaatagtgcgtttccagcattcactaaaccaatatcagtcatccattacacatatcttcgctaacgttgtcttaatcatctacaggtaccatatttatctgcggtgtttataattctgagtgcttttgttcacccttctgtaagccatatttttcccaacagtttattaaaaacttttttccttccaagcaattcagaacaatattaatcatcttcttctctgtttttctagataagaaccaatgtatcgaagagtgttggatcaaatgagcaggttggtttttcctattgttgctgatcattgtctttgagtatttcaaatgatgacctgtgttgtattagttgacatgactgctaagtttcgctcattattcctattactttggtgttgcctcttagggaattgctcaaggctgtatatcgggcataagctcgtttgccagcatattagctccactaatttttacccctctaacaggtatttttttcatttgtaaataaatcctagtttataacccttgtttcctttaatttactccatagcttttgctttcttgcggcagcatgggtcctttcagaaacagcgccattcaaattcaaaggtttcagtatcatgtgtgctggcttttgtacggtaagatttcaactgaatatgttcagtgcacactttttatgccatactaagaatagagtatatctactctgcagctcattgccttcattatcagcatgaggatgcgagcagggcaatctggtgcaagtgagatgttggccattgtgcagcatgagcaagcatgatgagtatgctagtagattgtaaatttggccaacctgaaaccattgtaaatttacatactgtacattgtaaatttggccaacgtgaaaccatcccattgtctactatcctgatgggcgaatgactattcccctattcctctgcaaatctccatcagggaagggaaggattcttcttcagatagtaaattgacaactgctatgtcatagaagccagcccagcttgttgtaatatcacctagtagtgtatattgctggaatgatggcctacatatttcggccggagcttcagacatgagttaatgccaatggtagtacagatttcaacagcaagtaaaattttctagaattagcaggattactgttagcatcaacacttgttccattacaacggattggattttacctcgtgttaccaatactactaccacccccagaagtctagtttcagagcttccaattaacaatccacgcccacggtatcgacgcagcgtctgaatgcaagggcccgtggtcacctcccgtcgtggtactcgcagtcggcggcgacgccgtggacgggcttgccgaggcttgcctcgcggacgtcgaggcggcagaggacgcggcggtagaacttggagcggacgaggaggccgaggatgtgggcgcgcgcccgcagcacgaaggccatcctgacgggcaccaccgcggggccgaggcggccgttgttgggcttgctgtgcagctccgcgccggcgccgtagagcggcacctgcttccccaccacggacaccgtcaccacgcgcccgctccgccgcggctgatagaactccgccatctgcacgcatgagtgagcacacacgcaacacgatcgttcagtgcagtgtactgtagtgcggtttggttgtgcatcctccgaataaattgtacttccagtatattattgcacgggaaacttttctgtcggaatgagaaaaattgcacttgcactatttaccgtccggtagaaaacaaggaacaaaaatacagaccggaacatgcacagcaagtcaatgagtctatgaaccatgatagggctgggttgctgcgcactgggggccatcatcttgtacagcaaaaggattccctcgccgcagcacagagtaaacaaagcgtacggcaaaagtactgtaactacggtaaagtaacgtaagctaaaggtgtgatgtctgaaacatagaaaagcagtaagggcatgcccaatgcagggcgcacccttacccacatctcatttttacactgcagcacctgtcagtcggtcatattttacatttaaacccttggattatttttatttacatatacatccaatattagcagtataccccctaaaaatcactaggctcccctccttggctcgattcccgtcctcctggtggcgcgatttccccttctccggcggcgccctccccagcacgacctcccctctctctcctcggcgcctcgagcagcggtggcggcggagcttcccggcggcagcagatcgagcagccgctggaggtggggatcgtggcagcgggcgcggatcgaagcggctgcggccacagatcgacgcggtggcggcagatggaggcgcaggaggtggggatcgaggcggcagcggcggatcgaagcagcggcgacgtggatcgacgcgacggccgcggatcgacgcgtcagcggcagggagcgacgcggcagagacggagcttcccgggtacgcctttctctcgagtccaccccttcgccatcttcttccacagtagcggagcagatcgatgcgtcggtggccggcggagcttcccggcggcggcatcttccatcgtggatccgtcacggggagacgacctcgccaacgtgccgctccaagcgtgcttcgctgttctcgagccggggcgagcagaggtgcgcggcgctctgcagaggtccgcgattctttgcagggcgatggtcccgggcgaaaaagtggggcgagctagggataccctccaaggtggagggttgggcatgccctaagggcaagttttatggtggaggtgagtgccacgtctaatttaaaccatgtcatcttttcattaattaagagataacaattacaacatgtcacctctagtacacaaaccccaatattagtttactctcacacatcatcttatatttttcttggagattgtgtggagattgccccttgcatgaggggtggctcattctctctctcctaactcctctcctccgactcatcacctaatctacgtggtaaatttaggggcaacataaaagggcttatataaaggtgcttatagtacttgccaaaaggcaatccttttgagtgttgacgttgaagatggaacaaaggcctgacatatcacattggctctttgcctgtactatgcaacggagtatccagtggtagcgcatgcagcagcggcaagacagtcatcagggaagtgttgtctttttcctctaaaaaaactatagcagagggaggctgaagagtagtcgttctcaaccggtcagtccttacatcagttaccggctggtctttgtgccgtgacaagaacaaaaaatctgctcatatcggcaaatggcaagcgatggcatccctgactcgagtcacgtgaacaccatgcccaccgatagccaatgacgccactgcttgcctctgggtgttattgcgtttccattccaggtcccctttttgctggttctgtgtagtactagtagtagtaggagtatttgttacttgatcacatgcacttcgcccccactttgcacagtactaccagactcaccagtattctagtgaaagaaaatcgctgcagttagccgagcgggtaacttgacagatgatatttttgttactgcggaacgactcacgagctcaccgtctgtgtgtgtgtaaacgctaagaggttctgtgtgtaaaacgctaaatccaagtcctgcctgaatggccgaatgcaagctgctgcacactcaaattctcaaaacaatgcactatcatgcttaagtccaacagcgcctcagaatagccccaatgcatggctgcgaagtctcatctgagatgatccactccgtcgaggaagcaaatggcaatgcaaggctgcaagctatccccggttcgaggatgacaatggaggagccggttttttaaaacgcaactttgttctgtcttccgagtgaagagctgccgaaaaaactaatcaaggacagagacaaataagaagggaaccgtgctgttaggtttagctttctcccgcacctaggcagtaggttagtatactccaccacactatgatgttcatggggatgctcaaaagctgatctaaaccggcaaaaattccacggactgctggcatcacggtcggaatggcataggagattagtactccactatagtcgtgatagaactcatgttagtaatgaagagcacagtacgaataatcgggacaaccctactgatccattgtacagagcccagatccaactcttgattcacccgtttgtttgtgagttgttacgcagtaactagcaataactaccatcgatttacgccagcctaatcaggcacggaaacgtccgcatcacctacccaatccattcagattcaccaaacgtaacgaggatggcataggcaaattcaggtagaagtacgagcagaaaggcgagggttggggtggtggaaagggcacgtacgtggccggtggcgacggtgaggtcgtcgtagaagaggtggaacggcgtggaggtgacgtgcaggctgaagaaggtgccccggttgcggaagcgcagcctgaccgtcgcgttgacggacatcatcttggtcgggacgcccgtccggtccgtgccgccctggatgtggtacgtctcgaacaccacactctacacacacatggagaggaacagcaaatcgtacagcaagtcaataatggagtagcactactacattttatactcctttcaaatttcaattgattcactagaatggcaccagcacagaaacggctagcaaattgatcgcaatatccgcaattccgcatgatgtccaggaagcaaaaactcctgctcctatattgttttaagtagtactcgttctcctagtattcctgtgtgcatgtttcgcggatgcttttactaggtaggagtactcctacagctgttcattggcaaaatgcgtgtacgatcgtcggaacggacgctgcctctagtaaatgcatgcattcagattggatgtacacagcttgtgtttctcttctcttggaaggaagacgggggcaatcggtgccagtaccgatatctcaaaacttgcatatagttgcatt

SEQ ID NO: 63672 - DNA, 1466 bp, Oryza sativa
ccgccgccgccgcctgcgccgcccgaggccaccacgacgtccgggtgggaggcggcggggctgagcacgtagtaggccgaccggcgcggcgaccgcggcggcgaggacggcgccaggctcgtcacgtcggagtccgtcttcgcgtgccgtgccatctcgggagccgcgcggcgcgatgggcgtgaccgcgtgagcgatagagggcacagtggtggattgtggcgaggcgcaaagcgcaacaggtctgggagcctcttcgttgatagtaagcgcaacggattgtggcgaggtttttaagtggaacgcgaggggttttcgtttccaaagtttggagctgtgtgcgccgcgagggtggcggccgttgggcgaccgcggagtaatgtgggggcggctggctcactctggctcgtggctggctagctactactggcgagaccgcgagactgaagctttgagctggtcccgtatgagcggagagacccactgcattgaaggcctgctcagcacctcggccgcaatggagatgtcaggaatggtcgaaccaattacactattttgagcttaagccacaatagaccttccacggcccatctcatcacacggtatagcctgttaagattattgcgggcgaataagttcatctgagggcccttaacttatcaagaatccgattttgatccttcaatcggaaaacaatacgtaacgggtccctcaactatcaaaactagtgcaaaataagttccaatgatggtttggacggcggtttcagctgacgtgatgtctatgtggctaatttgactcggtcttcatctgacgtggcattgacatggcgcttacgtggcagtttggtttggcaaataatataatcgtgaccctacatgttagtgtcgatggggatactcgtagaccagatgaatagagtattggggtacgttggtacaaggatttatacgatatgacatcaagcaaacaagaaaacaaggattatactaattcgggccttcgtaaggtagaagccttaatctagtttatatgagatagatatggaaataccacatattacaataaagaaccgacgatcctgatattaccggcgagatcccttgtcgagatggtttcgatgagatctcccggcaagtaggcttcacgtcctccggattgtaggctatggcgattgtgtttggcactatgattcaatgatctgaacccctctaagtggtgtgccttttataccctgagtcatcttagtctcaaagtagaactcgaagacaacagaccctacactatatagtatcaacccaatcctctttgagtaggactctaacattcctcttcttgtgaggataatttccataacagcttgtgaatttccttattgtatacggaaatacatcatatatacaaaggtatgccgtatccgcatattcgataagtcgtaagatttgaggaatactttatttttaacc

SEQ ID NO: 63673 - DNA, 2226 bp, Oryza sativa
ttcctgcaccccaaacggatgtagtaatgaccaatccgatccaagtctcatactatacgggcagtggagataaattattaaatatttaaatccagttgcaagaaaaaattaaggtgtctaatggagtgcataattcggtaatcagtgtatgattggtggcttgattcccattctgttataggagaccgtaccacggttttagtgtccgtgatcagcagtagcgttttttttttctgaagcagatcgaataatttgaagttaagcacgtgggttctatgtaatacagcatcttttaatacaaacgatgtggttgggactggaaatcctatggttaaggattaaccttttctaatttttggaagttttcagtagttaaaaaaaatcgatgttttcctgttgaattggcaactatttggtgaagtttcatgtttacaaacgaaatccaagccaaaatgagcattgatccttccatgaaaaagtgtaggagggagggacggttggttgatagaggtacgtactacaaggttcatagcctccatttctgagtctcggatatctgtataattaaagatacgaaatgcctgaatcttttcgttgctcgggaaatgttcagttcttaactgaaacaattcatttgcaaggcaaattgtgaagaatatgtaaaatattgtactagattaattccagtacggatctccaagtttatagtacaaaagagaaagtgggttagtgagaaatacctgtagtcttccagctagttccatgagatggtgggctagccggcttaggttcaaagtatcactccttatatttatttgatattagatcattctctaatattcatgttttttagaaagtgggttagttttctcagtacaccggctaaaccattagagttatccctgataattcataaatgaaaacgtaataacaccatatgcccaatgatcaattataccatgattctaaattcactagtccactgaagacaaagtgagttggcacttgcgatctgtaaagaatgtggaagaagacaattcgcaaagtacaaaaggtagtagttggttagttataattcagaatagtaaaattctctgcatttttgcatcccaaacacccttagagcttattttgtgaaatgcatgttctccgggctcaaagaagacgagcggttaagttctgtaaatatgaagattgcacaaaaaggactacaacatcactgttcgtgaattttgtcgcttttcctttctatatagcacagaagctagttcgagaaagacaagtgatatgttgaggcctaggtgactaggtatagggtaataggaagaggtagatgaaggctttagtttttcagattcagaaaaaggaaaagggaagagatagcatatagtagtacagtatgcttaaggaatgatgtataagggtgaagcgatgagtacacactagttccatgtctacacagaccatatgattgtgagtcagacaaggaatacccagtacagaatgtccatcaagtgatagaatcagctagtgtaggatgagaattccaactcctgtttctttaggatattgtacaccttttttgcctagcaaattataaggtctaaacaaaaacctagtatgctccaacataatactgtatgtcaattttggccaaatgtatgatgatagttgtacaaaaagaattgtataacattgtctgatttttatgtctcatggggcaactaccaagtagccagttttactatagttatactcgatctcctagagtaaccaaggaaggtgccaacaagacgaagtgctctagagtttttttttaacaacatctcgagttcttaaaaataagatctccctcaattgccataccctctcgcaaatacaataatcctcgttttggagtttttgtgagtgaagcatacaaaattcatgatctgaactggttctgataatttcatatgcttgcaagcactccagtgtacattctgtggcgctgtgcctaagaacatagggaaggcaataatttaactggtggtcagttctggattcgaagcttctaaatataccagaacggcggaatccaacgctaataaattttacttcacagatatgagtgcagtattatacaagagtttgtcaggtatcaatgcaggtaaattccagattatgtcaggcatggaattttgcatcactaggataagctgatataatgattaactaccatgcttg

SEQ ID NO: 63674 - DNA, 1244 bp, Oryza sativa
aattcctgcagcccagagttgtcgatgaggaagtgaagccgatctcgccgccgccgaggaaggaagaggaggaggaggagccgatctcgccgccgcaaccactgaagcgggagatctggcaggagaaggcgagtgcgttctcgtcggtgggctcctcctcctcggggaagagcggcggcgccgagagcagaggtcggcgtcgcggaggccacaggagacggcgatggcagcgtccggctggagatcgaggagatcgcggcgggggatcgccgtcacgagaccaggaagcggaagaaccacctcggtgcgcgcgcgcccctcgcctctcgaattccatctccccctttcaccactgctcatcctcgacgcgatgtccatgccccctgcaggtggtggtggtgctcggcgacgacaacggcgccaacgcccctcccttgctcctgcgtcgtcgccgccttgttcccccgccgccgccttgctctccttcccacctgttggctggcgacgctggcctgcccagaaccccagagagaagagtgagagagatagagagagagaggagaaagggagagaagagaggaaagagagagtaggctgacctggacaagctgacacgtgaggcccacgtgagtcccacggtgactcagccaccgatgaccgtggtcaaagcgccacataggataaaaccggtatcagccgagggacctattgcgaccggttttgtatagttaagggaccccgcatatctggttttgtgatttgaggatgttttttatttcgctgacaagttgagggaccttcggtgtactttttcctaattctggccccaagtcgtacacgttacctgtggcggtatgcttctgtgggcttttctgcttgggccaatcctgagcgtctcttactcttctcacgagaacccaaacgacgccgcattccccttttcctcccttcccgggaaccccggccggcggcgaccggcgacctcccctccgagtcggcgactggtgcctccttttctcccctgtgctccttctcccttatccgttaggtctacaagcacctgatttggcagcgttgatccccattgttgtagggtgccatagaggaaggaggcggtggagacaccggcggtggcaagggcgacatcggcgaagagttcgcctccctcctcctcccatcctatcccacggaaggtgtgaaactctattcgcacatgtgtggcaaattttggtaggtcgtgaagt

SEQ ID NO: 63675 - DNA, 1779 bp, Oryza sativa
  unsure (1)..(1779): unsure at all n locations
gtttttgttgaccatattggctttggtgtttaatctgtctctgaatgccagccagaggaaaaccttgcaattttgcgggatggtgtggagccaaatataatctgctggagtccaaagtgacccatggaaggacatcatccgataggcatttgctgttgagactttgggttccgggtatgaaaactctcttgcgtttgtgttgtctgggtaggggtggtggttttgcagtatttgcagcagttcatgcagctctgactctgcttggtaggataggtttggatggagctggatgtgccaggaattgtgcctgtattgcgattcaaccgtgcaatccttgtgtagggcaaaagagaataaaactgggaaagcgaactctatgtgcgctgggatagccacttatctttccaaaagagggttgttttgccgttgccaagttttacctgggtcgagtagcttagaatctggaattgcgactggatgagtttccaagttggtgtatcactggctctggggtttagctgtattgcgttttgcagatatctttctctaaaccagatagccattggatcatcttctgctgagagtaccttgtttgctagttttaagagtaacgctgtgttatgtgttcttaagtccttgatccctaatcctccttgttgtccctgatataggtctgatactctgatgtaatatcattcatgatttgtgtctattgccaaggagcaccacatgcttgtgtacgttgccagttcacggagtttctaaatccaacaatatcagaaaagagttgcatgcagcctcttcatgaataatttacaaacttatcttcaccgcatctaagcaaatctctattgaatagaagacactgcagcttaattgctgaaaagttctttnttccagcatggccctttcaagttcaggataggacaaaatcttgcatctattatattgctcagtttgacaccctgtcaatagaatcatcaatttcttctgaggtttttgcatgggtaaacagaagttgaaaaagagcttattgtttgcactgaaaccttggcactcttaataacggtttccatttactgtttaccacagatttggccttcccatggaatctgatgaagatgctaagaaggggtatgctgattttgaggagagggtaaagagaacgatatatatcgatcacctttctcctcaagtcacaagctcagtaattgaagcagctatttcccagtgtgcacgcgttgtcaatgtggacttcattgttaattacacaatcccatatgatattccttctgctgcgttggtggaactagatgatgaaatacaagctaaggctgctatcgacttgatgaataatttccctttcataatcggtggaaagccaaggcctgtaagagctatctatgcaaagcatgaaatgtttctggatcggcctcctcgccctggaatcaagaaagagttccagtgggtgaaacaagaagatggaatagagtatgaaggaatgaacaaactgcggctccttgcaagaaggcaggaaacagaaaatatggcactcataaaggtaagttggatgacttttgagttttttcggatgagtgacttatgtattgtgctttatgtccactaccatgaaacagcaaacttttctgcttaactccctatgaaactgttggtagaacaatagctcagaattcactcagaagaatgctcaagggaactgggggcaggctccttgatagcgcatagacaattggaacctagaaaatgtcaacctgaata

SEQ ID NO: 63676 - DNA, 2148 bp, Oryza sativa
acagaaatgagcttgcaggttatgaaaaataaacgatattctttggaagcccgtctaactcggaaaggtgaggtacctctatacaaatgatgaaatcttgaatgcttgactttaactccaagctctgtgccaacggacttctaaccaagcccaaagaatacatgatagcaatcataataccctgccaccaagttaaaaatactatagatttgaacgaaagaaattttgccaatggctttatatgtgccaattcgtccttagtagccgtgtaccactccaccaaacagtatagggcccaatattgactgaagttaaggacagcggcaaagtatgggtatctgcagtttgaacaaaagcaatgaagttgaaaaaatggataagcatgcataaaataattcattgaagtggactgctagatgttcacatatattctggggataaagacaaggtgataacagcttatgcagtgacacaggtagagtcatcaagaagattgcattactcttctatgcagttatctgtctctgcattattcctattataaaatttttccaagcattatgaaattcaaattataaaggtgaatgccttttgctttgctgaactcaagacacaagaggtgaaaatggaaaattgtcttacccgcatctcaaattgaattctccatcacaatatgcaccaaaaggttgaagaatcagggataggctagctgtgagggtctttataatcacctgcacaggtacaaagtacttaaccaatatgctctcaaaatcataaattccatttcaactagctggacaagtggtcatacatattgaaatataccaaatttgataatctggtaaaacctcacacccattctccatggtttcaatatgtaattcacagggaagtgatggtgtatgatccctttttcagaagcaccatgcaaaagaggttccccagaatctccgccaccctccctcttcaaaaatgcaattgtcctttcttcaccacctatatacaaaatatatacattttttttcaaattaaataagagcgatagatggagagcttccaaattattaatgaaccggttccatatagtatttttatcatgttaatcctactttccttgtataaaaaagcaattaatgggaaaatatacatagggatgcattgtttgtttgtccaaggtgacatttttagtagttatacacaggttcattttattaagcctcttctctcgggtaaattccctcgaatagaatccttgataacaacgatactgttatctcaggaatttaggcagatagaatggtggatgcctttgcataaccttatcgaacaatagttccagttgttctggggtgaatatagactagctgtatacatggaaaacctgtatccagttatggaggtacatattatatataaaggaccataaatgaaatcatgcctcattccaatgccaaaggtctgtttctgttacttggtgtgttgaaaaatttatgaatgcccataaattggtcatcctgccaaagttttgcccaaattgaaagcacaataatatgtagctagtcattgacaaagtccatggggttagacaggccacaaaccaaacataacccaactacctgcattgttttaacatatccatccccacgttccctcaaaatgggaaaaaaagattggtgcatcatagcaacatcataaatgtgacagatctattgcaaaaagagtagaccgtagatcaatctttaactaaatgtataagtgcaagtagcaccctgagagtggcaatgaaagttagaatgtctaagaaaacagctcacctaaacaagcagtaatatatcttccaaagcaatacatagcaaatgcttcataggcgtcacgcaggatgccacagtacacgctagtgtcaggatttaccaatgaaacatactgttgcagaggagaagcaaagatcatcaaatacgcaactaaaatatctgaagagccctaatccaacaaaaaaaaacagaagttgctttggagatattaccgactcaactgcatagcaagggaccatcaagataacaccgagaacaaatttctgttcctggaaaaacacaaaaacgaaatggatattgtttgcagacatgacaaaccttagtattgataacatgg

SEQ ID NO: 63677 - DNA, 991 bp, Oryza sativa
attcctgcagccaaatgtccaaaaatactacgtagccaagatgctttattctgtttccactaagtatatatagtgtataaacatatcaatatatatttacatcattatcaacggcatccgcaagatgttaatttttccccctcatctagaaattacgctctatgtccatatggcacaccaaagatttctgtgtttctttcccgagaaatcggtcacatgaaaggattcaagtgttccgttcggacatcagggaagaacgatcgaggatcagaaaagaccaaagcatatggtgcagcaaaagcattgcgtatgcccacgatctgcagcagctgcaagcgccggtcgctcttacgctatctcactctcggagacgggtggccagcggccgggccagcccagtccgaccccggccgcggcgactggccgtaaccgtgcgcgccgccgccgccgccgccccgtgccgcgggacgcggggacgccgagccgggggcgccaccgccgctgccgcccctggacatggactcgatctcctcgaggacggcgacgacctccctcatggagggccggttcttgtggtcggcggcgaggcaccggagcgtgagctgcgccgcacgctgcgcgcccctggacgagtactgcccctcgaggcgcgggtccatgagccgagccagcttccggcggtcggacaggaatggcttggcccagtccaccaggtggtgctgcccgctgggccgcccggcgtcgagcgcgcggagccccgtcaggagctccagcagcacgacgccgaagccgtacacgtcgctcttcacgtacaggtggcccgtcgccacgtactccggcgccgcgtagccgtaggtgcccatcacgcgggtcgtcacgtggctgctgccgccggccggcccgtccttggcgagcccgaagtcggagagcttcgcgtggaattgctgcacgtacgcatgatcaatccgcgaggaaaaggggctgcaggaat

SEQ ID NO: 63678 - DNA, 881 bp, Oryza sativa
tcaatatcttcccaaccgtaaatccgtttgactccgttcaaattccaaaatttctcaaatctcgagatctatctaatggcacgcttagaggtcattaatagagctttattttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttctgtctgcaaggcagattggcagacctacctaacttgttgcatttgatccttccattgttaattgctatacaatgtccccttgtaaccatccagttgcgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccgggaaacgtaccgggtgtacggtttcccgctctcgcacttaaggaccgattccttggaatttcatccaaacataagtcaagtacgaccacatgggtggaatgggacacccctggctgagtaactagcttatcaggggagccttgatgccgagagacatgtggattcgccggggtagtgtcggggaggacccctgggcttcctggcgcagtatggtctgggacctaacctgttgttggtctgggacccctctcgtcggcatatggtaaacctgtgtcggctttggaaatgccttgtcatgaaagcttggaggtctcccg

SEQ ID NO: 63679 - DNA, 714 bp, Oryza sativa
ttgcattataggagactgcatctttaacaatcagttgattaaagagatgtcttgatatcgtgatttttttgcatttggagtacaccttaacaagagcagtcgccaaaacaacatccagaggtatatatcttcttattaagtaggtatgaatactagcagcatagccgaaatagcatacctcaacacaagcagaaatcacgtttgcgaaggtgacagaatctggagttattttatgctcatgcagcatcacagacaaatagtggattgcatcaaaactctgtccagctctagtaagaccagaaagcatagcattccatgaagctgcagttccctttgaattctgtaaagtagcaactgctgattgataagctccacatcgagtatacaagttcacaatgcaggtctctagaatataatctgagacaacaagtgctctccttatggaatagcaatggagtgatttgccctctttaagtgctcccaaattcccagctatttgcagtaagcttatcatagtcacacggtttacttccaagttgccctgcagcatatcaatggcaatatcaaatgcattccatgcaactgaatccacaatttctgaataaccagtgatcatcgaagtgtaagcaacaacgtccttgtcaatgatctctttaaacactccctgtgaatcgtccatcctatgaagcttgagtattctatagtgtcacctaa

SEQ ID NO: 63680 - DNA, 1514 bp, Oryza sativa
tttgaggacagtattttgatatcttgatgctgttaaattacatatatataatgcgttgacgatgctttgatcttcagatagcatgtgagaaaatattttcatttggctgttcccttccccagaatctattggaagaggacaaggacctagcaaagcagcaacaggagttacttgatggaatttacaagaagtactgcatactagacagtgacgtgatgaatgatatcaagaacctctctcgccgttatggagtcaacctggccggtgactgatcagttttgaccatccaagagacggactgcttcaaaaggtccagatcagtccccagggcgagcaacatgcattggtgtgacccaataactgcatcttctatgtaaatattttttttgagaactttctatgcaaagattctgtagtgttactgttgttcccgcatcctgacccacccagcaacagtatgctcgttttgtgatgtgtataggagtaacttcttgcgctgcgcggagatgattcgctgctgtcggatgctgtctattatgcatgtctgaaattaacttgctgttgattaatcggaggttacattcataatgcctagtcttgccttgtttacattcattgtttcggttcagttgagagttcagagatgtcctgatggggttgcggatattgttgtatcaatctctcactgagcaagtttaataataggatataaccaaccacaaacttttgtgaaagaaagggagaaacaatgttagttctcgtactagcagtaaatgcactacttatataataagtaagagtaagacaaagagatagggaaaaaaaatagagacaaccttatagtaactaatactccctctatctacttttgatagtcgtattttatcttggcacacagaccaaggataagtaattctacttatcatccatttaaacatgttaccagtcattcctcgtaaacaagcgattcattaatatttacatttctcgatgcccatatagccaatcttgtgtggaagaatgaagagtcatgcattacaaccaagaaagtcattaagatgatagattgttgaattgaaatatgcctatcaaaaatatttttttcagatttagaaatatgactatcaaaagtagatggagggagtatgctatacatgttagctttagttttttgccgggatggccaacctaattttattaaggctgaaaggaattgttacaaattttacaaaattgacattaaactgtaggggggtggggggttgggggtagagaaaataaaacgaaaaacaaatagggccggctgacagggaggttctcagccaacttctctaaaaataccggcctccctccacaccaaatctcatctctaatttctctataaatctctgagcgtgacttttgctcaaagatcctagcattcctctctttccacacaaactaacataccatcatattagttttagtttgagcttgctaagggcaaccgcaatggttatctataggctatctac

SEQ ID NO: 63681 - DNA, 1299 bp, Oryza sativa
cctgcagccccacagctgtacgtcactcgtaatcgtcttgccttgcctccaatgatcgtgtgaacaggaagcagatgggcgtgtaccggccaccgggtaggcgtattaaccgtagggacgttttccctcccaatgtgaatcaccaacgacttgatgttgatctcgctcgtcctctcctccttcgacatgctccgtgtttgtagtgacagggagtgcactatcaagttccgactcggcaattgtgagtccgtcactatggtgtgctagctgtagttgcctccgtcgtctagcttctcagcctgttcgctcaccctgacaccctcgcctccatcaacgatgatgaggatggttactggtgtgcatccttcgtcgccactgccgagctcatgccaatgcatggcaaggacgaggtggtgccgtcgttgtggtggtgtccggtgtggtgccgtcgcactaaccgaagtagcagttcatcgttgtggggattgttgccgcacaacaacgcggaggtaagaggtcctccctctgtcctataatatagtaatctatgattggatgggatattttatagtgcaacgaatctgagtaggggtgtgatctatgattggatgggatattttatagtgcaacgaatctgagtaggggtgtgtccagatttgttgtactatgaaatatcaaatacagtcctagattgctatgttatgagacagagggagtaccgcagtggtgcataaaggcgggaagacaatgttaatagtggtggataaaggcgggaagacaatgttgatagagggagtaccgcagtggtggatgaatgcgggaagacaatgttgccaacgagagggatagtttggcatgtgtgctgttggagatggggagtgatgggaggtaatcctccgtccataaaaaaaatcagaataaatctagataagtgtttatacggaattatttgtacaagttgattttttaaaaaaaaatgtaaaaaaaattataggcatccatgttctctcatggtacgaatggtataaaggttcagttcttttgtttttacttgttagaaaggggaaaatattctgtcagaatcggggagcaccagcagatggtcgacacggtttatgctactattaacagcatttgctggaatcctcgaagttgaaaagtcaaagcaaagggaaccgtataaagctacaacaagcctacaatgccttgtttatagaaaactaaatcatcaatatccaaaacgagttcagtacttacatatcttcggtctgaacttacttaatttgatacgaaatctta

SEQ ID NO: 63682 - DNA, 3888 bp, Oryza sativa
agcaaaagaaaagcaacagaacagcaggcggcattcaggctttttctttgctaatccactgtaggaaaacattctgagtaccataattctaaacggtcccccttcacacccacgcacgcctattcccaacatcttagggtcgaagatagcaaactagtaaagctaataggggacctaagacacagtttgctacctcatgcccccggatacactatttactcttcatcgtcctcattttcctgcaaagagcaaattaaaaatgttcattagcaacacaactagcagtagtaaaaattcattgggcattcaagctaaaatagggcaccgggtgttcctttaatgattacctcatcgctaccaccatcctggtctcgtcgacctcagacttggacttgtcagagccttctccatcatcatgggtcttagctttctttgagcttgtgctctcctgaagaagtaattcaagaagtccaattagtgcctaacgcttgaagggctctataattaggatgcacaattattctatcatcaccttcttatcgaagttggccttggtcttctcgtagtcctgcttcttttggccagccttgtccacataaggtgccttctcctaataaaatttaacacgaagggccaaaaacatatggcacattgtcacatcaatagccacccatggtacttatgtgtacttaagcgcttcactgagtagaattcaaaaacaaattgcaattttcattcaactagtactttaggagcaattcaatctttttcctaacaaacaggccagaacaattattaaacagtcctctagtgatactcatggatgatgtatgctaaataacagatgcacacacttaataggaacatgtactaatttttgaacactgcagagaaaaactcacttgctcagacatagctcgccacttctcccctgcagccttgctcacctaatgaaccaacagaggagaaaaaaattggacatctaaagtacatcagccaaaaagtggcgaaaaagatgatggtgtcaggaagctcacggcggcgacactcttgttgtcaggatgcgctgcctggtactcctgcctgaactcagacctgcaaaagtaaaaaataaaaaccacaaaaaatattaaaattcaagaaaatcaacaaaaattaaacaaaaactcaagacagatctgtactagatctgaacagagcaaaacgtgggcgagggagcgagaaactcacatgaagacgaagaaagcagacggcgggcgcttcggcttgccgctagcggcggccttcttccgcttcccggcgccgccggcggccttgagcctaacaacaacaacaacaacaacaccaaacacaaaaccgctcagatgtgaaccaacaacagccaccgccagaaaaccctcctccaccgcccatacgcagcagcaaagacggccggagagaggatcttacctgccctcgcccttcttggaggcgtcggccttgcccttcatggctgcggcgcggagatcgcgaagtcggtgcgctagggtttttgcgggggtgcagcggaggaggaggaggcggagtttgggaggcggcgcaacgggcgttgtctggccttttggggcggagcgttgcgcggtgcgtggccgcgtgggagtgcgtgaaagggaaataaataaaggacagcgacgggctgagcgctgtacctgcgacgcgtgggtcggtggtacgatcggttttgggttggaggaagcgggctgggccgtgtgggatggcccaacattgcggtcagtcgcggcactgggctattgggccttatgtcaccgataaaacacagaaaaaagcctaaatcaaagaacctgttgcaaatgtgttatgagattcaggattgtcaaagggaaatggatgaatggctaggactaaatgagatgtgaagatatagatgagaagaatagatggctaggatacgatattacccttcgatggatgggatatcatttcccgatcccatttgccaaagaagcctaaaagaccattacaacatgtaacaagagatatgtcgattttctagatcggcaataatatttatcgggtgcactagacgtaggaaagatggtgacacagtgattatgctagttcaggcactcgaagagaggtaataccctagttcagtcgtatgagattggatctgtgcagaatttcgcaatacgacgttgagagtagcttgtagcgatcacccgaattagggttagccgacccccttatatagtcatcagggagccagctaagacatgcgtgatatctcttataatccggtacatgcctcctatttacatgagataagatccattgccttatctctaattcctttcttataatagaagtaagttggatgagtctagggcacttggcccgtgtaacatcctgaaaatccccgacaataaaaatcactaaaattttgaactttttaaaacttttgcatcatgctggatgttatggttggtattgcttgtcaaactataaattgtcaccactgaaaattaagctaaagctatacaactgattaataattataaaaataagatatttattgtgaaccctataaatatttacgcacaacacaacaaagccatacaaagagaaggttaattactaatttaatttataggccaaatattaaatattggaaccatgtgacaggtgtcatgacatctaagtaaccatgaaataatcgccactatgacgaccctatatataaaggagtgttgcactggaataattaaattaatatttacaatgttcatcaagtctctcaggggatagattcactcatgtaaaataatttgtcatgtaaataaattgagttctatatataaaaaagagcttatgggagtattcgattcaatgtttaagaccaatattgcaccaaatctcataataccttcatagaataaaacttaaataaattaaacctatgtatgtaaaatatattgctatacaaataaattcgaccaatgtgctattgtattattaaatgtcacaatagaatatttaattagtttttaagaaatatcaaagcctagaagttgaattggataatttttggataatctaatggaaagcaaactcatttgggaactaatgaataactaaataaatattcaaatcaaacatttgaattctcaaaaccagaatgtatagatttcatttcatttcaaatccaatcccattcacttttgcagattagcccttccccctttctctttttccttttcccccattccttttctttttcagtcggcactgttcatcgcccatgaaccgttcgatctgggcccaagccgctcacatgctgcgagtccgctccttcccggtcactactgagccgcgcacgtgatcaatcgcgccatctccgcatctcgtgtcgcccccgtgcaccgcatcgtgtccgtgccggtgcgccatcccctccgtgccgcaccagaaccgcgccaaacctagccgcctccccgccagcgcgtccggattccctccaggaaacatggcgcctcgcgtcttgtcgcgccgtcgccatcgccatcacccatcacctcgccaccgatggataacggccagaacgccaatccgcgtcatccctagccctagccaactaccttaggacgggaaaaccgccccagcaagccgccgctccgccacagctcccatgtgcgcgcgttccgtcgcccccattcgcgcccaatgaataaaacggagcctcctgccacagctagagttagaacgcacagactttaggctttaggtacgatgatggagccacataaccttaatggaggaggagatcaaaccttatccgcgtcatccacctcattgctcttatccgatcaccattagtactccagctcgcct

SEQ ID NO: 63683 - DNA, 897 bp, Oryza sativa
agcccattccactacctaaccatctctttaaggttggcgaattccctcctcctaccccgatcttaatatgggatcctaacttaagtcgccactatctcgctggctttcaaggagaaagagtgacaaggatctaatggtgaaggattcatcagatattcaactcaaatttgtgtcaaatgaaggttagcaattctgctaaatatcccatattataaacaagcgtttctcaaaagaaaattgaaaaataagtacaataataggcaaatggatctaatattcttttttcattggaatggatctaatattataatcttgaccccgcaaaaaaaattctaatcttgagaaactcaaaatgtttttgaacactgatgaaatttgaaacgaggtgccagtgtgccacaaaacatgtatattgccgcgatatgcgccatgcggccatgccgccatgtgctcctcccctgatgcatgggttcccagatgacagtcgaccagtcgcccagccaggagcagccttcctccaggcctcgtctcgtccttccacaccacgtccaggtcatttccgcctccttttttaatagaggaagagcggaagacatggcgaagcacgtcgctggaaggacatgatctacgcacacaagccattatagctcggggaagagactcacagagaggaagtgctcccggtgcttccctgctcgtttggctgctcgccggccgcgtccgccatggggaattgcttcggctccgatgacggcgaggtggaggccgtcaaggtgatggcccgtcatgcgctgccacaaggtacatatatgaatatcgacatcccgatgctctgcttacaatatcactacgttttctttgtattcgtgagatttattttgttcatcgggatctgga

SEQ ID NO: 63684 - DNA, 1708 bp, Oryza sativa
gaattcctgcagccccgccgcggcgacggccgccgccacctggaaggtggttgatgtctggaggaaccgcgcggtgagtgttccggagacaaccccgctgccgacacgccggagaggagcccgaacgccgccgctcgccgcctggcgccgacttggtcggcctgcgtccacaaacttcacctggtcaaggactccctgattgggcggtgggccgcccacttctgttacgctgacgagtgggcctaatcgccgtattttccgtttgttcagttgtactgtattggtagtttgtcctttactcctttttgtgtggtagtatacattctttctgttgtcgtaattgtacaggtcacatgttctcgttaaatatacgtattcgttattcaggatgcgtatctcaataactttgaaatatgtatttggatgatcgatctatcatagtgaggttttcattaccacgtaggcgagcaagaggcaatgcatgctgccctcgcagaagatgccggcgaggaccttaacgacgtagtacacgtagaagtacaccttggagcggttgcaggccagtataactgccagaaaaaaaagtggaaaacatatgaaaatgtgcacagatgcattatgcagtttcatcaagctagggtgacccaagtcatgctgcaaagagcatacacaacggcagaatggccacggtcaccggcagtgtcatcagcgccttcctgccgtatttgtccgacaaattccccacgatgggagtcaccacaagagcccccatccctgtgatctgcgcaaattagccaaaagccgttccattttcacaaatcccacccgcaaaatgtgacttaaataatccgaaacgcgcgatactcacggcgctctggaagccgctgaggtagatggcgacggagcactcgtcgcggccggggcagacggcgtccatcgtcacgtcggtgatcgccgggatgaccatgtaggaggcgaagtggaacatgaacgccgccacgaacaagtgccccagcacagccaagtccttcatcctggcgtctctaccaaatcgacagcttaagagaaacacggttaatttgcatgccaaaactccgggtctacgttttatactcgcatgcacggcacgcaaggacaagaaaaatatacatatcgccaatgcaacgcttccaagtaagagaagcagaaaaaccgaagcatcgatcagtcgctcttgcttagggtgatcacccacttgatctcgtcactaaaagtgaccctgcatttttgccaggtttgcacagttatattgcgccttgtgaacatacttttacgtgcccaattccccaaacaagccaagcaaaactgtaaccgtcccgatgtttgttgcagctgggagcctgagagagtgatctgaggacgagaacctgtgattactggagctagctaagttgtcgctgccgatggtgattggttagtgtggtgccggtggcttgtacgcatggcgctgcaacagagcactagagctaacatgcgagtgatggatgatgtactgatgtgttttttagagtgcactccactctactttcggagctactgctcgctgattgggtcttttgtagcttgcagccctggaactctgtttactcgtggaatacggacaccgttggtcttgcttctgggaaaagctgggataatcttgcttggctctttctgcatttggtgctgg

SEQ ID NO: 63685 - DNA, 1962 bp, Oryza sativa
accctatttgcttatctctttatcgatttaataaatctagaattcttgcgggagcacacaacctccactccgcgcaggacctagaacacattaccatttgtgctaaaacatgtgctaccctatttgcttctctctttatcgatttaataaatctagaattcttgcgggagcacacaacctccactccgcgcaggacttggaacacattaccatttgtgctaaaacatgtgctaccctatttgcttctctctttatcttgtgcacttgcacttgctgaaggcattgcatcactcctttaatctcttcaatcgtcgtcgcccaggccgatttcaactgatcatgcctcattaaatctttaacaatttctgcattgtccatctccagcacgttaattatattggcattgatttgtacgtgtacgtactacgtactatctacctgctcgtgtgacagcaacatgcataatgcattggtagctaactaggctccaaaatgcagcagataatttatgaatgtactaggctaaccgaatacgtgcacgtatgccaaaattgacagcctgaatattcgggtgtgtgtgtctccagcagtagttcttctcgatcgacgaatctatacacaactacgtgcgtatagagacactcgtcctacttagtactcctgccgtacgtatttattgtacgtactcccttcagttggattaatttcatgagaaaagcgagagtccgatccgaatatattcatgtgggttgatatataagtttttcatttagcaactgaagacatgcttggaagtttgaaagcgcgcagggagtttcgcagcaaagttcactgcaaatgattagatcctaattcccagacaggaactaatttcaatttgtctgctacaacggatatgtcatgagtatacacggttgaaaaaatatttcaagattattattcgtgtagtacatgcagctagcatatacttatacttttgtgcatgcatggcaggcaaaactttttcttgcccgcaggctaatacagcgaacagtccacttgtaaagctgttgaaaaatccggaccaaacctgcaggggagcactagtgctagtctccgatcagaaattcgccaatagcatgtgatgtatgggcccaagctagctagcgtccatgcaaatagggtttgacacagataactatactacttattcacatctgagtatgcatcaatattaaaacgaccgaactaactaatcccattgaaaaaaaaatgattccacctattgcgtggcgtccctttctaatctttacacagacaggtgcctatgagctgtctaattcgtaaacctctctaaataaaactctagcttcagacacgcagaaatgttatttttatatatctatatattctcgttctccactgctcattaggacagccagtttgcgagaactctgagaaaagaacagcaaaagccactgcaatagaagcgcgcgagcgctgagagtatctcagatccatggagatggaggctgccacgccggtgccgaggagtgacggcaggaagctggcgaggtgcccgaggctgcagatggacgccaagacggtcactgccatcgagcagtccacgggcgcggccatcgccgacgccgctgcggctggcgccgagggcgccggcggcgggatgcgcgtcaagatcgtgctgagcaagcagcagctgaagcaggtggccgcggccgtcgccggagggggcgccttcgcgctgccgccggcgctggagcagctcgtgagcgtgctcaagcggcagcacgcgaagaagcaggtggcagcggctgctgatgtggtcgtcggaaggcgccgctgccggtggtcgccggcgttgcagagcatcccggaggagtgctttagctaggtacccacgtctacgaatgtgtagtcgattcgcaacatgtatagcttcggtgatcagtccctccttttttt

SEQ ID NO: 63686 - DNA, 701 bp, Oryza sativa
attcctgcagccctgtttgtttgtttttttttaaaaaaaagaacttgttcattgttgatcaatttgttcgatcagctgttcgaagacaggccgcctcgtctacaagaggaatatcaaacccctgcaaacaattaattccttctccccacgcataaatagcagtgagaggcgaacgagaatattcgtcaaataagaaaatggacgcgttatccagctcatacatccagccgcccggcctatgccgtgccttctccctctccctgatgccctgatcgatcgatgggcggccactgccgaagccatcgggctggcgtccacggaaacagcagtgatcgcgcccacgagccccatgtgagcctgtgcgacgcgcgcgcatgtacgcccggttctttcatagcctttcggctctgtctcacggttatttcaacaagctttcggccttcactcacatcctgcagctgctactgatttactgaagtgatcggtgacgatggaatgctcatgcatgctacattgctaacgacgcttcgatcgagttaattctttatgtttgcacgtacgtatacgcttggacgaagtttgttatgttcaccgcctcaccggttcacgtggttgatcggttcgtgattacgtacagaccgaaaggagggagaggagtcacgttaatttttttagggtaaagagagagctttattaatgct

SEQ ID NO: 63687 - DNA, 710 bp, Oryza sativa
attcctgcagcccccttttcacaggctcaacactagcagcagccgccatcgccgctaagccgccatgtcgcctcgctgctgcgtcgtttgcgtcatgccgtcttgtatcctcgtcgatcctcgcccaggcgttgccctgcagcgactcgacggcagctgttaccgtcccatccatcgtcgccacaagcaagtgtcggcggcctgcctccgcctccccaagccgacaccatcccagccacaaccgctcccaatcggtgttgcatcgtcgtcgtcctagctggcaccggccgctagccccgccatcgccgcccctagccagcactacattgttgttgtcgtccctagccagcgtcggcggccagccccaaccgtcgctccgtcgtcaccgccaacatctatccctgcccgggtgcttcgagtctccgctcacccggcgggtccccagcggggctggggaagggtggggttttccaccgtctagcaatgcggggctggggcgggggataaatgcagagagcgggggccgatcaatcacctgttgctagctcctgctcaaaatacggagtgcaccaccggcagattggccgcagcaacacgaatgccacgggaagaagtattgacgaggtaggccgaaacaagtggttaggatttcaattccaaaagaaataagtttattttccctccctccctcccaaaaagaaataaaatcg

SEQ ID NO: 63688 - DNA, 711 bp, Oryza sativa
attcctgcagccccgataccgtcgttgatgtcacccctatattatttttattttcggttgtatgagatcgactgtatatttctataaaaataaattacatcctaaatatttttaaaaataaaattgaatgaacagtatttttcaaatttaattcgctgctgctccacttccgcacggggcgcaggcacacaggctttgggaagcgatgcttgcaaagagtggcagtgtccggctgttggcaggcgggcgcggctgaatggaccgatcactcgagacttggcgcttgtcgcacataaatggctgacccgcttgcatgtactagccttgatccgggccaccacgcactcattgcatgtccgaattggtaccaaaatctacggcacacatgacaaatctacagcagacacgatctgacgtacggtccaacatcgaggtcatgcgatcgcctttttaagcgttgggactgtttgggatggagattgggagataatgccaaaatacgataatgtgagcagcgcacgtatttgaaaaattcaaatacattttttgctggcaaatgccttataaaagaaaataaagatttaatcgtacgcgaaacatcaacatcgataataaaattaatatttgtaactattatatatatatatatatattttccaatgtgatagcatcttaagatttcaggtatgatgaatacaatacacacacatt

SEQ ID NO: 63689 - DNA, 705 bp, Oryza sativa
attatatctcttatgattatacacccccgttgctgtagaagcggggtttaaaaattcccattatctaaaaaaatctcttatgattataatatggtactcctatattttgctggttatctgaatcttttgttttcaaacaaagcagagtatcatttaataaaaaggacttcagtattttatgattaacaatatggttcattttactggtgatctgagctttttggtttcaaaacattgcagagtatggcatgggcagtcaaatctcaactgagggtgatgtctatagttatggcattattcttctggaaatgctaacaggaagacaccctaccaatgaaatatttactgatggcttcacactccgcatgtatgtcaatgcatcactttcacagatcaaagacatacttgaccccaggcttattcctgaaatgacagaacaaccttctaatcataccctgcaattgcatgaacacaagacaggtataatggatatctgtgctctacaactccttaaacttggcctggaatgctctgaagagtcgccaaaagatcggccattgatacatgatgtatatagtgaggtaatgtcaataaaggaagcatttttcgccacgagcatttgacgttaggtaataaaatggtgtcaatagaagtggaacactgaggaatgaagcatgaacgttaggtaataagggctgcaggaat

SEQ ID NO: 63690 - DNA, 4293 bp, Oryza sativa
ctcgccttgcctccccgctaagctacaccgaaggggggtgtaatctcgagttgtatgaaaacttttttttcccaaaatcttaatgaaatcgaccgtcgcgcttcctgctaaaaaaaagaaaaaagaaaaaaaaacaccaccaccagtccaccacctgatctgcttccgaccaaaaaaatcctcacctgctcgcggcgggacaccacctcgtcgctcccctccgcctcgcggccctcgtagtcgccgcccaccagctcctcatccccctcctcctcctcctccccatcgctatctcccccgcccccgccgccgctcccatcatcgtcctcacccatgtcatcactgtagtcgtaatagtcctcgtcatccaacatctcttcgtcgctggacatgggcatctcggcgtcggagtccatcaccccgaccaccgaatcgggcgatcggggaggggaggggggcggcggggctagggttccggcgaggtccgcggccggtggacgggagaattggggaaggaaagagtcggagttgcgtgggcgagtcggcaggcacacaggatggggtgttttttatataccagtgtggtacacttttgggaactgtgaagcaataagaggaggggattcagtaattttgggatgtaataatcaagattaggaggttggaagatgcaatttgcacttctcagttctcactagtatcagcgccctgtgtggaagattagcccatagctaattttaagagctaatgtttagtcatgaattgatatgctaaacattagcctagggtggtatgtttggatccctagactaattcaaggctaaaaggtggagagagagtagaaagggaggagagagaaggagagagaaagctgctttttaatggtccccacacaaaattagccccattagcggctaatgttttgaggggggctaattcacattagctcaaaattagcccacctgtttggatccttgagggctaatttaaggctaaaaggtgagggctaaacattagcaaatggaaccaaatagggcccaggctagcaaagttgtgttctttcagttttggtgtgacttttggcatgcctttagggcccgtttagttccccaaaattttttcccaaaaacatcacatcgaatctttggacacatgcatgaagcattaaatatagataaatagaaaaactaattgcacagttatggaggaaatcacgagacgaatcttttaagcctaattagtccgtgattagccataagtgctacagtaacccacatgtgctaataacggcttaattagtctcaaaagattcgtctcgcggtttctagacgagttctgaaattagttttttcattcgtgtccgaaaaccccttccgacatccggtcaaacgttcgatgtgacacccaaaaattttcttttccccaactaaacacacccttagtctaagttatgaggttttgttcaacagaattgcttgagaacttccataagtttttatcctcaaatttgctgatttctagccatcggacttcctcaagatttttgcatgtttcaaatatgtcatgcgtaagatctcggttctaaccaaccaaaacatggttaaatccaagttttatataagttatatcatagttaaagtatagttacaatacagttacactttaattatactatagttacatttgaaagtttttcactcagaaaacttaaaaaaaaaacttatggtaattttttagataccccttattcgatatctaaaatttgtataccaaagacttttctattggtagtaaatctaaaactaaaatttgatgatagaacaaaacaatcacaagagtatgagagtaacaatcgagcaaatacaaacttttgtaatctaaaattgtacatagatagaattaagcaaaaccaaaattgagaaaattcgtcgaaagaaatacctcgatattttgtagtgcagacatgtagatctagttgttcgcaccatgtgccaaccatggcaagggatctgacgcctcggtcgacccatgttcccctccccctccatctccctcaccccatcttcggatatccaaattctcaccccctcatcttcgatgatttctaggaaactaggccgtggttacgtccatataaggtttcaagtttgcgacacgggtgtggacggggatcgagaggatgggctaggtgtcaaaggaggtaggggcgactatgaaagtagtgttatcgtagccataacatcaaaggatgacaatgggcgccatggatgggatgaaacgaaagtggtggtaaatggtggtcgctggagataggaaagaaaacatagcggggatattagctggttttggagaagtcggcgacgagggggttaacaaagtggaggattggatggggtggggtggtggggaagggagatggtggacagagaggaggggatgcgatggatgttagagataaggtttgtcctatgcacaagttttgactaattcaataataaaatgtgtcggcgtatatgtatgtaattccttttttatttctcttgaaatgattttattttgtttttcaagacccatctattgtgattactttaacacaattttataaacaatatattgattgaccactatttacaaatgaaaaaaatgcaacggaaccaaaactttggaacacataatttaattggctttatcatttatcatagtttggaatagtagcatttatggtaggttggagttaatagcatttattatggtagttgaaaaagtagcccttacatgaagaatgaggtcatcaaacttagaaacaactttcttgctacctaaacctgataactcaccttacatgttactcaatataagcagtttgtttgtaactgagtaatttaaagtgaccttttagaattgagaaatttatactagcagtatacttgtggattttctatgtagtatacaacaaagaggggtgatttgggatgttaataatcacaattaaaaggtttctcccttctaaaaagttgtatttattctattttggtattgatatacatatatatctataatatatagattttggcatgatttaaatctaagtcacgagcttttgttcaacatccaaagtcaccttctatttcagtgctgatatacatatatctatggctttttttttatcaatttagtctaagttatggcattctgatcgactccaaaaatcatatatcaagatgtcttattctctagcagtgaatctaaaactaaaattgaaaaggggttcttgtagaaaaaaaaaaagctgacgtgagagcatagactgacaatcgagccgacatgagctttgtaatctaaaattgtacatagatagaatgaaaagatagaaaatgagaaaacacatggaaagagtatgttgcaaatatgtagacccctagagtcaacctaggtaagggatccgatacctcgttgaccctatctcaaatcaccaaattcgccttcatatccgatgaaatcttggaacctaagtggcggcacatccagataaagttttgagtttgggagtgcgggtgtggaggggaattgggaggagggcccgggtatcaaaggtggtagggacaactatgtaagtagcctcagtgtagctgtaagataagggtggacagttgtaacacctgaaaattcgaccgataaaaaatctaaactctaaaaatatgggccttcaaaaactttttaaataaattgcatcatgccaattttattcgacgattttattggattttgatttcggaattcatcgatcacaaataggggaaaattaattaggaattaaccctgaaattagatttggttaaagaaataaataaattataatttaaaataaagattatgtaaggataggaataaataaaatatcatcacggccatatttgtattaattagatttaaatgcaatggaacaagaattaaccctaattaaaaattcaaataaattataccaataaaatatgagtaatattaatctagggtgaattcattagttgagataacacaaatattgagtaaacttcatttatgcaagatttagaaattatagaatcaaatttatatgggaaataaactaaaatgggataaataggaaaaagacactattcattgcactctaggtgttcgacgaggttccctagccccttcccctcccctgccatgcgcgcctcgcgccccgagccgtcgccatcgccgcctgccgccgtgccgctgtcacctgccacgccgcgcgccgttcggccgtcgccgtcgcgcctcgcg

SEQ ID NO: 63691 - DNA, 4221 bp, Oryza sativa
accgctgccgccccgtcaccgcccgtcccgtcgccgcgcgcgttccatcgccgcctcgagcccgcgccgctgtcgccgtcgccgtcccatcaccgcgcgccgagcctcgcgcgccgccccgagccccgcgccgccgtcgcatcaggccgccgcccctccctctccttctccccctcttccctataaatactcccccctccatttcccccactccattttcctcttcctcccctctctccctccaccgcgtcgccgtcctcgtgccgccgcgccgccgccctcggtgccgccgcgccgcaccgtgtgccgcgccgggtgtcgctgtcgccttgcgccgccgtcgtcgccaccgccgcgctgccgccgtcgtcgccgccgttgagccttcttccccccccctcgcgtccaccaccgccgtcgctcgggtggacaagagccgagagagagaggaaaggagaggccggtagggaggaagaagaaaagaggagagaggaagagaaggaaaagaaagaaaggagccgggaggagagaaaagagagaaaaagagagaaaaagaaaagaaaagagagaaaagaggagagaaaaagaaaagaaaaaaaaaatagaaattagaggaagattagggaagtttagaaaattgaaaataattagaatttaattatggattaattatagtcgtagaattgcaaaatttaatataaattatggattattcttggcaatttctataagaaatcaattcgcggtaataatttagatgtagttaattactaaacaaatagatgaattcttatagattattatagattatttttgggtaatcctttaagtaatcggttcacggtagaaattcggatttaattactagggattttacccgtgtattatatttaatcatttagtcatagactaaattaattcgtataatatttctaggatttcgtccgatatttagctcgcgatagaaatttctaacctattatatggatataatgctcgggtagattaaattaaaaacttatgacaacaaaatatttatacccgcaaaatagtttgaatcgaaattgggtttgccttagttcgcgaatagtaaagttaatataaagaaatcgactttcgcattcgactttcatttggatttatttggatttttatttgaattctaaccgaattcaaatcaattttcgcacgtaactatagaacccgagggagttgcggatccaagtgaaggctaagacctgcaagactttgagcaggcaagtcatcactattctttgaacatgttgatcccaattgcgaaattattttgtttacaaataaaatcgcatgcaatgatgaacatcctacttgtgagtatgccatgccttgattattgtttacccttaaatccttgtaactatgatttacgaataagtccctagtcaactatgacaaatgcttagaaatgctactctagatttatgcatactcatatttatcaaatgctatatgcttgggcaattacctttgggaaggtaattgagatgcggtatgtggagatatgagcgccacattgccataatgttgatgacatgatttgtgaaaggagaaataaaactaaacaactgttttcgactggggcggacggaggatttgggtggtatccggaaaatgctagtaccgtccccagtcaattaaggaccgagccatgaagttaagcatgaaacgacccccgtacaaccgcacttctcgtatgggtatagacctagcggagtagatagctgagcagaggcagtatccatgcgtagtggtcttcttttaggtgtgtgatgcggcaagcagtctgctggcggatgcccggttcggatggccaggtggatggcagatgcccattccggatggtcagaggttggcttggcaatactacgtgaggatacccataagagaacaatcatgatggactgggttcaacgacaagaaacaacgtaggaatgtgtgtgtttttcccttcccgggagcgccagaactcttctcactgctagaaacgtatgacgcctagagtgcatgagggctaaagttcatggagcgggtactgccaatgcgaggttatcgaaaagctttgccgtgacgcgtctcatgtgttgggacgaggctcatatgttgggcagtcgcggagtgcgggtaaagtgtacatccactgcagtgtgagtaaaccaaatctattcgaataaccgtgctcgcggttattgagcaccgggacatgtattacacttggctagactctaaattcttaacctgtgtgggatgggatattgcatgatgatttctacactgatggagccacttcctgagaggcgggaatgtgggcgtcctcagaaaaccatgacgactcaatggcgggaagctatccttgggatcacaatggatggtggatagaaccgtcattgtttaatatgaacactggtactaaaatttgatcagtctgtgctaggtcttaggcttgtgaaaagaattacaaaacttgctttgcgcaaaagaaccatagccatcctttgaatacccctgtcatatgcattgttgctgtggtggtttgctgagtacggttggtactcacccttgcaatatacaaacttaatcagaggtcggagatgaagcttcggaggatccctacgcttactatcaggagggtgatgaagacgatggcgctcagtaggtcttagttacggtcgttgcctgtggcaatggcgtgccgctgccttgactccgctgccttacctacttctgtttttggaatgtattccggaccgctcagttcgatgatttaagactatgcctgtgggcttatgatgtaataattcgtactagacactcgtgtatgtgcacttggtatttcagctatgaattcgtgtgtaccagactacttgatccagggaaatggtactgtttacacggttgattcctgttataaaaacgggggtccactacagtgggcagtggtaggtggggtgaaaaggaagtagcggctaggagcatcaggtggtgctggagtatgtatctgatggcgatcgttggacatgggaaggaaagcaccacatatgtgaagtcagtagaaaaggttagggaggccgtggattcaataggggcaaggtggaggtagggagattgcggcaaaaagaggggggaggggtgggatgaatggatgttagagaggaagggaggcttagggttcgttctatgcacaagtttcgactaatttggagaagaaaatgtgtcggcgtgtatatatatagtttctttcttttcttgaaatggttttattttgttgttctagacccctctattgtgattagtttagtgaagttttattaacaaatagtggcggatttaggccatttctgtggggtcggctgaccccacaactttttgaaaaacatcctataaaccttgattttcatgtataaatccaaaagaatttagagaaatgttcccacttaaatacaaaccactagtaattgaccccacagatttaaattcctctccgccactaataacaatgtattagttgaccgctattcagaaaagaaaatttatggtgaaaccaaaactttggaagatatgctttatttggttttagcatttatggtagtttggaatagtagcatttacatttagagtgaggtcatcaaactcggaaacaactttcttgggacctaaactcataacataccactgccctacgtgttactcgagataagcggcttgtttggtaagcagttggctgagacatgaaaatttaaattttgtacaatcatatggaacaatataattttgtgaaaaaggaaaggtgaaacaatgcagagtttagaacaaggccttagcataaatactgaagatttgtgctccatcgttatttctttttctatagtacggtcaagacatgcatgttctttttggaccaaagtattgattttatactgagataccatgttctatattcgttggatgttcttctcttttcttcgaaagcctgatgctgagttgcctccacgtgcaaagtgttcttccaagagaagttttaagtgctaatttcagccccaatttcactcatgacacacgtacgatggaatcatcatggaactggaattgttgcgtaggtcctcgcaatcctttgttgtaaatttatccgtcattgcaagtttgaacatactgcataacgacatgtggccaaactttttattaatc

SEQ ID NO: 63692 - DNA, 15469 bp, Oryza sativa
ctgttttcagtgaagtacagatggtgatgttacagtgtacattaccaaaccatgagaaacagctagaagtatcttctttactccaccaaaaaaagggaaaccaaatatccttttttttgttttcctttggagacagaaactgcatctttatgtctgggaagttacaaatgatcgagacggttatcaatgcaaaaatttaagcataacccactatgatttttatacttgtggcaggacaccaaaaattgctccaccgaacaggtgacaatgaagatgatcctaaattaagtcctggtagcattttaaatttgagctcttgaatccaacaaaaatattaattgagattagagaatcagatttcaggcattgttacacctagtgatttttatttttattaattttttttttgtaaactagacctccaaaataagtccacgcaaaaaaaaaaaaaaactgagagctatgtgttattgaaagttccaaatttccatggttaacataaatttttagaaggtgcaacaacagaaataccttcttaaatagatcactgctggtaagccaactttaattctgatcataatatctattgcaccccacattcctcaaggagaccccactgcagcttctgttagcagaagataccgacagctagaagcttagttcttgtgaagatactgatgtgtgagttccccgctagtgatggccccgagaggaaacaagacgagttgtgaaaccaaggctctctagcttctccatggttacagtcgacctccttaacgaattgctaatgataaccatcttcgcccctttcccactgcaacaaccaaaatataacttaaccagtgcatcgcatcagagaaggggaaaaaaaagtaaactgaacactagtgcaacaaccaaatataacttaatcagtgcattgagtcagatgtagaacaaaataagagaaatggatatataagttagagaatataattatatacagtgtgtaccaagatacatacatgcaaggatggcaccaggtaaggcatattcccatggtgaagaacaccaatctggtcgaggaaccacgcctgcaagccagacaaatgcagctttaatcaaacgagcagaagaagtgctagtggtaaatgctagtactacgcgctgggtgggaaatcaactttccccgtaaattttctagccgaaatttcccccaaataattccatatccacccctgaatcgaccgcgtgattcgcagttaccataactaggaaacgcacgagtaatcaatggttaggggaataatcacaagcacaagcgcaactgaatgagcaaaacgagtagtaattccgcgcaggtcggcggttgctaacttgatggataggtgagggggaaaagagagggcataccttgaagcgggcggagtcggcgagtgctcggatccccgtcagcctctcgaacaccggcgccatccaccccgccgcctcctccgccgcctgaagccctgaacaccgcggcggaggagggaagcaaggacagagcggggcgagtccgcgagaggtgagattcgttggtgacttgtgaggggcaaggcagtgaagggacgggacaaaaaactccaaactagaccagcgaatgcatcagaaagttgagaacagcagcaatggcctaatgtttgacaaatttaagtcacttctggatgaaatatttggcaaatgacgaatcagtgaatcatgccgcgtactttctgtcgttgactcagtttaacatgcggtgccaagccgaaatactctccaccctcttggaagcgtcttaccaaaaatggacagtcacgtatcatcagggatttcagggccgggagacgtcgaacgagaccctcagggaacttctctatcggtaaacagttaaaaatctccaattcctcaagagctgtgaagccattcatcccatcgggcagcatctccagcatatccatgcaatacgtagtaagcgatctgagtctgggcagatttcccaggtgcgaaggcagtgccactaaacttcggcaatgtgaaacttccaaattcacaagtgacgtcggcatcttgggtatgtccagtaaattgtcacaatgcgatacttcaaacctctctagttggggcagcggaagggcttcatccgatgatctgcacttcccctccaacttgccacatgcacgaaaagacagatgtcgaaggcaaatcaagcaacggagctcctccattggccactgcacaagatcatcacaaccatggacagtcaaatccttcacaaaagcaaagcactcccagagcccaagatgcacttttgacaaactgcacgttgcgagaacgaagactgccatcatttgcttgtgtcctgtgattatacggcggcggtttggcgcaagctgagacgttggtacaacattaacattgcaatccctgcggaagatggcatgccgcttgcagattggtggatcgcgacaagacggcgttttcagaacacgtataggacggatttcgatagtctgttcatgctaatttgttggcttatctggaaagagcgaaatacaaggatctttcaacacatcgccaagtcggttgaccggctagcggatgacatcaacgaggaaatcgcaatttggagggcagcagggattttttcccatgctagcgagtaatcccgattagaggcgggacttgccccattttttctttttctttccgggcttgagtttgcctgagaccggcgcgacatccttcatgtcgttgtaattaaaactttatttcccccaatcttaatgaaattggccggcctacctttggccgtcccggcaaaaaacaaactgcacgttgctaagaagcagttagaaccacgcagagtcaagctccgtagggcttcgaagggtctacggcttttcttgtcttccagaggcaccatcatgttcgctggtgagctaacatctaagctcacgggagaagcccaacaagggtccaaaggcatcctcatagagtcaatatcacctgctttgtaataaaggtcagacaatgatgtgagatgtgaaagtgagaaaattgagaggctgtgacaccccagagcctccagccttttgagagccgggctttccggaacacttgaaattttcatgcaactcttcaattctaggctttcaagctccgggaaaatgatcacatcattattctccccctcactgttttctgcccacctctccaagttcggtaaaacaaataatatcaactccttcaactttggaaataactgcactggggtgttcccatcaatgttcttacataatgagatcaaactagtcatataagacaaggacaaatactcaagagaggctgatagccacactgttggaatgtccttacatcttggacatcgttcaataatgagcctttttaagcaccggaacatttgagggtctctcatccacactgaggctttacttccaccataaccatataaatccaaaattttaagcttgctgtgaggtttaagagattccaacatttcttcctcattattgtctttgtctccaggcatgtaggatgacatgcagccccaaaataatcgtaatatactcagctcttgtttctgatggagattggcttctttcgcgttcgatgtactctttatttttctcaaattgtacagccccaacatattggtaaggtatctcaactgtttgagctcctcaattcccctgccagcatcggtgtccacgacaaacgttgttagtgtcaatagattgttcagtagactaaaatttgggggcatccgttttaatctatcgcatcccaacagataaaggtggttgagtttccttagatttgccatgccttcaggtaaacattctagatagctgcagccattgagcctcagtgattgtaagttatacaatgcacatattgaatctggcagtctatgtatattagacctagaaaggtcaagatatcataattgttttgtatttatgagatggctagtgataatagaagaatcgtacctacagtgacaccacagtcctctcaacgacctcagttttaacctttctaagaaaaatgacctcagttccaacacttcaagacccctgtataatggtaattccatcaacaaagtgcggagagatgttgtacctttgaatgatccactgatttgttttaattcaccttctgatatttgcacatgccaaacatcttcagatggtgctttctgttgaatcagttcttctgtagttgcacattcacttgaaacgtcttttgctaagtcatgcattaaatcatgcattttacatacaacaaagtcataatctaagcttctgaataatattgttttaacatcttgaagaaatgatctccaaaccaactcattgaaaacaaactcgcctttttgtgacaactcaattgtgccctcttcttgaataaaaccatttgctatccatagttggatcaacatgtccttctccatctcatagtccttgcagaaaattgcacagaaggtgaagcattgtttcatttcagatggcaagtgtttgtagctcaattttagtattgataagatttcgtcttttcctttgacactatcaccaatattacttcttgcgatggcttcccattccttgacttggtgtttggaactcattagaccgcccatcgtcttcagagcaagtggcagccccttgcatttatgtacaatacatttgccaatggtgaccaaatcttcttgctcttgtacgtctctaccaaacgctctcttcgagaacaattcccatgattcatcttcacttagacatgctggcttatagggttgaagggtttccattatagatgccacccgccgattgcgagttgtgatgactataatgctccctggacccccgacagaattcagaagtggccttaggtgttcattccacttgttgtcgtcctcattccatacatcatcaagaacaagtagaaaccttttcctgtcaatgactccttcaagtcgccttcgcaacaactcaattgagtcaggtaggtcacattttctatttgtagccaactcaatgatggatttcacaatagaaataggttcaaagttctccgaaacacagtgccacatcttcagttggaaatgtttctggacaatcggatcgttgtacaccatcttcgcaagcgttgtcttgcccaaaccgcccatccccacgatggggagaacctgcaaattctgttgatcatgctgatccagcatcagtttaaccaacacctccttgtcatgctctcgcccaaatatgtctgctgactcgtccagccccgagtgtgttagccgataaggaagctgtggcgcctctgtgtgctccatcaggccaaacttgttcatctcttcaaccagatcgttgatcttcttgaggacatcgcccagcttcctactcatggtaacacggaacaggagtgggctatgcggcgtgaagtagccgagtaccttgcgggtggtggagtcgccgatcttgacctcgcggcgcagagcctcgtactcgaagtcgtcgaggacgtcgtcggcctcgtaggcgacagccttgaggtccttcatccagcgcttgacggcggggttggtctcgcttagggttgtaagtggctaacccgtgaaacccacttataggctaaaataagccgcgagcccgcttattttgacctataagtaggttcgcggctgacccacttacacccttagtctcgctcttcgccttggcatcggccagcttgcactggacggccagaagctggcgctccagcttgcggcggtcgccgtcgacgccgcacacgcgcgtgacgctctggacgagcgcgttcgccgccttgccagccaccccgcgcaccaccgggaagcgattccgccatgttgcgttctcagctgcaaagcacggtggaatgaatgaagatgaaaggcaaagcatgaagcgctctgggcactctggtccgtaattcaagtgggcatgtttggcccgtatgagtataatatggagaaaatttacaacttgacttacttttgcgtccttctcaaaaaaaaaaaagactaacttttgcgtagtgcattcatgtcgtggaatccaccagtttggttggcagtttcgttgaaatctcctcggccctcgccgtcttttcttatcagcaaaaacatactttgctgaaacaaactggcacggcagtcggcaaatcctgggcttcgaatatgatcctgttgagacgaatgcatcagaattcagaatagcaaaggccaaattttgacaaagtctggatgaaatatttgctaaacatacttccaacgaacaaatcccaaacaaacatgacgaattctcccaaaaaaaaacagagcacgaaaccaaccatttccatgggaatacccaataacgagaacctttacatctcaaaccacttgggtcagatataatcagcaacaagtttcagtaaggcggaaacattttcatcacaatatgccgtagtaccttccaactcaagttacttggtcagagaggttctcaaaagctagattcagtagaatcacttcatcaaaactaagaacgagaaggcgggtaggaaaacagattctgctatttcataatctgagcatgaacactctattaagctttcagaaataaaggtacaatcggctaggctattacaaaactgacaaggtataacggatccatcccttgcacatgaattacgactgggcataggttctgcactaattcaacttctcaattaattcattgattttatcttcgcggttccctgagtcaccaccatccttgaagggtttcttcttcatctgcaacctcctctctggacacttgagcttgaagggcatgaggaaatttgaagcttctctgaagtgtgggccaactgatgcgatttcatgcacaagatcttccaaacatatgatgccatattctcccagagcctgttttcagaaaaaaagcacagatgggtatatttcagtgtacattaccaaaccatgagattgtcttcaacatcgaaaactgaaaccaaatatccttttgttttatttagagactgatgaaaatgtatcttatgtctgggaaattatacataaccgagatgataatcaacacacaaaaaaaagcataaccacagtgatttttacacttgtggaaggagacagaaatagctctaccaaagcagtgcatgcaacaatggaattgatcctaaatgaagtattgtagcatgccaaatttgaggtccagaacccaacaaaactattagccgagattaaagaatcaggtttcagacagcgctacacctagtggttttatataaactatatctccaaaataagccagcccaattcccatgctcattgcaaaatagcctgttgtagacaaatttactaatgccgtgcaacctcaagttttataaggtgtaacaaaacaataccttctcaatgagatcattgctggtaagagggaaaggttccttgtccaggaacccacggcccttcttgtaaataagatccttcacattcttcaaatttgggaacctatattacacaacaataaataaaatttcagcactgcaagctacagatggacaaatcaatatgtttttgtacaaaagaactgttaatagagaagcatgtttgagttcagttacccataagtgataaacggctccacaacaagaagcctcttcatagtagcgtcagtggccttgaggaacacgccggtgaggacctgcgtcagccgcagcttgcgcaaaatcctcctcatgtgtggatgcaagtccattgtgctgcagattacacacaaacaaaattgttaaaattgtgaaccgcaatcatcaccaatgaaaagagacaaaccttgcagaaacaaaaacaagaactcctcatcacttgtactgctgctaaaatacagtaataatactgacccagggatgcgaatcgcgaagacgagcttggagttgagggtctcggcgggggggagcttgcggaccttgaggcgggtcttcatccggacgaagtcgagctccttgttgcggaactccctgacgaagtcctcgggcctcttgatggcgcccttgccgtcgtcgcggcggcgctgcctcttggccgccttccgctcccggttcttgaccgcccagtcctcgttcaccttccgcttcttcagcaccgtctcccgcacgtacggcagctgctgcgtcccctcctccgccatcatcgtcgccgctatctctacgcaagcttcgccctggacgacggcggcggcggcggaacgacgcgagggagaagggtttcggggatcggcggtgtctgggtctcaccgtcttattatggccttttcatctcttactgggccgggctcacgaaagtttaggcccattaatgatgtgtggcccagttgtagtgggcctgttgggctttttcttgctggttggtgtggcccagttgtagtgccggtcaggttgggtcggcggcgatgacacgtacaagaacagtcgtcgtgactcaagacgacgactcactcaaaggcagcggcggcgagccacgcctccgccgctctctcctgctcttcagtcggcgggcgatcgccggcggctcttccggcgaactcgcgagtcgcccccccccacctcccctctagcctgtactaaggaaggtatgtcatgtgaggggtggtctatggtcgccgccgcgccatggccacgagcttttcgtgttgattctagaaggtgcgcttattttctgagtggaatggcgaataagtgcactcggtgatgtcctgtgatttagttgtgcttggaattttgggtgtactgaatactgatgcttatgttcttcttgctgtgtcattcaggcttgtaataatttattggattttgataatttattcgtgcaatatggttcgcggttctgttgatgtggcaatcaaggagatggaggctttatgtatcggacaaaatcaagaaaccaaagtaggtgtgctgcactagtttcatctttggcgtgaattaaattgttttgtgcactaagcaatactgctgaccatgctttgcactaccatgttccataggtgataccgtgataatagatgtgtaacttttgaaaattgggtgccagacaatgatgcgaatgccgtttagaattaacctgttattcagtgtttgcagtgttctcatttattgatattgttagtttggttatgttcatagtttaccttaatatatccttgtaagttgttaccaatggcctgtttgctaatcttttttgttagagatcagaggtaccatttccataccaggagtttgaaagctatatgtatgatttcaatactccacctaatagtaaatgacatttggtttctaggatagctgaacctctcatggcttccatcttttcattggtccttggctcattgcctttctataaatttactttctattaagttaacattattattacttctttggctgcaggaggaagtcggttttgaaacacaggaggcctcattaaaagcaagcaaagttgcagatagcaaaggagctccgtactcaccaccagaaaatgatgatgatgcagaagtggactatccgtctcaagatggagcacaaggtgacaactctgacttgcaagctcttattgctgagttcctcagctagagttgaagcttttgcaattctctttagcacttgctattaaataatctcattccaagttaaaataatctcattgcaaggaacagtaatagctgccaagaagaaaaagaagaaaagcaaagcgaagtaagtttatgttaaattaagccattactgttccttttctttttagaaccatgctttaatttatttattctgtagaaagaagaagggacctcttcagcagacagatcctccatcgatccctgttgatgaactcttcccatcaggagaatttcctgagggtgagatccaacactataaggatgagtaagtatgcatttatcctcataaaatttgtttttttttacgcaatcctcataaaatttgtatataatagcaaacctggcacactaatttcttagccattttcacctctaaaaattcctaatggcaaattcaatggactgtaataacagtgagcatatgtttgcataaattaattgtgctattgctcatcagtaacttatggaggacaactagtgaagaaaagcgggaactggaaagattgcaaaagccaatgtacaatgctgttcgtcgggcagcagaagttcatagacaggtttaaaatttattgatatctttgaatatttgcgaattcatttgaatatgctctatatgttacaactctgaaacatatgttgtggtttgctaggtccggaagtatatgagaagcattttgaagcccgggatgctaatgattgatctatgtgaaactttggaaaacatggtcaggaaacttatcaaggagaatggattggaagctggtattgcctttccaacaggatgctccttgaattggtacggtattccagtattttacatttagtacttcgtaagttccttactctgcattcccttatgaaactaacgaaaacaaaaatgcaatgcttagtgttgcagctcactggactccaaatggtggtgataaaactgtactacaatatgatgatgtgatgaagctggattttgggacacatataaatggtatgtatattgtttgttatacgcgtcagagttttttgtggctttgtccttgaaagtataaagtcacaccttttctactgccaaaaataatttggtatttcgattcttctcagggtacatagttgatagcgcattcactgttgcattcaatcccatgtttgatccattgcttcaagcatcaagagatgccacaaatgctggtgttaaggtaattctctacacttttctgtgcattttctgaagccctcaatatagcaaatcaatgggcttggaaatggccccttaagaaaacacctttgtcatgtcacttgttaagggcttgttttaacggaatccattcatagttgttcattaaactgttagtcaaattgttgtgtagcatttatacagtttttttggctagttattgcatggtgttcttcactactgatttgatggatgtataatgaatctattgttttattttctctaaattgtaatagaatctaccattgtacttcagtagtgttttggttgttcccttcattttaggaagctggaatagatgcacggctatgtgatgttggcgcagcaattcaagaagtcatggaatcatatgaggttgaaattaatggaaaagtattccaaggttagtgctagtgcatctttttcccatttcacactggtaacgtaaagtgataagttgacaacgcaaattaaattattgctatgcggcagtaaaaagtgtgcggaacctcaatggacacggcattgggccataccaaatccattttgggaaatcagttccagttgtgaaaggtggtgaacaaacaaagatggaggagggggaattttatgccattgaaacttttggatctacaggtatgtcaatctatagcttaggttgtcacattactaatagttgaaattcagttttgcatcaaatataacaagtaactactaatatgaccctccttggctaaagtgtagaagttttcaagtgttgaaattatctttttttaaataatgtatatcaatccggcctctatatgttgaagttcttgaagaattttatgcttactgtctgtcataatgtttgcaggaaagggatatgtcagggaagacttagaatgcagccattatatgaagaactttgatgttggccatgtacctttgagggcagcaaaagctaagcaactacttgtgacgataaacaacaatttcggaacacttgccttctgccggaggtatctggaccggcttggtgagaccaagtacctcatggcactgaaaaatctgtgcgatgctggcattgttgaggtatgtatagaagtccattctctactccaatattgttgtaggccttgccataaccatattcgtggttgctcatagttgtatgctttaattgttggcagccatgtcctccaatgtgtgatgtgaggggaagctatgtgtcacaatctgaacacaccattttgctccggccaacctgcaaggaagtcatatccagaggtgatgattattgattgcaatggctgtccctcttgtactggttttgtgagatcattgctcgccattttttattttgggaaacctgtatacactgttgtatgtatcatatgatatcactatcataagataaataatgtgcagtaagcaccgtttgttgctgctgctgcttaccacttggcagttggtactctttaaataatttttagtggaagcttgatactatttcgaagcatagtcttcattttgctggaaatgtgccaatctgttgtattttggtttattggtatgtaggattaccatctaattctgatatgttggcaaaaagtaatagagtttccagagaaaaatgcaatagcaaatttacaatagaagagaagaagcttgaaagaggaggcccatattaaagcccatgaacgaaagcttagcccatctaattggagcccttctatgcctaggcccacctgcagcgagtgatgggggcatctcctgaaaactcgcgcgcatttaactaagggttaccagctcaatataaagtgtgtcttccctccccgccgccgccgcctcgtcgtcgccgctgccgccgccgccgcggccgcgcgagaggaacatccgttggctctagggactcgcgtggaagatggtaactattccttctgatccttccccttctccctagcgtagccggtttctaccgccaaagtgcgggtaggtgttactcatgccagatcggtctcaagatccgggatggtgtgaaggagagctgcgtttgatcttgctttgtgcggcatgtagcttggatattacgctgctgaggagatgccgctttgtctgtggcactctgttccgttatggtgacaggaatgtgggaggagattttgagttggctgttgcttcagtttatgatgttccgtaactttcctgtaaatctgtaattggttgatatgtgccacttgttattctattgctaggttcaatttgaggaacgagtgcttggtagtttttgcttgcagtggttgcccatcgctaccgtgttccgttttctattactccctccgtttcataatgtaagactttctagcactgcctgcatttatatagatgttaatgaatctagacatatattttagattcattaacatctatatgaatatgggcagtgctagaaagtcttacaatttaaaacggaggaagtaataattttatcaggctctgaagtttagttcatcccagattactgtaatatagcaattgttaagtggtatattgactggaaatgaattccaggttgtgtaatctacacccgtttacctagtttgtaggtaggatttctgtatgctcaccaggactagttatgttttcccaatatccctgtcatggaacatttattttcttcatgctactgcttgcgtggtttccttgatgtgcatgtaaatttcaaatgtgatatgatgctagaatggagccgattaatttgttatctactgtcatcctgtgtctaaactctaaactaaacaattattatgattccgtagccaaagcagattcgtgaggtcaaggacttctttctcactgtgagaagaaggatgctcgttcagtgaacatcaagaggagcaaagatgttttcaagttcaaggtcggctgctccaagtacatgtacaccctctgcaccttcgagctgagaaggcaaacaggttgaagcaatttatcccaccaggtttgtaaaaagtggctctagttctgtttagcactatctcatttctgtttgggtatctgagtagtttgtgctggtataaatcttgcttacaattttgttcttcttattgatgggcattctttctctgcaacatgatgctttgttccaatatgtttgttgtttataatgctggtattgcttatatctgttggttgatgtcccagtgacgataaaattttgctccaaagatgattattctctggttttagcttcaagccctctgtcataccattttgacacggatggcttgtggctaaaaccattatcaagaatcatcaatgatggccaataatagctatgagatctgagggacaaccctacagtacaacatattctggtatctcaattctttgttatccttggttcctattgaactggatgtgttattggagatgtcaacacattctggtatctcagttctttgttatccttggtttctcttgaactggatgtgttattggagctgtccccaaggaagataaaaactttgtaccaaatatggatttgcaattagttttagcttcaagccatccttcctaattcatatgatgtgtgtggcttttggttaaaactaggttacgcttttaagttcatcagtgattggcaatagctatgagatccgagggatatgggttatggttttttcagacaaaaaaaaaactattagcagatcaagaaactatttgagctgtcaattctgttttttttttaaaaatagagatgtttttaatgatgtagagattttctttatataaatttctgcatctgataattttgttttcattgatccatgtctgagcgtccaagaggtataaagatacaaaggcaacatcttaatgaagtatccaaggtctttggtgctgagaatgcaaacaagttgaagcaatttctcccaccaggttcacagaaagtgtctggtaagttgatgccctagcgaagataaagttttggtccaaagatgtttggtgtctggttttagcttcaagccttctgtctgaccattttgacaattggatggcttgtggctaaaaccattatcaagaatcatcagtgatggtcaataatagctatgagatccgagggacaactgtacaatataaaatattatgatatttcacctttgttatttgggatgtccccatgaagataaattgtttggacctaagatggatttgcaattagttttagctttaagccatccttttaattcttatgatgcatgtggcttgtcaaaactagttcaatttttaagttcatcagtgatgggcagtagctatgagatttgagggacgtggactatggtcgtttcagacacaaaaggctgtcaccttttgttctctgtctcgttttgtatggtccttcactgttctgaccaagaagctatttgagctgtctgttttgttttgtgaatgcaagttttttttttcatgtaccaaagttttgcatttgatgactttgcattccttggtccaggtttgagcatccaggaggtctgaagacacaaaggcaacatctttagtgtccaagtttctgtct

SEQ ID NO: 63693 - DNA, 7489 bp, Oryza sativa
tctgtttttttacgatgggccggcgaatagctggccgatgtatattaagagtaaaaaagggaatgtacaaggtagcgcggtacgtcaatgcaccaccattatagacataaaaagaaagctaaaatctcacagaatgagttgttacagagtgacatatgaggttaacaagtcgtgcagctatccaagtctctcattcatccgccccaagtcctgcagctatgcaagtctcctgttcatcccccatggaaccgttgccacgatcccttcgaacacccttgtgtttcactctttccaaatcaaccaggttacaaggatcacccccgcatcaatgttttatcgtcaaccttagcaacagatttttgggctgtaagccaccaatcagcaaaatcagccgacggcgctcgcaaaatctgactctgtgatttcttttgtgatgaagttgtactttgggcatgaaaatctttcactatatcgaaatgcacaatttgtaacttcaaactgccatttttcattgtctttgaaaggttaccactttattttattttacaggaggtaaaacaatcctataaactttcagttagtaaagcagcccgatgagatcgacggcgatgttacagtgcgtcgccgtcgtcctgtcgatgtcggccaccggagagaccttcgagcggcggacgatcatgttgtcgcacatgatcccggcgtagtaaccggccagctggtgcctgaccacgtcgaggtacgcgccgccggagctgtaggcgtcgaccgccgcctgggcctcgccggcggcgaggtcgtacatccaccagcactcgagcagcgtcagctcgaggacctggccgtgattctccaggaacttgccgtacacggcggcggcgctggacttcacggtggcggcggcgatgtcgaccgcgatgccggcgagctggtgcacggtggtggccctggcgctccgccggtcggcgctgagcatcttcacgcactcggtgtggttggtgcgcttgcacgtgcgggcgacgaagcgggcgtcgccgacgacggcggaggggagggaggcggcgacggagacgaggacgacgacggcgaggaggacggtgacggcagcagctggtctcgccattgctgaacccaactcagtttgatcgatgaactccttgattaattactctagttcttgtgtttgttgattttgctatgagtgttctagctagtttgtgtatatataggctttgaaaagaatcccaaatataaaaaaactcattaattgaagcatttaatgtttttttcccttagagcaaggtcaatagtatagccaactactgactccaaaacatctatagtcaatctaatagtctattcatacaatagctaactataaaaatatactacatcattaatacctggtcccacctctcatacacacataatatcttggagtccgtgttacagccgactacaaatctgtagcccgctttcttctctcttctctttttttctcgatatatggttatagccagcttatagcctgctattgtacctgctcttatggaatccaaataggagtaatgcctttgagcatccaatttgaggaatttaatactatttggaagaatttagtgtatgtatctttaatgaatttattgccttcaccccctagaaattccaattttcttgaggacttcattgtattttcctcaggaacccaaatgtttgtgtgcatttatttttcgtggaatccaatcttttgctatgaaatttattgtggattttttttctttttgaacccaattatccaaacccaaaccgtgcagaatattaaaaaggtcatatagatagaaagatggtgatttaacattggaagtacacatcttagagggacgtgactatacaggtagtggtagctccatctatgttagaccctatccacatatatttcaaataaaattttctcttaaactactcattcgatcgacgatccgattacaccgttgtgttcgtaataattactccctccgttttttaatagatgatgccattgacttttttttacatgtttgaccattcgtcttattcaaaaaatttacgtaattataatttattttgttatgagttgttttatcactcatagtactttaagtgtgatttatatcttatatatttgcataaaatctttgaataagacaaatgataaaacatgtgagaaaaagtcaacggtgtcatctattaaaaaacggaggcagtaaatctttataacaagatctcacatgattatattttgataaaaaaatataaattacttttataatatatctaaattacttttagatttcactaaattacttcttggatatataaaagtaaattcaataaagcctaaaagtaatttacatatattatagaagtaacttataacaaaaaaataactttaatgcatgcctttttttttattttggacgtgactacacagctagtggtagccggtttgtattccttctagtgtctcatttcaacttgaaaaatgcaatagtatgtatcttttttaatctctttaataacttatatcttttaaatcacatattgtttttaagatatatttatagagagttacttctgaaccatgcaaaagttacttccatttaacattgaagttatttttaaaaattgttaaactttcatgtgttgatctgtgctgattaaatttaatttctagatagtcatatttttatccctacaacaaatttacttctaatgtcgtgacaaagttacttccgttttattttaagttactttttataatatatgtaaattacttttagactttattgaatttacttttatatgtctaagaagtaatttagtcaaacatatgataaaagtaacttacatatgtaataaaagtaatttacaaatataattttatttcatcgtaatataatcatgtaagatcttgttctgaagatttaattgcaatgaacacaattgtgtaattggattgtagatcggataagtaatttgagagaaaattctataaaaaaaaaatagacatgcattgtgtgcactagtaacaactggaccttttctcacgtaactatactagcaacactggaccttctctcacgtactatagcactggaccttttctcacgtatgaatgcatcgctcttttaacactaaatcgagagcgctgtcggtttagattttgcgatcttagagcttatactagttataagtaagattggagctagtagtaaagtataggtaagctctgatccaatattgagcccctgagctttactcctttgcaactatactcctgtgcaaacagttggtgatgattcataactgctgactgaaaatggacgttagatgtctatgatatgatctcgttcagaagcagaactgcagaagcataagggtttgttcggttcatgcatgatcctgccatgatgcatgccatggcatgctcagttcgttgagacacattcagaatatggatggatcaaattgtcagacaactctttttatttaggagtacattttatttccatccaactagatggtttgatatggacacaaaaaatatctgaaactctgtgttgatcgttgttattaatttatctgaaaatcaatacagggatttgatgcacaaatacttgttacaaatttcacaccaagcacaatctatccaaatacaaaaatttggctcatacatagctcattgctaacatctatcatcacttgtacgtaatgggcatccatgtacatcatcggaatttttttccccaatggtttcagaaattacggcgtaggaatgaccagttgagcctcttgatgcgaacgatgcggttgagctcctcgcgaacggagacgagcagcacgtacgcctcacgtgcgccctccacctccacgtccaccacgtgctccaccgtgccggagtcggggtcgtagtagccgccgccgccgtcgaccacccgcacctcgccgccgtcgaccaccgccacctccttctccgtcgtcaccgtgagcagcagcacggccccgtcgtcgtcgacgtactccacgcaccgcaccgcctcgcggacgccgccgccgtcgtggagcgccgccggcaccgtcctctcctccatcagcgggaacacctcgccggcgatctccaggcactcgcgcgcgtcctcctcgtcgtcgtcagggacgaggcggcggcgacaatcctcgcgcgagaagaagagcggcttcccgtcgtactccacgcagtcgcgcacgacgccgccggacgtcgcgacgcgccacctcgtcagctgcggagcgtacagggacgccatggccgcgcgccgccggtgacgccggatcacaccggagaagctaagctaagctaaggatcagcaagtgcaatgcgctctgatcgatggcgacgatgagcttgcgatcgaattgcttgagctctcatcagggccagcatctgaatttatcatgagcaccaaactcagtgtggaattcggagtcggacaccgattccgagacacagtcgatccggcactgccgctcctgtgggacccacataatgtattctcctggagcccatgggcccatgaccagttcagtgccatcttgggcttcgagtttctattctccataggaataagttcatcagaggtcccttaacttatcaacgaatccaattttcgtccttgaccctcaactatcataaccggtgcagataagatccctcggcggtttcgatggtggttttggctaacgtagcgcctacgtggttattttgactcggtcttcatccgacgtggcactgatgtggcgcttaggtggcaattcagtctagaaaaataataaaacctgtgggacccacatgtcagtttcacattcaaaaatatatttaaaaagtgggacccacgtgggccccacatgtcatcctctctgtctatcttttttttttcctttttcattctttttcttcttttaagatggcatccggaggccgatgcgagcgccgcgccggcggagagggcggccgacgggaatggagcgacggccggcaggagggagggagaggagtggcggccggcgggtgggagggagaggaacggcggcgcgcgccgcgctggcggagagggcggtcgataggagcgccacgagggaggaggcgagctcgtcggggcggccggcgggagaagaggcagcacgcgccggccgacgggagggagggagaggagcgggaggtggctccggcggctgtgggcggaagaggaaggggcggcgagaggtggccctggttgcggctgccgttgggagaggagacggcgtcgatggtgaggaggacgctcgcggcgctggagacgcggtcgctaggttggtcgaagggtgagaagggagtggcgggggaggtgacgtcggggcgcactagtcacggtcggcgagcgcggcatgcacgtggcggaccggaccgagaaaggcagcggggacgacgacgagaggagatggagcgcgaatcgggacagtagacggcggcggcgtgaccccggtgtcgaggccgatcgaggtcgagtagcgtgaccccggcgtcaaggtgcgcggcgacggcggtcgcgtccccctcacctgccaactcaggatatctggtggtggtggtggccggcgacgtcacactacccggtctaggaggagcggcggcgcgggcggtcgtcatcgccggagttgcgcggaagatggggagttcttgttgttgccggacgggcggcggccggaggcccggagcagagtagcggagcaggccaactttgccgctatggatcgccgcggccacctcctcgctggccatcccactcgaacgccatcttcgtgcgcgctcgccgcgggccactgtttttctttttatctgaccgacatgtgggccccacattttgtttttattttttatttttatattttacttccagtgccacgtcaccgccacgtaggacgaggaccaagtcaaaccggtcacgtaagcgccatatcagccaaaaccaccatcagaaccactgagggacctgctttgcaccggttttgatagttgagggacctgttgtatctggttttttctggttgaaggacgaaaatcgaattaattgacaagttaagggagcttaagtgaacttattccttctccatatattgggccagatgactaaatgggccggacacagactttctttctgctgctctccctgtggtctactggtctcgtcgcagagcagcagcatggcagttggcctgaatgcaacgcagaatgcttactgtactacttgcttattgcagcatattcattcagggtttcagaaattcagtctcagaatgcaaacagttggattctctagaaatttcaggaccaacacatgtaatcatcgatatgaagcataaatcgcattgggttaaagttcaaagtcaaggatcacaaatttgacaacaaatcacggaaactatcaccagttgttcgagcgtagccagtttgcagtgccatatatactgccatctcttgtttccatcagaacctacaagctaggaggagtaccgattaaacttgctttgtaattgcatcccaccaagatatagttatgaattcatgacgaggagcagcacaaggcttgcattgcatggctgcatcatagcttaccatactccataactgttactcctagcccatccatcatgatgcatatgccttgccatgctctcttcagacttcagatcatggattgattcatcgatcgtttcgtcagaaaccttagttccccaaaaaattttcctaaaaacatcacatcgaatttttgacacatgcatagagtattaaatatagatttaaaaaactaattacgcaattagaggaaagattgcgagacgaatcttttgagcctaattattagttcataattagccataagtgttacagtaacccgcatgtgctaatgacggattaattatgctcaaaagattcgtctcgtggtttccaggcgagttatgaaattagttttttcattcgtatccgaaaaccccttccggcatcctgtcaaacatccaatgtgacaccaaaaacatttttttctcgaactaaatatgcccttattttgatttcccatataggattacttcctagtgccattcaagcaacgatcactgttcagtaacagtacatcatgtcgcactctaaaaagcacataatttatctgaaactctgagtagatctgttgtttctttggagtaacagagattcagacaacagaatgatcaatgcagcacttacaggtaggaaaaagattggatttggggggaattgatgcatgcaagatgggagtagataatgctctgttcagaaagtcagaattccatgcccccacgcatgtgacatgtagcaataccaccatccatatccactgcctactcaagtgttcctcatcaactgccattttctccttattagataatggaataatcctat

SEQ ID NO: 63694 - DNA, 25400 bp, Oryza sativa
ccgtttttcagttaagccacagttgttgtgatgtgtgatgatctatatggaccatccatgcagggctaggctgcagccatccatgcatgcatgaaccaatgcaaatgcttttgataatatgcagatctgaactggttaattatttcccagaaagctactacagcctaacatctctcactctcaccatcatgggtgtcacttggttgctttgctgccagactgaaagttttaactgtccagaaactagaagcagtcgagtctgtctaattactcttgtattttggttatgtacttttgatttagatgtagaggctgggttttaatcaattttctaaaaaaatatatacagaaggtattgtacatatggatcaagtggttttacttaactcatctgaaagaatgaacgaattaagcaggtttgttcttggacagtactacagtgatgccttgcaaattgagcaaaggcaggcaaaacaagtacataaatttccccagattaatggagtgagacagctaatagtactattatggtactgttagtaccttgctgccactaattcgaggccattttttatctgactttttgtttcttcgagcacttgggttcagaaccgcatggtttttgtttttcgtttcgagaaaaagtggagctctgttccttgcttttcaagtgaacttctgcaatttccatcctgttctgcttcagaattttatttgtacatacatgaatgtgaaagatatcaaatgtgtacacatgtttgtagtcttgtagagagtatgatcaatgatatcaactagctgctgcattactagaaccacatgcagataaggtcgaactaaaccaaatcaatgataaaattttgagttattaaaactaagtactttggctggtgcaatgatatcgacggctccaatacacgacgacataatacaggcataaaaatactctggcaattagtttaccaaccggcaatgcaaattatacgacagtggttaggagatccctatcaattaatcatcggcagcgactgtattattctgacgcttgaccaaaatgggggctggcctgaacattaatcattttcaggaaaatgtacttatctgaaatctacaaaatatcaatgtgtttggttaaatttaaccctttctataacatggattagttggagtacattacaatctgaagtcaaactggagtactgcagagacagactgtcggtagtccgatttttgattctgcgtacagtcgttgaccaaattagattggaccatttcatggttactgcagtctgcaggagaaagaaaagaacacttgatctgcactcaagcttgggtgcttatcttaagtcacaaccaaccacatcttaatgacctgatgaatatgagatgagcttggtgcttttatgagaaattgacttctcccaggaggtcccaccatgtcagtttctaacccacaaattttgtacaaaaactaaataaattcttgcaaaactcctactattactacaattttcttagacaacagcacacaaaaccttactatatcaaatactctatccgatccaaaatataacaacctaatacaaaataagacacgtcgtactactacgaatctgaacaaaacccttgtctagattaatatttactagtatctttatcttaatttgatcatcccctaaatagagggcatcaagaccaaatacactaatccaacattctgaaattaatcctcatcgatcaaaggtgctccgtcgcttcatgttcaacaagttaattcacactttaaatgttgtatgggttgaactaatagaaatcaatcttgatttgttgtatgcatgtggggcattcacaatgcacatgtactctttacacaaataaaaaaagaagcaatttattaaataattattattttgaaaacatcttagatgatgattaaattgggatgaagggagtagaatatactcctatctctacttcgggtgttatattttaggttggaggaaatagagcttaagcttgtaatatgctccctctatcataaattgtttagaacacgatttttcttttgctttaaatccaagtatgccaggaaatatcgatgatcgatattttgaaagagcaatcgaatctcgttctaaaggtcggatatttatgacgtgtattagggcttttgcattgccattgtttacccaaatgttgtaagcataaaaccatgtcaagattgttttttaacttttgggtgaaaactttcacagttggagcagtaactaaaagaaaaaaaaaaggctttccctttctccaaattgtccttggaactccactttgccccattgaaaacgacgcctgacctcaacaatagcaccacccaggcacccacccactgacttcccgggccccacatgtacaatccctacaatcgagagagagagagagagagagagagagagagagagagctcgaagcttttcccaaataactttgccacagtgcctcctgcttcccccctgtgcttgcagacttgcagcgcagagctcagcgtagcgtgctctcgcctccacactccacaccacaccacagtcgcctctctcctctttcaccgagaagcgaagcgagagagagactggcaccgccgcaagaagccaaccggcgggggagggagaagcagagcaagcggcagaaagaagaatcattggttaggctctgcagaggagaggcggcactgcactggaggtgagaggctgagaacgagaggtagaagaagaatcgggagaaggatcgtcttcacgggaggagcaaggaggggataattaggctcggattgccattaggctgaggggggattcgcgaggcttgtgttgagaggcttgagaggtgtgtgctcgcgtccctctgcttcttcttcttcttctccatcttactgtattctttatgctgcttctagatttgtctcttgtatctgtgatgttgatggagttcgtcagaaatgtcccttcttttcttctcttcctcccatgatttcttcgagcagcatctttctatattctgttctgtttttcccccctctgaagtacgttttggaactatgatgattccataacaagttgctagtcgaagattgcttgttactctatcgatcaatggcagttctgcagctgctgcttaaaatgggttcttttgctcaagatttgattgtgctttctccttctgtatctctgttggtatatagttctgggacaggtccactttgattctatcatgggactcctatttgattgtgtttgaggtcctcactggatctgctcacaccttacttgtactcgtatagtatcccattcggattgaattaaatgcatttcctagaaaaaaaattgctctacttagtccttgctccttgcagcctccatttcgagtacacctctatttattcgatgcttgacttcattccaagcagtattgttgggcagctaggtgtacttgtcttctcctttctgcactcaaaatgttgtagttaatggcacctttcgtgctcattgagtttggtatgctttttatggttcagcaaaatgggagtagcaaattgttgtgctttggtttcaattccagtgacaatttccagccatattactagttagcatttactgacaaaatgcattggtttcgtgttcactgtgagccatcaaaacggtttgtgctaccgacatgttagcctggattgagtttcactgtaaagttgcaacctttattacatttggttgttggtgatttcattttcgttaggactacccaggttgtcgactattaactcattagacttttgtcactttcaagttctaataattctttgaagtcctctgtatgattactgtgatttctgaattgtgcttaacatttgcaggtaatgtgctttagagtcgacagcaatggcttcgctggtacccggggtccttctcaagctccttcagcacatgaacagcgatgttaaagttgccggcgagcaccgttcgtcccttcttcaggtggtcagcattgttccggcccttgcagggagtgatctgtttaccaaccagggtttctatctcaaggtgtccgattcctcgcacgcaacatacgtttccttaccagaagagcagcatgatctcatattgagcgacacaattcagttgggacagttcatccatgtagaccgtcttgaggcagccactccggtgccaatcttgaggggagtcaggccagttccaggtcggcatgcttgtgttggcagtccagaagatcttgtggtaacaaactccacttttctcggaagtaagaaggcacaacaatccatcaacgggtcaaaggatgccagtactttatcactagaaaaggagcagagcaaattggagaaattaaaaccttcagtgaaaaacaatggggcagaaatcaagaaaccacagttaaccaaatcaaactcttctctctcgaaacaagcattgaatagcattatagacaagaaggaagtagtcagctcaaagacaaaacctaccagtgctaggtcgacaccttcatctccgaccagcgtttattctctaccggcatcatttgagagattctcgaatgacataaagcagagaacaaaatcaaaaggagcagataagtcatcaccttctaggctttccttgttagagaaagctgcttctgttttgaaggctactacagcagggaggaagtcctctgcaggtaacttgcttagtaacaccatgtcaagtattgaatcgggaccaaaggccctgagaagaagctgggaagggaatgcagaagcaaagagcaaaggaaattcagattcaaaggcagccaaaactgagaagaagtctgagaatagaagcacatcggtacgtgcggttgttgtcaacgcttatcagttatatttgtctacaaatgtggcgtgatttactttattgagtatccttcatgtagtacttaagctattgccttaagcccttaacacattgtagcctttcagtaacatttgaattcatgtttgatcctttattgcccatcttttttttttccaaagttactaatctttgctggctcttttgttatcagactccaagacgcaaaccactagtagaagagaagccattgcataaggatgacagtaagattcagactcctccaaggaagagctcagcaagtgccccttcagatgattctgagaaaatagtgaataagccttcttctcctttgaggaggacgtctggagtttcaagcaacacaaatattacaaatctagtgaagattgcttcaaacagcaaaaagttgacagatgctagcgcttcatggacatcacttcctccttcacttgctaaattagggaaggtatgaatatgctcattcacatgttcgcataggttggctcattgatgtgttcactatggctgtttgctacaataggtctagcattgcaaaaccttttgcaattttgagggtgctaatttaatttttgtctttgcacaaatatatacttaacaaaagaaacgatggacaagccctgttttactatgtgaaatgatggctccagttcccctgggcatcaacaaagcaattttactataccattttagtcatactgtccagaggattgaaggatgaaagaattggagatcatttttctctgtagctgttgaatgcttcattaatgtcatattgaatatttaattgcatccaacttttcacaggagcttctgaagtacagggatgcagcacaaatggctgctgttgaagctatgcaggaagcttctgctgcagagaacttgcttcgatgtttaaggtaattttttcactgacatatcctttgtgatgttgcaactacaaaatctataatcagcaccatttcaaggtattgccaactcctgatatttcaatgatattgaattgtttctcttgagctattccttgacttcttagtctgatactgatactacctaagtactaaccattagtatttatttccaaattgtgttttgtatgcatagccgtatgcatgtgcatcatcgctgtagttattttgagaaattttgttaactttaaggtgaaaattcttcaagtcaactgcttgcgccacactatgctcattaacttgtttccagcctaaatatgtccttatggtgtgcgtaatatgtgcagctgatatgatctgccttggattttcttttttgtacttagttcaaatttgaacccaaagccaaagatttgaatccaagccctccctatccaaacagggccttgaggattttgttgcctgtcctagcatgttgtatgcttacaacaagcaattttatggataagtttcaagtcccacatggcatctaattattaacatggttgataatcgatggctctcttgatgtttatatcacatgggttctaaaataatcgatgaccaatcggcgtcaggtcgaaatacctcagctatagctgtcaagcaagttgcaatgatattaccaaccaccaattagctccctctccttttgatccatacaaaggcttgattatgtctgcacatgcttggaatttagatttcggattgagcttgtgttcctgagtgctctacggacagattgaacaagttcctggagtccatgctagcaatgcatggaacagccagctgttcttgtctgaataaagctaggctgtatagtgtttatcttctcaaacagtctgaactgctgattcctgtatcttgacaagcattgccagacaagaactcctaacaattcagtacttgtcactgcaatgtactatgaaataaagtagtttgcactttctgctcacacactggtgcttgcagtgctctgacagttctgtgcctagtcacaactcacaaatagtagtactatggtaatgtcaaatgtgaccttttaatctgatcaaaatgtgtgttttactgatggtcccatcactgttactgaataatgcatggctgattgtacagcacaaaagttcagatttctgcaacctttttaccatgcactgttgtagaatttgtgtactcctccctctgtttcaggttataagacgttttgacttttggtcaaagtcaaactattttaagtttgtagaaaaaagtagtaacatcttcgacccaagacaaatttataatgaaaatatattcaattattgatttcggattgagtttaaagcgtcgtatgacctgaaacggagggagtagttaggaatggtgcatttgttgccgaaacaacaactaagaaatgtcctgtcactgttgtgttgatctgaatgcttatcaaatgagcttttatctgatcaaaatgtgtgagttttactgatggatcattgttactgaatgctgcatacggttacttctacagcgcagaagttcagatttctgcaacatttttaccttgcttgtgtcgttactcgttacgttcgttgcagtaataacagctaagaacttacctttcactgttgtgttgatctggatgcagctcgtacgcggaggtgagctcgacggcggaggagcagaacccgcagccggcggtggagcaattcctggctctccatgcagccatgtcccgcgccaccgtcgtcaccgactcgctgaccaaggccacggcgacctcgacggcgacttcaccggaccgatcaacacccagtgaagccgcagccgtcgacgaggagtcccttgccgtcgcggtggagcgccggcgccgggcagcgtcctgggtgggcgccgggctcgccaccgacctctccgcgttctccctttacaacctcaagccgccacccgccattgctgcctccccgctggccgtcgtgctcgtcgacgagtcggcgagaccggcggcggcgacgaaggcgtcgccgcccgcgaagtcgcggctgttcccgcccaaggtcaaggggagggtgggacccgtcgctgcggcagtggcggcggcgcctgtccctccgccggagtgggagaggggaggcggcgcggaggagaggggcgagctggcgaggcggctgggggaggaggcgagggggtggttcctggcgttcgtcgagcggttcctcgacgccgacgtggccgccgccgccgcgccgtgggatcgcgaccgcgccgccaggatgctcccgcagctgaagcgcgtcaacgactggctcagcgagatagcgaagcccacggaaccgccgccgccgcaatccgacgccgacggcgaggaggccggcggcggcgcccccgccgttgcgaatggaggcggcaacaccgtgccggaggagacgatagagcggctgcggaagaagatctacgagtacctcctcaccaacgtcgactcggccgcctccgtgctgggcggcgccggcgcggcagcgaacgggaagagggtctgagcgacatgggccgtcagatcttgcacgaatctcgaggccagcatggggaggcttaactggcctcgcaaatggggtgagttgtggcccgctttcgagttctatctagaatttctgcattctctaaaagagcattctaaaatctaaatttgatgcggaaaatgaaaaagagaaggtaatttgtaatgataatgatgtatacagtaatacaattgattgtttcgattgttgaaatgaaaaaagaaaatgaaagagtaaattacactcgtaatacagggacaacaacttagcacgcaacccttgtcaattccttagattgtcttcctttcttcactttcccaactcatctctttcatttttcctacgccttttcaaattactaaacgtgtttttttttaaaaaaattatatacgaaagttgtcttaaaaatcatatcaattctttttttaaaaaatagctaatccttaatttattatgtgttaatgcatacattgttttacgtatggataggagggattcccaactcctttcgtttattagaacaaacttttcaactaataaacagatttgctagaaaacttacgcaagttttttttcccatctacacatgttgcgcgtaagattttagtgatagcttgtgtagtagttataacgtaattactgtcgaaacaagattttggcaataataaaagggggtgactatcaagctaagaaagtggatgggtttagagacaaggaattttatacaggtttaggccttcttattcaagaagtaataccctactcttgtccggggatgattccgccgagtgtattattgattgtatgattgggagaaaaaaaatcgtcccgagaggaacctggacccctccttatataggggaagggatccgtattataaagtacagtccatatcctaacggaacatgagattacagataaaatacaatcgtaaccgactaggatcccgagtattttcttaacatacaagtttagaatctaacccgagtcctcataaagatattctatctatatttggtaccatatatccagctggaatgtaaccgccatgtagatatggggtaaccataatcttcacagtagcccccgagaccttcgcagttgaccaaaatagtcttctcgaaacaaaaaacaataatccgagtgcttcaattcaacttgctccggcttgccgagtgctaaaagactgcgaagggcgaaaataaaacatggtgcatcgagtagatgcacctaattaggtgtagcccccgactatgtgattagttgaaaaactaaacatatagtcaagaaccgggtgactttatatcgaagcatgcatggtactcaataaaatacccagccgactacttctcacttgaatatatcaaggataaaaaatatgaaaagggccgaatgataaacactcaaaaggtccaaaaatagatatatttggtaggaatccgagtaagaaactcttaaaatgatccaccaaatatgataaaggtcatggtaattaagaagttcattagcctaggctataacccttaccataatcaaaataagcatataacatgataggagaatgactactaataaaccagtcatctcaaattaacccaatagcttttgtagcctaaaaaagcttacaaaaatggtataacacctttctgtcgggcaccttttcatgtgcatcataataattccaaagaattattgaatcgcgttaaaaaggattttaacagcatcgggccgcgtcattgtgagcacatattgccaaagcaaaaggcacctaagtccctagggatcacaatgggccacgctgaaaacataattgggctgaagtactgtacaggcccaagcccattagtactcccgataccctaaagacaccgaagtccaaacgtcgtttcgtcttccctgccgagactctcgccattccccactccgtgctacagtacagaaccgcaccgacgaagctagggttcatcaatctgctccaacccaccctcaaaaacttcacgaaatttctccccgcgtccaccgctccgattccccattcctctccagccatatctcggaccaaattaaaccatccagttcacattcatggcggaagaaagagaaagcttcgaaagtcagtgggcgccctccgatgtgacagaagataacctgaaggagatggtggcgcatggcgttctcccagcgaaggagattatcgggtggcgaccggcgttcggcgaagcattcccgacccccgacacacacgaaatcgtggtattcgctcatttcttctatggcggattttctcttccaacctctagattcttccgggggattctgaacttctacgggattagcttgcatcacttgaatccaaactccatagtgcatattgccaattttatccatgcctgcgaagcttttctgggcattaggcctcatttcgccttgttccgccgcatcttcttcctcaagccccagccaaacaaaagcaaaccatgcgttgttgggggagctggtttccaactcagaggaaccttgagccaaaaatatttctccatgcccttcaaaacctcaaacaaaggctggcatgcaaactggttctatgttcagaatcctgagcccgcactccccgagtactgctgtcttcctccggtttaccaggacacatggaactcattgcctatgggagatgaagctgctcaggcaatggaattgatggaacgcatgctaaaactgaaagaacaaggtttgcagggagaacagatcactcagcacttcatcaaaagtcgattagctccaatcaaagagaggtcccgcacaacttttgagtttgatggcaagcatgatccaaatcaggaagatccagattctcttgactttaaggtcatgaaagaaagaatgtacaagatcttctcaaacgctattgttgtcagctattcacatctgctgcccgttgtgccattcaacgcattcaaccctcctccaccggtatgcactcaaacatttcaaccttcctcaaaagtatgcttttaccctctgttaagctaattgaaagtttgaaatatcatgcccaggaatttgctttgatgaaatcggatcctccaattgctcaacgccgatcacctcgccagcagactggtcaggcgagtggaggaccaaaaattcgatctgacgctcgaccaagtgcttccgatccactgttgaaataatactaacagcataactcaaactcgtaggaagccgtctgacatagatccttccgaaaaggaccccgagccgactgacatagaggcaaacctttcaaaagaaaccgggccagctgcagaagatcgtccgagtgacaaacaaccggcaaccgacaatgtagaagccagcaacgagcccccgactgggaaccagtcggccgaaactgaagtcggtgctaaccaggagcccccgactagaaaccagtcggatgcagggtcaagccaaaagattcccgaagttgaagctcaaacgaacagtccgctcgggaaggatgctgacaatgaatcagaaaccagatctcctgtgaaggcaccaaagtccactcgtccccgaccgggaatcatcacaggtagacatgccatctgaaattattttgatccaacagactttatttggctgcttcatcttcgttcatggatacactagggccaataattggtgatgaagaagagatcctccggatacaagcagctgaggattcacaccctccgattctggtcaagtggtgggatgacaacatgcagcctcaagggatcgtgataaataagcaaaaagaggacgaagagttatgcctactgaagaaggcacttggtcaggcaacccgcattgtaaatgtaagccctctggtacctgatctcaaccatcttgtttgccatttaattcatgcgctaattaaactgtcttgcagaggatttatcttaggaacgaagccaaaacggtaaccttagagaggttagtccctcatctcgggaccctcgaagccaccaggaatcgactgcacgaagcgaaacaacttgccaggaagaatgaacatgatctgagggatcggatcgctgatctccaggaatcaaattttgaactgagtggctcatcaaaaggtacgcacaaactctgctcaactgactcatactgttatctttgcaatcttgattaaccgtaatcaatgtagtgcaagctgccaagatatctcagttggaaaagcagattcaaattctggaaaatgacaaggcagaactggcaaaacaaagagacctggctttaaaggaagttgaaggtatcaacaatcaatacctcaaaagccattatcctccatatgctgacttattaatgtgaatctgttgatgcagaccgcaagatcaaatctcaagctcaattcgacgtcctggttggcaagatcaaaaaacttgagggagcccgggatgaggttgctaacgctgctgccccaattgttcaaccgatgttcttcaataacaacggcccgagtgcacttgatgcttctgaaattttcgacaagctgagagttgctccggatacatatttcaagaacatcaaagaagctggaagtatgggagcaagtctggcgttggcgatgaccaaatccctttatccaagagttgatattgatgccattgatggctttgcagacgggatgagcgaagaagctgctcttgacctcatcagtgatgcgcagaaagcggctgacaaaattgctgctgatgtagttgagagattccaagatgtcgaccttcggccgactgggtctgataagtctgatgatgaaaaaactgatactgattaatgtaccaatgattttgacgattaatgatgatggaggcacaatttgtacaatactgatgaatttatgctatgcttaatatcttaacttagttcctgatttcttaaaagtttttgtcgaaccttgttgagcctaaaacccgcaaaagttgttaaaaaactttcagtcctcattgactaagccaagaaatcaaacagggcaatgatacatcaagtaagcaaattgaattgataaaaatcacactccattattattatagtagccccctgactgaaaacttcaagaaaaaacttgaagttagcagtcaaagaggaaagatacaaacgaaatgcctaagcgtaaaattgacgaaggtgttcaatattccaagaattgttgatgagagtaccgtcttcgcgcttgagtcgataagaacccggccgagtgacttcagcaattatgaacggtccttcccataagggagataatttatgccgatcctgtgttgtttgaattttccgtagaaccaggtcaccgactaaaaaggctcgcgatcgaacattccgattatgataacggcgcaacgcttgcaaatatcgagtcgactgaattaaagctgcttctcgggcttcttctagtcggttgatgttgtctactcggccctcttcatagccctcctcattgaagttccgaaatcgtagtgattcaaattccacttcactcggcaacattgcttctgcgccataaaccaaaaagaacggcgactggccggtagcccgactaggagtagtgcgtaaagaccaaagtacggacggcagctgatctacccacttgccagcataggggcgtagtcggtcaaaaactcgtgctttgatcccttgcagtatcatgccgttagcgcgctcgacttgtccgttactcatagggtgtgccacggaggcgtaacaaattttaatgccgaagtcttcacaaaagtctttaaacgctccgccaatgaattgagtgccattatcagtgatgatccgattgggtaccccaaaccgatgcacaatgttgatgaaaaaatctctagctttatctgctgtgatcgtaatgaccggtttagcctcaatccacttggagaatttgtcgatagtcacaaagagatgcgtgtaaccgccgactgcccttttaaatgggccgaccatgtcaagcccccagaccgcaaacggccaggacaacgggatggtttgcaattcttgggctggcaaatgagtttgtctggcaaaaaattgacaaccttcgcatgtccacacaatcttgtccgcatcggacacagctgtaggccagaaaaaaccttgccggtaagctttgccgacaatggtccgtgcagcagcatgattaccacaaataccagaatgtatatccttcaacaattgtctcccttcctccaaagatacacagcgctgcagtattcctgatggacttttcttgtacagtttagcttcatgaataatgtaaagtctgctgcgcctggaaatccgctcggcttcatttttgtcttgagggagttcttgtttggtcaaaaattttatgaggggttctctccagtcggcttcaatcatgcttacgccttgagtatccatggcttcaattgcttcttttctgggcacggttggttcataaagatgctcaacgaacacatcagaaggggctgcttcccgttttgaactaaaattggccaatctatcggctgccttattgttatgtcgaaggacatgggtgagctcgaatccatcgaatttatcttccaacttgcgtacctcttgtcggtaagcggtcatattatcatctagacatgaccactctttcatgacttgattaacaaccaactgagagtctccacggacgattaatcggcgaatgcctaaagagattgcaatccttaatccatggagtagcgcctcgtattccgccacgttatgggacgcagaaaagtgtatccacaatacgtagctcaatctttctccagtcggggaaatcaagacgaccccagctccagtgcctgtgagcctctttgacccatcaaaatgcatagtccaatattccatcttttcctctggcatgtcttcttggcactcggtccactcggcaatgaaatcagctaaagcttgtgacttgatcgaagttcgtggcttgaacgatatgtccaaatacatcaactctaaggcccacttcgcgatccgtccatttgcttcgcgattgtgaagtatatccccgagtggaaacgatgtgactaccgtgaccgggtgactttgaaagtagtgagataatttcctgacggtaattagggcaccatatagtaacttttgaacctgaggatatcttgtcttggagtcggctaaaacctcgctaacgaaataaattggacgttagactttttgaacatggccttcctcttcacgctcgacaaccaggaccgcactcataacctgggaggtcgccgacacatataatagtagcggctcttgcggatgtggcgaggccaaaactggtggagtggtgaggagtttcttgaagtcttcaaaggctttctgtgcttcgggcccccactggaaattgtcagtcttcttcagcagcttgaagaaaggcatcccccgctcgccgagtcgtgaaacgaaccggctgagcgccgccatgcaaccagtcagcttttggacgtctttttgggagcttggcggtttcatgttgaggatggcgttgattttctccgggttggcatgtatgcctctttgagataccataaatccgagcaatttccccgacggtactccgaagatgcacttttccgggttcagtttcatcttgaaagcacgaatgcttgtaaaagtttcttctaaatccgcaatcaggtcatccttctgcttggtcttgacgactacatcatcaacataagcttcaacattgcgaccgatctgagttgaaaaacatctttgaatcatgcgttgataggtcgctcctacattcttcaatccaaagggcatggtgatgtagcagtaggccccaaagggcgtaataaacgaggtcttcaagcagtcggattcttttagttggatctgatgatatcccgagtaacagtccaggaagctaagtaactcgcagccggccgttgagtcaaccacctggtcaatgcgaggtaacccaaaagggtctttgggacaagatttgttgaggtcggtataatcgacacacatgcgccattgccccgtctttttccgaactaggactgggttagccagccagtcgggatgaaggacttccttaatgaagcctgctgctaacagcttggttaattcctccttgatcgcatccttcctgtcctgttcaaaacggcggagtcgttgcttgatgggtttggcgtcttccttaacatgtaaagagtgctcaatcacctctctagggataccaggcatatcggatggtttccacgcaaaaatatctttattattctgaagaaaggtgatgagcgcgctttcctatttacaatctaactcagcgcctattacatcagtcttatcaggatcggagggatctaggggaatctttttcgtcttggcatcactttcttcggtcttcgtcagcttggttgcaggcacttctcgctcgcttgccgtggtcgcagccagtcggatctcttcgcgggcgagagcagtctcgtgggtttgggccatctcgcaactttctttgtcgcatgtgacggcctgcttgatgtcgctccgtagtgatatgactcctcgaggaccaggcatcttcatcatcatgtaggtgtagtgtgggacggccataaatttagctaaagccggtcgtccaagtatagcatgatatgctgtctcgaaatcagcaacttcgaaacaaacattttctgtgcgaaaattctcccgagtgccgaaggtaactggaagagtgatctggccgagtggtgtagctgacaatcctgggataacaccgtggaagggtgcattactcggctttaattccgtgcgaggaatctgcatatcgtccagggtcttagcgaaaaggatgttgagtgcgctgccaccatcgatgagagtccgtcggagcttgacattgcgaaccactgggtctagtactagggggtatcgccccgggtggaccactcggtcgggatgatccgagcggtcgaacttaattgctatctctgaccaccgaagatattggggcatgttaggctgaaccgcatttatctcccgttctgtcagcttttgttttctcttagactcataagccaggggtccgccgaagatgtgattaagttctttgcgatgatcttgaaaaccagtcggggcatcgtcttcatcatctttcttctttgatgtgccttgatctccgtctgaaggtttacgtgcgttcttgacgtattgctctgcgaactgtttgtagacgaagcaatctttggccacgtggttggagttgggatgatgcggacattgggagttcattatcttgtcgaaggtgttgacgcggggacgttgtcgggaagatagagaggtggtcgccacaggttcttcgggcttacgcttgcgatccttgtggttgttacttccactccctcctacagtcggcgtgtccttctttggcttccaagtggtgcccgactgtttggacgtggtgatagcatcttcggctttggcatactcgttggctttttcgaacatctgcttaaccgtcctgggaggtttacgtccgaacttgccgactaggtcctcgtggcgaatgcctttagtgaaggcggtgatgatgacgtcgtcggtgatgtcggagatcttgttgcgttgttcggagaagcgtcggatgtaatctcgaagggattctccagacttctgaacgacgttgtagagatcaaactgtgtgccgaggcgttcgaaggtgccctagaagttagcgatgaagtaatcacgaagttccgcccatgatccgatcgtgccacggggtagtccgtggagccaggatcgggcggagtccgctagggccacaggtagatagtttgctcattgttatgtcgaaggacattttaattatactatcattatatctgaaagttttttttactaaaaatacttgcggcagatttttaagatattctcactaataaaattgtgccatccctctcactacacacagagcgggcaacgagacgcacatgcagttgctagctatcaacggtaccgagatagagtattattaggtactactccacagagtgttagtttagtgatattatacctcctaaatcccgattagcactagaaatacctcgacctcataataccttttgaagaaccgaaaatttcccttttcctactgtttctgattttacactaagcacattatgttcattcggcaacccttgtcggttccttagaacaactacatgacagaactaataaaattttgttttttttttaaactaggaagcagagctcccccaatttcattaagaaaaatgagagctacaaaagtctttacatgctacttaaagcagtctaataataaaattttgtactcaacacataacatacttgcccacaatctacagccgaaaagaattaatggtccctctagatcgatatactgtatggtaaatcatttgcttcatcatccttcttgtaaaagatgtggaaaaccagaagaggatgtatatatatatatattcctatgcatgctttcactcatcatcaagacctggtatgtacaataagttgacgtcgaacataactgggctgcttggagccactcttggccttccaggagctgaagtaaggcccttcggaaatgctagctgttcagatcaagaaaaacacgaaaaatcaaattatcaccctcctttcaaatctctgtgctaagaggggaaaaatgatgccatagcaatggctgcaattgtctggccccaaatttaccacatctttcattttctcttgcataatatttgttgacattggggagtttaggctacttaccgggccaggtatgtataatcgccgtagtcctccaaccttcattgacaatatcccttcatcaagtccctttatcacctaatgtttaccaccacaaatggatgaaagaaaattgaattgtttttaaagcattttagttagaaggcgcataatgtgttttccagagggtagtttggttactgatagtgtaccaaacattttcttgcaaaattacatatggtgaattcatgttttattaataatacgaactatacatttttcacgtagcattatgtatgttacattagtgtatttcatgtgcaatttacacattagacataccaagagttttaatttgaaaaccaaaaaccagacgttaaccgacatgttccaaaaacttgttagcagcttgttaccctcaattactagtttaataaaatattttggattcaatctttttccagataaaagtggtaagcggtcggttaccctttctcaaagggaccagttggtattttgttctgaaactaatattcaaaacctttgttcgtactctttaacatttaagttttaaatattaattcaaattgttctgggctggtataccgatagccagtcgatggcttaggatcggtaagtaccagtaaccagccgagattttgattcattgtacaaacacgatcaaatatataaactgtatatgactgtaaattgtatatttacagtcatctacagttcatatatttgatcagtttgtaattttattactcacatttcagtggtaatatttcagaacacaggctaccaagtaccaacaggaatatgtagggaaaaaaaataaatacctgtcctgaaccaacacggaatatgtagggctgccccttttccagagaactgtatacaacacagacacacaagaaaatttcagcttgcagcttgcaagtgtacttgaacagcatcaacttaatctcgcctatataaaagatggttagtttggcatcaaaagctcagttcgcacctgtcaaatatctgtccattcggtaccatggcaacataatttgcagcaacctaaatggtaatcaaagagagaaaaaaagaaacagattaagaacatgatcatgaacatctgcactgtgagaaatcaagtgagcacctggaagccaatgggtggacttgggccttcacccactttgatatccttgtactgaagaccagactctgtagtcaccatgggcaccttgggaatgcatcatgatgagttagttgctgagattagcattgattagatgattaacatttactaatctcatcgctaaacatgatcatgtatgtaatcatgcatagctcaagcagggttgaaaacttgaaatgttcctaaccagaaaacagatcgatcaccctggcaagaaagaaatttcaggtaaattttttttaaaaaaaatcgatcagagtaagtacattttcgaggtccttctcgcaggcggcgtcgcagagcttgggcttctcctcgggaggcagcccggcggcgagggcatcatcgaacgcggccaggccgagcgccagcgccgacgatacccccacggcgactccaagaacgctcctcctccgggaccgggtggcgctggtacagaccacgccgccgtcatccactccgcgctgctgcggcggcggcgccgttcccgcctcaccggcggcctcgcacctgcagcagcagcagaagcatcgccgcgccgctgaactcagcgccctgctgcccctgaacgccctgccgtcgggaagccacggtttggaggaagggagcgggcggcgggccgaggggaggaggagcggcgaggcggtggcggtggaggaggacgaagcggttgcagccatggtggaagaagaaggaagaggagaggaagacgaaggaattaagcaggtacggatcaggagacgtgggagaggaggagaatggatagcgcaacgacgcatcgcatcgcatactgggctttgcgcgcggtccgcctccaccactcgctgcgtcgggtcaaactgaaatctttcgggtgctgctggtccacgtgtcactcacagagggtttcgatctccatctcgcctgcaactgcaaaccacctcgctggctgcctcggcagcatttttcaccgtagtccacgaggtgtaaaataagaacgtattatgggatcccccatctctatcataagacagtcacaaaattaatttggagagaaacttcagctcgatcaggtcaagcggagattgtggtgcgtcatgctacctgtgaataatctcaagttctgaactctaaacaagtggttatcacaagttagaagaaatacagtaagaattctgaagattaatttgcctgtattcattggtgtcacggtgactctggtattggaacatttctttgcagtaggtagtagcaccatgccaagccatcagattatttttcataagagtgaaatgcacatacagtccttaaactggtacggatatatcatttaggtccctaaactctcaaaatgaatttttggatcccaaacttgtaatgagtgtcatataagtccaaacgggctccaactcgctccgtgagatgacgtggcatgccacggtaacgcttacgtgccagtggatccacatgtcagtcatataaaaaaataaataagagaggagagagagagagagaagaaaatgatgtttttaattttgaaaaaaacaaatgaaaaaagagaggagaaaaaaatatgtcatgtggttgacatatggggtccactgacacgtaggcgtcaccatgtcatgccacgtcagcacacggagcgggttggaacacttttggatctatatgacatccgagacaagttgagggataaaaaattcattttgagagttcagggacctagttaacacacccacgtaagtttaaagactgccgtgcactttactcttttcataattatactttcgataataacatgtgtaaactgtcagacagaaaacacatgatcagagagtaaaaacacaactgcatacattgcaaatttgcgattatgcagctcaatcgctggttcgtaatccctactaccaccgtagggtttattcttctgacataaaacataaaaacatggccagattgcagggcttggccgaattattgtacaaacatcatcatcctggtagtaatatatatagttgatgcgatcaaacaagctattcgagtcaccagacgttctaataaatactccctaaatatttgacaccgttgattttttttaaacatgtttgaccgtttgtcttattaaaaacttttgtgaaatatataaaactatatgtatacataaaagtatatttaacaaagaatcaaatgataggaaaagaattaataattacttaaattttttaaataagatgaacggtcaaacatatttaaaaaagtcaacgacgtcaaatattcaaggagggagggagtagtagtgtaaggtttttccaagtgatagaaagtgatgatgggactcctgacagcgtggtgccaatgatactctgctgatattgagcttcctctcacattatctaattaaactgagcttcctctcaagtacagcaaccaaccagttgcatatgttgtcagtgaactgaaaataggctctcctggaagctgcactgaatatgaaggtggttgaaacggtgcagaatccaaacgcaaatcccagcagagtaaacatgtatgtcagcgtgtcaaaaatctcatgatgtttgtgtttgtcgctgtccttgtggcagcttcttgtaagtggagccccacagagatcttcatttcccaaaaaagagtctccttcaaaagtcataagttggtttccatatggtatctttcctgagaggtggttgtaggatagattcaggaagctcaaaaataacagtgacttcatgctctgaggaattgggcctgatagatcattccatgagagatcaagtgattctaaccaggccagatttccgattgtttcaggaatacttccctcaatgtgattccttgatagatttaaggacgctagtctgtaaagatttcctatttcactgggtatctccccggttaaatggttctctgaaagatcaatactggtaaggaggaatgatatcacgaaagtaagtctgtaacctctgaaggttgcctgtaaagtatctttgtacacagaaaagtaagcgcccccaacgccataaaccatgaattggaaaaaaggcgatgagtcccattctagatttcgtgagagaaaggacgttagttttcccagagaacgtggtatagagccagagagtttgttgttactaagatccagatattgaagggcatgaagttgggataattcttcaggtatttcaccggaaaactgatttgaccctaaaatcagaagtagtagagtttgtaggccattgcctatccatgttggtatgtatcctgacaaattattctctccaacgtcaaggactaacaatcttttacatgactgcaatgaggtgggcaacaatccagataagctgttcttgctgagatgcaatgctgtaagggaacttagagagcccatagtggatggtatttcaccccaaaaattattgctggagaagtctatgacatacatactggaattcatacgccaacaatttggaagttcccctgaaagattgttattggatatgtcaatcagttccattgatattatgtcacatagatatgccgggattactccactgagagaattatgagagagcgacaggtattgcaattctttgtctccaaagctttgtggtaatgatccagacaagttgttgtgggatagatccagcactcgaacactatttggcatatcaggaatgtatccctcaagttgattatgcctaatgttcagagttatcagcatttttgatcgcaccaaacttgcaggcaactcaccagttatgttgttcatcgagacatttaagctagccattggcgaagagaagttccagatccaatctggcaatgcacccctgatgcctgcactgccaagatcaatcatcttgattctagtttgtgattgcagccaggttggaaactgtggtccaaccaggcaaccatgcagtcctagctttgtgagctgaaagggtggaaaccagctatgcttgactacaaccttgaaagaatttgatgctaaaactaaagcatccaatcttgataaattggtaaagtggagttctgataattcaccaataagtttgttgaaggaaatatccaagtatgtcaagttcgatagcctgctaatgctagttggtaatactccagataatgaattctcactgagatcaagaacttctagacttgccatgtgctcgcaccaaccagatagctgtccagttaatttgttatcagcaaggttaaggatctgcaacttcttcatgcagggaaacatgctccttgctgcttctgagagatttcctgacaaaatgtttctagaaagatctatgtgaactaagttgcataatctgctcattgaacgtggtattgctccattcagcttgttgttccctagtccaataaactgtagtgctgctagtttccctagctcatcaggaatcctgcctgaaagttcacaactagacaggtccaaatctgaaagggaagatagattccaaatccaatctggtaaggaagaattcagttcattattcttgagatcaattactttaagggcagtgaagttgatctgagaaacagaattaaggtccgtagctggaaggcttgcatcattcaagcgaagcacttccagcaaatgaagcatattcacagcctgcagccaatccacagaagcagcaaggtacaaccaactaaggtcgagatacctcagggaagttagcttcgaaacccactggaaatcgtccgcagtgatcacatgagaaccagatgagctcagatcaagaaagctgagccttgacaagttgccaagctgaggagggacagtcccaccaaaaccagcatgcgagagatcaagatacctcaacatcttgaaacagccgatgaattctgggatgggcaccccaccgaagtcactttgactcaggttgaggtacaccaatcttgtcagaccagacaacgatggattgatctgaccattgagagtgtactcgccgaggtccagcttgatgacatggccagtcttcttgctgcagctgacaccactccagctgcaacagttctcgccatg

SEQ ID NO: 63695 - DNA, 8402 bp, Oryza sativa
taagcacaacagagccaaagccataagcaatccattcatagtattttccatgttggtggataaaactgtcagtactcagtagctggtggtagaatagagaagataggtcgagttgcacctaattggataaatggaagtgctgagatgaagacttgaccagttgacctgatgacctctggtcttcgctgctagtctagtctttctgcatttttagtcatctgaaaaacttgctttcctgtgtattaattgcattttgcagtaactggcctttttggcttgacggccagggaggaactgcaattaccgatcgagaaaagggtgtacacaagggatatgtttgctgagattaaagcagtaccacctgtacactctgggaggttacaaacttacaattactgcactctaatattttttttgattgaaaatactatcaggccttgcctatatattaaaggacaaagagcattctttactgcactcaatattataattcactcaagaaaaaccaatgttgtggtcagcctacccaggttcaattcaagtcgtaggattggctaggatgatgtagagctcatgtttagttttcagataaaaaaggcaagttcttactcaatttgcttttatacttggattcacaaattgatctcctcttcccgggaaaatctacatcttgctcattcatatttattggcctgaaatttctggtagatctaagcacggcattctcagcctgactaacatctcagaaaatgcaaatgttactgaaacataaaccaaccccctcctgctaagagcctaaggcactagggtagtgaagtgaactaaactacgaaaggattggcactaacgaatttatagcgggatgtacagtaatccggaaacagtaaatcgtagagaggaagaagcctgtgcggccataaacctgaaacccgaactcccaaacccctagttgcgtacctcgcagcggagaccactccacgctccgccgccggagacgtcagccggcaagccgccacggcgaacaggcagcacggtgttggagaccagtttgccgccgtatccgctccacgggtagctcggcgaggatgagggcagagcctactgtcggaagcggcgcttcggttgagggatcttcaggtgagggtacctgcggcggtgaccggtggagctacgcctggagcggcggccgccggcggcacatgctcgccctattctattcgagaatttttttcggttttagattttttttaaaaaaatatttacagaaataatctatcggctaaaaaaattacaaaaatagaccctgccgcccacctctggggcggcaagctgacgtggcaaacgggggaggaacgggcggtgacggagggagggtttttttgcaggaaaacccttgccgccctctggtggggcggcaaggggcccgaatacaaaaaagccagtcggggctggctattttgcaggcggccccttgccgccctctggccggacggcaggcctcgctgcctataaaaggcctgctgcccagcccccagccctcattcttctctccttaattccagtgaaaaaaaaagaagagaggggaggagaagagaagaaggggcgaagccctgccggattcagacgccgatttcaggtaatattcatagatcctatatgtgactattgagttaaatagtgtgtgttctttaaaaatttgtttgaataaatgcattatttttttgggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccagctgagaggagtgtaccttctataaaaggatggttaatgaggggcttgagagttgatccacagacaagtgacataacaatcaatgttatagtaagtcggacaactaagggtttttattgggaactaatgccagttcaaaactctcgagtgtggagatggtatttggaaaatgcattgcaacgcaagtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgatgttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacgcgtataaggggaaatggaaggattattggacagtgtcagtcgttaccaagcatacatgttttctacctggtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgaaacactatatttttcagagatggcacatcaggatacacctcagttgttggacccggcgatagatcaccgacaccagtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggactgtggacaggtccctcctagcagctttggtcgattgatggaggccagagacgcacacttttcacttgctgtgcggtgaggtagcccctaccctacaggacgtatcgtacttgttggggctaccgctcgcgggagacgctgttgggccagggaccacggctatggactggaaggatgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgactgcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggagcatcgctgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcaaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcttgagtttgttatggagttcgaccgccttctgccgactgacgtcgtgtgggagccctacagtgccgcggctacccaggctcgtgcgctgttgggtctgtccacactctgcaccagggaccaggcgtactggatgactacggttccgatggtcttcgacatctgcgttgagcttcacgcccctttccgcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccaagttgcgagcactagagacctctatgccaggcaccgcgaccaggacttcgctcgtgctgtgagtaccctgcatcgcaccattcctttatgttttcatgtctttctcttcgtcaaattttacgaatatttacgtacaaattaaccatgcaggtcgacgacatcaaccgggtcgtcgttgatggttcaacgacgatccaacgtttaggcgcggggattccggtacccgtagaggagcacctgacgacgtacacgcggatggtggagtcgatgcgctcgcttctccgagtgctcacctgtcgtgccgacgacgttgctcgggcagacgcagctgtatagcggccacccgtacagactggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggtcagcgtcacaggcagccggcacgtcgagtcagggtccaccactggaccatgttgggacctcatcggaccgcttgctgccttccaccgtgctcttcgacatcactgacttcgacttcgcttcaggctcgtcagaggacgtcattggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcagcgcggggcagggccagtagagcagtcttctctttgtttacttgcttcactttccagtactgtatgcttgtgtaatgactacgttgttgttatatgtgcacgatacctttcggtgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcaaggaaggcgcttttttaggtgccctaactatgaccgtgaggtattttattatctgcatatgcttattcattctgtatgggcaatcgctttattcttcgtaacactactctattcggcagacccgcactacggcttgtgcatacatcgagtggatcgatacaaaaaatcccgttctcgacctaaccacttgtttacaagaaggtcgctggtatttcgcatccgaaagtaatgagcaatacttacagagaaaagcggcttatgaacgacaatgtcgtgaacaacagagcgactggcgggtgctaactacggcactccctccatgggaagcttgtccaagatgcaggtgtggtgatcgttgtcaggtttttcgttccataaatcctacaacattgggttgaaggttctttgtttgtccaaatattcttgacgacgatttcatggtaagaatattttgattacatgaatccttattttctcacaacatttactaactttgcttgctttacatctattctttcctcctaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtatgggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagtcgtatcatgttcaaattgtactactatttcttcatgttacataattctccttgtttaagtccatataatgtttatacgacccagactgtgataggcctatataaattatccgagtactaatacgtcgaataaggtacaaaataatacctcacttaacatatgaaattacgcaacaaccaacttcaatacatttttataacaatattaacaagttttaccaataaatacttctttatttattattaacataacatagaaaaatcttttggccgtacttttttcatctggggacccagatgaaaaagtacggccgcaagctctttatgggcggccaaaattgcaattagccccttgccgccctctgtatgggcggcaagggcctaatcgcaattttggccgacggcgcggtcgacccaccgtctgccacgtcagcttgccgcccaccattagggcggcaggggctatttctgcaattttttttggtcgatagattatttctgtaaatatttaaaaaaaatctaaaaacgaaaaaaattctactattcgatattgggcttcccgttcatgggccttcaagttaagcagtttctacttggaaaaagtatactttgactccctcaactatcgcccgagtatgattcatatcctccaaccacaaaccgggtatataaccggtgcaaacaatgtccctcggtggttttggaggtggttttggctgacgtggcgcctacgtggtggtcttgactgaatctttgtcctacatggagcttacgtggcattaaaataaaaacaataattaaaaaaaatgtaggacacatatgtcattcacacaaaaaaatattgtgggacccactgacatgtggaacccatatgtcatcctccctcattcccttcttcctccccctctctctcccttatagctctcgggagcggcggcgggccgacggctgtggcgatggggacgaggcgaaggggagtggtggcggcggcgatggcggtggggtcgaggcagaggtcggggagcggcggcggctatggcggtcgggagcggcggcggcggcggtctgggagtggcggtggagagcggcggcgatggggagaggcggcagtggggacgaggcgaaggggagcagtggcggtggggacgaggtgaaggggagcggcggcggtggggacgaggggaaggggagaggcggcggtggggatgaggcgaaggggagtggcggcgactgtgagtgtggggagcggc

SEQ ID NO: 63696 - DNA, 26903 bp, Oryza sativa
gtcaaagtatactttttcctttctacttctgggctgcaacttcatatgggccgtccaagcatacaggcttcagtttgttcattcacggattggagaaagtatacattgagtccctcaattatgatctgagcatgattcatgacctctaaccacgaaaccgggtatatcgacttctctaactatcaaaaccggtgcaaactttgtccctcggtggttttggaagcggttttggcctatgtggctttgttgacctggtcttcgtcatacgtggcatcgacgtgacgcttacatggcattagaataaaaaaataacaaaaaaaatgtggggtccatttgtcattcacacagaaaacaaattgggggacccactcacatgtggaccccacttgtcatcctccctgcatccccggtcattcctctctctctccatcccatcttcctcgttcctctcccccctctgtatgtccttatcgctgcgtcaccccgcaacaatgatagccccaacgtcgacaaccatggttatggctaaggcagctgcgtcagagaccaagggagacagagaaggacagccgccgaggccagagcagcaaggagggtgttgatgcgaaaaacacacactggcctggaagatctgcttaactcctgtgcaggtctaaaatcttgcttttaggttcgtgagcgtgccagttgatttgatcctgcaaccaacaagaataaaagacaagaaaaacgagattaaatccataaatgatagccgatcggctaggagccgatgacatatcgtccatcattgagccgatgttattggtgatagatcggcaatgaagaatgaagcaatataaaactaaatctactcgatcggctgtagatattaacgatatataatccttctctcaatgcatattttgattaagtgattgggatagatcgagcatcatgtcgagacagtataaatcacatagatccaaagatacaataagatgacgattatatgaacgtttataacatagctgatcaaatagatctagcatgtatcggctaatactccgataccactctatattaagatattaaaacagacgaacatattaagcaaaggcctaatatactctaatgcaataagatcttgatataaagggtatatttagcataacaatcaagcatataagatatgaaatagctaaatcaggtaagatcggctgaaaccccgacgatatctctttcagttatcataaaacatgctagatattatagttataaatattacttaatagatcgaactcaaccgatgcagcattaagcataaaaataaatacaagatctaggcaaggtgatgaaaacctctaagagatggtagatatgcgatacaatctagattaataacaagatttaactttatcggctgctctctagcagtaaaaaccagccgattgtgagttaaataacacaatcaacaaagattatgaagcatatatgataactcgatgaattaaataaacaagattagagtatcataaagatggaagcactaatcccgagaatgtaaaccgccatgacaagtttacctctagttgaagatcggaatcgatgcagctcaactcgaaagtaagaactcgtcgaaacaaacgaaagtgaaaaagggtggcgatgcgtcgagagtgttattgaaccgttatttctagatcacacgggttcgggtcatatttatacccgagatacatgataggtccttgccggacacaactcttatatctaacaaactctaagatacacataagtctttacggtagacttttacctaaacatatctctaaggaaattacataaaatataaaagatacaattgcctatctgagagcttatctccatcgtggcaatccttgtgaagcacattgaccgattccagaaacagttttataaccatctcaaaagaatcggctgcatcggctgtatcggccgtattggctgtcccctgtccgacccatctcagccgatgcagactccagccaatgccttcgcagccgatgcacactctgttcttcgaacgcaatcctttgctaaatccactttgattccagtaccaaacctgatttatatcttaccaaatttggtcgttaacagagggacggttgggcgcggagcgaggggagtgtcggtgaggcgatggcgaccaagggacagaggtcgatggggttgctgacggtgagggaggcgacgatgggcaccaataagaacgccatggggagcttcgtgctacacaacgacatgtgggagctcaggtctggcactaaccccggtgccatgctatggtccatgaagaggaagacggacgaggagaagaagaagagggatttggggtggtgctggcgcggatgaagaaagggggatttagggtggcgttggtgcgagtggtggcggaggacgaggaggcaacgcttcaactagcggcggcggtggcgacaaagtagacggctgcatgcttcctccttcaatttctccgtcgctcgatgttgtgaccgacgatcctccgctgccttcgcccccacgcccgtctccgccgccgacgctccggcccttgcccgcctgctgcccgtcgccgctccaacgcccgttccccacgaacaaccgaagggtaagagataaggggaagagagagtaaggaggaacaaggaaagggaggatgtcctgtgggtcccacaatatattttgtgaatgacaaatgggtcccacatatttttttgttattgtttattctaatgccatataagcgccacgtcaacgccacgtgggatgaaggccaggtcaataaagccacataggcgccacgtagaccaaaaccacatagagataaagtttgcaccggttttgatagttggatgagtcaatatactcggttttatggttggaggtcataaatcatacttggatcataattgagggagtcaaagtatactttttcctcatagattcaccaggcgaagtcatgggccagatcacagataagtctaaatcgaatgaatcacttaagagtgagataatttcattaaatatagtaggataaaaactgtacattgtgaaaatacaaaacaaaaaggagatgtaagatataatttgtgccaggcgtttcgctcctgctagagcccaagtcttggctcttccttgattttagcttcgagggaaattgttgagagcccttttatggtggaagactgtgttcggacctccaggttcccaactcctctcactcgtttttcgcgcgcacgcttttcaaactactaaacggtgcgtttttttaaaaaaaatgtttctatataaaagttgcttaaaaaatcaaattaatccatttttgaaaaaataaatagctaatacttaagtaatcacgcgctaatggaccgctctgtttttcgtgcgctgagttaccaacttcctctagcgaacacatcggaaggagcaaggttctaaactcctctcctaggttcctcatggtgggtttccagctatatccaccaaccgtggattgatgtcggttggtcccaattggtcgggttgatgtgcactctatactcctttaaaagcctcaagttatagtggtaagtcaccttgatattgcttttataaattgttccctaatattttttaatattatgaaatagtacaacatttagtttgaacaagtgaataacagatactaatcaaataaacaaccaagtgatactaagatatttgattaaaaattataaaatatatttgataaaaaatattttgttatggtatattataatattttttctcttttgcccatggtaaagcaagcgtatagtttaacatgaattatgcaatcaacttttttttttgccaagattaatgttcgttcaaattacttattttagttcatttttttgcccggattaatcaactcgatttctgtccaagttcgtctctattgacccatggtgatcatcgtggagatcagagttcatgctgggatttgttagtcagtgacacaaaaaaattcttcagtttgttagtcagtgacacaaaaattcttcagtttcccactctactgagcaagtgtagacgcatgcagagagtttttcagcctgtgctgcttcccggaaccccagcaaccatgaatttcaaagtccaatccacggccaaggacagcagcctgtcgccattcccattcggatatacggaacccacagaattcaacaacgaactcctacttcattgaccataacagaatgaagaatatattactcgccttttgacctgtccaacacagttgatgtcatgtgctaacagtgtgctagttcgttcgtttctttcaaaaaggaagctcacttgaaccttgctggtacagattacagaatgattagcagataaccacagtacggcaaacatgaggtattttttagtctgatacaatctttcgtagaaccgattcagacatgctctgagtttgatattttttgtattatctcttgcatgacaaaaacattgataaatgtccaagtgattacacaatcacatggaattttttttaaagaaaaacaagaattcagcatgcgttttccaagtccaatatcttgacttcccacaggtgacaggtttgctcccaaatctgcactgggtcaatgttttctccccacaagtttgctctttccaaatccatggctccacacaatctctccaccaactcatttcgatatttttctactgaacacatgcgtcaactgctccagccaacacgcaatcaaaatgcttacaaatcaaaccgcctctcgaactatatatagagcagagcaccaaccaaaagaccaaagtgtttcagagaaaatttcagacttcagtttggtgttaagctctctttgtctcggcctctgaatctctctgaactttctgatgtgttcgtggaggagacgagttcttgccgtgttcgtcgtcgtcatcgtggtgatcatggcggtcgccgcttcccgtgctgacgcggcgaggccggcgccggaggaggcggaggagcggctggtggactgcggcgaggggggatacgagtcgatggtgtacccggcgatggtggagaaggccaaggagacggtggagctgctgctggcgaggttgccggccggaccgagccccaagggacccggtcactgaagatcatagtgattacatgttctttttttttttcacttttgttcatagtttgatttctcaaaacagagaaacaaaagatattcttttttacctgtatatgatatcagtaggaatactggatgtaattagacagtgaatttactgattgctacgaaggttaggattctttgatatggctgctgtcattgtagtcatgtgttgtgtgttcttgcccattcgggagaatcggaatcaccaacgaaaactttagctctgtttcatgcctcgaacatatcgaaatatcgagggagtgaaagtctagaattaaatcattcaattggggctagaggtttgaacaatgatcaaaagaggggaaaaaaaggaagacaggtgacaaaaaaaaatttaaaaaatgcccccacgcaggatcgaactacggaccttcagtttacaagactgacgctctaccactgagctataagggcgcttcttgttgaatgattgtgtatttctaatttatacttattttatatttgtgtcgacaagatgcacaatttgttgaatagaatctctccgtagcttgaatgcataaaggttttcttctaaaagataaaatgaattgcatagatgtacagtcaggtatgatcatgtggcttttctgctgcattttttcttgaaacttcgtttatgggtacggatctaatcttcgcatatgcggtagatgagcaacgcggttatgagtttgcttatccaatggtgttttgattatctctctctccagatcaatatccaaacgacttaacctgacacggactcggagtcggactccgagtctgatttccacacgagttcgtgccctgataaattcagattctggcgctgatgagacctcaagcaattcggaagctagcgcatcgtcgccatcgatcagagggcattgccgccatagccaccttcgcttcttcgtcaccggcggccatggcgtccctgtacgctccgcggctgacgaggtggcgcgtcgcgacgtccggcggcggcgtcgtgcgcgactgcgtggagtacgacgggaagccgctcttcttccggcgcgaggactgccgccgcctcgtccccgacgacgaggaggacgcgcgcgagtgcctggagatcgccggcgaggtgttcccgctgatggaggacaggatggtgccggcggcggtccacggcggcggcggcgtccgcgaggcggtgcggtgcgtggagtacgtcgacgacgacgacggggccgtgctgctgctcacggtgacggcgacggaggggaaggagaaggaggtggcggtggtcgacggcggcgaggtgcgggtggtcgacggcggcggcttctacgaccccgactccggcacggtggagcacgtggtggacgtggagggcgcacgtgaggcgtacgtgctgctcgtctccgttcgcgaggagctcaaccgcatcgtccgcgtcaagaggctcaactgatcattattctactaaatccctaggaaatttgatttgtatttgatagattcttattgtttgtggggaagtttgtaacaagttttgtgcatcgaaaccctctgtcactctgggttctgatttgaagaatgatggttctaattaacttcgaatcatactgaaatcgtcacagttctagttagtacataccatgctaaaaggacatgtagtctagtggttgcagtgtcctgagtagcacccaagattctaagttcaaatatgcataggagcgaatttcagattgggttatttgagaactagttttctcttcgatagactaagtttatattaaaaaaaggctaaaaaagctacatatatccggttagatatagacgccgggtaaaaataccttctctaaaaaaatgctgctgttacatgcttgttttaccatagagacatgaagaaattatgaattcatattatttgatagaaccccacgaattcacagtgcttgtacgacttttatatattacaaataatttaagaatgcatatactcaaaagctttggaattttgttacatgtatccgtaatcaaaagacaccaacttaattactctgccactgtcaatgctcgtcccgcgcgcggcggctcagcggcttccagctcctgcagctggctcgcctgctgcgcgtgccggtagatcgccggcggcggcggcccggtggtgccgccggcgccccacatctcgatgtcgtcgtcggtggtcgtcgggctgtggtggtggtggtggtgcgccgccgctccggcgacgttgtggacgaggcagcgcgccacggcgcagatgagcagcctcgccgcaacgacgacggcgacgacgatgagcaccgccaggaagtagtccagcgccgaccggtgcacgcgctggcattcggcgacgctgatgcaaaccattgctcgcttgcttgctgcttatgctgttgtgcatgcaagaacaagaagtatgtgtgcgagaagttgcagggacagtgagtgaactagtagctgatgatatatttttgggggcgtgatgaaaagctggagaagatttggattcgttgcttgggttggcaagaggatagagagatgtttgaacctgtaccttccttggggcttttgggatctagtcgcatttcagacagcgattgatcaatggcttttcagaatgtctttctgggaatggatcagccacaacttttaaacatttagtacgggagatcgacggagaagctatgattttcttcatcgattccaacttaattacatgcagttacaacatgtgagttttattcccagtcttcttcatgcaacagaatacagctgaattttgtaaaatccagctatgcgaagccgccattactgtagtttggatgtgaattttcatccctcaaggggacatcctctcgttgcttcgtaatttgcttgtcatctaaatagttataaaaaaataaaaaaaatattaatatagattaatatgaaatatatctctccataaatatacaagaccaaattcaacttccataagttgtaaaaaaaagaacaaattaaactgaaaatagttctcatacattcacagttatatttgttattataacttaacattatttgtgaagtgatatatttcatactaatttatcttgtaaaattttttaaaattttcataactatttaggtgatatacataaaaacattttccatgtagtttgtccaatgtaagaaatttaccatgaagctcaaaaccagtaaacaggtgtagtttgatccaaactccatcaccactgtaacgtacgatcattcgatcaaatggatgattagatgcaggtggagatcgatcagctagcgatctacggactggaggaggaggcgagagcttcacctccggtctcctcctcctcttctccgacctgatgggaagcgacggattcagatgccgcgtcctcctccttcccgtcttgaatccgctgcggaacgacgatccgctgcctcttctccttcctctcaccgcggcaggtggtgatggaggacgccgtgtcctcctcgtcgtcgtcgtcctcgtctccggcggcgtggcgcttaggagggcggttgagggggagggggtagccgggggggaggaagccggagaaggccccggacatgaagtcggccggcgagggtgaagccgccgccgccgcgggcctccgtcctgagcgtgacgcgctcgtagaggtcggccctggcgcgcgccacctcctcggcgtccgtgctctccctcaccaccttggatagcctgcgctccttctcctccgcctcccgccgcgcgaacacgttccggtggtactccatccgctccgtcaaagtttccctcgtcgcccactcgtctatcggcggcggcggcacccagatccaccgtagatactcgcgctgccccatcagcggcacgaacgtccgctccatctcaagattgatccctctctctttcgccttagattattggattggattctgaagatttttctcgcgatcacaagtttgtaataactgacttgctaatctgatgactcgaggctgactcaacgactgcgtccgattccgatatacaccaatccgttcaggccgcccgctccagtttttggatcgaaattgtgcttgcagtgacaatattcatattactagcaaacgagatgtgattttcctcgaggaacaatatttttcatacgtacgtatccaccattcatttacacaggcaaaactgcctcgacctacaaaatgttttttttttttttggaaaccgatcgatcgtcctacaaaatgtcaaaacttccaaagaggacgtaccaacagttccaatctacccatctcattccttgggcgttcaaatagtcttctgcaaatgcaaatccagcggtatgtgagggcgccatcgttgaagtttgtcgaatggaagaaagcgtcatggagctcaatgaatcccactaaaacaagctgcacatctgaagcaccacatatgcctttggcaggaaatgtcaagaacttgatccagttcccatcactttgtggtaaacttcgattgggcggtcaaaaccagtaacagcgccctccagtttgtccgtaaccacctctaccgacctgaatccgatctgcaaggaacaatgcatggtgaggcaaaaattctgttgctggggccaagaactgaacatagaattcgtggctgacattagaacataccttgtctagaagtatctcccggaatttatctggatgtattaggatggtattgaagttctctttggcaacctgaaagatgtaacacaaaaaagagtgaggtattgcaactttgcacgataaaaaaaaaactgcggtcatggaagaatcaaatgtttaatgaggactaagatttctgccagtatgttcattctagtaatcttaagattgaaataacagggggttaagaaagcaggtccagtaagagtgaggccccaacatactgacgataaagccaagcaagcagctaaaaccacaaccgcaactgtagcttttacacaagcaaggggctgaaagtaaaataactctagccttcaacaactgacatagaaacacaataagcatttcaaacttcaacgcgatccagaaaataatcaactgggtgtcagagatcagtatggcattggggaaaatgatacctctgaaaccaatctgtttctcctatatgaggtccaaggttgaggctccataataaaaactccaccctgaaaaacaagagaatccagtgggaaaatagtttattattttttttcatcttatcattgacatctactttaccaaagcacaggaaacataaagacagatagataccggtcttagaagtctccagatcttcacaaataaagtaattatgccatcgtcaccccagttcaggtggatccatttggtcacactcaaactgcatgagaataaaagcatataaaaacgcatgtgtcaatatgacatccaatgtgggtaatgatggcaattttcacaaatatgttgcaatataaaaacgacaaagtgactattattaatgacagcagaaaatctatgagatctatattataatttgtaacttaccaaacaattgtatcatactgttctgaacttgtacacatgctgtccacaaaattctcgcgacgaaaagaaacaactttaaaaatatcatgatgactgccattagaaatatccccatttgatatctcaggtgccactttttccggacagctttcagacggtgaatctgatgacttgtgagccttggtgttttctacaaccaccttatccagtcgagacatccttcttaaattccagttggcagtttcgatcaaacctaacaggacaagatcaggatcagtatagcaagaaaatagctttacaaaatttataacaatatgtttgcctaggaaagacatgaaacattagttaacaaacctgaatcaatatcaactccaagaatgctttggcatttaaatttcgcagctgcacaaggttcacaaataaaatgagaaaccatactagtaataaaatttaactaacacagacatacaaagtatcttacagtaacacatatgaatagataaaagaatatatactgcaaatagtttaaattttaaataccgtctctgttaacattgatacagaattcccaattctatttataagaggtacaacaacgtaactgtacaaccatacaattatgaattagatatatcatttttgttcaaatggacaagacagatcatcaaccaaacaaaatagtactaaatattgcacaaagatgatttacctagaccaatcgttaccaaaccctggttgcatccaatatcaagacaatccttgctttcaaaccactctctcttaaatattttaagacgagggtcttcatcaacattacggtcaatctgtagaacattagaagaaaggatgtataagctaatagagagacatcagaagagagaatttatcagatgagaacaagataaggattgcagtatccggcgaaaacaagataaggattgcagtatccggccatcgaatgggatttatattgtactaagagaagtaccacatgcagcgctgcaagtagaatgtgaaataaacccttcccccctccttgtctgaagaaatctacagtacactttggcattggcaaatcttaaggaaacaacaagatctaactaggctccctgatacttcactccttccttcgccaccaggtgtacttatgatatgcagggtatgggggcacttcctcgacctacttatgttatgactaaataatcagtcaaagtaaattagacgattttgctttcctgaaatagtgaaatttgttgttcacttggatacccgacacaatcattctgataaacaacaaaatgctgaactaaggaaacggaatagaaacagaaatttgattatctacattctacatgcccccaataaaagaacctaaactggtctactgcaaaccacaacaaattaaatcagaaatgacaccactgtaactaaggtacattctaagcgagagcttcgactgatatccattcagcgttccaatccaaacccatgaaccatcccaatcccacgagcaccgcgaccaccatcgaggcattccatcgaacagttggtgcgctcatacacacagcaacgatctgcgcgcccgcaagagaagcgacagggggaggggtgggtgttcactcacccggtagccgtagtagttcctgtagttcccgtagacgaatacctccttcctcttccgcttctgcccctgacccccgtcgccgcggccgccgccgcctcctcctcccccacgccagttgctctgtttcctcttcgcctctcctttagcccccttggccgcggacggcgcgtcctccggcgcggtggtggtggccatgctcggagaagagacgcctctctcgccgccgccgccgcggcgcggttcgtgcgggagctgaaacgagaggggaacagcgcgggacaaagcggcgagaaggagacgaaaccctcgccgccgacttaagaagaagaagaagttcagagatagcccttccaaaatagaggtccagttaggcccatcaatatttgggcctatcgatgtttgggccgtaacctctcatgcatgtgcaatttgatgattaaaggatttgcacaatgtacattgtataacagagatatgctttgcattgtttaagatgaaggaagatttagttgtgaattactcgtgttctgattttttttctttggttgattttttttttctccaatccaacgcaagctaaattttttttactcatgctctgcccctcgcgccggcggccggcctgccggccttcccgagtccggacggcgccgcgacggcccactgcccctcgcgccggcggccggcctgcccgccttcccgagtctcgacggcgccgcgacggcgcagcggcgctctgcccctcgcgccggcggccggcctgcccgccttccgagtcccgactcgcgccgtcgcggtcgcaccgcctccggcctccccgacgcgcatcggcgcgcgcgccctgcctcggcgcccgccgcctggccggcatcccgcatccggcggccctccccctccggtgagcacggcgccactgcttctccggcagtccggctctcctctccctcagtccctctactctcccccttgcagtagtcagcaggcagtactacctccttcaataatcaagttctttatatccatgattagccaattggggatatagtaatttgtatagattaccacaaaattgtgcgccacaatgaacctcatatgacttttttgcatggtgtgatggttgttaggagattgaggaatgaagaagtcaagcagtgtatttctttttcagaagcatgaagcaaaaaaagttgatgaaggggcaatttacattgtcatttaggtaaattttaaacttatttattattttctacttgtattgaactatttagagttatatacccgtatcgttttacagattttatatcgaatcatgatgtattgcatttagatttttttcgctaggcctaccctaggttcaaatcctgggtccgccactgcctaaattacccaaggacgcggtaaggaaattattggactcagctattgggcttcttcatgagcctgtaaaacattagtacaagtcgccacagaaatatccgattgttagggagttcggagaagaaaacaccgaaccccaaacgatcacagagcagactgcatgtcatgctttcttctgttcagtcatcacattgatcagtatttctctcttccctaatcactcaatgacgacatgctatgtctgaattcctttttgtggagttcccttctgagttctgaatgtattccctcgttgattgaatcgagtcagattttagtttttttttccttcttctttcagtgccggatagtcttcagtgcaaggaattaattaagagcagacaatagaaaattcagcgagagtgttcaccattagccgaccctcctccaatgcctctccgctgtgcaaacgcctgcaaggatcagtgtgttggatgcctgtactgtatgctgttcgattatcccgtttgcatgttgcgccttcttctggtaggcgaggccatcagctgaatcaaacatcactattggagcaatcaaacatcaccattggaggctggagctatagtttagtttcctgtttgtaaagaaaaagtgaagaatgttcgtgactgccgggggtcggagaataaaactccgaaccccaccggtgaccgagctgattgcatgtcgtgccttcttgtattcttcagaaaagccaaacgaccagctgatcaactatcagatcagactttttgtaattaagtaatttatttctcttgtgaatgtgttctctacgatttattttcgaagagaactctaaagaaatgcagggagttcctttttttcattatagaataacagtcactagtacgtaaccttccatctctaacggcctctaacatgcttagaattagcggactgtcataagaaagtcatctcaatcgggccgaaaaagcgcccgattgagataacgcaggtccgtcacggatgacacatatcatccgtgatggacaccaacttggggcccgattgagatatggaatgttatctcaatcgggtctaaactacggctcgtcactgatatgtgtcattcgtgacgggcctgagttttatttccatctaacatgtttgtgcgatcatatctcaacaactaggtgagagatatgtgaattttatgaacaatattactatcactttgtcggatgaaaaaatgaccaaaataaaagttatagatcttgatgagttatacaactttgttgttaatgactttttcagttgaaatcatttagaatttgaaattgttgtttgaagttgttatatttttaaattcaaattcaaactattcaaaaaatattatatagaaaaatgaccaaaataaaagctgtaaatgttgataagttatacaactctattgttgatgacctttccatttgaaatcatttagtatttgaaaatattgtttgaagttgtcatattttcaaattcaaattcaaactgttcaaaaaatgttatatagaaaaatgaccaaaataaaagttatagatcttgatgagttatacaactttgttgttgacaatatttccatttgaaatcatttactacccgaaaaattatttgaatttcttatattttaaaattcaaattttatatagttcaatcaaacccggatgaagaaatgaccaaaataaaattggtagatctcaatgagttgtacaactttgtttttgtttttgacagctttttcgtatgagttcatttagtatcataaaattcaattcgaaatttatttttgcctagaagtcttatttgtctcctcatcatgttaatacttgctaaatatatattaactcagttttgctggtgaaatatgtgaatggatgtgaaatatatgatcaaaatggatgttatgtgaatgtggttgtgttaaatatatcgatggttgtgtatgtaaatgaatatacaacttcttcttaggaagctgatctccaaagaactctgaggttaagcgagccaagggtggagcaatttcggaatgggtgatcgaccggatgcacacgagtgaggataaagtacgcagaaaagactggcccgcgggcgtggctagcaagctataatttaggcccgttagagatgagagtcatccgtgacgggctatagtgttggcctgttagagatgagagtcatccgtgacgggctatagtgttggcccgattgagatgtgtgtcatccgtgacttaggcctattagagatgagagtcatccgtgacgggctatagtgttggcccgattgagatgtgtgtcatccgtgacggccggagaaattttctcacatcagtaacctttgctcagtgacggggtcctgtctgaaagatatgaggctttaggctcgttagagataactgatcccgttctagtaagttaatccaatttacaaaaggaaaccatgtcttaaaaccttacaaatgttcaattaatttggaagaaatccagcgaaaacctccacggagcaaataatgcaatagtcccaagcttaatttggaagaaatccagcgaaaacctccacggagcaaataacgcaattgtcccaagcggcatacccaccacaactgacgacaaccgacacaagtcaccgttgctaagattaaagccaaagaccaagcagctccaacttcctagggttatcctcaacccccacgatcaacaatgctgacaaaagggatatcagcgattaatcaaagtggaacatgaccttctaaacagagcctcaaataaggacataacgtcgaggacgttgtcattgcctcctggaactctaggactaggttttcatataaaagcaagagagagaattcagcacgacaacgcctccaacgaggaaagcggcacccatagttgttgccatcaccggtacctaccaaaactagggcaaggcttccgtctagtcacttcctatcaatcacaccctcctcaagtgtttcttctatgtggctagaataggaggatttaagcaagaaatggcagtgcaactatgcaagcaggcaacaccatcctacaccaagtaaaaataagggaaaacctagcctatagtgaaagagagaactcattgtcctctacgcatcctttgccgccgcgcacccggatctagccagagccgatcggtgcctctccgtgccctggcaactcatgcttgcaccactcgtgtgatcgtggcgttgctactatgtgcggccttaggccttgcgcccttcaactacctgaacccatgcaatcacgcctgcctaacctccacgctccacaccgactagccacctcgcggttgtgccgtctctctccacatattcatacctccttgttacaggccatcgccccttccgtactacgctgatcgggtcaagaaacaacagatccaaccggagggacattggatctagttgtctttgtgcactagccggccttagcacgagcaccttatcaagtatatgactaatagccaccttttcctcgtccaactcccctgcacaccattttgcctccttggccgcttaagtagtgaccttctccatgagtcacgagagccttatgacgtagtatgatgaaggaggaaaaaaggacgcctcgccactaccattgtccttggctccttgaagccaaatgggctccagctggactgctctagcagtagcgatggggaagaaagaaagatcgaggttgcacactaggtggtcccatgggagtgacgcacgggcttttatttgtttctatatatttgagttcactataaaacactaaaagattacaccatatatagatttacaaaggacttttgctctaagcgactttagatacctttatttatatagaagaaaacaaagttcttgttgagaagtatgcgagtgatacctgcattttatagttcaaactttgtatatactagttggcaactcggtatgcaaacaagtagtgacgaaggcttttgctttgtatgatacgaaaagggctcctctaacacactactattctctaacacactactattctctaaggtaggtcgctgacatgtgaacccacggctatagaattcacatatcagttactcaaaagttactcaaagttagatgatctatatatgcaggatagctggggtgagatagcagcagcagtagaatacagctgttgtcttcatctcatgcagcttagctatgaagctaggtaacgtacgtagcggcacatattccgattcgcatagcatagcagagtagcaacgcggcacccgaaacacgttttacaccgcgcaaactctcctacaacctgtacccacccggattcctacgcgcctcccataaataattgctacgctctctcccgccgcatgcactaattaaaaagcccacacgcgacgcgacacgcccggcgagccgcgcgagcgcgacacacacagaggaggaggccgcgcgcgcgacgcgagctcgccctctgcgtgcgccgccgcgaggtcgccgccgccgccgccgccgtcgatcggcgcccgatcgatggggggctgctactccgcctacgcctcctcgcgcaagctgcgcggccgcatcagcaagatctccctcgtcatccccgacccggtccccgacgccgaggccgcctcgccgcgcaaggacggcgtcgatggcgacggcgacgacgtgaggggtggtggtggtggctgtgacgatggcggtgacgtcgtcgccatcgcgacgacgacggcggacgagttcgcgcggcggtacgtgctggggaaggagctggggcgcggggagttcggggtgacgcggcggtgcagcgacgcggcgaccggggaggcgctggcgtgcaagacgatccggaagcacaggcgcctggcgccgccgcgggtgaccgcggcgaaggcggcggccgcgcacggggaggacgtgaagagggaggtggccatcatgcggcgcatgtcgtcggcgtcgtcgtcgcgcgggggcggcgccgcgtcgtccgccgccgtggtgcggctccgcgaggcatgcgaggacgccgccgacggctccgtccacctcgtcatggagctctgcgagggcggcgagctgttcgaccgcatcgtggcgcgcggacactactccgagcgcgccgccgccaacatcttccgcaccatcgtcgacgtcgtccaggtaataatcaagaacgaacactacacatcatcttcttcttctcccattgatgcatcaaatcaaacgagtaatcactaattaatcaccaacaatctgtgatcgatcggtcgatggatgcagctgtgccactcgaacggggtgatacaccgcgatctgaagccggagaacttcctgttcgcgaacaaatcggaggactcgccgctcaaggtcatcgacttcggcctctcggtgttcttcaagccaggcacgtcgatcttcagcaaaatttccacctctcatcgtccatgatttctgtcaaatcctccatggtttctgaaaccaatcaaatgttgatgcaggcgaccggttcacggaggtggtggggagcgcgtactacatggcgccggaggtattgcggcggagctacgggccggaggtggacgtgtggagcgccggcgtcatcctctacatcctcctctgcggggtccctccattctggggaggtatatactcaccttaattacctttttttttaatatacaatgtcattgatttttaaagatatgtttgataatttttttgaaaaaaagattatgtgattaccgcttattttattgtgagtttattgttaattattctataagtatgacttaaacttttttttatagtttgcaaaagttttgaataatacgaatagtcaaatatttataaaaaaaataacgggatcatatcttaacttccttttttactatatatatgatactatttaactttttagtcatgttcaatcattttaccttataaaaatattaaatatttttcgtttgatttatcactaagaaactttaaacattatttatgttttaaagatttacatattttttttaataaaacgaattgtcaaatattaaaaaaaaagttaacggtatcatttattaaaaaaatacattaccaattcaccatgatgatgcaaatcatctcccctgtcaattcttgtcatgaaaaaaaactataactgtaatcttgtctgaacttgcaaatgtgcagacaacgacgagaagatcgcgcaggcgatcctccgcggcgccatcgacttcaacagggagccattgccgagggtctccgccaacgccaaggacctcgtcaggaggatgcttgatcctaacccatccacccgcctgacggccaaacaagttcttggtaagtaaacaacttaatcaaaccttctcaatgattcagatatacacatgattactggaaatcaaacatcattttgtttgtttcgtcgattggttttgaaacaaaaacagagcatccatggctgaagaacgcggacacggcgccgaacgtgtcgctgggcgacgccgtgcgggcgaggctgcagcagttctccgccatgaacaagttcaagaagaaggctctcggagtaagtcgtcgagttgtctcattgcttctgtgttgcgatgatcttgatgggtcgccggagctaacaacggcggtgtccggtgaaggtggtggcgcggaacctgccgggggaggaggtggacaagtacgtgcagatgttccaccacatggacaaggacaagaacgggcacctgtcgctcgacgaactcttggaaggcctccacatcaacggccagcccgtccccgagcccgagatcaggatgctactcgaagccgtaagctttctgctcatctcctcgatctcgatctcagaatcattttctttattaagataatggaagatttttatcgagctcattcaattacatggagaagatctcaaaaatcatttttcttgagtcttgatctcagaatcattttcttttaagataatggaagatttttatcgagctcattcaattacaccgaggagatctcaaaatcattatttttctgaagattttgttgagatcatccaattatatcgagaagatattactgtaaaccgttgaattgtgatggatgatcatactctcattttctcgatctcaaaatcgttttttaaaaaagataataaaatattttatcgagctcatccaattacatcgtgaagatataactgtaccgttgaattggggtggtcagaccctcgtattctcactctcaaaatcgcttttcaaagataatgcaagatttttatcgattgaacttattagctaatttattgattacttgtcgttttagacaagtaaacggtcttaaataaacaattatagccaccattttctattacaatatatatatatatatatatatatatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgatatcatggtgccccatatgagtgtcctatatatatatatatatatatatatatatatatatatatatatatatatatatatatatatatatattagaaaaaatattttattgtagtatttttaagactaatttctacatatggtctctacatttctacgatttaagaaagtttgaccaaattattatccaaaacaataaatatcatcaactcggaggtattacatcgaggatatagtaagaagatgagatgatgaatttgcaggcggacacggacgggaacgggacgctggactgcgacgagttcgtgacggtgtcggtgcacctgaagaagatgagcaacgacgagtacctggcggcggcgttcaactacttcgacaaggacggcagcgggttcatcgagctggacgagctgcgggaggaggtgggcccaaacgagcaggccatcctggagatcctccgcgacgtcgacaccgacaaggacggccgcatcagctaccaggagttcgagctcatgatgaagtccggcgccgactggaggaacgcctccaggcacttctccagggccaacttcagcaccctcagcaggaggctctgcaaggatactcttactccctgatgatcgatgatgcccaacaatctcatcaactttgtttcatcaaggcttataaactgcacatctttcaccttcaccagacagggataactagagagagatacaagaccaacttagagaaatgtattggagtggcaacacgatgcgatgctgcgcttggattgtgaaatgagaaatggaactgaaatggggatcgtaccggttttgctactctttcggtaaatgggtatttttgtttgctataatatgcacacaacatcaaaaattccatccatcaaaatatgcagctcgaacgacgaatctataagaaatcaggtactgctgagtaaacaccagtttcccacatgatttatcaaccatagattatgacgagctttggtaatttacatgaccgctcaatagataagagctacatctaccattctccagcttcacaggttggtcagtacagggggtggaactttacccaccacatcatctcatgtcatttaaacaaaaacagaacattgcccaccacattaacacaactacagaccataactaatatgtacataatataggctagaaagtaaaaaaaaaaaagactaccacatgtttgtaccccatccaccttcgctccatagtcggtcctgcattgttgctgcaatctagatacaaccagggaccttcactcacacatgtacgccattgctgccattggaagctcttcttcaacgccacataatttaggaacagaactacaatcaacaatcttctcatgagctttgagtaagcacccaccttctcaacagcttcgagatttatggggggcactggctttcagccagtttttcatctagtatctatgcttatcgcagacgctgcatgcatccaccgatgaagggttaataaacgtgcagcgctcacaaggccagccttcatctgagttgtccgaagatgttctaggaagctgcttctttgttttgcctttagtgactgctttcttggaggggatgttggtggcattgcttgatgtggtaccctgggcagtagatgtacatcctccaagccagcctccagtgcttgaacaaggttctcaaaataattccgagtcacactgcagtggagacgaagcaaagtcaacatatcgtaaacaaagctcatatgacaataaagaataggcaaggaagctgctatccatgagcatagacagcatctcaagaccttgtaaaatgctagcaagtaaaaacatttgcgacaacaactaccaaaatcaaagaagcaagtctagggtcaacaagtaaagagcatagctgaaatgtccacctctttgactgtttgactactttacatgatggattaatactaaatcattaccaagagaaaggtgggcacaaacaaagttcatgtcctttattagaattataaaatctcaggcttctaaaattctcaaatggcatttaaattatggcataattagttacattcatgtgaacctacccaaggattgttaagaacaatgtaagaacgttcaaggataatttggaaggagcgcaacgccaaaatctttcagcacaagcaacacaccgtggagcggttattggaagacatcaaagaagaagtttcggtgtggacgtctggaggttattttcatattgtgtaagacatcaaatttttattgtagccttcagccttttctgtatggcttcgattgtttgggggacctgtccccaccctaatctcgacatcctactgtcgatataaagcccatttgtaatttgttccccttttccttaatgaaatttggtcgaccgaacctttcggccgacccggcaaaaaaaaaaaacgttcaaggatgaagaaaagcaaacccttgggttcatcctaaaaactagtactaattgaaacaagagtaactatcttaaagcatgcagtagttgaatatggccaaacccaaaaggatataggaaaaacaataactgtgaaataccttgtcagccccgcaagcttcacccggaagtcaccgaattcagcaattgatggtgcaggttcagtattatcagatctcacagtcaaaaatgattgcaggtctttctcagcacattggtgaagacgctccagaccagactcagcttcacctataaaagatataatatacataccacatgatttttggcaagcacgtggtagaacttaggattttattttggaatgcaacaaacaactaccttgcaggtactcgaaaaattcgctcttgaccttgtcgtccagataatagccataagcatatgtccatttgagtacccgcctgcattcaataatctgaaatagacatagtggaatggtgcatgcatcagacgcaggtgaattgtatagtatggagtgtcatttgggtcatgacatatttatgatatcaaacctgtgaccaagcttcaattatgaacttcagttgggtctccggtattccaaaaacatctgttaattttgcaagctgtagcacatagagaagaaatagagttagcagctatcaaatataaaatacgaatgaatggcgaagataaacaattatgtcttgccctaaatgcaacgcccccaacctaacatgatgcgaatgcttacttgttccttttctgccttttgcagatctgcttgtgccttctgcctcgactggcaatataagtgaatatgtcagtacagaaacttgcatactacagcagaaaaaattccaagttcagaatagaacaatgcagaacattcatcccaagcatgtacagtagattagaaactatatacccatcaggtatagaaaaacatctggaactgtatttttttatatcatgaactgataaggtaatacaacataaaaattaaaaaagagcatttattagcacttactaccttcatcccataatgttgataggatgacccatcttagaacaacgaatctggacatgaggaatgtccaaattcgttgtcctaggatgggtctcatcctatcctaggttgctacattctaggacggagggagtaagagataaacttggcaagtaatcttcaaataaagctgcagctagttgggctacactcggtaggtaagaatttaagtcaaaattagtatctgcccaagcatatggccaacacaacacttgccaagtaaaccagaaggttcaaaaacacagagtaagttatgagcacaagaatgactaaagctgcacgtatagttgttgtagaaagaaaaaaaaactcaaagagacatcaaacttgagcatgttgaacataccgtctgattagatgcccagcgctcatagtaatgcatgtatctctcaagtgaatttttggctctttccctccttgcttcagtctcatcatactgcattagaggtaattaagttaggaaaaagtaaccgttatgattctatgaatgaatgaactaattgaacaaactgtcaatttggactcgacattgacttgtgggattgaaacatttaattctacagaagcaataacaaaatacacaagacatctagaaactgattccttctactaaatgcaattggatagtctcaagataaaacatacaactccctccttctttgctgattcatagcgattacaagcgtaaaatccaccagttctctccccatgttcagcccatgaacccagacataacctgaaatgttcaaagaaaacaaatgagaggtacatacactagtaatatggacataaatatttcagcaagcatagacattggactataccagcagaactcaaatttgcaaggtggagtgcaagtcatatgcatgcatccctggtttttctctattggtcgtttgcattttgggcacggcttagaattagccagtatcctgaaaaggatcatcaacaacatgataaaccatctgacatgattagatgatttcaagcaacataaagaccttaaatacatttgagcatcatggactagccatgaactgaagattggtatacaattctaacagcattgtataataggcaaacattcctgtaatgtaaacatggcaaaaacgcttgagcagcataatgttctcactagagcctccacaagtttttccataaaaagaagtcatcaattgataaaaatggagtcaatgccaagtatttaacataaattaagaggtgtttattatgaggtttaagccacagtgccacatataatacatgttttccgtcataatatattgttaaaaaacaatgcatcagcccttgcagccctgactcagcaaagagttaatagtgttcacagttccttgcatcctcaaatcttctgcttccagaccaccagtcacacatgaggatgtccacaaagtttgatgtttctgaatacataacatctgaatatacgtacgtaaattaaatgcacaatttttttcaccacctcagtttttactcataaccatgaggaaagttagaagatagctgcaatattggcatcaaggataggttaaaaaaagaagtaaatatacaacacaaatgtttgaacatagatttatctccacaaaaattaagaattccttatctatacactatccgtacactatggcttaataaagttttgagcctgaaccataccagttcatattttcagattctgcgctattctttaatatccacctagaaacagtctcacagttcactggtcgatgagcttcctccgtgcactgcaaacatcaccaaagcattgatgaagctccacacttttcatcactagcaataaaaaaaagtagaat

SEQ ID NO: 63697 - DNA, 1257 bp, Oryza sativa
ttgtattagttgacatgactgctaagtttcgctcattattcctattactttggtgttgcctcttagggaattgctcaaggctgtatatcgggcataagctcgtttgccagcatattagctccactaatttttacccctctaacaggtatttttttcatttgtaaataaatcctagtttataacccttgtttcctttaatttactccatagcttttgctttcttgcggcagcatgggtcctttcagaaacagcgccattcaaattcaaaggtttcagtatcatgtgtgctggcttttgtacggtaagatttcaactgaatatgttcagtgcacactttttatgccatactaagaatagagtatatctactctgcagctcattgccttcattatcagcatgaggatgcgagcagggcaatctggtgcaagtgagatgttggccattgtgcagcatgagcaagcatgatgagtatgctagtagattgtaaatttggccaacctgaaaccattgtaaatttacatactgtacattgtaaatttggccaacgtgaaaccatcccattgtctactatcctgatgggcgaatgactattcccctattcctctgcaaatctccatcagggaagggaaggattcttcttcagatagtaaattgacaactgctatgtcatagaagccagcccagcttgttgtaatatcacctagtagtgtatattgctggaatgatggcctacatatttcggccggagcttcagacatgagttaatgccaatggtagtacagatttcaacagcaagtaaaattttctagaattagcaggattactgttagcatcaacacttgttccattacaacggattggattttacctcgtgttaccaatactactaccacccccagaagtctagtttcagagcttccaattaacaatccacgcccacggtatcgacgcagcgtctgaatgcaagggcccgtggtcacctcccgtcgtggtactcgcagtcggcggcgacgccgtggacgggcttgccgaggcttgcctcgcggacgtcgaggcggcagaggacgcggcggtagaacttggagcggacgaggaggccgaggatgtgggcgcgcgcccgcagcacgaaggccatcctgacgggcaccaccgcggggccgaggcggccgttgttgggcttgctgtgcagctccgcgccggcgccgtagagcggcacctgcttccccaccacggacaccgtcaccacgcgcccgctcc

SEQ ID NO: 63698 - DNA, 715 bp, Oryza sativa
aggatcaatggattggatcatcaattctaatcagtgagaaggatcaattctaagctattgggctaaatacctatatagggtatatacctggatcggagcctccattttggctgggccctaggccatcgcccttatggccctgctccagagccggccgtccggcggggtgccagggacggtgcaattcagcctgccgccgcagtcgccggacttggagctggcctgggcaaagaccgtgttgccactgccgctgagggagcatccggtgctcgccagatggtgacgccgggggaacacgttgacggcccacacgagccctggggtgaggtgagccattagccgccgacgattgggagggcgcccgcgcgcaccgtgaaggtgcagttgttgacgatggtaacggtagcgccgcaggccaatggctggaggatgagcggcatcgagaaggtaaccggtgaagttggagactccatgctgtgaactaccagtgcgagctcaagcgtagtgctagcgtttgttgttatggatttggccgtgattgtgcaagcgtttaaacggtgtatgtgctgaccaagagctggaacatggatatggatcatatgccgtggacctgaggttgttaccgttttttttttttgacaatttggtccttttaaaaaacttattttgaaaactaaccctcgccaaaaacttcaaccaaaaatagggctgcagg

SEQ ID NO: 63699 - DNA, 729 bp, Oryza sativa
aagccagtctccaaagaactccagggttaagcatgcttggcttggagcaatttgggatgggtgaccgaccgggaaattcttcccgggtgcacacgagtgaggacaaagtatgcagaaaagatatgtgttggtctgcttggcctggagcaatttgggatgggtgaccgaccgggaaattcttcccgggtgcacacgagtgaggacaaagtgtgcagaaaagacatgtgttggtctgtgagggcagtctatgacctatgaaagctatcagatgtaagcgggcccggcctgggagagggagagaggacgttcctggcttggggttgatcgacgggggcgtcgatctctcttaagggggtgagggtgtaacatcccggcctagggcttaataggattaataaaatactcatatcaacaagttacaacctatgaaagctatcagatgtaagcgggcccggcctgggagagggagagaggacgttcctggcttggggttgatcgacgggggcgtcgatctctcttaagggggtgagggtgtaacatcccggcctagggcttaataggattaataaaatactcatatcaacaagttacaacttcttttccggaagccaatctccaaagaactccagggttaagcatgcttggcttggagcaatttgggatgggtgaccgaccgggaaattcttcccgggtgcacacgagtgaggacaaagtatgcagaaaagatat

SEQ ID NO: 63700 - DNA, 1906 bp, Oryza sativa
actcttgaaggttttgggctttttcagcaggtgaggaaaccgcagccgcacaccattgcctactacctgcgacactattctggcttgtagctcgacagccgaacatgtcttttttcccctaaaattcttgaaaggagtttctttagtattgttacccgataccatacacatggcagtatatatatcatttagatcttagcgctacgaatgtaatttaaattttcgcgcgcaatttctatacattatttttttaaaagaatatttttctctcgagaaaagaaaagtaaaatttgcggggctcccaaaattgccagcccgtctccctctcctcgtttcctctacctctgtgactctcttctttttttttcgtcagtctctcctctattctctctcctgtgtttccggcggaggcacgagcgcacggacagcctcctccccccgcctccacctccgcgcggtcgccgccggcgaggaggcggcgccggacgagctcctctccttccccgccacgccgtagcatcctcctcctcccccgcgcgcgcgccgctgggcgagcaagtctgggggccaggagcgagcggcgcggcgcggcccggccaggcctctcattccaccaccaccggcgcccatctcggcggctcggatcgaattcagaggtgattcgagagagactcttctctcgtagcccctccgttcactccctcctcctcctcgttgtctcgtgttccggcgtggcgtagattggagacctgtattgattttttttttttttttgcgccttcgcacgcagtttcgtcgcttgctctccgacggcggcgatgatggaggcggaggaggcgttccctccgcagaggaatccccgccgcgcgcggcgccgcgacctcaacgcactggtttgatccgattgaccccctcagtttttttttaaaaaaaaatattattgttgttatataactccccatcggtttagcggccctgtggccctgtcattgtagacgtttgatgtatgcagggtttgaggttttactgtgaaatttgactctcgtttcgaggttttacctggaatggattgtctcgattttatggggggtttagggttccttacgtgactgaatggctgtgtgtttgcagtggttcatgttctagtaaggaattgtgatttcgggtttatatatttacagcggcaggttgtttgtgagtaaaggactcgaaggttaggatttttttgtagttccaatttgttcgtatttaggctttactgttttatattggtgagttggagtgacattttagtttcctgaggcagtttagttcaacccattatactagttcatcctcgattggttttgtgtgttgcaacctctgactattaggatttagtacttaacatagatgactgctccagctcttttaatgggccaaacgaggtatcatgccgtgccatcctgatgatcctaaatttgccaaacaaagtatcatgctgtgccatcctgataatcctaaatttaggacattctatatgtgcaagttcaacgagtagtgattccatttctatgttgtagagaaggttgattttttagtgtcatcaatttgtataagctggaagacactttaggttttgaacatgttgcatttgctatgttctgatgattgaggtattgtttcaggatcccagtttagaagagtctgatggagaggacattggtgttccagaagttggcatggtgtttaataaccacatggaggtcaaccgattctaccgaaggtatgctcgccgtgttggctttggggtgtctgttaggaggtcctcattttcacaagagggcacctgcttatatctggagctcatgtgctgcaaaggagggcggccacgttatgagccaaagttcaggaaacgggcctcttc

SEQ ID NO: 63701 - DNA, 2074 bp, Oryza sativa
atccatgtatgagttctataacgatgttgtcacacttgacacatcgtatgtggtcggtaaatatgatatgcctcttgcaacttttattggggtgaatcatcatggccaatctgttttattgggttgtggcctgctttcagatgaaacagcagaaacctattcatggctatttaaggcttggatagcatgcatgtctggtaatcttccaaaggctatcatcactggccactgcaggggcatccagagtgcggttgctgaggttattcctggagtccatcatagaatatgcctatttcatataatgaggaaggcgacagagcgattaggtggtctgtcggagtacgcagctatcagcaaggctttccaaaaagctgtatatgattctttaaccatagatgagtttgaaggaaattggaatgctctgattacatacaatgggcttcagggtaatgactggctaagatcaatttatgagtgccgatactcatgggttcctgtttttcttaaagatacattttgggcaggaatgtctgctacacaaagaaatgaaaatatcattcctttctttgatggatatgtagatttgaaaaccacattgaagcactttcttgggaagtatgagatggccttgcaaagcaaatatgaaaaggaggcccaagcagattttgagacattccataagcagtgcccacctgtgtcaaaattctatatggaagagcaactgtccaaggtatacacccataacatcttcaagaaattccaagatgaaattgaagcaataatgtactgccatgtatcttcattaatgttgatggcctcatatccacattcgatgtcaaggaatggattttccttgaagatggtaaaaggactatgagcaagatctttacagtgacaaataacacagataaaaatgatttaacttgtatctgtggaggtttccagtttaatggaatattgtgtaggcatagtctctcagtcctcaagtttcaacaggttcgtgaaattcctccacactatgttcttgataggtggaaaaaggatttcagacagttgcatgtgatggggcgtccttcaagtgatgttgttccaaacaatcgtgtggatcgatatgattatttgtcaatgagatgtctgcagctagttgattcagcagtcctatcagataaatatcgtcttgctttgagattggtgagggagatggagaagtttatgttaaacagcaacacgcatgatgatacacaaccaaggatcaagtctcgcattcctaaagcaaataaaccaaatacagtggttggtcaaaatctggtaaacgttggcacttacaatggaaatgataggcccaaagcaacaacagaggtatctgttcaacctgtagttaacattgtaaagatgcctattatgttggaagcattatggtaaataactatgagaataatcatcttaacccactgcctatctgattgatcttattttgcaagatgcaggcttcttcattaacacagggattggatgtccagaaggtactacatttagctatggcatgagtaaattttggtgcattatcctcttataggtgacatttgttaataaggatattgatttctattttttttttaactatagggaggagcagaaaagggcatagttcctgctggttacattggactgccagctaatgttcagcaattcgtaggcagtcaaacagcgattcgcccaagcattgtgtatatggttccggtatgtcaaagttacaaataactatatctgctcaactgtgccttgatagtatctacagcaccagaggaccaaattctaggatatttggttgcttttcttgcacaaacatatgtggattcatacaactcatctttatttgttaatgcataagccccaagtactcatcatttttcaggatatgtgctgtgaaattgattctttcttatttaatttttcagagtggtgttgacccacaggcatttggaaatggtgttctgatgcctgttgtgtaccagcagatgttccaggtttgtatatttttgtgttaggacttgagaagttaatccgttcgtct

SEQ ID NO: 63702 - DNA, 2570 bp, Oryza sativa
  unsure (1)..(2570): unsure at all n locations
cataactgcatcccaggtctttgtaaatatgcagaggaagtgaagagttgcctagagaacttcaaacggatgctagcactaacaaaagtacatcaaatccatcttggctgtgatctgaagcctttgtgctgcagagattgagcacggccaagcccaagcgccattcttcatttggatcatcctggagtgaagtccagggttgaaaaatagccttcacctcatttgactttagttgattccagcaacattagccgataatgtttttgtggctctgccatgatatacaagttctgaaatcccgctgtcgtttccatggtaatatgtaaatgattttttgatggactaacctggtcatttgactggatttttttagttcggaggcttaaagactcccttagcatcatgctagccatctcaaaatatagctaagctaaaaagacatacttcaagaaagtagccaaatctcctctagctggccaaatttagtcgtcctccctcgctagccagtagccactctttccaacagaaagaggggagaggttgagtggttgacatgcaggtcccacttagggcatccatgtggatttcatctggattatttgcaaactgagggagcgaggttatgatgctcatgttttcaagctatgggtcccaacttaattcccataaactcgtatatctcaaacattgtgaaaggtatcaccagtgaaactttaccgaaacaagtatgcctcaccttaataccttatgatcccattggactatataaatcggtaatgccctaagggcatgcgcaatgcttattgccgaacgtgaatacgatagacaccataattctcttaaaaatttaagtagatctattttttttaaaaaaagttttaatttcgtagtaatatgtaattaatcatgcgctacttatcaccacgtttttccgagccatacagtctctagccaaactgcgcagtcgagtcagtcgagctagccctatacttaccgtgagcacggatgcccatgctcgagagaacattttctgcccattacccacgacgcagacacgcagtgacgctcgggtgcgactgctgtggctagccagccaaggttgtcaggacactagatagtttcgctcaaagcaatatatcgtatagtaggatcgtatcgtaatatcgagatactatgagatttttatttttaagtttaattaatatttatattaattatatatagccattctatataaaataaatatagtaatgatatatgtcatgcaaatagagatatttattaagggaaaccacattggttttgatatattttactgatttttatataaatttgagcgtatttatttacattattttcaaaacacgttatttaaaataatattttatagtatcgtagggattgtagaatcgggataccacctaagatttcgtaggataatgtagtaatgaatagtaatatcgagatactatgaaaattagtatactatgtgggatcggtattgtttcgactcgtagaatcgtagtatcgtaagatactatgatataaattgggatactaacgaccttgcggctagcgacaacgattgcagcatatccaacctattctacgtccaaattcgttgtactagaatttgattggttttttttgacatgacacaccccagtgcaataaatctgaacatagatttattataggatatattacattctattactagattagctccgtaatacaataaatctgggcatactctatactagaatatgtcacattctactggattgactattttttttttgggacatatcacatcctaatactaaattgactttttttttttggaacagggagcatgtcaaacaggtggagatctaaccgacggcgctaggcagcggctagcggcaattccgacttacgttagacaaggagtggtacctggtacatgaaaaaaaaaatcacatcttccatgacaaattttaaaaggcgcgtgaattgggtgacaatttctgaaagactgatggcaaatactgaaatccctctgcccaatttgcttcagccatctcttgctcctacaaagcaaaatgagctcagcaggaattttctcatcctgtgaaccgagatttctcccaattagagtgaatctcatgcttctccgcccagcgcctgcaaatgaactacacactaaccatgcatcgcccaaacaaggccaacggccacaatttgcacgtcccggcagggagggcgtcttacagtgtaattttagacaatagacaaagtcataaactgaaccaaacatacatttaacagatactcaggggttcaaaatagatctaaaatatggtgactagagggtagcatccaaatccagccaatccgtatttccacttccacagcaaccagttgaaatttcggttgcaatttacctgccgatctagagcgctgagcctaactatatgaaagtccacatctttacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63703 - DNA, 5371 bp, Oryza sativa
  unsure (1)..(5371): unsure at all n locations
tcaagcaatacttgaggctcttctagattcaataaattatctgccaagctagttagccaagttaggtagtgtatttgtacatagaaaaaatcaaaagctttcttcttcgaccttgaaattcaaatccacagaaatatttcaaaagtaaaagcaatctggaaaagtctgaacactgtgctctttgaaatacatacctcagatggaaaaagcacatgatcaaataccgcgtctggccagtcgtgcaatgctgacattattttctccaccttcttcttgacacctgtgtagaatgaacaataacaaaacaagttatctcattatctgagcctactgaaagcaaaagggttctatggcatattgaactgcaggaagtgaactcttacgtttgtcttgactgtccttttccaacttctgagaatcattcccagtgaagtgggtgccctccaccccatccttagcccattcatgacattttgcggtctcatcagaaaagattacagtcttcttcactgggttcttggtggcctcatggctgcgaagagcagtcttcttcaagatagtgccatcagaaatgttgcgccctcggggcttggcggtgttggacacgtcctgcaggggcctccgcgtagaccaccggggcttgccaatgttggatacatccctcagggccttcttctcttgaagcccttgctntgctgctaatggcttcagtggcttggccttcaatccatcagccctcttgccagcaggccctgcacacatggaccaaacatgtcagtcatttaaccacaggagatcctccttgtgatgaattagtcagatcaaaagcagccttacccctatggatatgcaggttctcatcaagaaaaacagctgttgcagttggggcagccatcacaaatcagcaagcttttcttcctcaaacttgcctgaaaaattctaggtactgagcaaagggggaaaagacaaaattgctagagaaaaacaataagcagtatatattacacattttgttctacaaattttgcacaaggtcagaaaaatattagttcaacttgtagcataacaacatatggttgctgaaggaaaccaggatttcacatacattctgcatgagtccccatttctccaacagattttcagcaaaatatcagaaatattttgctttgcgttctaaactactccctccgtttcataatgtaagtcattccaccatttccaacattcatattgatgccaatggatctagactatatctatatagattcattagtatcaatatgaatgtgggaaatactagaatgacttacattgtgaaacgaaggaagtaacagattagacggcgcacctagagtcttcaagggacacagccgtttctccaacagatttgcagcgacagctcagaaatattttgctccgggttccaaactaacagattagacgacgcacctaaaatcttccaagggacccgagccatacgtatttcatgaaattagcaggagcaaacaaatccccaataacatgccagtttgcacgaattggaccggaatgttgcggataacctagggtttggattcggtcaccaacaaccatgaaacgagcaagatagggcaaaattttcctcgatgacgggaaaaaaaaattcaagacaacgcgtgaccaatccaagagaaagccccagtgcttacctaccaggtagaagagaaaccccgctccggatcgatctccgcctaaactccggcacagcggcgtcgaggacgaggaggagaagagcgcgcgggggcggcgggagaagggcacgatcgcggttcgattcggcggcggcgcttctcgccttggtcggcgtgggggttttgcgtttcttggcgtggagaggaaaggggaaatttttttgctttgcgcgtgggagagagaaggatcgggaagaggaagacgacgtaaaaggcgaggcgggcggtgcaacggtcggattctggatgggccgccgacttaccgttgtgacacacggcccatctacacgggctcctccggcccatataaatgggcttcaccggcccaagatggctcaccgaaaccctaaccaggcagccgccgcgactggctatatatatactcatacttgctcaggagtagagacaagcatcgccggccgccgctcctttcgaatcatatccattatatctctatcgtgtgctttttatcatcgtggtttgtagtcgtgtgcgttttattttcgtagtttgtgtaattggtttgattcgttgaattttcggggtggttttgagttgttcgtttctttcgatctggattttttttttgggggtgcggatttgcaagatcagcttcttgtttggatctcgagcacacgcacacggtccaggcaatcggcatatggtctgccatcttgcgagattgaaatcgagccagcttaaactcacctggatctgaccctcggtgattttctgggccctttcggctggcacatgcccctcgtcttcaaaatattcgagatttgtctttttgttcttggttattgatctcgaagcaaagcaaacgcactctgtcccaagacttgtcagtgttttgtggcaatttcttcgtttgcgagaaggatgttccgagaatctcgtacgccggtgaggtttcccgtgatctggccgaggttttctggatacattcaacgcggaaagctgcttttaattttgttccaatttgctgtctttgtaggtctgcaccaaattcgatctgaatgtccttgtgaagcgtgaaatcaaatttggaataacatagtacggagtagtgcagaaccgaaatccgcatgaaagtactctgtatctgttgtctgataaactgagaatttcgaataaaccggaacataagcattattattatatgaaaaacggagcattgaaaatttcgttatgaaaaacggagcattgaaaatttcgatgttttgctcgtctggtagacgagaagcttatttttcgaagatatatcttccaaatcccaattatgtttgcgcctaattcagacgctcccactccttgagggcttgccggctcgtttacctacattttttgatttaccgaattttattaaggtaacaaacttttgccaactgccagtgtcagtttgtcactatcaacatttggtatttcaggaagtttacttgtgtacctatacaaaaatttagaaagattgcaaactaaacacatctaacattgacaaaaaattattaacgagtctacccagattttgcactgtcaaattttaagaagattaatttatcaacaaactgaactagggcttaagtcatggataaattcactcgcactcacgggccaacattacgctcaactggcttgtgggcctaaattatggctgctggaattgctcgaactgatgggccaaaatgaagaacatttgtgggcctgaatgttatcatatcatccaagatttaaatttagaaagattttgaagttttttcatcaaagttaatgtttcagtctttgcttttagattattaataatacgtatataaaaattttatttacaaattacttctcgtttacaaatatgccgagctccgaatagctagagacgatccctcaaaaagaaaaaaaaattatagccagagacgaacatacaagctggacgcatttcttcaccacggagttgatttgatcgatccacagcattttcagcggaatatcgcatgaaaatggcgtttttttggcaacacaatcttgaaatgctcgaagccaccaagtcctccaccaatcgctcggcaccacccaatggcgggcagccaccacgcatgcacccacctcctcacctttgcaatgcccataagaggaggccagccttcacgccttcctccgccatcccaccaccaccaccaccgcggcctccgacgcctccctcccacacgctcccctgtggccgtacgtgcagccggctgcaccaccagctagcggcggcgggcgccggccggcggcgaggggatggcgtgcgaccagcaggcggagctccggcgggtgttcgagctgttcgaccgtgacggcgacggccggatcacccgggaggagctgacggagtcgctggagaggctcgggatgcccgtgcaccgggaggagctcgccgccaccatcgcccgcatcgacgccaacggcgacgggtgcgtcgacatggacgagttcacccagctgtacgagaccgtcatgcgcgtcgacggcggcggcggcggcggcgcctgcgacgtggatgaggcgagcatgcgcgaggcgttcgacgtgttcgaccggaacggcgacgggttcatcaccgtggacgagctgggcgccgtgctggcgtcgctggggatcaagcagggccggacagcggaggactgcggccgcatgatcggccaggtcgacagggacggcgacggccgcgtcgacttcctcgagttcaagcagatgatgcgcggcggcgcgttcgccacgctccggtgatcggcggcgtcatccacgcgagcgtcgttgtatcgtctatatacccaacgtacggtcgattgtttgttttaacatagcttgtgcatgacagtttgtatgagtgtactacgatccacacacgcgatcgaatttcgcagaaaatgtattgtgatcataagccgataagtttcggaggtggtaaaagcataaagcagccgctataattaagaaatttaatttgatttcctgatgtgcattttcaattacgtactgtttgatccacggcaggcctgcaagcttattgcgcataattttcacgtatgacccaaaatggaaaaatgatgttcctggcagaaaactgataatctattacatttgtaattgtactgaaactataactatgatgatataacttatatataactatgatttggttagctaacacccgcaatctcgcggtgtggaggttaggagttcgactccttgcatatgacctgaatctcaaggtgatctgatggctacagtatcacatgaaaaaaaaatcacgcattacatttttcatcactgttttaaaattcgacttaattattttcaaatttaagtatgtttctcaaaatccaaattaattatttccaaactccatgtgcaatccaatgttttgggcctgacaaggccgcgcagggaagcctcctcagccggcccattaacaattcacaccctcgacgacggtttgccctctctcccgagcccgggactccggccgccacgtgcgtccacctccccggcggcgccaaaaccctaggcaaggaggagagcagcgaagggaggggagagtcagagtccaccatggagnnnnnnnnnnnnnnnnnnnnnnnnnnnnnnnnnngggctgcaggaat

SEQ ID NO: 63704 - DNA, 1305 bp, Oryza sativa
tagtcacaaggttcggatgaacagaagacatctgagagcaaaacaacgatccccttcgcctcgatgaaatattttgccggcggcgcgccgcgcatggaaccacaagaggagctgaagaggcgtagcatatcagcgccgtgattaacgagatcagctgaagaggcggtaccagatgggctgttctgcaaaacagaagtggaggaggcgggcgtgtattcgtaaaattgccacgctaggagacttggccgtaggatgtcgatcgaacggatccggacgcacgtgtacacgagtgcagctgtactcccgtgtgcacaggatacccttcctacttataattggcttgctatttgtagagttatgcatactattgccaaatatagtcttagtcaatgaacaactaacattaacaactcctagtacctcgaggggcaagaggattggagcactgtaaaaacactaataatagtcatgggtcgtgctaatagaaattctcattttacaagaagggcaacaatcatgtttcttccgccttacacacttaattaacattggcacacgacagcggaacagctagctcatggcattcggtccaagccaagtgcacctcatatgtacgcgtgacaaagagggtagcatatatgtctggctcaaacctcactagcaacgcccgagatacgaactcttttgcttgccctgttagaactcctattctattgcatatcaacatacttttgtttgccggttcattctatttatcctcgtcgacatcacatatttacatccttcagaaatgggttaaaggacggtgatatgaatcaatgaccaggtcgtcatagagctaggttagttggcatggagctcgagaagaacggcaggctgtttggttgatagtcgaattttaccatgtcaaatcttaggtgtagcgtaatttcttatacagtgtttgattgtgtgttacacttggagttaagtcacactttattagtatgttagctcacacattatatatactcttattttcaagacaaagtttatcacaattgtgactaaccgatagtgataaagttaacctccatccaaacagtctcagctagttaaatgaggaaatgaacatagatagatagatagatagaggatgaaggaggaggagaatagttatacacggaagtattatgaacaagataaaaattaagttttagttcctccatcccacaatggggttgatcgtttgtgctactttccagctgcaggcatctggagcaacaatagtagcaatcgaaaaattaattgtggctgcagcagctg

SEQ ID NO: 63705 - DNA, 887 bp, Oryza sativa
gcgacgtggggaagtcaatgccgttgtgcgggaagtttgcccgcggcacggcggcgccggtcaggtagttgttgttgccgacatcggccgtggagtcgccgaacacgtatatcgccggcaccttcgccgccgccgccgcggtgatacagatggccacagcaacaagcgcaatcggcggtagcatctgtccagccatgccggactgcgaggtgcagtccgctggctctgggtgggggctgaacggcaaacctatcccttgtttgcttttgggaaagggaggggccgcgaccggagcggcaatggcgcactttaaagggcgacgatggcgagctgcgtacggccaacgccttttattgagaccggcaaggcgtggcacagcacttagaccaagtagtagtacaaagttctttacttggcttagctttggtaaagagagatgtgaatgtgacctggtcacctggctatcgcgcaaaacgttgctcctcctcctgggttggtcatgggggtctcctggtcgaccaggagacaggctactactctcgtactcctacacgggaagagtaactggatatacagcgaagaaagtcgatcgatcaaggtatcctactatcctggctcctacatgtacttgtgacaaaaccaagaagatccctcagtctacttgtccagcaaaccccgtcaaatttactcgccacgatctcatgctccctggtggtcctacaggcgaattatatcggcatgatgttctaagtgcctttggatactctgtctctcaagagtaattactgctacttttcacagaaaatcgatccccgggaggccgggactgagtgggggtaacttagcttgatcagaaccgattacttggatcaaccccgttgtccata

SEQ ID NO: 63706 - DNA, 709 bp, Oryza sativa
attcctgcagcccgacgctactggcgcgagggtgtaccgcgagacggcgagatggcgaaacgcggcgaagtggagctcgacgcggtgcaggacaggggcaaacgacggcgacgtaaggtgcttgacaacgtttcttgatgtccagcggctacccggcttccccatggcgacggcggcagcacggctcttcctccactccctccaacctccagctccggccggggagcctcacaatggtgatctctagcggtggtgagagggtgatcgcaaggtgttcgatgaaatgcatacgagaagaaggctgagagggatgaggattttgttgagggcttcgcttaggatgcaagcaaactatggggataagatcaccagcacatgcctaggcgagctggagtactaatggtgatcggataagagcaatgaggtggatgacgcggataaggtttgatctcctcctccattaaggttatgtggctccatcatcgtacctaaagcctaaagtctgtgcgttctaactctagctgtggcaggaggctccgttttattcattgggcgcgaatgggggcgacggaacgcgcgcacatgggagctgtggcggagcggcggcttgctggggcggttttcccgtcctaaggtagttggctagggctagggatgacgcggattggcgttctggccgttatccatcggtggcgaggtgatgggtgat

SEQ ID NO: 63707 - DNA, 779 bp, Oryza sativa
tcctgacaccatcatctttttcgccactttttggctgatgtactttagatgtccaatttttttctcctctgttggttcattaggtgagcaaggctgcaggggagaagtggcgagctatgtctgagcaagtgagtttttctctgcagtgttcaaaaattagtacatgttcctattaagtgtgtgcatctgttatttagcatacatcatccatgagtatcactagaggactgtttaataattgttctggcctgtttgttaggaaaaagattgaattgctcctaaagtactagttgaatgaaaattgcaatttgtttttgaattctactcagtgaagcgcttaagtacacataagtaccatgggtggctattgatgtgacaatgtgccatatgtttttggcccttcgtgttaaattttattaggagaaggcaccttatgtggacaaggctggccaaaagaagcaggactacgagaagaccaaggccaacttcgataagaaggtgatgatagaataattgtgcatcctaattatagagcccttcaagcgttaggcactaattggacttcttgaattacttcttcaggagagcacaagctcaaagaaagctaagacccatgatgatggagaaggctctgacaagtccaagtctgaggtcgacgatgaccaggatggtggtagcgatgaggtaatcattaaaggaacacccggtgccctattttagcttgaatgcccaatgaatttttactactgctagttgtgttgctaatgaacatttttaat

SEQ ID NO: 63708 - DNA, 710 bp, Oryza sativa
ttcctgcagcccctgaaaaagggatcatacaccatcacttccctgtgaattacatattgaaaccatggagaatgggtgtgaggttttaccagattatcaaatttggtatatttcaatatgtatgaccacttgtccagctagttgaaatggaatttatgattttgagagcatattggttaagtactttgtacctgtgcaggtgattataaagaccctcacagctagcctatccctgattcttcaaccttttggtgcatattgtgatggagaattcaatttgagatgcgggtaagacaattttccattttcacctcttgtgtcttgagttcagcaaagcaaaaggcattcacctttataatttgaatttcataatgcttggaaaaattttataataggaataatgcagagacagataactgcatagaagagtaatgcaatcttcttgatgactctacctgtgtcactgcataagctgttatcaccttgtctttatccccagaatatatgtgaacatctagcagtccacttcaatgaattattttatgcatgcttatccattttttcaacttcattgcttttgttcaaactgcagatacccatactttgccgctgtccttaacttcagtcaatattgggccctatactgtttggtggagtggtacacggctactaaggacgaattggcacatataaagccattggcaaaattt

SEQ ID NO: 63709 - DNA, 1145 bp, Oryza sativa
ggaactccatcagccgtctcctcctgctgatagttaagacagagtgccagccatccgttcagtgccttgatgaagctcctctgctcattcacccaggaggaaaaattgacgatccatttaatcaactctagttcaagcccattgccagatctcgactggttccaccagaaattattgaatccaagttttttgcctctgatattgcttgacactggatgtggtagcagttcagcttatcttgccacattttcacaaacctgtaaaagatggctataagacttttcttttgacacaaactagatttgaagataatatgaaatgcaagaatatctagaaaataaatttggagtgttcagtattccacttgattgttctacaacataggtatcgtcaaatacacttttgccatagagtacccaaaaaaaaaagcaattctagacgtacacatgactgtttgtgatgctttaacttgattaacttaaatgtgcataaatcatttttgttatgaaaatgtgtcaatttctacagagatcaatttagtgcactggtacataattaccttcagaattaaggcagttactttctgatagacatactacacatgtggactgacattacaaaataaaaaaaataatgggtaaagacaaagctaaatcagactatttgaataaatgtcagagggaaagaatagagtgtacccttggattaaggtattaacttgtggccataactcctcgtcccttactctgtttatctttttcgacaccttagcaataactcgcacagctatccgtatttttgttgatagcttcctaaccaaattacgagttgcatcaatcttgggagcttcagcgcctttttgatccaagaatttcagcctcttagagttcttggcaagcaggagccgcattttctcttcagcctggaagaggaaaacagcaccaaaacattcaatacggaatagagactaccaagggtgagctcaagcaaacaacatgatttccccaatgtaagagcagtaattcttcattgatgggttcctcataggattattagtttacacgtagggtgatcatgacatgaaaacaaaatataatattgtcctgttatgctacaagggaacctaaaaaggcatggcagcaaca

SEQ ID NO: 63710 - DNA, 14300 bp, Oryza sativa
ttagaattgttcctctgtacttgcctgtcatgaaaggccatcaacacagagcaaaggaatgcaatttttaaaggcctctatcatgcacccaaatgaccagaaagcccgacgaagaacattctccccatattcattcacctcatcgagaatagcaatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttatgtgcaccagacgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgctcactatcataacaccagtgggcatctaaaccatcgtttaccttcatacgactcattgatatggtcgtccaattatcgggtatgtaagtttcgttgtcccacagtgttgtatcttctccttccactacaagcgcaatgtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacattttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctctggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttctacatattttaacacacaacatatcaataatatgtactaactaagaactaatttaaccgtacaattacttagatacctctaccagcatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctcccctcgctccctccggcgctcacggcgacgaactggcgactctcggcggcggctggcgatgtggtcctcgaaacaaatcgagctcgcggacgggccttttaaaccggcctgtcgaacgcccattgttcgacagggtcggtggagggccctgtcgaacgcccccggttcgacaggcctcgcggcgccgggtggtgggccctgtcgaactccctccgttcgacagatgaggctgtcgaacgcccccagttcgacaggcctcgcggcgccggtggtgggccctttcgaattccctccgttcgacaggtgagcgtgtcgaacgccagccgttcgacaggtgtatgtcgaactgcacccgttcgacagggacctactttcgcgattttccccggttggccactacttttgcgattttccataaaaataatattaattctcaaaaaaattcagaaaaagtgaggaagtgggtcacttgcgcatgactggaagcaggagagaaagagagagggaatatgatggcgaagaggggagggactcgccggcgtaggcgaggagggcagggtggcggcgaccacgacgccagcgatgaagccactgccacgtccatccttgcgtcgcgccctgacgagccgtcgccactggatctggcgagcttggccaagcactcacgccgtcgtcacgactcgccgccgcaccccgatgagccaccaccaccggatttggcgagcttggccacgccgtcgtcgcgactcgctgcagccgcgcgcccgcgcgtcgtgcctcgacgagacaccgccactggatctggcgacccttgccacaccattgtcgcgactcgttgccatcgcgccatgccccaactcgccgcaatcgtcgcccacagccagatccggtgagccccgacttgcaaagctccagtcagcggcgaccttcgcgaggaagacgcaggtgaggcggcggtggcacgcgagaagaggagaggccaagtccactgccgccgtcgagtgccaagcccgtcaccgccaagctccatatccgccatcgccgaggcgggcaggggagggaggcgccgacgaggtcgctgggaggtgagaggagaggaattagttgaggatgggatgggttgggattttggggaaatgtaaaaaggagagagagagggaagatgaaaagatgtatgttatgggatccattataattagctttgcactgtgagatgagttgctttgtagaagttctatccaatatatgacatcccgggtttggtcttggtgtgcaacgcactgtaaacgctatcaagtccataaaaaacataaatagacaattataggcttatgggtatagttaattaacatacgtataagtaatttaagtcccacggctgcctcggttttatgggtcttagaaaggtatggaaaggtatattttgcttttgatggaacgtccctttttcttcatgtcgttaagaagattatttttaagaaaatattgataagatagccaatatgtgatgtgctgcttcaaagtttaaatttgacctatgtaaattaaaacaataaataataagtatgattgctaataatacgtactattggcaacatatttgttatttttgtttcccatgtatatgttgaatttgagcttgcatcttttacggagtgccttaccaattttttttataactttttaggtgataatggcataaaatgattggacatcctcgagaaaaaaaaagaccattccctgtaaagttattatgttggatatatatccagtagcattacaaatggttaatcgatgggtagcattttcggttaggtagaatcaagatagatgacttgattaaaaaattcaagcgcacgattttctcacttttaatatatactgtttttggctaagatatgcaacctgcatccccagtggtcttttcttaatgccataacaaatttaaaggcctcacctgcacgcttgccaatcgaacagacaacgtagtgatagtcacgggacgaacaattccaattgctaacgcgcactataatacggaagtagttgaagtgttcaaagttctttggctttatatatatacctaaagacttggtcaaaattaaactcagatccgattatattggatatcgaatcaaaatttcactttcgagcttatgtgaataacggaaattatgtttccagtcaagcatgttgtcacgttttacaagggcattaagcatgactataattgactaaggtgaaaaatgcattcacaaacacaccctgataagatatctcaattaagcggtggaggaagctcgatccccggcaggtcggacgaacgcttaggtttcgccgttattgtcttcactactgatagccgtcgacacttataaaaattagttaattatctgaaaacaatgctagtcacctaagcttgatggtgctgctagctcttcatcattgtctcaattagtttattgaaggacacacatcactagtttgtcaatttcaagttctcctttttaaccattcttttttatcgatgggatagtcaacatcttgaataaagttccttttatatagttataataaaggttttagaaaaaaacaaattgcatgatatatatttccaataataaacgactggttatcttcctctcctaatacatcctaattaagtgatgcagcaagatgtgagatatgtactcgaatataatcacatttcccgcgtgagaccacatcacgttttttttcacgcttaattagttttgtacattattatcttatggagtagtaatttaacttaacatatagtcatataccagtaattaactacgtccgcgaactgacctcaaaagtggaatccactgtcaccaaactcaccatgagttcaccacccctctcaagtagctagattagagaaatagtagagttaggttcatgaaaggctagctactaataatcaaacatcggcacagtggattgttcaaacatatatatatatatatagctcttgaaaatgagatgcatggagcttaattattggcattgtttagtgtcgcaacgcgctctatatggcaccgaccacgtgattagtattacatcgtcctgattgatcaagtgctatagacttgttcgatcatcctcatttgcttgattacataaagtattatttctagcaccactatgcaataagaaaaaaaaaagagctcgctgatctctcagccaccatttagttaataagcttgattaggcacagttgttagcttaattagctcggcagcttagctaagctattgtgtgtttcttgctgttaaggatactccgtatgaaatagccagtggccggcctagctatagctatagctattatctaggctgtttggtggttcagtactcctccgtccacacacacacacacacacacaccatgcgtatatattgcctacggcagtacggggtggccaaaaagttgaagcatttctggattattggcacgcgataattaattaaactaaactaaagctgggtgatcttagtttggcctttttttatgagagagagagagagagagagagagagagagagagagagagagagagagagagagagagagagagagagagagagagagagagagagagagagagagagagaggagtttgtttagttaccttcagaaatgtgaagtcaaggcgtctaagcttagtgtgtgacatgtgcaggcacattggtgcagtaagccagtaacacgtgcaagcaaatagccactactctctgagtcacctttttcttaatctaaatttataatctgtcgatcgaacaagtgcgcattgccgcattggtaatttgatatggctcttatatgtccgaagtacgtccattgggcgtgtcccgatccgccgtcaaacaacagagcgtacgcacggacgtaggcaccgtcgcaccgaccaactagctcgccgcaagctgcgttcgatcgttagtactcgctctgttttaaattatggcgtatgtattttttttacataactttcaataacatattttaaatattaatttatttcatattatattctcaactaatatgaaattaacatatcaaatacttcaaatatataaattcagttatataaaatgcataatagttagcatagatatgactagtaaattagaagttattgagtttgaattatatgacgaatgagtaatacgtagtactagttggaaatattttcccttcacacgtaaaatgcgatagtatattgacatatgattaattaaggattaactaaaaaattaaaagattaaaagataggttgatatgattttttcacagtaagggtgtgtttagtttgcaccaaaattgaaagtttggttgaaattggaacgatgtgacgaaaatttggaagtttacgtgtgtagaaaagttttgatgtgatggaaaagttggaagtttggagaaaaaatttggaactaaactccgcctaacttatctacaaaactttttaaaaataattacattatttagcactttagaacgagtggttatggaaaacgagatgaaaaatatagagtttcgaacgagagtgtccacctcgactactccgctcccgtttccgctagccgaccaggggaggaaagttggagtgggctaatcggtttctgaactaggccggcccattcagagcttcttgtaagcccagtaagctttgagagggacgggcccagttagccagtagggctgatttgggaacactaaaattaaagcccgcccctgtcttttatgggccattgttttaggcatgctcttaatgagacaaaatacaccttatttttgtatacgaatggaataggattttcagtgaagaatgatgtttgttgatcagtggatggttttaaaaatatataatacgtaacgtacccacatgtactcttttactaaaaccgtacgttacgtatttgcatgatggcattcgctagattacagctgtttgtataagaatgtttcacataaagctttgacactcatattttactgtcttcttttatttcgttgaagaattcttctccatattctgtaaaaaaactggacattcctttatatatattacgtacgtaaagtacccacatatttggtcagcttacttattctagcttatttgcacgcaatgtcaacactgatcaagacactttgtgggctccagctgtcctagcttatattcatgtttaatttagcgttgattatatccatgtcacagcaaatttacctaattaaaaaaatatcattactatttgtgatatatgttactcctacgtgctattatatttttgtaaaattgggattatgctatcgccatcaaaattcatatcatcttatttcctaaacccattcttcattctctctatattctgttcatctccccctcctctcttggatctggcggccggagctctatccaattacacgtggtgcacattttttttttcaaatcaaaacttatcaccaaaccaaatcagcactgaaatggtcctgcgctatatcgaagcaattaatagcaaacaaggttgaaactcgacaaggaattcattgcatgcatgaacacacatttgataaccgatcgagcgtagcgcaagccccattcaattcacggaagaagctgcagaggattcgtcaaacaagcatagattcgtcgcagaacaaacaaaatccagaaatatcttataaactgaacccccaatctggatcatttcgatgtacaccaaacagaacccaagcgacagcacgtacggcccaaatccagcccacgctatcgctgcgccgttggcgacaaggcactcggcggccctcgcgtcgtgccagccatggacatggagcgcgcgtgcggctggcgtagcttcctcatggcgcaacgatcgacgtcttcagacttcatccagcagcttcctcatggcgccggtgtcgttctggtgcatatgtgccacaggatcaacgacgtccgcgccacgtactattggacggtttcatggagcttacataaatactccatataatgatctcatatggggtcaattcgagatcatactgtttgatatgatctagctaccgttatttgatctataaattctactattctagtgttaacctctccacgaggtaaatactagtacgagatttacactctcgagtaagtgaaaagaggaagcagctgctagctttcaatttgctgagggcactgaaacgcgtggtgttcgtcaacttcgctgccgccgttctggggctcctcgcagccatcctcgggttcgtcgcggaaggcgccaagtccaatgcaagtttcaccttcatctcggtctcacttctcgattagttcttgtgtgtgtgtgtttgaatttgacgtctcgtgtttttttctgcgtggatcgatcgatggagatgcagtcgttcgtgcggttcgacgggaggtactgcgtgtaccgcgccacgccggcgctcggctgcgggatcgccgcggcgatgttcgtgctgtccggccaggccgcggtcaccgcggcgagcggctgcttcggccgctgccgcgcgcgccgcggcgaggagtcgtcggcgcccacgccgggcgagcagcgcaggcgctccgtcgccgcctggctgtccgtcatctcgtggtacgtattaattcttgacttgttgccacagcatccgcacgcgcgcgcgcggcggcgatgaccattgtcgacgtcgctgcagggtgttggtggcgacggcggtggcgatgttcctgtacggcgcgtcgcggaacgcggccgtgaggagggggctcgcggcggccgcgctgggccggcgaggcaggcgaggcaggcgccgcggcggcggccacggccgcaacgtgtacggctgcgccgtcctcgggagcgggctgttctcggcggcgtccgtcgcgtcgctcgccgcctccgcctgcgggatcgccgcctacgtctacgtcgaggcggatggtgaatcattgacactcacgccgacgacgccgccgccgcggcctggtgggttcgccggggcgccgggcgcggcgacgggtggtcagccgtatttccagccgcaggtggcgtacccggccacgggctacgtcgccaaccctgctgcggctcctcccccaccaccgtacggcggcggcggcggcggcgactacgccggctatgtcgccaagtcgcgtgaaggcacagcttgagattgccaaaaaaaaaaaaaaagcgtcgaagtaagatcgcgcgagaggttgccaagaactctgcctttgaacttgtcgaaacatgatttcggcaataataaaagggggtagcgcacgagacctaaaagtggatggatgcggagacaaaggatttagacaggttcaggccctctcgatgagaggtaataccctactcctgtttggggatttgaatccgccgagtgaattatagatctgacgatctagttgtctcatgccccttagagggcctcctgcccaccttatatagggtggggggcaggattacaaaatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctagaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaaacaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggactaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtctagtctttgagcatataaaatagacccatgatcatgaattcatgttgcatgtatccggagcaagtccaaattgaagatataatacttgtatttgagctagtaagcccctgagcacgtagtcacaattgttcgttgatggttgctgacgcatttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacaacagagatgtcagggtcgatgaagcagaggtgctagtgatgatgtcagtgacaataatccatcaaattaatgttataactgttgtagatgcttcacttggaggagagttgatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtagcaaaacttgtgaagtagcagcaatagagtttgcggtagtgaagacgcgcagttgtgaagataaaagcactagtcggcggcgacataacacgagtcggcggcggaagacgatgatgtccatcagtagtggtagctgtataaaccaaatgtagaggtaagggcactagtcagcaacagacgagacgaccggcgattaagatgtagatgcccaacaacggcggcataataggccagccgtgcaggcggaaacaccagtcggcgaaggacgaggcggccggtcggtgaagacgtagacgcccaacaacggcggcataataggccagccgtgcagacggaaacaccagtcggcggcgatggaggcaggccggtggtggagtcgtagacgcccaacaacgacggcataataggccagccgtgcagacggagacaccagtcggcggcggcgaaggcaagccggtcggtgaagacgtagacgcccatcaacggtggcataataggccagcgtgcaggcggaaacaccagtcggcggcgatggaggcaggccggtggtggagtcgtagacgcccaacaacgacggcataataggccagccgtgcagacggagacaccagtcggcggcggcgaaggcaagccggtcggtgaagacgtagacgcccatcaacggtggcataataggccagcgtgcaggcggaaacaccagtcggcggcggacgaggcggccggtcggtgaatacgtagacgcccaacaacggtggcataataggccagcgtgcaggcggaaacactagtcggcggcagacgaggctgccagtcggtgaagaggtagacgcccaacaacagcggcataataggccagccgtgtaggcggtgacaccagtcggcggcggcgaaagcaaaccggcggtgaaaatgtagacgcctgacaacggtgttgtgaccaaccaaccgtataggcgaagacaccagtcgacggcgacgacggcgagccggtggtgatgttctgactgatccattactggagcgtaagagataagcttaaagccatgaatcccttttatgcatatctggatttggatcctgcagaacaaacatataggatgagtagtatctgatgtaaatataatactcgagaaaaattcaagcagtttataaatacgtatttcttctcttgttaattttgatttccccgagcagatgactcattacgtttaaacactctgcccgactagccatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaacaccagtcggcgccagtggaaccaagccagtggtgtagatgatgaagcccattaacggcggcgaagtccgccaaccgtataggcgaaaacaccagtcggcggcggaagcaagccggtcggtgaaagcgaagacgtccatcaacggcaatgaagaaaccaatcggcggcgacggaggcggtcgacggtgaaagcgatgcccaccaacagcggcataataggccagccgtataggcaaaaacaccagtcggcggcggcaaaggccagccggtcggtgaagacgtggacgcccaacaacggcggcataataggccagccgtgcaggcggtgacaccagtcagcggcggatgcggcggccggtcggtgaagacgtagacgcccaacaacggcggcataaaggccagccgtgcaggcggaaacaccagtcggcggcggtcgaggcggccggtcggtgaagacgtagacgcccaacaacggcggcataataagtcagccgtgcaggcggaaacaccagtcggcggcggcgaaggcaagccggtcggtgaagacgtagacgcccaacaacggcggcataaaggccagccgtgcaggcggaacaccagtcggcggcggctaaggcaagccggtcgatgaagacgtagacgaccaacaacggcggcataataggccagccgtgcaggcggaaacaccagtggcagcggcgaaggcaagccggtcggtgaagacgtagacgcccaacaacggcggcataaaggccagccgtgcaagcggaaacaccagtcggcggcggcgaaggcaagccggtcggtgaagacgtggacgcccaacaacagcggggctgcaggaa

SEQ ID NO: 63711 - DNA, 1291 bp, Oryza sativa
aaggcaagccggtcggtgaagacgtagacgcccaacaacggcggcataaaggccagccgtgcaagcggaaacaccagtcggcggcggcgaaggcaagccggtcggtgaagacgtggacgcccaacaacagcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgttaattttgatttctccgagcagatgactctgtacgtttaaacactctgtccgactagtcataaccatcaagcaccgggagtcggcctaggcacttcccaaacatgcatatgagtgacatgagttcgtcattaatggaacaaagtttcacgtatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaattgtcacgtcctgataaattcatcccgaaataaaaatcatcttctaaaaggaataatagaattaattaaaattcgaaaagaaattggcaaacgctaaaaatacgtacaagaaaaattcaaatgtggcccggagaatttttgttaaattctccttggtctaaaaggagccctcaaattttacttgaattttcagagcaccggaaataattattaagcaacaacaacaattaacaaagtttattaaaaagaaaaaaaacctaaaaataatctctcttcctcctttgggccaagcccagcccgaagtctccctttcctccctctctttctctccctctccttctctccctccttctcttgggcccctcttcccctcccggcccactgcctccccctcctctctctcccgggccgtttcctccc

SEQ ID NO: 63712 - DNA, 10515 bp, Oryza sativa
tcctgcagcccccacgcgtcaggccgccgtcgtcttcttcctccgcccggccacctctctctctcttcccgtgaaaccctactcccttcctccctcaaatccgtgcgattcgctcatgggattccaaaattaaataggggaaattaaaccccattgaatcctcttcaattcccccttaattcccccttgaacggcgcccccaatcgccgggaacggacgcgccaagtccggccgccttcctttgccgccggccgccattcccgtcgccgttcccgctcctcccgtggccggctctctcccccatcctataaaatgggatcctcatcccccgttctctcgttttagccccctcccgagcctccccgtggtccctatccacctccccgtcgccctcctctctctcccacgctgccggccgcctccagccacctgtgccgcctcacccgcgcaccggccggccgcgccgtcgcctcctccagcgtcgccgccacctcctccaccccggcttgccctccgtttcgcgaggtgacccccggagctgccttcccgccgtcgccctcctcttttctccgcgccggccacctccagccgcacctcccgcctcacccgtgcaccctccggctgcgccgtcttctccctcggcctcgcagccacctccctctccctcggtcaaccctccgtttcgcggggaaagcaccggagacgcgtcctcgccggtgtccagtggcgtcgccaccacttctgcgtctccggccggctgctgttcgtcgccggtgcgccgaccgacgtcgccgtctcctccgttgacgtcgcagtgccgtcctctctcccggccagccacggcgtcgcccgaatttcgccggaacgccgtcgtctccgcgccggcctctccttcctcctcgtcggctcgtcgccccgctgcaccaccaccttcaccaacatcgcagcggcgtgttccacgccgtcccctcctccgctcagccgctgctgcctgccatcatcgtttcatcgtcgtctccgatcgttctcgtcgtcgacgtcccatcggtcgcccggctcgtcgtctcgcggcgccgcctccgtcatcgtcatcgcagcggcgtgttccacgtcgtcctcgtctccgtgcagccgctgccggctgtcctcgtcgcctcctcgccggccccggtcatcgtcgtcgtcgtcctctcgtcgttcccggtcgtcgtggcgttcgtccctccgtcgagccgttctcgtccgtcgtccgcgttcgtcaagcgagccgctgcagccccgtcctcgtctccgtcctcggctccgcgtcgtcaagcctcgtgccggccgcgtctcgcctttgtccaaggatcgccgccgaagtcgttccctcgccgttcgcctccgtcgtccccgagctgtcctcgccggtcccgttcgtcgttgtctttcccacgcctcgtcgcgtggtggtaaggatccgtcctctcgcttccccgccctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgtctctgtgtactcggtctaccgcggtcccttttgttgacacgtggggtccgcatgtcaacggcgcagccttcctgtcttttccaggctagcgcttacacatgttttataattgcaaagcttaaatataataatccgcaaatctccatataacagcattaaacttcggatgatcatatcttggtcatacgaactccgaatcgacccgttcaagtctcttaatgtttgttataacctaaagaaccctgtgctttctttttatgtattgttattgcttctttataggtttgtagctttgcttgtgtgcttcgcgtagtcttcgtcgttccggaggttcccgaagcgtggttcgtggtcgtcgccgaaggttcggaaggccgttctctctgagcaaggcaagtcacatcatccttgagcatattgaatcccagtttataaaattattttaatttaaattaatgcattatcgttttatttaaattcccgcgttatcactgttttatttagccatgcctatttacctttgttatgaccatactattattgttattgttattattaccttgttcaccctagaataaacaaaaccccaactagtggacactctatttatggttccactagtatgaatttaggtagatgcttcgctgattaataggacaacattaggtggttttacaattttagactttgggtatattcatatcatttggtcactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtccggttataaacaaaagtacacggatggaggtggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcatgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgcgtagctctaggatcgtctttataaaatggctttgggcaactaagtagcttttaaatgctgtttactgcaaaacttaacccgtatattattatccccttgtattcccttgcattaattatgcatctccggtgtggcttgctgagtactgtggttgtactcattcttgctcaatctttcccctcgtcagtaagagaagctttggagaagatgtcttaggtggagtcctggcttataccccagttgagcgcctgtgaagatggagccgtaggcccgctagtccgctgctgtttatttttgtttgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttctcggtcgcgacagcaatcaagataaatattataaaaaatatgatataacatctgtagcccccgactcactactcaatggaagaccaattggtgtagtgaggcagaggaaaaggaaaaatatcatatagagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggatgtagacatccaacaacggcggcataataggccagccgtgtaggcggaggcaccgctcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtagacggaggcaccactggtgtgaccaaccgaccgtataggcggggacaccagtcggcggcgacggaggcaggccggtggtgaagtcgtagacgcccaacagcggcggcttaataggccagccatgcagacggaaacaccagtcggcaagagtagtgccgcggcgttacatgcaaacagcagaaaataccaagagagattaatctgacatttagagatcaatctaataaacaacaataagttgaaaaggaaaaaacccggtgaagtctgagattaaaaggaaaaaactcgccgagattgatctcttcgactgactccgagacggagaaaattggtcgtcggtgttgcaccgtgtcgctagggctaatcaagcaatcgacactgagatggtgaggcctcccggcggcagtttgatttgtccggcacaaatgcatgtttgcatcggccaggtcattattggcgatgacccagatcgcgtgattcgaaaccggccaggaggacgcgagcgccaagccccagcagggacgagatgtatgtgcggcttggtcgagatcatggcgatgtacagtacggtggccaatcccgtcgatcgtcctggcagcggatagctttccccgacgtgcggcggatagccaaatcgtcgagacatgaaaacaagaaaaataccagggcatcaatctgtgattagatttcaatctaaagacgatagattagaacgacaaacccgatatcttcctgtagattgatttgatcagaagatggcgtcgacggcggaggatctcacgctacataggcgaagacgaagccggcgactcctgaaaattgattccatcgtactttgacggaaaactcgacgcacccctacctggcgcgccaactgtcgaaacatgatttcggcaataataaaagggggtagcgcacgagacctaaaagtggatggatgcggagacaaaggatttagacaggttcaggccctctcgatgagaggtaataccctactcctgtttggggatttgaatccgccgagtgaattatagatctgacgatctagttgtcttatgccccctagagggcctcctgcccaccttatatagggtggggggcaggattacaaaatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccatatgggtatggggtacccataatatccacagaactggtctcgtttaatgctgatcttttcctcgcttgtgtgaaatttcattgtgttgtagaagcaaatcgtgtatgccacacaacatgacgataacaatcttcatgtcttggaataatgaaacttgtaaaaaactgataggtcaaaaatgccaaatgcgttaatgcgttattatgggtaaagagatgagtagtagatgtcgtaatggctttttattggccatgcatagtcaacgttgagtttagtttcggactccctccttttcatattagagtcgcaatcctccaggctcccgagtccgacctggttagggtttgctcgcctacaaatcgagacgccgccgccacctcccatcacgtacgatccccacccgccgtcgacgacctcgaaatcccaatcgctgcgccgcgaattagtcgaagctgcagtactgcatcgccaagctcatggcggctgagggcggcagcgcgttcgctgggcagaaggtgccgctcatcgacgccagcatggctctcaagatggaggagacgtgccccaccccggaggaggtgaagcatctctcgccggccgacgagcgcctcgcggcgaaggagtactccgacggcgagctcaacaagtcccacgccgaggtctgccgtgaagctgacaagaatagcgccgcctacctgctcgccaagcgggccaagctccaggctctgatcaaggaagaatgggctaagattgacttcagccgcgtccatgtcggtgactgggacgaagaagcaggctgctacaagtagctagcccacccagctctgctgctggaacattggacactggccttattctggatggatggatgattcgcctggcccttttttctctaattagctctactagtattagttagtatcagttatgtctagctgttcgatccatcgttcgatttgtgatgtttggtactagttactaatcaatgggtatctatgttatccaaccatccttatttacgtataaaattataagtcgttttgactttagtaaactatttaaactattttaagtttgatgtaaaattttcaatccaagacaaatatattataaaaatatattcaattgttgatccggaaaaattggaagtttgtgtgtgttggaaagtttgttgtgatggaaaagttggaagtttgaagaattattttggaactaaacacggcgataatatgaaacggagatagtatgcatatagggacagagccaagtataggcatagaacagcttaggcttaggctctaggattgtctacataattatgcttaagtactcttaaatcaccacaaaaaatttaaagaaatctattaatgcattagttggttcgctctaggctttaataattttctagctcaaccctacatacaactctaaccatcacggagaaaactcgtcatgttacctttgaggaatgttctctatgtgtgcttagtctttcatcgatctctcaaagtggctcagataggcattaagaaaaagctttcttcatttcataatgcaaatgatgctaaaatggttaaacattgttttaggtacgtacaactgaagtcgtgtattaccgaaagcccatacaagcctattgggtatttctttaacctaatattgtgacaatatcattaaccataaatgagtctataataggaatacttttaggggcgacctatttggcatctagcgaaaaacatctaaaaatcttactatagaccattggatcgcttttgggatatgtgcaacaacccttaacactaaccctcttttcttcctccctcagtcccaccgtcatcatttcgcagactcgatccaccaacctcctccaccaccaccagcctagcgtgtcgttgcttgacctcaccagcaccaacaatgttggcggggtctattagacctccctttccctttcctctccacgcctttcatccttcccggattgagcgatgtcaaggaggccccgcacgcctctcccccatctccgacaactcccttgccactagagacaccactaccgcccaccgccatcctccataatcgtggttccaacggtgctatcaccgtctcgcccttctaccaccgccaatcactaccgggttgtcgccgctctggtatccctttaaacctgaggaatccccccccccctctcctcttcccttcccctacccctttgtacccaccccctaaacctaatacctaattggtcgggggcatcgtcgttgtcaagctcgcaagagtggaaggagaaggtcacggtgcacgaatctcagagccgatcagagcatccaaattttgaaagatggggtttcgattatgtccaatggaggttagaaattctgatactagttttcatgccattgattttttttattgttgatctaccaccaaaaactatcttactttaacgttggtttaaatggatcgggaagaaagatttccaaccatgcttatagagtcgaacagtaacaggaggtcactataggacgggccaaaactttgaatctgtttgaatttaggaaaactagaggatttcccgtgtaattttgcacgaagctagattttaaatgctaaattgggtttgatataaaaaccttaactcatgtttccaaacttatataggtagaattataaaatatattgtgtacacaataggtttgtgaagtaggattatatctgatatatacttcctcagttttttaatgtataacactgttgactttttaagatatatttgatcattcgtcttgtttaaaaaaattatataattattatttttaatttattatgagttgacttatcataaaaaatctttaagcataacttaattttttatattcacataaaaattttaaataagtcaaatggtcaactttttttaaaaaaaaagtcaatgacatcatatatttaaaaaaacagaggtactatagaattctcaaaaagagccgagaaagtggtgaattacaaatatgcccctctttccccttcatctattattcctcccttcctactctactccctcgacttctcgagtctcgattctactctgtctccaatctacgcagcgaaagccggcgccgccgtctcctcgagcgcgccgacggcggagaagaccgcaggcacggcgtcgtctacggcctcctccccttccttccagaccccggccacggccgcgccgcgccccgccctagcctccgccgccgcctccccagtccggccgcctggcctctccacgcgcgcacggccggggcgagcaggtcttttgggggtgggcgacgccgcccgtgccgcggcctcctcccacctgaatccatcccagctcgcgccgaattcggaggtactcgtctcctctctctctcttctctctctctttccctccaggtgtcccgtacaattccttctggatttccatcattccatgatgcctggtggattgtagctgctcgtgtttccacgaaagaaggtttgggggtttatctccgaatccttcttctgggagggatactctaattggtccggtttgctgcggaaatctgtggagctcgggtagatgctccgtgttagtttcgccaccgcgcactgcaaattctagtggagtgaagaggaatatggtagaggggttgccggcggagttgccaatcgtggacgtggccgctcgtttggatggcaagagctcggagctgccagagaatggtgcattgctgaagggtgctgaggaatcccaggtttggaatgttttagcttactcgggaagtgccaaatatatttgcttctattcgaatgatttgtgatgctttgtttgcttgctaggatttgggaggtaatcccgtggcggagttgacgttgcacgaaggcaaagaggtgatcctcgtcgatgacaatgatagtgagcaggaagacggtgggagtggcaaggtggatgagaatgcgccccgggtcggattgagattcaaaacttatgatgacgcgctgaagtactataagcaatatgccgcggattctggcttttcagcaatcattctgaagtcgtcctacttgaagtcaggggtgtgccggaggttggtgcttggatgcagtcgagctggaagagggagggcaaacgcatgctatctgtctagagaatcaacgaagataaattgtccagctaggatttcgttgaagctaaggcaagatagatggcttcacattgatgacgctaagcttgatcacaaccatccaccgaaccaatcctcggtgtcacatatgaactgttataagaaattgacagatgccaagaatgaggaaactgcttcaagatcaaaagggcgtaggaatgttcccataggtgacaaagagcaagggagctttactgagataggaaggcttaaatttggggaaggagatgatgagtacatccacaagttttttgggagcatgcagaacaagaatccaaatttcttctacttagtagatttggacaaacaagggcgcctaaggaacttgttctggagtgatgctaggtcacaggcagcacatgattactatggtcgtgatgttatttactttgacacttcatacttgaccgaaaaatatgatctgccacttgtcttctttactggggtgaataatcatggtcagcctgttttgtttggtactggattactttcagatctaggtgttgacagttatgtgtggttatttagggcattttttgcatgcatgaagggctgctacccagatgcaataatcactgagcattacaatgctattttagatgcagtgagagatgttctcccccaagttaaacaccg

SEQ ID NO: 63713 - DNA, 1266 bp, Oryza sativa
aacctatgggtcactgaaagcctcagagtttgaagctgattggaagaagattattctggagcatggacttggagaaaatgaatgccttagttccctatatgagcatcggcagctatgggcacccgcctatctcaaaggccaattctgggcagggatgtcagtttcacagcgtggagagtctattgtttcatactatgatgggtttgtgtaccccaaaacttccctgaagcaatttttcagtaaatatgagatcatattggagaacaaatacaagaaagagttgcaagctgatgaagaatcctcccataggactcctttgactgtaacaaagttttacatggaagagcagctggccaaagaatacacaatcaacatgttcaagaaatttcaggacgagttgaaagcaacgatgtattgtgatggtatgccaactaaagttgatggacaatttgtcacctttgtggtgaaagaatgctcatacatggaagatggaaaggagaaggagggaaggaattatgaggtttacttttgcaagcaagagcttgttaattgtgaatgtgaatgtggtttctttcaattcactggaatcctatgtagacatatattatctgtgtttaagttgcaggagatgtttgagattccaataaggtttgttcttgatcgctggaaaagagactataagaaattgcatgctgatgcgctttgcaaaaatgatgaaatgctacctgatgtgctacctgatggcataatcgagcgtcatgatatcttgtttacacagtttcgtcaggtgcttaatctagggttcatatccgagggtaggtaccttgtagctctgaagttactgagacaagcagaaaagactcttctggatgatggagatagaggcaggcaggcagggcttctctcgtttgaggctgaagcacctgaaaatgatgaagggatttttagtcctgagttttcagagggtgtaaagaattctcagtcaacaaatgcaaagcgtcgaggtcgtccaacaaagaaactaattgaatctgattctgataccgtattacggccaaataaagagcaggtctatattcattcttggggcctaaagagcctaagatccatatttcactttctgttatatgaatatgccttcattgattttttttttttatttctgctgagcaggattttctacggtcatcttttgtcactgatgagtctaatatgattcaaggggcaccctcagcctcacaccttgaaagtcctcacttgggagtt

SEQ ID NO: 63714 - DNA, 1360 bp, Oryza sativa
aggtgataaaatgaagctggctgaagatcctttcacggaagacgagcttgactactacccatttcttgagaacaatcccgttgagtttcagctgagagatgagctaccactcctggagcctggaatgaactgaagaatgctaatctgccccacttgaaaagacctcagaacagtgctattatcatcattatcctctttgcaaactctacttgctcaggagcagtttatttgtagtagtagtagtagtaactagtatcctagatgttctgctgtatgtggttggtgtgataatcattcacactttaggaagaacccaagtagcggaagcaactttagcttcctttatgttctgtgtcttggctgaaatacccatcattaagccattgtgtaaatggtagtagtagtaaactgtagtgtaaggattctgcagaagtacatgcgtgtgccacttcctctattacgaatgcgtgcacatgtgtttgatttcctgtttatattttgttcagagtttcagcttggtcaatacaatgttaggttcatctgaacgcagccatccacttgaccaccttgcatcgattcccagttcggattggatgaatttgccgttccctgttcaaaatttgacgttcgctgttcaaattggatcgtgacgaggaagccttttgccgtcgtgttcttccatcctctgcggctggttctcccgggcccacatgtcatccacccaggggaaggtgggaggaaagaccaaaaaaaataaaaaataaaaaaatgttggatcgtgacgactcaccaaggcctaggattatttatgtattgatcggtcgcaaccgcgagtccgcgacggggcgagacaccggcggccatagctcgagagctcgaggtcaacccgaaagccacgcacgcgccgcgcaatgggttccgacgccagcagcgccgccgacgcgatgggagtgctccgggcggcggtgcccctgcagccggacgccgacctcgtcctggctaccggcggcggcggcgagcgggggcaggtggtggggctcgtcctcgtcgacgtctccaacgggttctgcaccgtcggcgccgggaacctcgtgagctacctccccccctccccacgcctctccctctccctctcttctccttcgcccgtgccttaccgcgcgcgcgacgcggattgatggtggcacgcttggttggttgggctgcgccgctgcttggcgtcgtggccaaaattgcttgtgtgctggggattgggacacgagtgaatagaccactctggattactcgcaggaatatcctcctcctggcttctgccttgttttgaacgaccctgtttgttttgatctttattgtcgtattc

SEQ ID NO: 63715 - DNA, 711 bp, Oryza sativa
  unsure (1)..(711): unsure at all n locations
gtttcttgacacccactaccctgataagcccgagccgcctttcccgccacactgtataattggttctggcgaggaaaattttgtcncaggttgttcacgcttcaatttgttgcctcaacttaaagctcctaaccggatatgtttagcttctttcgttatgggctgaagtgatcaattgatggttttgccaacgctgacatgagaatggcaacacgttatggtcctcttttggtgcctgacaaaatttaatctctaccatttgcagctctggagtggctggaaaaggatccaaatgtaacgatcaggaggaaggattgtattgatggttatcttggtgcatttgagaaagatggctcaaatgttttttcagattgggttgcgaagtttcagatcaaaaccgtgagtgatttggttctgctactcttcgagtacttcagaagaaaaatagtgtggttgatatgaaccgtgatttggcttgatgcaggtattggttttaggaatatgcacagacttttgtgttttggattttgcaagttcagctttggctgccaggaacattggccgagtgcctccgctggaagatgttgtcatttattcagagggttgtgctacgtataacctcccagttgaagtagccaggagtatgcaaggaaccttggctcatcctcaggtattggatcactgaaaaccaattaacgaggggctgcagga

SEQ ID NO: 63716 - DNA, 2618 bp, Oryza sativa
catgtgtccagagcgattggtatactattaatcttatttctttctggttgtttgtacatcatatattgcatcaatagtaatcggcgttcttcttacttacatttcaggttattttgaattaaagaagaaccaaaatattcctccttcacagcagatggtgacatgtgatcctgagtttaccattgtaagtatatctaagttcttttagaggactaaaaattttgctgggtctgatctgatagcttttcttttctgttaggtggacataactgctaatactgaatttcttgtcatagcaactgacggcatctggtaggctatcaactatacaaataatagatgtgatttcttttcattatgcttgctcccgatttaaaaaaaaatatcatgcagagtatgcccacttcagttttttagatatatgcatagcagtatagcatatgtatgtaggcttatttagtgttgacacaggaggttcatatacccatgtatgcacattggttcagctaaagttaacttgattgcttcttctaagacttggattaatttaaattagatgcgtagttctctatgttttctcatggtgaaggatttgaattatttttctgaaaagaggaacatctgccaatccctgtgggcctgcactaggtattttttcatagaattcagatgattatttaacttgttggcttggtatctgatatgcttactaagctggaaatggccagcgtgccccttatatatctgacttctactgtaaggacatgcttcgagaaccatggcactacactggtaggaattatgctaaattacaggatataacttgtcactgctaatattgataaaggattgcaatctgccatatattttcagtctgatatgcagtccccatctttgacaatttcattcatattctcatagtaaagttaaactcatttttttccctttcaggggtcacatgtcaagtcaggacgtggttgatttcatacgcaaggaattacgctcggtgagtccatcttcctcatttttctctgattgtcatgacagtaatgcatagaagagtatcctttcgaatgaataaatttcaagaacctaccttcatagttcatacatgcgctcttgaatcaagtagtaattttttactccatttctaaacacatatgtgggtctgcttggctggctggttggtatttaggcaattgaaatctaaagtctacatgcctgtaaccgttcatccatttgttgcttgcaaccaacacagggggaggaaaatctgcgcgccatttgtgagaagcttcttgatcattgcttgacctcgagggacaacgtgacggtcatactggttcggttcaagcccggcgccgcggttatccctatcctgtccgacatcgatgaggagcctgtcctctccgacgttgaggaggagccccatgaacctcaacaaaatcccggggatggcggcggcggcggcggcggccagcaagacatcggtggcgaatcagaggagctcccattggcccattttcctcaggaatagttcgtgctaggatcttagctagctgcagagagttttgatgttacagtgctatctccctctttgtccaaacaaagttgatggggatgcaactaggagtagttcattaccataggagtagttccaactcgtcagcacgtactacacttacgttttgcctgagatttacctgaattcgcttcacgcacttttattactattgttctgctctggaaccctgaagattttgatcgaacgttaacagtgtttaattcgtaaatgctcactgccttttgtaacttctctagcaatgtgcatgattttgaagaattttagtgctagactgctagtgaactaaatatttgcgtgacggtgtttatcagatcagtgtatgactgtatgtaatatcctatgaccgctgaattaagctagacaataatttcaccatgacacagatcgagtcggagatgcaaagaaaggaaagaaacacagatgggagaagcccagttacggttttagcgcaagctttcaaacacgcgctttacttctaatcaacatcattaattcgatcctgattcggacatttgggatggattccttcacacgtgcgcagcctgatcagaatcggacacacccacgaggataagaggcgaggacgcgacacggcgacaccatccttcctcgcgccaccaccacgagcgtcctactatctttcatcccgccaccgcctcttgcctcctcttgctctccctcacttccggcgaccatgggggatttgatcttggatccctacatggaggacgcgatcttggatcatccctgcctcgccgaacttcttgctgattaaacagcgctcccaatgttcgactctttctccggcggcggcactccgccgattgataccgacaccttcctccgcgccatcggcgcgctgcctccgcttgcaccgccacaggaagctccgctcgcaccggcgccaccggactccccccgtacccctcacacctacggcagcctcctccccgtctacggtgatcatccactgctcaccggcgccgtcgtccaggagcccttgccgctgccagaaggcggcgatcaccctgtg

SEQ ID NO: 63717 - DNA, 8399 bp, Oryza sativa
acgagttcagccggttccacgagctcgccgacggcacgctccagcgcgccgcctacttcctggaccgctacctgtcggtgacgcccgagtcggacgacgcgctgcagctccgcctcgtcggggccacggccgtgttcctcgccgccaagtacgaggaccagtacaccctgaggaagatcgacgccagcatggtcgccgcccggtgcggctacactagcgagaccaggcacaagatggtgtcgtgcatggagaccgagatcctcaacgcgctcgactacaacctaagcggcccgacggcgtacacgttcgtggagcacttcaccaggtactacggcgacggaaaaaaagagaagctgttgaaggaggctgcgcatcggttcgccgacgggtcgctgctgacgtatggattccactgctacctgccgtccgtggtggcggcgtcggcgatcttcctggcgaggctggacgtgctggggcatgagccatggagccaggatctcgcggagctgacagggtacaaggccatcgacttgatgggctgcgtgtgcgacatgtacagtcaaatcgcatgtcctcgctttgctctcttccaagagtacttcttcgagaatccatagccaatgtatccataggaagaactgttaggaaacgataggcgaacaaacgataaaaaacaatagatcaatcacaaaagacacgagatttaacgtagaaaatcctcccaaaacaggagagaaaaaaccacgggcgccagccagcaaaatatcttcactatatctgaggtgaggttatatcgccgcacggcggcttacaagagatatatatatagtggaaccctaaaagggatgatgatccgtacggcagaagctggcctttattaaatgtaaataaatttggatcacaactcaacgagaacaagagtctgtaaaagcacatgcatgcaaagcatgatggcttcaattttgcactgttgtctgtacatcgatctgtaaaaccaaatttgtgaatttttggttgaaatacatatgattcatctcaattcaaaatttattactattttttggtactctgttctagtgttctgtgatctctgtacaacataatctatctctgtcgttccgttttttttttactgggtttgcattcgcgaactagcgatgtcccgatgtctagctagtatctgttgcgttaggatgcacgtacagaacggcaaataaccgcttagatcaaattgctcggattagtgctttcctagtgaaggaaaatattgacttactagagtcctcgcgccgggactaatgtctttggtctctccggttgttttcccttttattctgtagtactccgttgagtttctctagtctcactcagttgtcaccctgatcccccaactgtaatcttcggtactgcttttctctctctaatatattcggcagaactcctgctgccattcgtcttaaaaatattgctcggattagtatttcttccatttaaaatataagatgttgttaacttttagatataaagtttgatcatttggctcaataaagaatatataaatattatttatttgagtcccgctccggtgctttctacctggagtagaaagcaatctgagccgttgatcatatttagttggagggttgagatttagttctactcccaccagagttagtagtagtagaaatttggaagagtatattcgtccaggataataattcacgtaggggtattatcgtagtttatcagtatctaactcaccctttccctgcgccaacccgggccactacatcgcgctcgtcaccctccgcgtcgccgaggagatgcggccgccgccgccaccgccggcgcgggccgagcggcacggcacgggcacggtgcaggtgacgcgggtgaagctgctcaagccacgggacacgctgcttcttggccaggcgtaccgcctcatcaccgtcgacgaggtcaccagggtgctgcaggcgaagaaggaggagaagtcgaggagggcggcggcgcagcatcacctggaatccaagcccgccggcgccgttggagttgggatcaattccagcggcgacgaccacacgaggcctattaggcctgcacatttgtatattgtttcctgtagatgcagttggtagtaagacaagtgctagagatttgccaagttaggtgccaacacctgaactcgagttcccctgcaatgaacaaggtttggtcgttgaagaactgaaatgattgacagaacagatcatcaaagggaaactggagcatcatgccatgtttgtacatggctgcaaatatgttctgttggggataactaccctaacctgaatttattttcctttcttgatgaatcctactctctcatgtcctaaacacaactttggtgtcctaaattataatgctatcaggaaagcaagtgcttttcgagccaaacctactcatacaatttccatgtatcacccatttacaaataccaatcataaaaagtttcagaagcttggctagcacatctgtccaaaacaacatgggtttgtggctgtacaacaaagcaccagaaaaaaaaatcaaccattactggttggttgcccggtacagatttcagtagacagaatgtgtaacatcccggcctagggcttaataggattaataaaatactcatatcaacaagttacaacttcttttccggaagccagtctccaaagaactccagggttaagcatgcttggcttggagcaatttgggatgggtgaccgaccgggaaattcttcccgggtgcacacgagtgaggacaaagtatgcagaaaagatatgtgttggtctgcttggcctggagcaatttgggatgggtgaccgaccgggaaattcttcccgggtgcacacgagtgaggacaaagtgtgcagaaaagacatgtgttggtctgtgagggcagtctatgacctatgaaagctatcagatgtaagcgggcccggcctgggagagggagagaggacgttcctggcctggggttgatcgacgggggcgtcgatctctcttaagggggtgagggtgtaacatcccggcctagggcttaatagtattaatagaatactcatatcaacaagttgcaacttcttttccggaagccaatctccaaagaactccagggttaagttctcgggtgcacacgagtgaggacaaagtgtgcagaaaagacatgtgttggtctgtgatgtgaaagaaaaaggcccaaattccatggcagagagccacacaaatcaacgctgtgtggtccttctcctggagcttggagatgacggacatgtacaggtcgcgcacgcagcgaggcgctggtagggcacgccggccgcggtcaccgcgtccgcttccttcacgtcgagggacatccgatgtgtgcaaacagagcgaaacgattttccccttcaatcaacgctggcagcgccgccactgatgggagtagcgataaccctttttttaggagtagcaattgtacttgatgcgagcgatgagacagagaaatatcccatgccaaaattacccctaatctgtattaaaagattactaatataccctttaaaataaagggtcgagattaattctacttgtagtaaaatactttaagtagagagcaccggagcgtcactctatttattttattttgttgtgacttattttattattaatggtaattgtagtttagcatatttacactatttttttaataaaatgaatgatgaaatgttatgttcaaaagtacacaattatagcgaaagggcctgtagcctaatggttacaagagcctcagtagtacctgaggtcctgggttcgactccctatgggagcgaattttctagaatttaacggcgttgtgttttcagtgataggcaacgtactcatcgacaacgatgctcctgttgtgacttcgtcaatctcaaggatttgacggcccaataggggcaaggtttgcgtgcatgtgttcatagggggtgattgcgcgtgcgctgtgaatgtcttcaaggatttgccaagttacacaaaacgacaagtagccaggttacacaaaacgacaagtaataaacagatccaaacgtaaataaaacgtaaaatacttacagaagaggcacttagtcctcacaccgaaagagaacgatagcagcggaaaaaggcgatcctagcggggcttcagctccactccacaggcaaaactcaactgtggtatgagccttggtcctctaactttgagccgcggaaaaaggcgatcctagcggggcttcagctccactccacaggcaaaactcaactggggtatgagccttggtcctctaactttaagccttggtcctctaacttcatcttcagccttggtcctctaactttaagccttggtcctctaacttcatcttcagctcagaagcactacacttctgaaaagggggaaataatagcaaggctgagtacaaccaccgtactcagcaagccacaccaacgatgcattcgtgcaaggggagacaaagaggggttttgggggctatttgcgtaaaggcggttgtaaaacattttattgagcaaacagtaaacagttgagtaattaagataatattaaatctccacttatcaacgctacaccacgttgaacaggcccaaccaacccacctgaactacagtgcattgggtcgatttattaagtgtgagactaatcacggtgaatctggtcgatcgcccataaccgtgggcacggctattcgaatagttttactctggccagaggtgcacaactgtacccacaagacacaatccaccggcatgtcaccgtgtcatcatgtgcccatgatgaacacgtcaccacgtcgagtgattgtgacaagacccttcatataactctcccctaaccatccacaccacgctaaggtttcacccccactcctcgcaaggcagcgggcagtcccctcgtgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcactgtaagtcttccagggtttcccgtgaaccggtccttaattgccatggtgcgactagtaaaaccatgcacccacagcccaccattcagtcgcattttagttggataattacgaccaatgcaacatggtcgggtgtctcgagtacgcagctcgttctgatactaacaaggtctaatactgcaattatcccatcaactgagctagtggcaattaagtatggctaagcatatagttctaactaggtcacataagtaacatgagctagtcgatttattacccaatgttgacaaatgacagatatcaagtaaacatggcacaagcgagccgataggtaaaccctgatcccatgtaattagcaaaacatgcatatttatttgcaaacagtaaaacattaataaattgggatcaacatgctcaaggggaatgtgtgacttgccttgcttcttcacttggatcttctgaactcttatccttgcgaccgcggactttcgaaacaacggaatctacgcgctgtcactcaaaacgaagaaaaactctaataaacaccaaggaaacaatacataaaaagtaaacaaacatatagatctcaattttagatgaattttgcagtttgaatggctcaatttggagtttgtatgaattagatatgaattttagaagtttttgagccattaaatgaatttctataattattaccgatttattgcgcaattattaaatatatttttccaaaggaaatggttgttgctgacgtcaacaaaaaggaggggcgcggaccacgtccacaaagcacgaggcccactcgtcagcgggtcaaatgagttactccaccatggaccgagtccacggtggcggtgcacggccaaaagggcggcggcggctcacagccggatagctgagaggcggtggcgcacggccaccggccatcgacagcgagcggcggcgcgggaaacggtggaagggagaggggtgctcaccgaggacgcggcgatgagatgcggcggaaggcggggagagatggtgaatgtggcggcggcgtttcggcaatggattggggaaggggagcggtggacggggtgcggcacgacgcagcgaagctattggtggcggcggcgcagcgcgaggtggaccggagaggcggcgcggcgtggctggaggtggcgatggcaaaggtggctcgggttggcggtggaatgggagtttcggtgaggaattggggaaacgaggtggaggccggtgtgcggctgggagctgcgtagctgatggtggtggcggctcggtgcagcgactggtagggcagcggtggtggctggctggagagcgctggcgtgcggcggcaatggggaacggcatggggagagcgagggagtgcgcggcaagcacggggaaaatggggaaaaggacgagggaggtgcgggatgcatttttatagcgcggggaggcgatgaggaggccggggagtggcggatttggggtggcaatggccagcgacgtgggcgacatcgtgggcgaagtgggggctcgatttggcgccaaaaattgaggaaaagtgggggatttggtggaggaggtggaggggaaccgattttatgcggtttgggcacgagggcgtgagcgggaggacccggaattggtggcgacgtgggcggcaacggccgtccatggcggcttttgctccggggaccgaaggtagaggaagggcctgacatgtggggtcgtcgggcccacctgtcggggagggagagagggaggagaacccaggggaggggttaagcagacttaggggtagaggggagccgagctgggccggcccaagagaaagaagggggcgcgcaggccgcgggagagaaggaaggcttgggccgaaaatggcccaaagagaggaaggaggattttatttgttttctatttaatttaattggttaaataaactttgtattattataattacttcttgagctccgaaaattcgcaggaaatttcaaagggttcattagggcacagaatattacaaaatattctcggccaatgatttttaaagaaaattttcaatttccccaataattaacttgattaaattgctttaacttttattaaatttctagaaaatggattattaaatgatttttaatcccgaacgaaaatcgggccgttacattgcgcgtgcgttgtgaatgtctatgttgtactgtgtaattctaataaaaaagggccggcccagtcttcgaagatgctcatagaggtagggtttgcgtgcgtgtattcataggggtgagtatgtgtgcattgtgaatgtcagcgttgtactgtgtaagtctaaaagaaaaggtacacagttatatttagaaaacagcatgtatttaaaaacaaagggagtacttaatcaagttggcactattcatggctgatcattaatcaatagcaaatttttttattggacattatagatttatcgcagaacactctaaaaagaaggctttgttgtaggacactttggttttctggtaattagctaaaatactatgtgacaattttttaaccattttttgttcaattggagaaagacaattttggaaatgacgtttttacccatgacaaattgcacactcaaccttgttatattttcgtcccaggcaatgttttttttaaaacaaaacattttggagacaatcaacagaatggaaatttacaaaaattcaaaaaaaaatattcgaacaaaaagtttgtagtttgaaaaaaaaagggtagtgacacctctatcctcgccaacttggacaatcaggccgacttagactgggaggctaccatgcatctatgatagtagtaccagtccgagtatacataagtttgtacacacataacaacagttgatcagagtagataacttcattacattactatgatagttcttaagaaggttgccatcatggctagaccctacatgtacaaaacttcagtataaaatatggaggcgaaaagaaacaacgtcagtgcaaaagctaacggcggaaagcgtctaagcatctaagcactctaagcatccaagcaactaactttttccataggcatggtttgggaatttagcacaaaagacttcatgtttcgttggtgaactcctcgacgattgggtcaacatcttctccttcttcaaaacctaatatgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgg

SEQ ID NO: 63718 - DNA, 20359 bp, Oryza sativa
  unsure (1)..(20359): unsure at all n locations
ccaaagaacacaggagtagggtattacgcttcccagcggcccgaacctgtatacatcgtccgtgtctcgtgttttttcctgggacgcgatctttccacacacagcgagagcttgagatctcaccctaagcccccggccgaactggcaaaggggggcctgcgcggcctcccggtgaggagccacgagctccgtcatctggcgcgccaggtagggggctcagcgtgtgttttctgagctctcagactcttccgtgggcgccaagtttcccttgttcagcctaatggccgagcaagcaaaggcgcacgacctctctccgagtgtgagcggcgacgacggggagccgaatccacgccgtcgagctcgtactcccccacctcctccgcgccaaagccctaagcagggggaggcgcttgagaaggtcgacaagtccatggcatcaccagccgcaggtgatgcaggagaacggcgagatggggagcgtcgcctcctcgtctacggcgacggcagcacgcctcagggcgcgcttcangctactggcgcgctcttacgacacccgcctgtcgtccatgacccggagtctccagcccaacgatggctggaagatgtggccaacttggtcatgacggctcagcagcgcctgggtgctggtggacggtccgccaccaccaagacctccggcgccgccaccaccggttccgtgtcatcaaggcggagggcgcggcgagcggcggcggctgcacgtcgttcggctgccactccctcgtcgacacctccgactcgggaggatcagcatggagagccggatgcccgcctcgacatcgagcgccggcgtaatagccggcgtactccccgcgcaacggagggcgcctcttcgtccagagtgtcacctcgacagggacgtgaggaccagccctccgtgcccccggctggtggtgtcggctgtagagcctttgtggcgagtcttcggaatgtccgttggcccccaaggttccggcccaccatcaccgagaagtatgatgggagtgtcaaccccaccgagtttctccaggtctatacgaccgggattgaggccgctgggggtgacgacagggtcatggcgaatttctttcccatggccctgaaggggcaagcacggggttggctaatgaacctgccacccgcgtcggtccactcctgggaagatctgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactactgcggagctttttcagctcgcggaccgagtggctcgcaaggaggaggcctggacctggaacccctccggttccggagtggcagcttcggccgcccccggatccgccgctcagacagggcggtgtgacaggaggaggaagaagaggtcagcccataccgacgacgagggtcatgtcctcgccgtcgagggcgctccgcgggccacccgaaaggggaggcctgcgagcgacaaaaagaaggaagccgacgctccctgacctcggctacttggaagagcgaaggcggcgcgcggccctccgagccgcgcgctaccagcagagcctgcggcgctatcatcagcgccacgtccgggcccgatcactctgcgtcaacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcaaacaccttcgtcgcttctacccctagtgggggtcgggtgtcaggttttgggctcgggccaaccccgcacccccccgggcgtgcatggttggccgggggcttatctttttttctcttccgtatttcaataaaagcattttcgatttcctaaaggctgtgtctatgcttttgtttccttttgaagaatcttgacttgaaataggtcactcgtgttcaatcctgccctcgggggctcgggtcggctaaaatcgccaaacggggcccagaaccgagtcgtgccccggggcgtggtgaactccgggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttattcaagccaagacacagaaggaccatggcacagaccatcctcgtctcatacacagaacaaatgaaattgacgcaaaaatttcctctttatttgattgcagattaaatcagcctataacaagaagggggcctgaaggcctcggaagaagaaagaaaaagctattcaagattggcgggggcctgggggctcactccgacgcgcccgggtcaccagccttgtcgtcgctgtcatccgcaccatcgtcaccgcattcctcgtcggagtcgagggcgaacgcgaaccgaggggccgtaccctcgaagctgtggacgatgtggtcggcggcgtcccggtcctgcgcgcgtgcgccgtcctcggttccggaagggaactcttccagcgctgcccacggggagaagtcagggtccgagaggcccccaagccgaacggcggcccaaggcccccgacggccggagttggccctccgcctgcttgtcctacggtgtcaggcgcccccgaccctcaggatagcctcggggccactgcgggaaggccgcgcctgtcgccctcttaccccgagggtatcggcgcagaagccgagggcgccccgcgctgcctctcggatgaagagcgccctggagatgcggcccctagcgaagaggatcggccccgccgaaaggtgcagcggcccgtctactttgttagtgaggccctccgggacgtcaaaacccgataccctcgggcccagaagatgctatacgctattctgatggctccgagaaaagcgccatcaccatatctccaggcgaagcaaatcggctcacccagattcgtacgtcgctcaagtaatgtggcagtcttgaatagaccgcccattatggacaaccaaagttaccaataccaatatgcatggattaagaccgttgggtattttgcccaactatggagaccggtcccacctgtcaccaggctttaggggtggcgtcacacctgaccgcttcccttgggaagggaaattgctctggtataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgtttgccccggccccgagggccgaagcaccccgaccccttaaagaagtctgcgccacgtatatgggataagtgagcacagctgtgctcacctaacagcatttattgcagtctggtcaagcgtgtcacgctgcatgcaacgcagtacagcacgctcttttatccggtctgtgaccggtcacagaccggtcagatcaagggttaggtggcgactggcggtctgacgcacgccttgccccatcccgtcaagacgaaagcctctaggcactcgtctcaagccggagctagcgtgttatttcttagagatggcacgttagccctggtaaaatgaataccaggcttcatcctaaccattacaggcaaggcgttacacgaagaagggcaaacatgcacgttgttaaaccgacgcgtggtggacaagaatgaccggtctgacactggtcgcatcagcaacgggcagccacgatcccacgttgcacctgtctccgccgggagtggaggcaggtatgggctgtcccatcaaagtgtcatttggacggcaaccataccgatctccgtccataaagagaagaaaagtccagtttggaaaggggagggtgcatgtggtatccccttgaagtaaaaaaggaggacctggcccatagagaagggttggttgattcttgagagattcagagcctagaacgagggagagtttagctcataccttgtattcccttcattcacagatccaccaaagaacacaggagtagggtattacgcttcccagcggcccgaacctgtatacatcgtccgtgtctcgtgttttttcctgggacgcgatctttccacacacagcgagagcttgagatctcaccctaagcccccggccgaactggcaaaggggggcctgcgcggcctcccggtgaggagccacgagctccgtcataatatatttgtatagagagcaagggtgagtattttttactccaaaagccaggggaaagatgacatgtttagcttagtcaaggaggctagggcttacgaatcttttaaaagagttgattcacaaaagcactagtttgtcaagttttacctattaaaaagaggctcacacataagcaaggagcggtcacccttactcctagcaacatgggaaatatagaaagagagaaaccaaagagtctttcagcaaacccaactctcaatgatgacgctcgttgcaaaaaaaaaaaaagaagaagaagggaggaagaacttaggctctggtgggagaaaaaaagactagcggagacattgccaaagtcaatcgccaatgtgtagcccttttttcctttatatctgtaaatattgttttttcctactatattcaacggtattgacacgcctcggtgctgatttgttcaaaaaaagaatcacatggctaatcattcatatgtgctaatccaatttagggtatatcaactgcttttggctcataaattagtgttcccagctcttctataggagtgcatgaaacatcaacactctagcggtactcaagccaaagctagataaaccaaaacgcagtaaaaagggttaacaattttggggaaaaaaagagagggaacccataattcaaatttttggaaatatcgggatgaaataagttgtattctaaacaagttttggtcaaatttgaatcttattttgcaaaatttcacaacattttttatgcaaattttgaacaaaatagttttcgtgtgtgtgggaatttcctttagaaacagaatttcaaacccactcaaatttgaacatgcaaaatacggataaaatgtatcttgtattcttattccacttttcatcgagtctagtacgtacttttactttacactaggttatattgaaataagtttcactagtacactaggttgcagcatataattaaagaaaaatcttgtaaaatattggtacaacttgtaaacccttttgatattaaattttatacaatttctatcaaatgaccctcaccggacctcctccttgcggtgccccgcatctccgggcaacgcgcacagtacgttccgccctcactagcaactcctgggtaggggacatccatggcgctcttacagtgccggtcatctcccaattcctactgatctaggatgcagtgcgtcctatccagctctcccggggcattgaggaacatcttgtctagtgttcgactggtgaccaatgctattaagcccactcaacctaccatgctttcttcttggggcagcgcatctttccttgcgccgatctgctctggtaggctaaaggctctgccaagtgcaagctcttcctccgacttgcgtttcagcagcgttggtggatgaccgatctcctgtagaagcgcgacatcgacagccacttggcatgtcctttttgtgcctaggagtttgaaatggcgaatcacatcctcctagacagtgtgtttgcacgtcaagtctagctcctcaaactgtgttcccctggctggcctgggctcgccccctcctagggctgctctattcaggtctggtggccatcggccagggcccgtctgccagagcatcttcgcaagggtttcgactctctcgtcctcctggtttcctggcagctatggaagaagtggaataccaaggttttcagcttctccctcttgccgtctcagcggttttagagtccatcctttaagagggtcgtctctggtctcttgctaacacagcttcttttggggatatgttgggaacataggggagttctaccccctatttccctctttataggagtagctttttttagctttgttcccatttttcagatctccttcctaaaggtctctaccctgtaccagcaagggcatgtctggccttttgcattgtgtaactaaaactctatttttttaatatactgacgtgtaattcttttgcacgttcgcaaaaaaaatatatcaaatgaccctagtgtaaagtgaaactacgtgctcaacttggtgcaaactgaaacatggtgtattttatccggtgacagaacgaagtgctatttactgttatagtgttatatgatgcaaaatcatctgaataagtaacatcttactaaaaccaaagcctacatatgccagtgtttctggcagccaaagctgaacttgcaaaatacaaaactaaataattataaaataaaaacctgcatgtctgcaccagccttttgtcctcctcgcagcaattttatcctttatgcatctcaacacttctcaacttgcagaactgaactcagcctttatttgccttatccctaaaaaagatgatgctacagacgctgatcacttccgtcccattagcctcatgcatagcttcgccaagattatcaccaaaattctggcaaatagacttgctcctcaactaaatgaaatgatctcacaaaatcaaagtgcttttgttcgtaaaagggcgattcatgacaattttctgtacgtccaaaacatggtgcagatgcttcatagatcaaaaaaacagagtctattcattaagatagacatagcaaaggcgttcgactctgtgaattggccatatctcctggaggtccttcgtcatttcggctttgggcatcgttggttaagttggatctctaatctgttttccacctcctcgtcccaagtgctcctaaatggttccccagggatgagaattaatcatgctaggggactccgtcagggagatcccctgtccccgatgctgtttattttagctatggagccttttcaccggatcattaaagcagcggagagtgccaatgtgttagccccgattggcatgagaagtggcagattcagatgttctctctacgcggatgatgtcgcagtttttgctctcccaaatcccgatgacctgaatgctctttctcgcatcctttcgtgttttgcacaaatttctggtttacattctaacatcaacaaaactgagattttccccatcagttgcaatggaatcgacttgaaacagcttcttgccggctggccagggcagatcaagaatttcccttgccgctacctaggcctcccgctccacttcaggaaattaaggaaaattgatttccttcctcttatagacaagatcggggccagactaccagcttggaaaggtcgcttctttacctctgcaggtcgtcaaaccctagttaactcggttctgagtgctatgccgatgcatcatcttacagtcattcatgcgccaaaatgggtcttcaaaagaatcgaccgtttcagaagatcttttctgtggaagggcgaagaccctgatcattcaaatccaagtgatagtctagtcaattggcagactgtttgcaaaccgaaaagcttgggagggttaggcctaccggatctggacaggttctctagagcactccgactccgctggctctggttcaagtggaaagaagttgataaaccctgggtaggcatgaatgtgccttgcgatgagatggacacaagactctttcaagcggcaacgataataacgattggtgacgaagcaaaaactagcttctggcatgataattggatccaaaaccattgtttaaaagatattgtgcccagttgttttagcctggcaaagagaaagcaaagaacagttcagatggaaatgcgagataatagatggctcacttccttcagacaattctcttccgtggaacaaattcatgatttggtacagcttggtggattactccaattggtttcgctttcccaggatcctgacgacatcacctggaattggaccgagtctggcgtctacacaacaaagagtgcttaccttttccagtttgaatgctcatttgccaccaatgagtttgattctctttggaaatccccgactgaaccaaaaataaaattctttggttggctagttctccataaaaaaattttgactgcccaaaatctgctccgcaggcattggccttgcaattggatatgttgcctttgtggttgtgcctttgaagatacaaatcatttgttcagtgactgtgtgtttgtcagacaagtgtggaccctaatttgtcaattccaaaacttgtcttcggtcggaataaatcctgtcctggatgtgtcaacatggtggtctggaaccaaatttgcaggctctaagaaggatgtgcagctggtcaggggaactcttctaactacttggtggaatatttggttggaaagaaatagaagaattttccaaaactcttcttgttcagatattgaagtagcttattttatcaagcaagctattgatatgcgctgcttggcctttaaacccccatgaattttttagctttttctgcagctgtaattctctttccattcattggcttgtaacctctgaacctatgtgctactttgtatttatttctcttctaatgttaaattccgacagatctcctgccgtcgttctccttaaaaaaagaattacttcaagagtgctagaaccaaccaatcactaacgacgattttgatctcaaatttttcaaatcaattcgcagaatcattttcaaaagtttcaatcctccctcttgttagttgttacatttgaatccttttgcagccactcgagagctagctaggagtggtcattagtaccatagaagtagttccaagttccaaatcctgagcacgtactacgcttacattttgcatgagatttaactgaattcgcttcacgcaactctctatatattgtgtttgctctagaacctgaagattttgacaggtgataccagtggttaattcgtaaatgctcagtgtctaccggaacttctctagcaatgtgcatgaatggataatattataatagtatgatatatcatctttttttaaaaaaaaacttgatatatcatctcccatgcgtaatcctctgttccagactctagtggatttaaagaatttttgtactagtggactattttctgtgtaacggtgtgtattagtgtatgtaatatcctatgatcggtgaattaagctatacattaattaatctattcatgacagagatcgagtcagggtgcaaaaaggaaaaagaaaaaaatggaaagaaacacagatgagagaactaagagaagcctaattacggttttactcctatatacgcgcgtaaggcgcaagctaaattaacgactccaaacacacgggctttacctctaatcaacatcgttaattcgatcctgattcggaaaaccgcgcgcgctctacattttgatgaattccttcacgcgtgcgcagcctgatcagagtcggatcgtgtcaggcaggttaaaaggcgagagcgcgacaccatccttcttccttcctcccgccaccaccacgagcgtccaactttcttcccgccaccgcctcctgtctcctctcgctctccatcgatctcacttccggcgagaccatgggggatttgatcttggatccctacatggaggacgcgatcttggatcatccctgcctcgccgaacttcttgcagatcaaacagctctcccattgttccatcctttctccggcggagccactccgcagatggtggataccgacaccttcctccgcgccatcggcgcgctgcctccgcttgcaccgccacaggaagctccgctcgcaccggcgccaccggattccccccgtacccctcacacctacggcagcctcctccccgtctacggtgatcatccactgctcaccggcgccgtcgtccaggagcccttgccgctgccagaaggcggcgatcaccctgtgcctcccaagaagatcaaggtcgcaccgctgctgccagagcgcgccgatcagccggtggtcaccagcaactcagcgacgacgacacggccgcagctgtgtgcgccctacgacgacgaaatcgaggccaccctacgtgccatggagacgaaccctgccgagcggccctccccgtacttcttggagacgacacagggcgggcggatgaccgcgctggtgcgcgcctcgatgatcgctttcatggacgagttcagccagttccacgagctcgccgacggcacgctccagcgcgccgcctacttcctggaccgctacctgtcggtgacgcccgagtcggacgacgcgctgcagctccgcctcgtcggggccacggccctgttcctggcggccaagtacgaggaccagtacaccctgaggaagatcgacgccagcatggtcgccgcccggtgcggctacaccagcgagacgaggcacaagatggtgtcgatcatggagaccgagatgctcgccgcgctgggcttcaaccttggcggcccgacggcgtacacgttcgtggagcacttcaccaggtactacggcgacggagaagaagaggagctgttgaaggaggcggcgcatcggttcgccgacgggtcgctgctgacgtacgggttccaccgctacctgccgtccgttgtggcggcgtcgtcgatcttcctggcgaggctggacgtgctggggcatgagccatggagccaggatctcgcggagctgacagggtacaaggccatcgacttgatgggctgcgtgtgcgacatgtacagtcaaatcgcatgtcctcgctttgctctcttccaagagtacttcttccaggattgatagccaatgtatctataggaagaacaagagtctgtaaaagcttatgtaaaaaaaaagtctgtaaaagcaaaaccatgcaatgatgcaatgcatgatggcttcaatttgtagagttcgtatgtacatcgatctataagtccaaacttgtgagttttggttgaaatatatatatgattcatcaattcaaaaaatactaacttttcgtacttggtttctgtacatcttgatcgatctgtaccgtctctcttcttcctactggcctactgcatgtacacgcattcgcgaactcgcaacttctcgtgccacctgccacgtgatatgctggtagtatctgttgcgctaggacgcacgtacacaacggctgaaccacatagccaagcttcctttttttttaacgaatcagcattcaggtgcgccaatttcattgaatatactggaggaaaaaactgtataggaacaagagatttacaaaaggaaaaggaaggggaaattattttctaaaaaaactaaggattgatatgtgcaaggcattttgttactgctagagcccaagttttggtctcctcctttattttcatagtgatggatattgtcgagagctctatgtgttcaaacactctattgtttctctccttttatatctctcatgtcgttagtagtagcagcctgcaaacacctttcctgcacaccaggtatggactgtagcgggaatctagctggtcggcttcatgtgttcttgcacattcagtttgcgagcatgcatgttccatatccttctcgtatatctacggtccacgaggaggtggaaggttgcctccaaagtgtgtctgcagtaggcattaggtgtttttttggacatcctcgaatcacttatttgtctaacgtccagtccctattatgaatcacaagccaggcgaacagcttatatttgtttgatgcccacacatagtttgtgctagtggatccaaggaacttttttttaggtggaaccaggtactcttcatgatttgtgagctgcacgctttgaactgttgcccacaggatcactagttgctccagaagctcagttgtcatggctacagtattgagaggtttaggtctcgtgaccaggtattatctgcgatgacatttctcaaggttctattcttcgttttggagattgcgtatacgtacacttgtggcatgacttccttcgggtggcgaccatgcatccaggccgagtcccgaaaacgtgatgctactccgtccccaacggttatcatcgtaatcacgaagagtattttatcggtttcatcacatggggtatccaacccaacccatgccttgtttgaggatttctatttatgacatagccatttgacatgtagtgctagtgcgaagctttctagatttagcgcgtccaggccgccatatataggcaactggtgagcatgatctttttcagtttactttgcatttcccgcccattatgttttcctgacccgctcataggaagctctttcgttgtttgtcaagcacttttatagattctttggtaaatttaaatgttattaggacatagactgactgcggggaaaacactgacttgaccaaggtggtgcgctagctagccccatgtttctttcccgccaagtggccatcgttcctgttgatttatcgaagagtggttgcaggtctgccttgcatgtgcaatctcccaacggtgaaaggtagtcccaggtattttattggtagtaatgtccgcgtcgttggtatgttctttggtacatcgtcgagatctatgttctcacacctaatgagtgccgtctgcgatttttggatgtttgtacaaagtcgagctttcggagccaaattttttacacggattgaacaaagtttcggggctaggctttctgatattgcttactcccaataatacatataatccacagtgttattagatagacaaaacaaactatgtaatttctctaactctatttttatattagatttacaccaatatttagtttgataatgatcgaattcacattcagaacaattttctctatatgctctaatcaaatccagtaaaaatctgcaggggtgcacgcacgttcatcaaattgctctgatcagacgaaagcttagcctgcattcgtttgcagggcttcccaacttccccatctcgtttggcacaattcaggactaattaatcaattaatcgttcttaagtaattttgttaatagtgtctctaccgtgttccttagagaaatagatgtattttaagaatttaagaacagtagactttttttttgtgtgttccggtgtatatggaatggagttattatcctacccaaaatggtattgatcggtgaattaatttacagcgctagaaattaattccattgcaggacagagatccagtcggagtgaagaaaaggaaagacacacatatgtgagaaacccagttgccgtttttacgcgcttctttgatggatttttcttgcgttcgtgtttgagttttgatgactccagaacgatttgaaaacattaacctgatacccaattttcttgtacccaaatttacacggacgccaaaaggaaaaagaagaaagaaacgctttcgtaagtcgacatactaattcaggactataaacaatcaactaatcatcattaagaaattacagctatccgttaatcccatcaggaatttgggacagagtcggagaccgaaataggaaaggaacacaacctaattccaggttttttacagcctagtacgggttcacaccgattcgcttggttcaaatcaaatcgatcaatacgatcccgattcggaattgcgcgcgaagcctggcctgaatcggatcgaacacccatggtggcagccaggataaaaggcgaggagcgcagcgcgacaccatcaccatcgcctcgccagtcgccaccagcgtgtgcaagtttcttcttccaccactagcctctgctctcccactgctccggcgagcgagcgagagcgaccatggattcgatcatggagccctacgtcgccgaccttctcactgacgacataacggcctcgatggtcgagctcttgtccggcgacggcggcgcggcgcagatggatgtcggggttcttgaagcgtacctccgcgccatcggcgcgctcccggcgcatccagcggcgcccggcgccgacctggccgccgccgccgaggtggagtccatggcatcgaatgatgacaccaacggcaactgggacacgaaggtggatgccaaggtgccctctgcttttcttccgccgccgccgggctttcctccgcttcccgttccagcgctggccgacgagcccgtgtacgccgctcccgtcgacgaaggcgacgctatcagggcgttcatgcagcagctggagtggagcgagcagtacaacggcgacgacgacgctccggcccccgacgactccatggcgtcgcgcccgcagctgtgcgcgccctacgacgacgacatcgacgccaacctccgtgccatggagaaggacgccgccgagcgcccgtcgccggactacctcgacacggtgcacaacggtcagatcagcgcggcgtcacgcgcctccctcgtcgcctggatggggaggctcacccaccgctacgagctcgccgccggcacgctccaccgcgccgtgtcctacttcgaccggttcctgtccgcgagagccctgccgagctacaccgagcaccagctcagcctcgtcggcgccacggccgtgtacacggcggccaagtacgaggaccaggggacggtcttcaagctggacaccagggagatcgccagctacggcgagttcgcgtcggcgcaggaggtgctcgcgatggagagggagatgatggcggcactgggctatcggctgggcggcccgaacgcggagacgttcgtggagcacttcacccggtacagcaaggggaaggaggagctgcgcgtgcagcggctggcgcgccacatcgccgaccggtcgctggagagctacggctgcctgggctacctgccgtccgtggtggcagcggcggtgatctccatcgcgaggtggacgcttaacccgccgggcgcgctgccgtggagctcggagctgcacgagctgacggggtatagctctcaggatatctccagctgcgtcctcaccgtgctcaacacgcagtgatcagccggtgatggatggataatagttacaagaatctggcaagaaatgtatttttgtaatttgtgaacacattggcaaaaaatgttacattgtgttgttcacaatcattgtctcagaaagattgcttctagatttatcaatctggattcatatggatgtacaacaaatgtaaccgtgcaatgtttcaatttaattaattcatattaatctatgttgtcaatttttttataactatttagctaacatgcaaacaacgagaggatattttctcgagggatgaaaatccatatcccttcttcgaggatccatagccaatgtatagaaagaacaagagagtctgtaaaagcacgagcatgcaatgcatgaatatgatggcttacattgatctgtaaacccaaaactctgtgtgttatttggttgaaatataggagtatgtgattcatcaattcaaatttactagattttggtagtctgatctctatatattgtatacactttcgtttctttctcctactgggcatgcattggcgaacccgcaatgtctaatgcgcacgtttggaatttcggttcgaaattcaaaccctcccctgacacaaaactatgtccgacttgtgtgtgtgtgtgtgtgaatttagcaaattttatttaaattcgatcaacattggaaatttgagcaatatttatcaaatttgaataaattttgctaacttcacaatagtttgttttgtttgaaatttatgggagggggattgcaaggtacggcgggttcacgtcggcgcaggacgtgtccctcagtccctcacggagaacgcccgtggtcgcggcgctcgactaccggctgatctgccagcgcgcccaaccgcggacgcattcgagacttcacccggtgcagccgaggagaggaagaacggccgacggcgggtgcagctcagctggcgcgcgacgtcgccgacctgtcgctgatcaactacggctgcctggctaccagctgccgtcactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatctgtgacggcttgcacttgtaacccgtcacagatcgttgtgacgggtcacaaccatggctcgtcacaaatgacatgtcatctgtgacgggtgtagtattatgaaccatcacaaaagagaccactcatctctgacgggtctttaactaacacacgtcacagataacgttatctctgacgggtggtagttatgacccgtcagtgatgagtgaaaattcaaatttttaaattttgcgaaaaacctcggattgaaacatgtcctatataaaagttgtagctctcaatgatatccacaactttataactaacaacatttctattagagatcgtttacatccccgaagatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatctgatgaagatattttctatgtaaaagttataaaacacgatgagatctataactatttagttgataatattttcatttgaagtcatttagggtgttaaatatatgttaaatgattcagacaagcatagacaaaataataacattggattagtagtcaatatgtgttgagtaggtgagttggtaagggagctctatatggaggttgaggtcttgagttcgaatctcacttgtagcatacaagttatattgcgtgaaaaattgtgaatttgtaggtagtgatgtgtaaccatgtataggatggctagtaaaattcaaaatatttttttgaggttttttgttgcatttaaaattcaaaaattgtatttcttgctttgtcatcagtgacgggtcgtaagttacaacccgtcagagatgagtcatcagtgacggtcaggtagttacgacacgtcactgatgactcatctgtgacgggtgacaagttttaacccgtcagagataacttatataccggtcagagatgggttatctgtgacgggtgtttcatccgtcacaggtgattttgtcatcagtgaccactaatcactgaccaagaccaaacccgtcaaaggtgagggtttgggcccgtcagagatgacctggtccggcgtagtgcgtccgcggcggcggcggcggcggcggcggcgatcttcatcgggaggtgttcgctgaacggagctgcatgctggagctgacggggtacagctgcatatctcctcgccatgtagaacgcggtggtcgatcggttgatcgaggacgagattggtaggactgtaggagcagatatcccttgtaataaacaatgttatgttaattcgttcatcatggttgccatgcaatgcaacttgagttttttttttctttttgccccctcagcaagatcctacaatctttattaacacggcccagatgttgtgtacatccatatttgaggtatgaattttaaacttagactctaaggaatatttcttctatgttatctaaatagttataaaagatattattccacaaatatataagtcaaaactcaacttctaccaggaaaaaaacaaattaaactatagcctagttaacggataaccaccattaattttgtttttttttcaacttgtataaattgaatttgatcttgcacgtatattcgtggaatgatctatattaatctattttgtttatattttcgtattcgaatgacatgtaaataactagaaggtgtcctctagtgagtgagtttagaattgtttccccatatttgtaacttgtggttttttgcccttctgaatgtgtacaacaaatgttacacatcctttgtaacatatgcattgtttcaatttactgtagttcgttttcgttggtaagtggcaacatatatacaccattatttagtcgttgcatttcattgaggggataaaattcaaacatttgtcatggcaggagcgagataatgttgtactaatccggtaatccctgtacagttttttctctggttttctctaggaagtttctctgagctccacatttcctgtaacatcttaactgggaaaattagcgcatcatgtgcaacgaaactttattgttagtgtaggataagagtgaattagtatagttcattaatcacaatttggttgcataataattggcattgaaccagcactccagcagtaataaaccatactgcgtgactcataacttgttntaagtacatgaataatatataaatcaagtgttcttttccccctttttcaactccgtgcttgcgcttttaaactgttaaataatgtttttaaaaagaatttttatagaaattttgctttaaaatctatattaatttaattaaaaattaactaatatttgattaattatgtgctaattcgtcgatctgttttatacgtctgttgtagataaagctagattcagtcctactcattataaacgggccaaatttaggcccacataggagtttaaacggtctgaatttaggcccaatacttccgcggactaaaacgagggcctgttttgtgattattgatgggcctaattctggcgcgataagcgcagcccgagtccaccagagctggaaattccccattcccatcccaccgccgctcctccacctccccacacgtcgtccacgtccggccgccgcctgccgcgccgcgccgccggcgccgccatggccggggctccctccgtctacgccaatgtctcctcctcctcctcctcctgctcctgctcctgctccacgcgccgtcgcacaccgcgtgctgccttgcaaccgccgccgccgccgctccacctcccgcatcggccaccgtcgccctcgccgacatggccgacccggattccttcttccgccgctgccgcgtgctccgatgctctcgtggcgtggcgcacagctcgggcggcgagcccgcgagcgcgaggaggcgctggcctggaccccggaggggaggggtgaggctgtggttgtgcggcggccggagcagaagacgaagggggtggagctaagcggccgacgacggcgagcccggcggcgcgtgggcctcaatgcagctcctcggggctcctccgcctgtactcccgagcggctcggcggcgccgaccaataccccggctacggcggcggcggaggaggaggaggaggaatccctcctcgaaggccacaaggcagcgcgcgagtgggcccaggtgcacgggcagcacgaggggcgcacctgggccgtcggatcaggcgcagcagccacgttgggccaatccaacggacgagatgcgcccgctcgggccgaagacggaagctttgggttggttttactactttttgtgccccacctcctcttgcatgcaaggctttggctcctcccacccacttttgcttcgcaaccacaacaattttcacaagtcacaagcgcagcggaatcgcggagaggtgagggcttgatttgatctctctcccactctctcctcctcctcctcctctgctttcctctgctccaagacaaccgtgagatttcttctcttcttcaatgtccatgtgtttgtgttggtgatgctgttgctagtagccgctgctcttctagttcttgctgtttcgtttcgttcgccgtggtcctgtggagtacttgatcgagaccattgggtgttgtgtttgtcttcgatcttgagacgattctgtgagagttttactcttggtctggaatgctgcggcctgtgttcttgcgttggtgtgtgttgatgttgttgcggttggttttgaagttggtctgtgttcttgcattggtatgtgttgggctgcaggaa

SEQ ID NO: 63719 - DNA, 1902 bp, Oryza sativa
atggtggcagttttcttggaggagaaggaggtgacgagcaccaacctatggtgatcttcgttgtctccttttattttcgatcttacttatcattcttctccaccttgttcctgttgttgcgtctactgctgcttccgtgtcgctgctgttgcggttcgcatggtctctgttggaggaggtggtaatctgtaattctgtatctgtccgtcttcttgcaactggatagtgttcatcagttcatgagttcatccttcatcgtagcacccgtttctacctacgcattttcttgatgtttcttttcctggcgttatcgatgtaaacatggccgctcgatgatctatatctgctcgtctctatcgtttacttattttggtatgtttttccagattctttctgcgtgtaggtgtgctttcctctctttttttttcccacactgggttttgacgttctgttgattcctcttattcttgttgattcttgatgatgctgtgcatgcggaaactcggtgatcttgatttataacctgtccgttcttgctgttgagtgccagcgagcagtgttactctgtttttcatgaaagtacttttcattcagtagatgtttacatccatagatgtatgagtctcttagttcttacttactatcaagcaatcaagttcaagccatctttatttgcagctcacattaaatggtctaacacttgatgatgtttcacttccccagtatggtgtgaagtgcgattctgttaagtagtttgttacccggcaccaggtgttactgaaatttgagtgggaaatcttagcctgtgattatttgtcccctttcatatcgtgtgcactgcaggctgctgcatttgttcttggcacaaactttggagtttttatttttgttctgaaatgctgaagccatttttcatggtcttcttaagtcttagtgaccctgatcagtattgaacaatgtttggttcaacagatagtacaatagtgtgttcacattagtccttacaggaaagaggcttctgccatgggtgcatctcccagccgtccactagaacaatcaccatcatctagtgaaggagagaatcacagagttaagtatgcctcatatactacgcaaggatttcgcccgcacatggaagatgcagtgagtaatcttgcactcttttaaccaattttatggccataaggtgtttacctgtaagtaaatgtgatcaaacaacaagcttgatttgtacctttcgtattatctagcttgcagttgaactagatctagatgcgaccacgtcattctttggtgtttatgatggccatggaggtttgatcttcattctcatcttttctaacaaatgtcaaacaattcatctgttagaccacttcacgcgttggttaaaatatcatagaagtcacaatcctctataaagaaaggacggcgtttcctattaggaacataataacagttgattcatccttcaatccttcgttctctatctgtacagtcatgctgagttttttacctttttctattcaggagctgaagtagcaatgtactgtgcaaaacgatttcatactatgcttcttgaggatgtagactatatcaacaatctgcccaatgcaattacgtctgtatgcttcaggttattttctacataattatttcatgtactctacatattttgtgcactcatgtttctcaatagtggaaaacggaaggacaagtgttcataattgcaatcattttcttgaaaatatagtaccatttgctggattagcaaacatgaaaatatgtaatcacctgccttcttaattacagacttgatgatgatttgcaacgatcaaatgaatggagggagtcacttaatccctgtgctaatcgcaattgtctcactaacatttgtgctaatct

SEQ ID NO: 63720 - DNA, 1581 bp, Oryza sativa
ttccgcaaaagggggtgttgatggaaacatttttgtttctccctactttagaaaggaatcgtgggaggcaacttggcgtggtgaattgcgtggttggcgtgccgtgtgtgatttcactcgtcctcctccagggcaagccaattgggttcctgactcaaatttattagttgatactaagggtcgtcgccagtcacgcaggatcaagaaccttatggatgaagctgaagtgaaagatcgttctcgtcgtaagaaagcttgcattctttgcggggagaaccattcccgtaaagattgcagcatgtacaatgtagggcatgatgccacaggcgctgatgttcgtcgcgttccaaaggggaagtcgaaaaagaaaaataatccttagttcgctattatcctcgtggtggactccctactttgaagatcgttatcgttcaatttatgtttagtgcgtctgtaattttaatttgaactttcttgcacttttattacccgaatctatttgtaatggccttgtaattttcattttgaactgcactgcactattaatatcgtcatgtatttgtattgcaattgtaatttaaatttcgaactgcactgcacttgtaatatcgtaatatatgtgtcgtgggcttgtaattttaaattgaaatggcatgcaaatttgttaattgcattatgttgcatacatttattgtactgttaccatacgtgcattgtactaatgttgttttcgatctgcaggtatggctgatcaaaatgatgggcagctgatagacaaggagatcgataggaaccatcgatcgcgacgtcttactacaggaactttctgcaatgtgctaaagatgcgaggaccggatcaatattggcgtattgatcctcgttgggttccaaggtgtgtgaaaatatattgtttttactaatacaaggtgtttatattttcatgtattaataacttgtgctctgtcatgttgtaggctgagagcagctgggttgttgacgtttgcacggttggtcgagccttcacgtgcaaggtccgaacgaatccacattgacgcggcgcttctgagtgctcttgtcgatagatggaggcctgagacgcacactttccacctaacagttggagagatggtgcccactctgcaggatgtgtcttatttgttggggctgccgatagctgggccagcagttggcccaacaatggtgaatgctggatgggcggatgaccttctggccagttttggtggtgtgctgcctgttgcactggaggatctcacagatgggcacgggcctacgaaaagttggttgaatcagtttcgacaggatgtcttccctgatgaccaggaggagtggatcgtgcagcggcacttagtcgcttacctgttgtggttgtttggatgggtgatgttcacgggaactcacgctgactccgtggacaagcacttcatccactttgcggagcagattgcagagttacctatcgcggagattccacagtacagttgggggtcggcggtacttgcggcgacatatgccggactgtgtgatgcttgcgtgaggaacagcaagcaaagttcactccct

SEQ ID NO: 63721 - DNA, 2079 bp, Oryza sativa
tgttcggtggactccctacactcagcacgatgtcaatgatcgtgcaccgcacggtctcgcggatctttgcacgcgagatatgcaactctggaggacgacttgtcacctcgtggtggacgtgcacgtcgagccacacaatgtccacagggttctcaaacagttgggcatgtatcaggacttccctccgagagatggtcgtcctttggctgatagtcttcataggttagttcacatcacagttgtttaatcctacattttttaaaataaatcactgcacaacattttttctgatgtgtgaatttgttgttgtgcaggtactccagaaaggggctcgggctttcctacgagctagttattgtgaccacggttcagccgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttctggaatttgagcaactagttcaatatttttaaaaagttagcaagtagttcagtatgtctaataaatgtgcaattggttcacctagttccttttcttacataaatgtggaactagttcagtatttataaatgatgtgcaactagttcattatttctaacaaatgtgcatcttgttaaatactcttaataaatgtgcaactggttaaataattttaattgccttgattatttgtggaacaggcggaatttgttgagcacgttcacgtggagtccgacaccctgctgcaaagactagaggcgagacctccagtcgtcaggtctgacgacgtggcgagtgtccttcgcaacttccgttcacgtgctgccgcactactacgtcgtgtctcctgtcggagcgcggcagatgtggtgcagacgtcgggccgacggccatcaccaccactacaccgacgttccagcgtggatcggagtggtccatcctcttcacgtcgcgggtacgaagcggcccacacatctcacggtcgtccttcctttcagcacaccccagcaccggagtacaccagggggtcaaccggatcaggggtacccacgtcgagcacggcaccaccacgtccgcaggtattccaaactccgccttatgttcacccctcgcagggagcatctgggtcgacacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtacaaacagacgatgagtacggttcggcgtcgacgcatcacggagtgcctgcttactcccctcgcacagcattcattgaggacttcttttccactgatcctccccagggggaagtagggatggattactggcacgcagcacctcaggtcacacagccgacgcaggatacggaggccggtcaggggccagacgtgacaccacagcaggcagctagagataggcacccccctgataatttgacatatcccactgagcagattaggcgtaggaagaagggaggacctagcaagcgtgcgaagggcactgatcgtccttgacttatctatttgtattaaacttttagtcatttatgttctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcacatacatataacattacaaaaatattttcctttcttacacactaaaata

SEQ ID NO: 63722 - DNA, 7653 bp, Oryza sativa
agctcatctacgtggttggtcggggctgaataacacatctttgccttgtgaatagccttacaaaatttcttggctccgtcattatttgtatgtactatcactgtctttcacagtcacttcatcttccattttctttttctgaaagaactgatcactgttctaccttcactctaacgaagacaagaccagtctgatctgacggaatcttttggttgaactagaaaagagaaacgctagactatttcttcgacggcccatgcatggcaagcacgacatacacgaacatacgcgctgaacaaccggccgcttccgttgggtaggaagaaaacttccaagctggccacttggccagtggacagcaccgcatgcactacgccgacttgaccagtttatcaagttattagcaaccgtatgaaaggagcatcttttattcccttgtcccacttactaagacgcgaacgcatcttaagatttaactctttaaagagttaaatcttatttacatatttcatatttcatcaataaatagtttattataaattaaattttatttgatgaaaataatattattaattaccatttaaatttactttcatattattatgattttgttgctataaatattatagtatatgagaaatttaaagtaaaaaaattagtctcgaaggctatattaagtttgaccacgcattagtaagtgggacggagggagtactagattgactggcatccctcgatcagtccaccctccatccgtcataaaatctaacaacatgtattgtttaaatcttgtagcaaaatatatagtaacttctgcacctctatctttcatgtaattttctaacacactttttcatcttgatcaatcatagccatcctcgatcttttccatgtaactttttataaaataatagtgtactttattaattgggaatgaactgcaattgttttccgactcttaaatacttctctggaaagtacaataaaagttgtagtaggagttaagaaaaaacctactccctccatcccaaataaactaatctaggatgtgtttagttcacgccaaaattgaaagtttgactgaaattaaaatgatgtgatggaaaaattgaaaatttgtatgtaggaaatttttgatgtgatagaaaagttgaaagtagtataatgaatctggacaggtagactatgtcccatctaaatagtataggttggacttttttttacggagggagtatataacttaccaacacaacctatatggttgcaatattttcccgagcacacacaatactaaagctcatgtacacactgctataggcccaccgttctcacgcatatatacgaaaatgctcctatcacatgctcaagagctgaagagcaatggcaatcatatagttctcgaaaaagaaaaagcaagtcatatcatccgacctcatcgaaattaatcctatatactccatagatagtagtgagaggaggggaaattaaatgacaaaactaagggcccatttgaatcataggaatgaaaaaattgaggaataagaaaaatataagattctgatagaaatacaagtgtaaaacagatgattgcaaaacacaggaacgactgtttgattgatccataggaaaaacaagggaatttgaggagagataaagactcaaaaggattctttccatgaggttctacctcatgttaaatttcctccaaaacttacatgagaagagatattccatatgaatttcataggattcattcctttgattcaaagcgctatataggaaaaatttttataggaataaaatcctctataattcctatgattttcctttgaatcaaagagggcctaagaaattatacaacgagatgagttattagcgtatgattaattgaatattaaatattttgaactagaaaatgattaatacaattttttaaagcaacatttatttatttttttttaaaaaacacaccgtttattgaaaaatgggatcaagatcccattgttctcctaaggacatccataggcataatgtataggagaagtggtcattatagtttcatatggcctacctcaccattgtaggagtagcccatataacagtccttatatatactgagctacctatataatataagatcttcatttagggaaaaacataacaataatttctctcctctcccctctcctctctcacatggttgttgattgagtgagaccagtgagactcaggttaatccctcctcctactatatatattgtagcaacaatcttatctaatgtgtgaacccactttataacaaggggtattatgcattgaaagtgccctaagtacgcccatgtgtaccgttcaataaaaaaggacgatatgctactcttttcggtttcgacaaaaggacaatatggtgatagttcagcttctctccatcggggtggcggcggctggagggtcccctcacgtacgttatagctgtaagcatgacatccagagggaagaggagacgaacaggaggaggtgtggattgatctgatgtgcaaaggagcaagaggcgtcatcgtatttagatgtggttaatacggagtaccccttcgtaaaaaaaaaactaatcataactagaattgggttttttatgggacagactagtaatgcatcaaaatgtctaaaacccctcttaagagtggtatggctaccaagcgagtagcattttaacggaacccaacgcattatcttttcctccctcattcataagagactaaggttgtgttcgtttcccctagttgaaaactaatgccgtgcgcacagaaaatggagcggtccattaacatatgattaattaagtatattagctattttttttaaaaaatagatcaatatgattttttaagtaactttcttatatttttttttcaaaaaacacaccgtttagcagtttgaaaagggtgcgcgcagataacgagggatatgggttgggaaccctgactaaagaacgcagcctaaggaaagtcacgaaacactgactttatccggcgcttgccattttggacctaaacactattagcaaaagttggtaatttggcatttatcatttactagtatagggtagcaaattttgccaaaaaatgctccgggaccacgcgctctctctttttaatgctaaattggtaaaactttaggatgcatctatacaccaactccatgctaaattttttaccactaaaacttttttgccatttaccatttatttttgaaactaaaccggcaggcagaggctgccaattatattttcaataagcaggagtaaaaacctagacgagttacaagaaaaagaaaacaaaggatgctattgttgtcggccaaacaagttcacagcacgcacaacaactcaacgctacaacccactcaaaatagacaatcgacggagcccaaacacgagtcatcgttgccaagcttgcgcaaaagcgacgtagcagctccgaccttcacttgaaagcatgttatcattgccaagcttgccaaagcaaaccagctccgacttcacggcaaacttgtgtcgtcgttgccaagctcatcacagaaacgaccaagcagcttcgacttcccatggtgaacatcagccaaatccaccgtatcaccgcttcctgcttgttgttggcaccaacacacctagagagagactgcaacgtgttatcgttgccgagcttcatcacaccccatcaacaaagcagctccgactccacctagcagaaacaaacaaggccgttggccgcctgctacaaagcaagaagcagatccaataaggcaaaggcctcgccgaacattcccggcctattgagcatcagtgtgaaggtagaagctacggagctaacgccaattccacgatcgggcatgtgcatgaaaggttctccaaacatcactcccaacagagacgcgatgttaatcaccattgccgctttcccggaacgtggcaaggttttcacccggagcacagtggtaaaagaagaaagggaacacatcgtaacgatgcctcaaaggaggggaacggcgccgaaggcgtcgccattgtcaagccggccataagacacggcaaggctttcgcctacggttccctatcctctcctacacactgaaccaaatcgcatacgaccgtcgaaaaatgccgcactgccccgattcaccgaccctccgacgaggcgacgagccgacgaccgagcaccctggagctacctcaccgacgggcgcagccaaccacctccaccatcagcactgggcgccggcgccgcagagccgccccggctcctcgcccgacgccgccaccaccaagcacgccggtggcattcgtcagccgccagcctcaccgtcggccagccgtgtcgtcacccgcatctcccgcgccacctgccgccgccacacgcgccagacgccgccttcacgcgccatccgccgccgtcgcccgcgccgtcgtcggcaccggccagatccggcggcgacgggccgaaaccagccgtgggggagccaaatccggcggcggcggcgccggatccgcagccacgcgccgcaccgccgcacggccttcccagcgcgccgtgtcgcctcctcgtgccggagacaggctgtcgccggggttgtggccccgccgctgccatcccggcgggccacgcagtttccggcggcgcgctccggcggcggcgaggcgggggagaggaggagagggtggcggcggccgagtgttagggtttcgcccccggtcgcccgcgcgtggacaatagggggccgtccgctcctccacttgctgtccatttaccatttatcattccaaatggatataaagatgcctttagcgcgcgtacgtacgtgttgtgcgtgtaacaaggagttctgacgttaaattaatcgcacgggcctgcatgccactggcgagatgtccgttcatacggctaacttagtcatcacagtgcactccgtcgtcgctgcctgcaggttgacccgcctcgcggcctcgatggaccgcaactaatccccccattcccccctaccccacgtttgcccccgcacgaatttcaaagcaacctcccctcgcttctccgctgcccccgcgtctaaagtccaagccgccggggtggccttgccgtccccttatatatacccgtgccctccggcctccgcttcccgtccccctcgctctctcacccccactcccactcccaagcgccaagcacctctccgccattgatggacttgtcgagctccaaggaggcgacgcctcctcccgagtaagccctagcaaatcgatccccatgttgtacgatttgaatttgattattgcggcgcgcgcgctgatgagatcgagaaatgttttcgctcgcggggggcatgcgcgcagggcgtggtggacgggggagacggtggcggtggtgacgggggcgaaccgcgggatcgggcacgcgctggcggcgcggctggcggagcaagggctggccgtggtgctgacggcgcgggacggggcgcgcggggaggcggccgcggcggcgctccgcgcgaggggcctccgctccgtccggttccgccgcctcgacgtctccgatccggcctccgtcgccgccttcgcctcctggctccgcgacgaactcggcggcctcgacatcctggtgagtccatccatccttcagatccatccgctacccgcttttcgttgtcggtttcctccagctacgatgtttcatctttcaaatttgcggatcgatgcatagatagaatgatcgatagatttcaaaataacctgaaaattgtaggctgtggcagtgtattattggcaccaaccagtcaatcatgcatgtaccaaccaacctatctgtataattgatcggctatacgtatcattctcctagccatttcacctggtaaaaattcaaaatcaaaatttacatcccaccctggcttttacccgttctttccagagtgtggctgcctaagctacacactttttgtgtgtgcgcgcgttacactttaattaggatcgaaagtaacgtgctttacttgccaaagtatgtgacaggcaacgaaagcctggctagttttgcttgccaccacactccacacctatcgagttaactcacactgcagcaatagtgaatgtgaattcatagaacgctaaagcaaaattggccagcttcctggttgctagagtgtgatccatctgacactgttgttgtgtagtcaatgtcgccgttagctcttcggatgggatgtgttccccttttatatgtcgcaggatataaaatttttttataaaatagatcgtgacgagagcacgaagctggtccaagtcatggtcattgatgttgacttgatattacgtagtatatcacgctcttgattgttttgataattgcatcaccattttgcatttgcatatatgccgtcgctgtcctgattaaggtccagttttcttctctccttcggagaccgaccaacttaggcagtcaggtggcgtcatcattcacttgttatttggattttcgattgcataatactggccactgttgacttttgtgggagcattctaaaaattgcggtcaatttcccttacttgcatatgtgcacagcgcagatttttcttaggtgaagaatagtttgcccttttgtatgacgagctaataatgcagcaattttttcaccagaagctgaagtataatgagccaaggcaacatttttttctattaagatttaatggcctttcaaggcacttaattaagtactagtagcaagctaagctagccgtagctgaaattccagtacagttttccgtagagtcagattaaaattatttgaaagcaaaattattgcatgatctgctatagaactatttcgtctattttataaatacaattttagttcttataaaaaaaactatattggtcaatatacactattacaatactgaccaacaaatgatgtagatatttatatttttttcctcgagtagcgtgatatatagtagtttttggcctcctcttcttaagaaatagattaacacataattatctaaatgcaaagtacatgaattagctgtgtttaagcctcttgattagttcagtagcacaccaggacgaccaggtcaaacataaacaatataaagaagtataaagaactagtcctcatgctgtcattacgcatatatatacaaatacgtacatgcttccatgtctggctaggatttgatttaagctaataatatttaagcatcgaccaggcttggatccgcatgatacacgatccaattttaaaactagcacactcgaattaacaagagaaaagatccagtgctgatctatctagattggttatacatcttttccatgcgggccaatgcaagtattctacgtaaagctgataaaaactattaggaagcccatgtcttccattccatgacgatggaacagtactgcagatggagctgttctctgaagtctaaacgatataataagctagattgcaagctaagctgtggcagttgctacattgattgaatggtatccaagtttttttaaaaaaagagatattagaatccaagtcattacactaattcacactaaattattgtagatgcctagctgtgcaggtcttagttatatgtttacgttgacgtcaagaaaa

SEQ ID NO: 63723 - DNA, 6554 bp, Oryza sativa
tagtgcttgatgttaaagtactacggcagagacacggtctgtacgtgtatcataatcacggtaaccacttagatcaatttcgtctgcgtgatccactctgcccaactactttctgaatttcttttttactgaaagagaactactctctgactttcttcgagggctgatctggtcgaattccatttacatcttctctgccataaactacatcgttagcttatgccttacggaaagcactattctagtgcggtttctaactctagaactctagccaaaagctccactgaaagcaagtgtttgccaattgccactactgaaattggccggtgtcgtaactacttcagatgtgcacatttttctttgtggttttgctatctctgtaggtttgccggatctaatgttgaactctttgccgtctgctttacatttgcaggtgaacaacgctgccgtttcgttcaacaagatcgacaccaattcggtggagcacgctgagacggtgctcaggaccaacttctacggggccaagatgctcatcgaggcgctcctgccgcttttccggcgatcggctgccaacagcaggatcctgaacatcagctcccagcttggcctcctaaatgtaagtgatcatcaatttaatggttcatgtcattctaatttcaagcgaattactagtgccatttagtgacctttatggagtcagtaagttacacatatttcatcccataggagagaaattttgtatagatgatagtggcctcccttgctaattgaccttttgattctcaccggcaatggccgcacactgtgtttccgaggaaaaaaatggggacctaacactcttgtctgcacgtaagattcaggctacgttaattgtctgaaaaggctgaatagtgagttcgcaagcaaatcttgcccctacagcttctctgacgcctgcagtactacaattatcactttatgaggcactcttgaaacttcacacctgccggctgccgagtagtgagttcacattgctgccttgctggtgttgacttaaaactttgtttatttcctgagtgggcctaatcaaaccatcctctgagctcgtcagctgattgagatgccatggcccatggacttcaaagtttgaacgcactagactatttcagatgataaggttattcaagagtctctgtcgttgcacatgatatcagtcgtgccctgtctattactccctccaccttatatataagttcatttttgacttatcccatttatcctaaaataaatatatttttaagtaatcattatactgtaaatagataaagtgagaaataattgtattgggacattgagagtagataaagtggggaatatttgtattgagattaaagaaagaagaggtgttttagttttttggtgtttgtattggtaggtataggatggatgaaaaattgaagtacctactccctccgtctcaaaaaaaagacaaacattggtttccgtgcccaacgattgaccgtccgtcttatttgaaaaaattatgaataaaattaaaaagacaagtcacgtataaaatattaatcatgttttatcatctaacaacaatgaaaatacgaattataaaaaaaattcatataagacggatagttaaaggtggacacggaaacccagagtttgtcttttttttggaacggagggagtactctctatccacctcttgaactgtctgagctccaaagtcatctgaattctcaacaaacaccagtcacatgttactcagtactatgaattaggtaatcataatagctcaaatatagattgttagatcatggcagtaatgagaattaacaagactgccaaaccacgtgcatcttacagtagtgagttatagtgacatttgcaagtttcagaaatcattagttcctccgtttgactttctagcatggcatatatttatatatatatgctaatgaatctaaacgcagtcttacattatgaaatcgagggaatagtattttactccatgttgttatacgcgagagtaaaacattgttgaattaataatcagcgttttttttttgggggcatggtgcagaaggtgagggacccgtcgctgcggagcatgctgctggacgaggcgtcgctgacggaggggaagatcgagcggatggcgtcgcggttcctggccgaggtgaaggacgggacgtggtcggcgccggggcgcgggtggccggcggtgtggacggactacgcggtgtccaagctcgcgctcaacgcctactcgcgcgtcctcgccgcccgcctcgcccgcggcggcgaccgcgtcgccgtcaactgcttctgccccgggttcacgcgcaccgacatgacccgcggctggggcacccgcaccgccgaggaggccggccgcgtcgccgccggcctcgcgctgctcccgcccggcgacctccccaccggcaagttcttcaagtggtgcacgccccagctctactccaagctgtgaaactgtcagcgacatgctaggctcctgagctcctcatggtaatatgagagaaaactactgcaaatttagagaggaaaattaagcatgagttgcttaagcatcaaccctgtcagttgacagtgaaaatatatagtaccactatatggcagtatgcgtctttggtgtttagttcctcagtaacataacagtatgcacgacaacggctttaattaagctcagccacacactcgacacgttgccacgagaaaaacgacgggatagttacaatgtggcatacattttgggggtcaagtggcaggtatataatgataggatttcgcgaagaaaggtcagctggttcaatagaatacgtcaataatgttcatatgcatgcctgctgcgaaacatactacggggagtactgctcttcccggcacgcgtttcattattgaacattaatattcatctcgcacacttggaatctttggaagcaatattcaactggagatgatctgaattagcacttgtcattaatcccacaattattttacaatgttagatgtgtgttgcttttgctcaatatatatacttcactgaactctccatgctgttgttacaaccagagattgtttggaagaaaaggaaaaggtacaaattgattccctcgtatataggtcagatttgatttatatccctcaactgtaaaactgggtataataacatatcagattcaattcgccatgcttgctactagtagtgcgccgcagtggtggaggcgacaaacataggcttgtcagtggcgacgaggatggtgccaagcgcggcctccactaagaagttagccctatacgctatgtctaactcctagatgaggtcgtcgtggtagtagatggagtgggcggtgggagcgccgaagttgacgtgggacggctaaggtgagaaagaaggtggcctcaaagggggtcggatagtgaagttgttgagtgacatggtccatcagtgacctcccccttcccaccgttggttcatcgcagccttttctcccctctcccccacgctatggtggtggtctaggaggacgcggagggaacagggagatggctagcatagggagaatatgatccggccagcattgtccctaccttgccaccgccgccattggagaagacgaaggctagcactgagtcagagaatcaagaaattcccgatgggttacctcagctagcgacaggaaagaggcatgtgtccatcaaccccaagcacctttcgcttcttgttagggcaacagccttctgctatctgcgccccctgcctctgatggctctggcgccccgatattgggagagaagaggggagggctcgccaatgccctccctagcatcagctccgcgccgtcactacctccttcccggcctctctagtctctactcctaccagaagtgtgagaggagaaagaggggagagatgaaaaagagtggagagataatgaagaagatgagatgaggcaggtgcatcccattgtttctttttattactataatatgatgtagatgccatgtaggataaagattaggtcaacatgcgttgcgtaggacaaagccgatgtccaaaccacatggagaggcaaattaaacttatatatttatagttgaggaagttgttattctcggttttgcttatattttaagggacttatattgaacgttctatggaagaaacatatcggcgacctacgaaaggaaaaagtccgattaccccttgaagtattgtggtagtacgaattacccccctcaattcaaaacattcatcatcctaaactttttatattagacgaattaccccctgcccaactccggagtgttttttcctacgtagcggacacatagcagtccagtcagcattaaaaaaagatagggcctacttatcaattctgcctcttctcttggtcaccacgtgggtcctacccttatctatattttttatgctgacttgattgttacgtgtgtactacgtagggccaaacccgctccggagtctattagggagtaattcctttggtattaaaaagtaaaaggtgaagactgtttgatttttcaattaagggggcaacttgtactgccacaataattaaaggaggataaatcagacttttcccctgggaaaaggatagccaaagcccaaagggatctatggccgaaattttccagcccatgggagacccatcttcttcttttccttgagagcccgtagggatatggatatgcatggagatggaaattacggcccataccaaccgccgccgctccacctcccacgccgagcgtgctgctgctgttgcaccgccgtcgccgccatggccgggcccccttccttcttctgtgccggtggctcgtcctcctgctccacgcgccctctagccccgcatctctatgctccccaaccgcgtgctgccttgcacggctcgggcgccaaaggccgcgaggacgatcgaggagcagggggtggagagcgggctaagctagagccgagcggcagccggagcggaagacgaaggtacggagctatccgatgacgacggcggcgcggaccaaatgcagcgcccacggcgaagagaagccgcgcgggaagcgagagccgccgccgcggcgtcggcggcggcggcggagcggaggaatcccctcttcccctccccgtcgccggccggcctacgccgccgcgtgctccgcatcggtccgcacacgtggcacccatcggacggccaaggcagcgcgagcggggcccaggggcacgagctgcgcgacgggtgctcctcgaccgtcggatcaggagcaagcaagccacgtagagccgatctaacggatgagatgtggccaggtagaagaaaacagcatcttgcaatgcatgcagggctctgcgcacccacgctttttgcttccgcaagagcagcggaattgcggagaggtgaggacttgattttgatctctctcccacactctcctcctcctctgctttcctctgctccaagaaacgcgtgagattccttcacttcttccatggccggtgtgtttgtgttggtggtggtgctgttgctagccgcgctgttcttcttctcgttctgtatcgttcgtttttgttgtgattctgtgaagttatttgatcgagtagtgggtaaatgaatgatcgaacagcgggtgtttgtgttgatgttgttgctgttgcttttgatgtttgttggtgattttcttcgaggagggtgacgagcaccgagagccatggtgatctctgtccccctcttttcttctgtcttgcttgcgcttgttgttgctgttcctgctgatttcgacgttggtggcagattgcttggaggtgacgagcaccaagacctatggtgatctatgttgtctcctttgcttggagattgctttagttgtttgtttctgtttcagttggtctgtgctctgttcgaggagatcctaacgagcactacgacccccatggtgatctgtatttgcgccccttcttgcaactggatagtgttcatcagttcgtgagttcatcatcccggttctatcaatgcctttttcgtgctgcttttcctggcgttattgatgtacacatggcagctcgatgatgtgatatctctgctcgtctcgtgtatctctgcttacttcttttggtatgttgctgttccagattctttctgcatgtgggtgttcttcccttttttctacaactgtgggttttgacgctcttttgattgctcttgttctcgttaatttttgtgatgctgtgcatgcggaaaattcttgacgatgctgctgcgcacgggggaaacccattgatctcttactcaatggcgctacctgtacgtccgttttcttgctgttgggtgtaacatttattgatgtttcacttcccctgtgtatggtgtgaaaccccgtagaagatattattgaaatttgagagggggatcttagcctgtgaatttaatatttctccccttctaatgatcatgtgcactgcaggctgctgcatttgttcttgacacaaacttttagatgtgttttgggttctcaaatgttgagaagct

SEQ ID NO: 63724 - DNA, 1265 bp, Oryza sativa
ctattaaagattttaggaccacaggattttattttatttatgcttcactctctatcttataagatgaccaaactgagtttttttttaccttttctattcaggagctgaagtagcaatgtactgtgcaaaacgatttcatgttatgcttcgcgaggaagaaagctttctcaacaatctgccctatgcaattacatctgtgtgctccaggttttttttatagatatttgttccatgtactctgcatattgcgctacataagttcactcccttttcctttgtggaaaaaagagtgggacatcgttgtacccattgtcttcatagttgcaatgtcttgaaaaatctagtttcgtttgttggacaagcaaacaatgaattatgtaatcagtgttccttcttaactgcagacttgatgatgaattggaagcaccaaatgtatggagggcgtcactttatccccatcgtagtagtgagtcgagaagcgagtctagtgactgtttccagttcctcagtactggcagttgtgctaacgtgtggcgttcctcagaggtgatatatcaacttatgattgttctttacacatcctactgcacagaagttaatcaaagatttatttctagtcatatagtgtgcgtatgaagtctgtatttatctgtttcaatatacccagtcattatgtcaagtgcctgttttacacagtcagaatccaaaagcttgttaagttattgctgcactgtggttgttatctacttatactactacccgaattatgttttttttttatatgtcactatactgggctcatcatgtcttttgtacattccttcttttatgaatgccatttttttcgctagagtcatttcacactttttatagtctttttatttcaaggatctgttgaattctttgtattacacttcagttggtatttttgtccccccaggcagtttcttacaagctgccgtcatatgaaggaagcacagcatgtgtggtaatcattagaggaaatcagatcactgttggaaatgttggcgattcccgttgcgtgctttcaaagaatggtcaggtgtagtaactttttccttgtcaaatgcctcattgcttcattctgtcatacctaatggctaatgcattaaatctgtgcctaattattctgttttctgtatttttcattgcattaaaagacaattgatttatccactgatcacaaaccaaacgttccacttgaacgtcagagaattctaagagtaggaggacaagtatggagg

SEQ ID NO: 63725 - DNA, 2630 bp, Oryza sativa
cctgcagcccctgccaaaatttgataaatcagggaaagaaaagagaatgctttacagaggatagccaattagccacaaacaagaacatagctccaaatacaacaacactggtaagaaacagtgctatgcatgtttggttttaagtcttccggcgaaaaagtttggcttaagtcttggacgactaaagtagctatgttcgcccgcatttttgctttctccttggaaaattcttttattgatcctttcattccatatcgtctatgaggtttgggttaaagctgcaattattttactttcctttctccttttgatttgatggagctgaaggcaatctaacattcaattaccaattaccgagctatatatgatcaacagctacaggagtaacgaagttcattcatttgttggtagaactgttattcccgttgcatctgacatatttttgtaaattgtaatcacacagggggaggaaactctacgcaccacttgcgagaagctcgtcgagaattgcctggaatcgaggaacaatgcgacggccatactggtccagttcaagccaggcgccgaccagccgatccctgccttgcccaacatccaggagggctccgacgaagtcgccggcggcgccgaccagccgatccctgtcctgcccaacatccaggagggctccgacgaagtcgccggcggcaccgaccagccgatccctgttctgcccgacatccaggagggctccgacgaagtcgccggcgtcgccgccgaccagccgatcgctgctctgcccaacatccaggagggctccgacgaagtcgccggcggcgccgccgtggctgagcagcatcaggacaacccagagggcggtggcgagcagcaactcgacctcgatgacgcgcttgacggagaagcactggcgttgctgtttggccagccttagctagttcgtgcaaagaatctttagctagttgcacagagttttgatcgagaatagaacaggattagttcttagttagtcctcgtgttgcctctcgagtcttgaccacgttacattttttttgcctgaagattttgcttttcacgcacgtctgttattgttctgctctgtattcattcctgaagattttgatcgaattaacgatacctaattcgtaaatgatcactgcctttcatgacttctctagccatctgcatgcatgtcttgaagattagctgtgatgactgtaatttttttcaggttctctgtctaagtgtttctggaagtgttttgatgctgtgtcctgtgtgcctaggagctgaaagtggaatgtcctaggggcctgatgtttattcagatattggaaaccagagtagttttagtgtatagtgcgtcctggcagaatctgtttcttttgtttttcgttgtttgattttgaactgctgtagatgtctttggctttccagtaaaagccggatcaatatgatcaatctttttttttttgaaaaaaagctagctagctagctctagctacgtgatatatgtgctgttagtggtaacttcttcctaagctattgccatcaagataatgcataaacagtttgtcattgaaccaacttcccaacagtatttgcatacttaaacatcaatactgtgcttttgcattttttttcttgagtacatgactatttcatttcattaaactggtaaagacatatgctttacccctttttatttcattaaactctataataaaagcttgcttttatgggccggaaaactctggcccattcatatgggtaagtttttacagcccacgtgagggccattccaaccgccgccgctccacttcccaatctcccgtagcgagtgtgccgccgccgccgccatggccgcggttcggcttccttctcctgcgccggtggctcatcctcctgctctccgcgcgcgctccctatccggcatggaagtgctcgggcggcaagccccagcgaggagggaggctgtggtcgggcggcagccgtagcagaggacgaaggactggagctagccgacgacgacggcgagctcggggtgggggtggggggcggcggcggcggcgcgccgtggacctcagcgtagcgcctcgtagctcctccgaccggggaggagcagcatcagcggaagtccatggggtcctctcgagcgggacggcggcgcgaggaccaatgcggcggctacggcgaatagaaaccgctcgggagcggcggcggcggcggcggcggagcggaggaatccctcaccggcctacgcccgcgtgtgctccgcatccgaccgcacacgtggacaccatcggacggccaaggcgtcgcgaaaggggcccagggagcacgagcagcacggacgggtgcccctggaccgtcggatcaggcgctgcagccacgtagatccgatccaacggaggtgatgcgtccacgcagccttcctgtgcgaagttggtgctgcctttgcatttgcgcttttgcttcgcgaatcgcaacaactcgttgcaagagcagcggaattgcggagaggtgaggacttgatctctctcacattctctcctcgtcgtcgtcgtcgtcctcctcctctgctttcctctgctccaagacaacgcgtaagattcctccaccttctcccatgg

SEQ ID NO: 63726 - DNA, 2139 bp, Oryza sativa
actcgtccatttctacattgttttcttggtgctcttcagcagttgctttcgctattggcgtgggatcccatggtatcatggtaatctgttggattggaggaggggctaacgagcacccgcaaccccatggtgatctctgttttgtctccctctctgtacggaatggtgttgttcttcttgagttcatcttccgttgatattcctgggcctttattgatgtgtgcatggcaactctacgtgttcttcatcttctcatctctcactttattctgcttacctcttatggtatgttgttgttccagattctttctgcatgtggtgatttgggtgctttcaccttctttcacaaatgtgggttttgacgttttgttgattcctcttgttcttgttgattcttgatgatgttgtgtgtgcggaaaactcggtgatcgttatctgatgagcgcttattgctgttgagtgctaacaaacggtgcaagagtaattatcggtgtttttttcttcatgaaattacttctgattcttttgatgtcaacatgtatttccaattatagatgtaacttgtaagttgtaggtccccctagtttttactttttactgaccaagcgatctagttgtttcaaggttcgatggtgccttattattgattttttaatttccccattatggtatcaagtgctattctgtaaagtagcttaataccagcagcaggtgttattgaaatttcagagggaaatcttagcctgtgaatagttctcccctttgtaatgatcatgtgccctgctggctactgtgtttagtttcgagacacttttttggatgttcttttgggttctgaaatgtggaagagcttgtcattttggacgctctcttctttttaagacgtagtgacttggatcaatattgaacaacatttggttaaccagattgtacatcgttgtgttcactttagtctttttcaggaaagcaagtcttgcgatgggtgcatctgccagcagttcagtaacatcgaagcttactaacgatggagagaatcagaaagttaagtatgcctcatcaactatgcaaggatactgtccgacaatgcaagatgctgtgagtaatcttgcactgcctttatcaattttgttgggatcataatcctacagataaagtgttaacttgctggtaattgtggccaaacactgagcttgatttattcctttcttattgatctagcttgcagttgaactagatctagatgcattaaggaacacatcattctttggtgtttatgatggcgatggaggtttgatcttcactctcatctttttccaacaaatgtccaactattcatctgttagcataacagaccttcgtgtgttagttaaaatattgtacaattcataatcccctaaaggaaagagagtgtccatttgtgtacataatggaaatatgtcaactgccatatataggctgtgtttcctatcaaagattctagtaacacaggattgcagttgactcatcatccattctctattttataaaatatccatactgagtttttttttaatcttttctcttcaggagctgaagtagcaatgtactgtgcaaaacgatttcatgctatgctttgcgaggacgaaaactatctcaacaatctgcccaatgcaattacatctgtgtgttccaggttattttgtcgataattgtttcatgtactctgcagatggtgctacataagtccactcctatttttcgatggtggaaaaaaggggacattgttgcacccattttattcatagaatcatagttgcaatatgtcttggaaaaacgaattatgtaatcagtgttccttcttaatctcagacttgatgatgatttgcaacgatcaaatgaatggaaggagtcactttatccccgtggtaatggtgaatgtttccagttccttaagactggcgtttgtgctaacctctggcattccgaagaggtgatatatcaatttatgattgttctttacacatccaactgcacagaagttaaccaaagttatatttctagtcgtattcgtatagagtgcatattattatcttgaagaaaatcaggagtatgcatgatatgcagtccatatttttctttcccaatgatctggagttccaa

SEQ ID NO: 63727 - DNA, 38072 bp, Oryza sativa
  unsure (1)..(38072): unsure at all n locations
ttactatgttgatatattcttgattaagacctgagctgtagtgtattttattttaaaagaactctagtgttatgtggatcctctgctttgagtgggtgaaccactgcacatgcaaccagcggtcttcatggacttttcccgttgtattacgcatgcaactgtgaacaaagacttgtacagttgtactttccattttagggtcaacgcttagtcctactgcctcattggaggcctttatcgcttgggtgtttgggccttttcaaggccgtgctatatgtagttcacaatacggccgttgtagaaatttagcccaacaaagttaaatagctcgtgtaggagtaagcactaagcagtaatcgcactgttttttaatataggatgccattggcattttaacatatgttaattaattattcatcttattttaaaaatatatgtaattattatttattttaatgtgaattgttttattgttaagagcataatctatatttctacaaatttatttttttatttgaaataatatgaacggccaaatgtatatgtccaatcttgaaaccggcaataataaaaggggtagcgcacgagacctaaaagtggatggatgcatagacaataatttagacaggtttatgccctctcgatgagagataataccgtacttctgtttggggattgtattcgttgggtgtgtatcgatctgacgatctagctgtggagttatgcccttggagggcttttgcccaccttatataggttggggacttgggggacatgattacaaagagagaacctggccggatacgacatcagtttccttaatctactttacaatattaccgaatcaaaactttaggttgttccataatacataagaaaacgcaatatctaagtcatggctcgttacatattccataaacataatctatcccctatatctggtcggataaagaagttgtgtgcgcatatggtactcataatctccatagtatatttagaagttaattgtgtcatatattagaaaaacacatgggaacattaagcagttacaatatatacagtttattcttctcaattggacacgaaccacaagtacacttgttggaggatgaccattttgggaatactttaaaaaccatatgtgatgaacaaaccgtgatagagggagtatattataattaaagaactacttatgttatgaatgaatattgacaaggaatttttcaaaagtaaaattgcttaattacgggtactgattactgacacaaatagacctttgacacggcaatgctagaactgatgaagtcatgaaggtatacgatctcacgccatatctgtctatcaacagtggttgttaggatcgttgcttatagggcacgatcggctatacttttgctccaacggtggtagcctgtggcctcctgtccagtgcggcgacggcggcggcggcagcgctatgttgcccgagccaccggcgccggaggcttgatcggcgtacgggcttgccatggccggtgaccatgacgccgacatgaccatcgtcacgaagaacatggccactgacaccttcctcatcgttggcatggcgattatgtatactgtaactcctgtactagctagatcgaagatactcgctcacagttgtgttatctgatctgctctgttttctccacaaaaattataattaactctgcagtgttttgagctgtgacacgaagaatggtcgatgttacgatcggttatttataggttgggagaagctcgtgagtcatgagacatggcctgatgccaaggccaaaccctgaaagttcttggctttttacgtgtgtgactgtctgtctgactgatcaactaattaatttgacgagtttgtgaatgaaattgcaaagcagctacgaggttttcttggtctacaagcatgcaactttgcaaagttatatcgagtgaggtctgtcggtcgatcggtcagtgcatgctttcttacgaacttgcaaaaccaagactgtaataactctcttcttcagatgtagctttctgccactgatctctctttttgccgtaagtagtctgactgtccggatagaccaggccagctagcatgaatggaagacgaactgaaagtgtccggaattcgtactgggcacatcgttccaacttcgacgtgaattgctgaaaggaatggcaagattgcgaggctagtgcttaattaagagcgattgccttgtgaacacgccatcagctgtattagagttcatgtagtgttcttcatattcaaaaagaagaaactccctataacagagcttgaagcactactagttctacttaaccggcaatttcgtgttcttaactagagcagtgatttttcatgcatcccaaaatgcagttcgatatgataagagattaagagctcgaaatgctagtgtttcgagcagttttaccagttcttagatgtaccaaaagataccactatttcacaaaactgtatacacctctacaaaactatatatgtatcgtgaaattaaactatatactaaaccataatattgtaaattcgcttaattagcacaatttctatactccttttaaaagagaacaatggtggtcaccaagtatatagtatttctttaatttatcatctactccggccatcatgttttctatcaattccccatgcatgtgctttaatgttataaaatgatctctctgcatgtatgattctatcatattcacctgtacaatatgacatttataggtacaaaattattcaaaaaacctcactaataatttgttttaatccgtaacaaagcacggttattcggcttttatcatataacaacataagcaatcgtatcgttcataataacatatagtaaaactacatatttatttaagatgttaattagttcaataaccaatcttgatcagggtacattacaatagttaatcaagtagtcatcacaggttagtggactaaatttcttgttattaaacacaacaattctgataggttgataaccacttaggttgttttctttttctaagttccaaacttcctctccttcatttttcgcacgcacagtacgctttccgaacagctaaacgatatgtttttttttaaaaaaatctacaggaatgttacttttaaaaaaacatgttaatctatttttaagttttttaactaatacataattaattatgcactaatctgtcctcttgttttgcgcgttgggaggtgtgggtttggtcataccttcgaacacaaccttaatacataatgatggccaaacattagtatggttagtggacagaatttcagattttctagacacccttatgaaatactaatatgtaatcctttaataaaattggtactaaatctagagttttacaagacatcaaaatataattgttgtcatggttatgataccacatacctaatagtagttgactaaatctcggcaggatccaccacatacaatgtcttatacggaaactgacttcggatatggagagagttccgataaggaaagacaaccagagttctacatggaaacgacaagaactactcggattgtatccatattggtttccctagttctacttggacaaggggacacctatgggtataaatacagggccccctaggaggagaggagagaacaaccatccacgatgagaagatcaacacccaccagaagccacaacatacaagcctacatacgccaagacaagccgccggatatcgacatcagagatacgcttggatcgaccctatccggtaccttcagaggccggccgtagggatctagcactgtctctgattccgtcgggcgcgagctcgaggaggaaggctaccctgttgtcgactacgagtcagaccttcagaccgccatgtcgacagcagttagataggctaccccacatattgtactggtgtgattatggtgaataaaaagcaacatcggctccagccaacaggatgtagggctattacctgacagctcaggggctcgaacctgtataaaaatcctcgtctccatctcttttatctcagtctcgcgtatatcctagcaccaacgatccccatactgtccaaataccgtagtcgagacatcaaacgtcgacagtggcgcgccaggtaggggggttttggtgctctatattttgacgagatgggttcaaaggatggattctccaacaacaagctactcgatgacttcggctgtaaggagatctaacccgactgaagtacatcttccgaccagatcggaaccatcaacgtcaacaattttgatctgttgagataatccaaccttcaaagatgacgccaccgctgcggagggcatctgtacggtatttccgaccattgacgatcttgaggatgatgccggaagggtacaagacgccgacacctctagagaccgaaaccgactactacactcatcgggtttaagtgcggttttggttagactcggagtaacaagccggatataccattgcccgacatcgccacgtactgatcgcttctgacatgtgcacatgcatatgcacagactcaatacgtgcccaggcatgcattggtttgccatcatatacatgcaccgaagacaattcaatggctactaaggctagttaaggtaattagtagattaattaatttaatcaatctactaattccgtagatatatccggcatatatctacacaggtacgcaatattttatatgcaatttatcgtacctatccagatcatgcagtattgtcagatcaataatttattatgtttacctagagcatgttttttatacaatgtccgttgtgcgagtacttccgacgataggccaactacggtctaacgctgggggctcgctctattttcttctgtataaatcatgcttgtttacggtttacataatgcctgatatttaatctgctcgttatatcctgataatactagaagatccatgcagttttttgagtacatactcgatattatctgctatatatcttgccttctagaaaatatttttcaggaataattgagcacttgagtaggttatggtcgagtacactccattatcgagaacattctcgacaaatgcggagttatcgcacccaacctaccaacaaagaccgacgacctatctcatagcaccggccatggctggactactcgagaaaaggttgttaacggataattcctcgcgaacgccgtcggcttgatcacccgacatgattgcgaacggacatccggatatgctataagttgggtacgtgagtcatgctggccacatgaaatacacttgcaataaaccaccagtacgcagcaatctctcacaccgcaacttccgttggtgttcgagagataattccgcttgctcactagttctcgcaccagtacgcagcaatctctcacaccgcaacttctattggtgttcgagagataattccgctcgctcactggttctcgcaccagtacgcagcaatctctcgcaccttaacttcagatggtcaaggtacgtctacggcagcgtagcggtcctcgtaccacgactacaaatgatcgagggacactattcaccggttctcaatcagttgatcgtagtgatctctcgtacatttgcttcaagtggtcgagttacgactactgcctggtcctcgaccagcgatgtagcgtctctcccaccacttccactttcagtggtcgagttacgactactgcctggtcctcgaccagcgatgtagcgtttctccagctacttccactttcagtggtcgagttacgactactgcctagttctcgaccagcaatgtagcgtctctccggctacttccactttaagtggtcgagttacgactaccgcctgattctcgaccagcgatgtagcgtctctccggctacttccactttaagtggtcgagttacgactactgcctggttctcgaccagcagtgtagcatttctccccctatttccacttcaagtggtcgagttacgactactccctggttcttgaccagcagtgtagcgtttctcccactattttcacttcaagtggtcgagttacgactactccctggtcctcgaccagcgatgtagcgtttctcccactatttccacttctagtggtcgagttacgactactgcctggtcctcgaccagcggtgtagcgatttctcccactacctctacttcaacaaagttggtagcaggtacacaatatcgccaagtgttttacctagagatcccttaccacgatgacacctagcgttgaaacctatcctactgtccctttacgccgtcctgacaaggcctccgaggaacctaagggatcttcggctggggacgcccagagccgataaggccttgtcggatcctgtagagacgaaataccatgtaagatctggtcgtgtaagagttcttgccatgcgtattaaccaagccgtgtaatcggaaattaactttccaacttcacggctggggctaggatcagtgcttattcaaccaaggcagattaagggtccaagagccttatcctctgagaacgattctccgacgacaaggctgggggctagggagagtgtatgactctacaaactaactgatcgaagtcggtaagacgctcatacacaaaacattggtcggtaaatttaattcattttcaatttaccatacatattataacatgtcaccctttgagcattcgctcgggggctctttctatttgatatacttttctgagtattgattttaggaaaattctattcgacatttacgaagactccatgtctctatggttctacaccaagatcgactaaaggcgagtacgacaaatgttgacaaagctccgtcgcagactctatgccttctcgatcactcgagaatggttgctggatctcgacaaggaatacggaatgaaaagatagtgtaccctccgagatagaatttcttgacttcaatacaaattctcgattacggcaagacggaagacttagtcgtacgctatgtacttccttggttgacatcggagattgactcagacaaaccctttaggtgcccgcatgaggctgacaaaggaagtctaacgttatctctaaactcaccgagaacggtcacatgagctcgataacagttactccaaggtctgcgtgcggttgagaatatgaattcgttcatttgcattgaagtcggggggctactgtcatggttatggataccacatacctaatagtagttgactaaatctcggcaggatccaccacataccatgtcttatacggaaactgacttcagatatggagggagttccaataaggaaagacaaccagagttctacatggaaacgacaaggactactcggattgtatccatattggtttccctagttctacttggacaaggggacacctatgggtataaatacagggcccctaggaggagaggagagaacaaccacccacgatgagaagatcaacacccaccagaagccacaacatacaagcctacatacgccaagacaagccgccagatatcgacatcagagatacgcctggatcaaccctatccggtaccttcagaggccggttgtagggatctagcactgtctctgattccgtcaggcgcgagctcgaggaggaaggctaccctgttgtcgactacgagttagaccttcagaccgccatgtcgacaacagttagataggctaccccatatattgtactggtgtgattatggtgaataaaaagcaacatcggctccggccaacaggatgtagggctattacctgacagctcaggggcccgaacctgtataaaaatcctcgtctccatctcttttatctcagtctcacgtatatcctagcaccaacgatccgcatactgtccaaataccgtagtcgagacatcaaacgtcgacaattgtgtgttaaattctttgcaaatttttattctgtatgatattgtgaattaaatatggactccctccatatcaaaatatacataactacctctaactaaaaaatatcttgaaatatggctacttcgcagatgagtgcttgcccagttggtatattgtaagctgttaagcaagctagtacttgtacattgagaataaaagttaccaccaaagacttccactttacattatcatttctgaggtgaaaaatggtccttgtcgatttgccaatggccgagtgaatactgtaaaaactgacgacttttaatagaggtggcactggcagtagaagtaaatttactacgtttcatttttactatgtgtttatgtctgatcttgtgaagctatgatgttgatcgattgtggcacaattgatccatttttgggggcgacatgagtaatatgcagtggtcagtgaacttgtcgcacatacgcatgctagttttatccattttttagtcagaattaggtctcgttagtttcgtggcacatttttcaaactgctaaacggtgtgtttcgtatgaaaactttctatatgaaagttgctctaaaatatcatattaatctattttcaagtttataataattaaaactcaattaataccgccttgttttgcataaaaaaactttatcttcatctctatcttcatcttcatcttcatcttcagttacattttaggatgggggaatactcacactagcaattatctggttgagttatcttacaaccttcgtggaaatctacgtggctgattggctacagattagcacttgttttgtgcaaggggaaatttatagccccatcggtcagcctaataagccaaagtaaaagtcaaaattagaattttcgaacttgattttaaagtttattttaagatattttcaacttaatttctttttagtattgacttttagatcgctacgaacaaatatataaaagttttatctataaattaatttttattttctaataaactattttggcttattagaggatatgggcaaccaataagactcttaaatcgtatgatgctgagtaagctagtgtaaataggctagtagtactagactagctacgcataatggatattagatggtttcatcaggaatggaagagtttggcgagaagatgaaatcaaaatccaattcttgtttaagatctgaactccggtctgctttgaataccctttagctacccctaaatattcaccatcaatactgctttcctattaatgagaggtattttgtttttttttctctactatctaaagctaaatattaagttatattggaaagtagggagtagattccccagctgtacaataggcatgtatgatattccactcatgttttaggcatgcaaacaagcaagcctccgcataaaacccacttagttatttatttcttttatggtagtatagtttttagaagaaaaaataaattagaagtacgattcactttattcgtcttattcgtcttgcttgcatcccgacgcctgttcttgtaccccacttatgaggtcagcaagttgatgaaacctttgtttggtgtaacaagctagctcagtcaaagttttttgttcaagtcgaagtcaaccggccagttcgtttgatacacattctcagagatagacgcctcagctcgcaaaatagagacgggaagaacagagtaatgatgcaatctgcttgactctcgggtgttccataggtgagatatttctgaccatcgatgcaatttatgtagacatttctgtggacatgcatggctgcttttccatcggtacctagtccatcaattccctttatatacatatacagtacaggtccatggaattggacgatacatacgtacatacagtacttgcaaggtttgtgagagcaaataatccatacatttctgattcaacacgaaataaaataatattatattaagtaaggacaaagaaaactagtggaggagccacgcacaaactatgggtttggctgaccccacaatttttgtactatcaccctttgtgtgtcttgatttttttttcatttaaatctattaagttttgcacaaataaccccactacaataccaaacaataaaaattgttttcacggggtaaaattactggcttcgccacttacgacaaccagaccatacaatttggtatctaccatgttagttgtggcaatctggcggcggtttattattttggtcattgctgcggcacgagggacctggttgtgaaagctgttgcagatacagattttggaggaactgtatgagaggatgatcgccggaggtggccatgccaacccatttgtcgcctcccatcggccgcgctgatcctgacacggccgacagcagaagcaccaccatcatcagtggcaaaacaaacctcttcgccacggccataatacgagctcttcctactctctcgatctgtgtctaacacaagctttaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagagactaaagttaagtcgctgatgtaaacaccaccttcaacttgcacactcttctctcgctcgcagctagctagtttgtcctctcctgtacgcgtctcttgcagctcactgtctcaggcaagtcacaagcgagttcagttaactcgttagctagctagctaccgctgcgagctctctgcacaagacgatgtcgagtgtggttgatttgcatgcatatatatagcctactgcttcgtgggaaccccgtgttggctccgctattacgtgcgtgactcgtttgctgagtaaaactgaaaaaactgggcacgcccggactccgattctacggtctctacaagggaaaaattcacgcggccttagccgtgcatgagccgtgtgtaacatatacaccaacacacatcgatcacggccactagcaaattactccctccgtattttaatgtgtgacgccgttaactttttaacaacatttgaccatttgttttatttaaaatttttgtgaaattataaaaatatttgtgttatgcttaaagaatatttgatgataaatcaagtcacaataaaataaatgataattacataaattttttaaataagacgaatggtcaaacattggttaaaaagtcaatgacgtcatacattaaaatacggaggtagtaaatctgtagtgaaatttgcatgagtacaagagaagctagctagctttgtctacgtaaaaattccatgcttgtgctcagctctattccctccatctcataaaaaatccaatcatatatttaaatctggaagattcaaacccagaattgagtttttttatggatggaaggagtacgtgcgtgactcgatagtagacggtgtaccgtgtgcttctcactgcacttataagagaggggacaactttttcgattggaggaatatgctttcaaattagagaaaatctacacaacagtatcccgtcacaacgggataaggtctcatcaaccttatctccttcgatcccttcctctccacaatctctctctctagctcactcaggagtcaggagaagtccaagagcatggagatgaagccagctaggaggaaggggtcgtcgtcgtcgtctccggcggccgaggtggacgacgatggcacggcgtcggtgaggtcggggcggcatcgagggtgatctcgtcgcgcctcctcgacgccgtcctccgcccgctgcggcgccgcttcttctactggcgctccccgttgctgccggcgccgaggcctctcctctcctccctcgcactcctcgccaaggtctccatcgccctcacgatccactagcgccatcgtccttgcccgctgctcccgccgcgtccttgccggtgagtgcaaatggctcctcctccgccaccgcagaagaagaagaagccggtggtctcgatgcctctgtcaccgcaacgccggcgacaacctgctctagaacctctacctcctctctttcgccatcaacttcaagatgaagttgctgaagcgcatgttcctggagatggtcgtcgccgacttccggccggacctcaccatcttatgcgtccgtgccacggccttctctattaggtattaatcgcgatacctcagtatcaagcctggtacccgcctggtacccaggtacccacaagtatcaggcctggtacccaggtacccacaagtatcaggccatacataagatggttacgttgactttttaacatatatttaatttttttttgaaaaatgtaattagaagtattatttatattgttgtgacttattttaatgctagggtacttaagcatgacctatatttttacatatttaaataaaatttttaaatgataggaatggtcataggtacattggtacatatccccatgccatatattaaaaaaacaaaaggccagtattaaacagttacagtatacgcactttattcatcgtaattggccacgaaaatcacgagtacataatctactactaaaatatattaaagaactacttacgttatgaatgaacaccgaaaaataaaattaattatgggtactgacacaaatagaccctgacacggtcaatgctagaactgattaaggtaacgatctgtctatcaacaattcaacagtgggtattacttattaggatcgttggtataatggcacggtgggcgccattgcttttgctccaacggcagtagcttgtaacctctccaatgcgtcggtggcggcaacgcggtgttggcggagccaccggcggagggttgctcggcatacggcctcgccgtggccggcgaccatgaggccgacatggccatcaccacgaagaacatggccactgcaaccttcctcatcgttggcgtacgtggcgctgcttttttagaaaaaaaaaagagaactctgcagtgttttgagctgtgacacgatgatgaaatgctcgatattacgatcagttagttataagctgggagaagctcgtaagtcgtaacatggcataatgccaagaccaaaccctgaaagttcatggttttttacgtgcatgtgtgattgtctgactgatcaactaatttgacgggtttgtgaatgaaattgcaaaagcaggtacacggttttcttggttacatgcaacgactttgcaaagttatacggagtgaggtcggtctcggtcggtgcattcgttacgagcttgcaaaccaagactgcaataactctcttcttgagatgtagctttctgccactgatctctcttttcgccgtaaccagtatgactgtccggatagaccagcatgcatggaagacgaactgaaagtgtccggaatacgttcttgatgcaatgttccaagtgaacttgttgaaaggaatggcaatatttcaagactagcttttttttttctttagataatggattaaaaatccggttattcacacggatcgatgtacacagccaaagatttgcaaagctaactagtgtttaagatcgattgccttatgaacacgccacgtacagtgatgaaggttgatgtaacattcttcgtattcagggaaaaatgaactcaacaaaaggagaaagtaccgagagtgtatatttgtgttttataaattcaattttttggttaacataatgtaataatctaattgctgaatttttttaccgctaccaaaatttaaatttttgaaacttaattttaagagtaattttacggttcttaaggaggtatcatgaggtaccaaaaatttagtggtacctaggtaccaagaggtgccaaatatataatagaaaaagtggaaccttagagtatcttctcaagtaatataaaattgctctaattttaaagttgattatattttttttctcatcttggtatattttctagaattgggttttaaatcacaaataatgcatacataaaaattatatccataaatcatttctgattttttttgtttattttgtatggcttgtgagctgtaactcaaccaaccagagccgtgcgatcggccacatgtagcttccttgaaaagaaaaaaaatgaagaagttgtagcttctgccccacttatgaggtcagcaagttgatgaaacttttgtgcgtagctagctcagtcaaagttttctgttcaagtcaaagtcattccatttgatacacattaagagatagagacatcgcaaaatagagacaaaaagagaagagatagagacttcattagaggagccataatgctcgatcttgctcctagcgaggatcctttgatgttccatatgtggtattttattttttaaaaaagagtatgtggtatttattcttaccgtctaaacattatatctcgagggctgctatacaacggaatcccgttttcgaacgggatgataccgattaggtatcaggtcccgatacctctgaggtatcatgtcctgaaacataaccggtatcaagtgatacctatcaagtattagacgattcatactacgtatctggtgatactcataaggtatcatgtggtacctatcaggtatcagatgatttctaccacgcatcgggtgatacttgtgaggtattagatgatacctaccagatatcaggtgattcctactaggtatcaagagctgagcatcgaggcgtcgtcgtcggtggccccaccctctacaccccatgtcgaaggtcgtcgccggtggccatgttctctgtcgtccacgcctcacgtcggaggtcgtcgccggcggccgcgttctccgtcgttcacgccctatgtcggaggtcgtcaccggcagcctcgtccttcactgccacgccccacactagacttgttgctggcggtcgcggcctccgccgccacgccccacaccacgtccttcgctatccatgctctgcaccacgccggagcttgtcccggaggctgcatcctccgtcgtccatagccatgccacgccgggaactcgtcaccggtgaccgcgtcctccaccatccacaccccatgccacaccggagcttgtgcagcaatatgcatgctttgagagagatgtggtagaatggataaggtagaaggagatagaatcggtggattagttggttgctgccctatcatgtctatcacgattgggacgggatcccgtcagatactcagatagcatttctgttatatctctactggtctactgcgtgggatatatattcagactagcttccagtttcacccatatatatcaaatccattatatatctcacataacactggatggattcatcgaattaattggacaacatttacattaacacttgggcaaggtagtacgaagaacagaagttacaaacaaaaaactgccattttattaattcatatacttgcagtttatcacaatctaacaagaaacagagcaatccaaaaagactaaattgcattttttttcaaagatcatatacagtacattgtcttttcttgaaagatcttatatatatacactacattgtctcctatagagaaatatcacaaccaaactttagaatttggtgttagcatgcaagtgatggcaatatatatacatggtgggatatttaatttggcgtctaccctgttttttagtggtggttggccgaggcagtacatgatgggttatttgggtcattggtttggcacgagtgacctggacctgctagctgctgcaggtacagatgtttgaggaactgtatgacagatgatcgccggaggtggccactccaacccgtttgtcgccgcccaactgccgcgccgatcctgacacgaccaacaccagaagcaccgccatcattagtggcaaaacaaacctcttcaccaaggccattatatgagctcttcctctctctgtgtgtgtgtctaacacaagttctacgattgcacactggtgtttctctcgctcagagcttgcacaagtatctacttccttgcagctcactgcttagttaagccaaaggcgagttcagagctaactcgttagctaatagctacctgcgagctctctgcacaagacgaggtgtcgagtgtggtcgatctgcatgcatattatatagcctcccctgcttcgtgggaactccgtgttggctccgctattacgtgcgtgactcgtttggtgtgggttaaactgaaaaaacccggcacgggccggactccgattctacggtctttcacaagggaaaactcacgcggccttcaccgtgcatgggccgtgtaacagatacaccacaccaacacatcgatcacggctactgctagctagctagcaaagcttgtgtatgtagtatgtgaaaaattccatgctcatgctcagctcaagttacgtgcgtgactcgacagaagacggtgtgcattgaattagccgtgtgcttctcactacgtactactacgcggcgggtttcccattattccacggtcgtcgctccgaaaggaaagagaaaacgactggtttgtcgcgcgccgacgtgaccaattaaccaaaccggtgccggtgccctgtgccgtgggtcgtaaatcgtaatgcgcatgtcaacctgtggccgtacgtggtgcgtgcatggcgtgtgcgcgcggcgtcagcgacccgcgcgccagcagccgcgcgccggccactgcacgcaccggcgtacgtacgtaagctagctttgctctcttcccacttgctttcgctttgaggtaggcatgtgcacagcagcacagcggatgtttggcgcaaagctagctagcctctccttggttggtcgggaactcgccgacacgctttcccgtctgcgcgcgagagagagagaggtcgatccaccgagtccgaatcaaccccaccatctgatcgatctcccgtgcgaatcgtgcgtgcgccgcggagacgcggactcaagtaggctaacacccgagagatcgaacagaacggccgggtcatgcgtgcccctgcgcgtttcgttcaccttcaccacgagtcttgtcacgaaacagcacgcaacgacgccggccgcgggcggtcaacatgcattctacagtactcctacgttgtttgcgttgcaggttgagaaattaacggagaaagcaagctgcgcaggttcatgctcttcggccttaatttggatctctcctccttgatcagtaaacaatgtgctatttcttcatcaggtcgtcttttatcgacgatcgataggttcagatagagaccagtgtacttgggcaaagtggggagggggacagaaagaaggaaaagacagagatcctgggtgttggcacgagggtgcttttcggtttcatttgacttgcagctctgctccgtttctggtcaggcattgcgctctactccatccgtctaaaaaaaatcaaatcatagatttacgtgtcaatgtttgactgtccgttttatatgaaatttttttataattagtattttcattattgttagatgataaaacatgattaatactttatgcgtgacttatatttttaatttttttcataattttttcaaataagacggatggtcaaacgttggacacggaaaccagcgtttgtcttttttttttttttgggacggagggagtacgactttacggcagcatctcatggtcttaaattttgtaatttcctttttttagtacaaatcaaaatgctcatagcgtcggtcagatgtgctagctgccagcacgaggaagccgaatagtatttacctaggactgaatttatcttttttttaatcaggcaattttcattacccagcttgaaaaccaagccaaacacaaacaggaacagagtcaaatgaatttatcttttttcgccgggccagtagcgaagaagtgcccctgcggattttattatatatttgaccctcggtggaaactagcaaaactgaagagaatttctgttcgatcccatcaatagaagtgaaaaatatcaaaatgatactacctccatattttaatgtatgacgccgttgactttttgtctaacgattgaccattcgtcttattcaaaaatttatgtaattatcatttattttaatgtgacttgatttatcatcaaatgttctttaagcatgacataaatatttttatatttacataaaatttttttaataaaatgaatggtcaaacgttgttcgaaaagtcaacggcgtcatacattaaaatacagagggagtatatatgaagtacagaagtaggcaaggtgtatgcaaacaaaacggtattaatcactgtctttttctattttatataagcttttctatacacagctgcagggttatccactgaaatttctacaccacaaagatcgtttcaacaagaaaatttcaatccctatcgaaacaacaacacgatataatctacttagccggaaaaaatcaccggggaaaaataatatctctagtttacaaccgaataaatctacaaattgaactgttgtatatattagcaaaaagaaaaaaaaagaattgctgtatatatgtctgtgtcacaaattagctagctagcttccaagccatcttcaccatcgatcctatcagcatccgccgttagggctgtaggtcttgcaggagtgacctggaccagcaagcttgtgcagatacagctgccggagaaacctgacgacgacggagtcgtcgccggcggtgtcttctccggcccattcctgtcccgccaatggccgcgccgccgccgtgccagacacgaccaagaacaccatcaccatcacgatcagtgacagaacaagcttcctgatcaacacggccatgatcttttacttccctttcgccgttcttctccctgatctccttctgtcttttctactcactttcactaagaaaaaagctaagaaactttactgaactttactatgttcttctcaaaattctgatatgttcatcactgaattggagcaagactatagagtggcaggcggcggttgcttgctcggtacgatggccacttgaatcggcgttagtatttggaattaatttaagggatttttttttgcggggaattaatttaagggattgacgccgtcagtgggaaatttagactgaaaatgaagaactaggaaccaagtctaagctcctgaattttcaacacatcagatgcaatattgcaatgtctaatgttaggctgctggtacgtactggggaaatctgaaattcgcgctaccgcgttttcccctggcacgcgtaacagaaacctagcaaagattcctcagtcaaggaaacattttaatttggccaatttgccgtgatctcgctgcctgaacaggaagaaggatgtaatgcagaaataagtccattacgtgttctgaatgcgttgctgtaagggagggggtggcggtggtgcggtgccggagccagaggagggagtggcagcggaccggcgttggccgaagctagggaggaagggtcgctggggcggcagtggtcgtcggcatcgatgtcggggtatgtatagtgtgatacttggcaggtatcgcacgatacctttatcacctgatacattgcaagtatcacctagtaggtatcgcgtgatacctgataggtatcacctgatacctcgtaagtgtcatcttctatgtggcaagaatcgcatgatacctgatatgtatcacacctgatacttcgcaggtaccacctatcacctgaaacgtggtagaatcacttgatacctgataggtatcacccgataccggacctgatacctaactggtgtcatcccgttcgaaaacgggattccgttatatagtagccctcatatttaaaccggcacatttatagggataaaagtgctcctttttcaattttttttagaaaggaactttgggatgagctagcggagccgaacacatgagcatgtggtcttttagttctcggccttttctcctcctcctcctctcctctctcttgtgttttctcaattcgtcctctccccaaattaattgagcggcgcccctctctcccctccaacaacgatggcagcctcttcgatccgcgcctctccatccaacggaaacagtgacctactccccttggcccgttgttgacgcgaaaaacatgaaggcctggaagatctacttaggttcagtgcaggtcatagatcttgatgaggtgcaggcatgcaagttagtttaattctacaactaacaagatgtcaatgtagcagtaattagccgataggttgaacaattggctgctggagaattggatcgattggaagtctgatacaaatagacttaaatagttggataaacaatgaagtgtttgctacattcggttaaaaccaacttgtatataatccttataagccgatacaacacttaaacaatatatatccagataacgcattggttgaaacccccgatgatataattattgatgcctacttacttaaataaatctaatttacaaccacaacccccataggtcgaaaccaaccgatgcagcataaggttgataattgcctgatagatttaaacaagctaatatgacagtgatcaaaatggttatgtattgaatttaaccaagccaggaaaaccatcaaagagaaatttaacacattggataaggtcggctaaccctccgacgaacctatcaacttaacatgactttgattatcaatattaatctagaagatcgaacctaactgagagttcaagattgtgtttaatatctgatcccaatgagttgataaatctgtctaatgtgatggatatatataacaaatcgatctagagtaacattatgtttaaagaaacatcaacttgatcagaatatcggacctgaccgaggaagtcctaactaagtcaatataactataaacaataatggaactaaaaatagatatgatatacctgataggcaacacttgcatcagctcgattggaatatcatactcaactgaggaagtcctagccacaccagcataagcgaagatgactaaactcacttcttgccagaggtcaaactcaatcgatgcagcccatgagccaaaactagaactcatcaagataaaatctcatgggatggtggcgatgtgccgaaatttaatatattgatatgtggagatagattatagggacaccgggtgtacatatttatacccataggtcgataagagtcctaattggacacgactcaaactttataatgataaaagaaaaaatacaagtcttgatcggataataaacacactttcctaaaactaaaaaggaaaccaactgactctatctaattaatagataaattgtcatatcgcatcattcttgaactcgacctcttctggataaactttttttaattgattaatttccttaaccgaatccatcaagaatctaactgttggtgaataatagttagcatcggtctattctaggactctgaaaccgatactacctctaggccgatgacaactttgaagtataccaaacacccgtccaacaacgatggcggtgcaccaacaccacttacgagttacgacttggagatcgtcggatctatcaatgcctcggtctccaatgagcaacggcagtgatggtttttgttaaaatttttattcagtttttgtatgtgttcttggatcgaagcatcgactcgatttgaaccgatgtgagcagtttttttttattactagagcctcaaaggtgccggtttgttcgtatcacctgaggggtgccggctagaaaatccggcacctatgagggtttttcaaccgataccattgacgttttcttgtggcaatgtatcttgcacgattgcaccgaccaattccgttttacgtatcattcgtccatcatcgaatggacgataccacatacagtacttgcaggattgtgagaacaaaagtttacaaacaaagactggcactttattaattcatacatttgtgactaattgcaattgaacaagaagtaaactatattgcattcatctctacccttctaggaagtacacggcgagaaataccataaaccagactatagagtttgccaatttggtgcctaacatgttagtgggggtgggaagggcaacctggtggcggtggaatatttgggtcattgctcgtgcacgagggccttgatggtagctgctgcaggtacagctgtttgaggaactgtatgagaggatgatcgccggaggtggccgctccaacccatttgtcgccgcccagcggccgcgccgatcccgacacgaccaacagcataagcaccgccatcatcagcggcaaaacaaacctcttcatcatggccatactatgagctcgatcggacttgcgcgcgcgctggtgtttctctcgctcagagcttctctcctctcctgtacgtgcagtgtgtctgctctcttgcagctcactgtcccgggcaagtcacgactcacaactcacaagcgcgagttcagtgtctgatctgtgcgagctctgtgcatgcacaagatgatgtcttttttttttaaactaactgcacaagacgatgtcgagttggtcgatttgcatgcatatatatagcccccctgcttcgtgggaactccgtgttggctccgctattacgtgcgtgactcgtcggtgagctaaactgaaaaaaactcggcacgggctgaactccgattctacggtcttcagaagggaaaattcacgcggccttcgcgtgcatgggccgtgtacagatacacccacacacatcgatcacggccactagcaaaactgtagtgaaatctgcatgggcacaagagaagcttacctttatttgcctatgtaaaaattccatgctcatgctcagctcgagttacgtgcgtgactcgacagaagacgctgtgccgtgcgcttctccctactacatacgccgatacgcgggttccaattccacggtcatcgcttcggaaggaaaaaattgcagggtgcggagctaaagaaaacgaccggtttgtcgcgcgccgaggtgaccaacgcgcgcgccggtgccctgtgccgcgggtcgtaaatcgtaatgcgcatgtcaacctgttacgtaggtgacactgggacccggggcctggtgtgcgtgcatggcgtgtgcgcgcggcgtcagcgacccggccgcgcgccgccggcaactgcacgcaccggcgtacgtataagctcggcttacatagctcttgcttttgctttgagctagaggtaggcatgcagagagatgtgtttggcgcaaagctagcaaagcgagattgaccgagttgcctctcgttggtcggcaactccccgacacgcgctcccgtctgccggtctgcgcgcgcgagagaggtcgatccaccgtgttcgaatcaacatgtgatcgatcttcccgtgcgaatcgtgcgcgcgcgccgcggagttcgtagcctaacatccgagagatcgaacggccggtcacatgcgtgtctacgcgtttcattctcgccacgagtcgcgtcatgaaacaggcacgccgcaacgccgccggcgcgggcggtcaacatgcatgctacagtacgcttctgtttgtagattgagaaattaacggagaaatcagtaagggttcatgctctttgggccacttcttcttttcggtaaacaatgtgctattttcttcaggaatcaggtattctttattttatcagcgatcgatcgataggttcagatagagcagtgtacttgggcaaagtgggacagaaagaaggaaaagaagacagatcctggatgttggcacgagggagcttttcggtttcatttgacttgcagctctgctccgtgaaatatgcagtttctggtcaggcattgcggtctacgactttacggcagcatctcatggtcttaaactttgcattttctttttttctttagtacaaatcaaaacgttcatagcgtcggtcagatgtgctatatagttgccaacacgaggaagccgcatagtatttaccgaggactgaattaatcttttttcgccgggccagtagcgaagaattgcctctgcggattttattatctatgactgaattttaccctcggttgtaagttcaagccaaggaactagcaaaactcaagagaatttctgttcgatcccatcattagaagtgaaaaatatcgaaaggatcgaacagaaattcttcattagaagtaggcaaggtgtatgcaaacaaaacggtattaatcaatgtctttttctatttgatataagcttttctatacacagctgcagggttatccactgaaatttctacaccacaagatcgtttcaacaagaaaatttcaatccctatcgaaacaacaacacgttataatctacttagccggaaaaaaaatcaccggggaaaaataatatctctagtttacaagcgaaataaatctacaaattgaactgttgtatatattagcaaaaagaaaaaaagaattgctgtatatatgtctgtgttacaaattagctactagctagcttccaagccatcttcaccaaatcaccatcgatccnnnnnnnnnnnnnnnnnnnngctgtaggtcttgcaggagtgacctggaccagcaagcttgtgcagatacagctgccggagaaacctgacgacgacggagtcgtcgccggcggtgtcttctccggtccattcctgtcccaccaatggccgcgccgccgcggtgccagacacgaccaagaacaccatcaccatcacgatcagtgacagaacaagcttcctgatcaacacggccatgatcttttacttccctttcgccgctcttctccctgatctccttctgtcttttctactcgctttcactaagaaaaaagctaagaaactttactgaactttacaatgttcttctcaaaattctgatatgttcatcactgaattggagcaagcctatatatagatattagagtggcaggcggcggttgcttgctcggtacggtggccacttgaatcggcgttagtaattggaattaatttaagggattgacgccgtcagtgggaaattcagactgaaaatgaagaactaggtaccaagtctaagctcctgaattttcaactcatcagatgcaatgtctcatgttaggctgctggtacgtactggggaaatctgaaattcgcgctaccgcgttttcccctggcacgcgtaacagaaacctagcagagattcctcagtcaaggaaacattttaatttggccaatttgcagtgatccgctgcctgaacaggaagaagaatgtaatgtactaatgcagaaataagtgcattacgtgttctgaatgcgttgctgtaagcgagacctagcttgttgggtcttccctgacttaggacctcatggcaacttggcaagtgtttggtatgataatgcagtgtatgtatgtactctatttgacaactcggtgttgtatggtcaaaacttgatttcttgtgaactacgacagtgtacttgcctgagatgttgctcagtcagacctcctattgttcaaatatattattcaagtcaaagtcctgcaaattttccaagaaaatgcccccaatattgtgtgtttatctgcattctgtgggaagaatgatcagaattacattttcctagctcaatatggtccacattctgaaatattggttattttgttttcctatgctatgttgagatagattacagaaatcccgttctaatcccaaaggcataattttggaattaaggcttggcatataaattttgtaggattcaacttcctaacgaatctttcctactccctctatttcaaattatatcattataattttgtcctaagtcaattattattataaatatttcaccattttttaaattcatatagtttaacaacatgcaaaccgtatattataaaagtattccccatggtaaaacaagaaacataaatcttatgatgataaactttttctttttgaaattaattgtcaaagatactaatatttgacttatagaaaaactagaacgaggaaaataagcaagaggtataatattttgaacactttaatttgctttcaccatgtttggactgaagccaattctaccatttttttggcaactttagtgccatatggatgtttgttttgctaccttttcttcacatagtacaaattaatggcatcagatttgagcgtgccaaaacttgtctatattaaagggtttatcttatattttcctctttttttctatagaattaaacaaacatgtcatttcaatttttttacacttttttctgccctacgcattctaaaagaataaatttattattattgagaatgtatcgagaaataccacatcatgtatgcaagttctaatgtaaaatttggtatcttcatggtactaaatatttagagctaccaaaatttttagtgtaaatttggagctaccaaaatttttagtgtaaatttatatatatactagtatactttcttaagagacataaaatttctcttccaaaagggtctggttatgcaatttattcctacaacatttttccaaacaaattcaattttgcttgagcacattgtgcacgcaagtgttcctaatttcctactgttccactgcacgagacaggacatctctcacttttctaacagtctcgcgatcatggtgtccatttctagtttgaaaacacgacaggatatctgaacttagttccagcatgaaacttgacctgctagtcactactcgcgactgcaaactaaaagcaggttcattcattcttccattgctgacatggtaactcgtaaggcgtaagagacacatatagcaagtttcttgattacgagtaccgcacggtataggtaacttgacttgtgactcggtagttaaggtaagagtatttactgagtcaatactcaagattatgctcatctgatacagaactcactgtgaagtcagtatgaaaatcttgcgattgacgtctagcggatctgtccctgttatactcgaccgggatcattccaaatttcagcgacgacggacactttgggttataaattcagtgatcttttcactttaattaatttccaaggaccgaggttaatcatgatggactaaattaagaatgttgtttggttttgctggcttagctttaaaattcttggagtaactcacttcagtgtgatttgtgaagtactatatactattctctttgtccctaaaagatctttatttttttaactatgtaactggacaagtattcctacgccacatacaattttgttttaaagatttgcgttcgcgaaaagcaggactagaaaagggcatcactactgcaatagcaactagcatgcagcaacatgtcaacacctaatgcacatctctcttcttttatttccgtgtttgattgattggttcatctacgaaataaccaaattaagctgctacagcgtgagattgaagtagtatacactgaaaccttcggtaccgggccgtgaccaggcgaatttaacgggccgcaggttcgtctgtatcccgttcagagcccactactcgaatctgcggagatggcgctctcgtaacagggccgtgaagatctcggcccataggaggcctgctgttctgcacaaactggaggcgataacgtcgtcaggccatcccgcacgtacttgggaatcctgttccgagcccacgttacaaattggcggaatgggcgcgctccaagaaggccatggagtttccggcctatatgaagtccttcctttccccgtttgcggaataagttcactttgggtccctctatttgtcgcccattccgattttcatcccttaccgcaaaaccaggtatgacccgtcccccaacttatgaaaactaggcaaacgtggtcccttggcgattttgaaggcggttttggctgacgtgacgcatacgtggcttgtttgactaggtctccgtcctacgtggcattgacgtggcgcttacgtggcaactatatctcggaaaaataataaaaagtgtggcccacatgtcagctgaaaaaaaaatggtgggggccccacatgtcagcctcattcctctcttcttccctctcccttctctctcttcttccctttcccccctctctctccttcccgggcagaggacggcacgggtgggcgacggagcaggcgagctccggcggcggcggcgggcgtggtcggcgccgccccccgaccggagcgccgccggtccgcgtgaaggcgagcaacgcggcggcgccctaaaagatgccatcgacgtcgccacccgtgtcgctgccgccgaccacccagacgccctccgcgcgcaccgggacagcatcaccgagcgcctctacaccgcgctcatcctcccgccgccgctccacaagccgcctacgccgcgctctcccctccctcctctctcgtcgtcctccctcctctctcgccgctgacgccgccgcgcgccgctccctcttctcccgccggcggccatcgaggagaagggcggcggacggctagacgagcggcgcaagagaaagatggccgccgccgccccacgccgtcatggggctagcagccgacgctgcaatcctccttcccccgctccaagaaacgctcctcctcctcctcccacaggctacgctccctcgcgctggccgtccttgctaccgacgcctcggcgaggtggggaggaggcggaggggagcgcggtaaacgatgacagacggcctcatccattgcgccgcccttgtcgccaacgccaccgatggctcgcttgctcgcatgcggagagggagaggaggcggagaggccgacggcgagcacgcggagagagggaggaggcggcgcgggagcacgccggggctccgagtctgccatgtccacctccgcggccggcgggagggccgaagagtagtggcagttcgccagccgccaccgctccacttccacctgcgacccctctgctccgcccaccgaccgccgtccttccgcccaccacccgccgcccctctgcccgccgtccttgcgtccaccgcccactgcccgccgcccgccgccgctctgcctgccaccccctatgcgccggcaacgccactgctcgcccttctacttgccatgtgtcacgcccagaaattcccgaatagaattccaagcagaatgtgcattaaaacccccgtccaggaccggccggggtacacaaacgataaagttgacgtacagatccacgtcttacaaacattataaaagtcttacataaatgcagcggaaaattaaaagataaatggagctaagccttgacttggactgcagcgggaacgccacttcacaggcatcctcgacggcacggatgaagcctactcctcggagaagccaccatctgacacgtactcaaactctggggtttgggggaaaatagagcaagactaagtacaaccaccgtactcagcaagtcataccggaatagagggtatgatgcaggatataaccaaaggatagctagagtggttcatttgcataaagcgagcatttaaaggcagtagttaaaagcagtaaaacagttataataattcatcaatattaaccatccactgttcaacgctaccccacgttgcaacaggcctaaccatccacctgaactaatcgattccattagactaagctagggtgagactaatcacggtgaatctggttgaccgcccgtaaccgcgggcacggctattcgaatagttttactctgattagaggtgtacaactgtacccacaagacaaagccccacgacacgttttcgtgcgccgacatgccaccacgacataccggatagaggccgtgacaggacccttcgcataaccccctctaaccaagcacaccacacctcaggtttcacccccactactcgcaaggcagcgggcagtcccctctcgtgcctaagtgaatccggaagccgcataggccatcgcagggcccatccaaactccatcacacccacccttgcctagatgcgtcagctagaggaaagctaccctacaagcccagccgttgcgcacgctggcttgttgtaagtacgataagttcttccagggcataccgcaaaccggtccttatgtgccatgggcgcgaccatcaaaaccatgcacccacagcccaccatttaatatattttaattaaccaacaccggagcggtggcattaaccaacatcattactagaatctgatatctatgcattaatgtaattcccccattgtgtgctagttgaactaagcatggctaagcaatccctagtccaatatctcgtcatgttatatcctaagctaacaaaggagcatggtacaaaaatagcatggctgtaacagtaggtaaatatcacatagtaacattataaaacaatgcagtatttaagggaaaacgatagaacatttgcaatataggatcaacatgttcaagtgacaagcatgacttgccttgctttgctgctggatgaacctcggcgactatttcaaagtacaccggagcgtcgggagagccggaatctaagcgacatacaaagcaaacaatacaaacaggccataagactactgaaacagagaataaaaccatttttaatggattctttgcatttttcttgatttactgagacttgaatgggcttaaacggagctcggatgaattttctatgaattttagaagattcattgtgtttttactataaacagaaaaacccttaaatgatttattgcgcaataattaaaaccctgggagagagagggggcggcaccgacatgcgggccccacatggcagtgactcgggtggcggtccgcggtggaccgggtccacgaaccggggaaggggctgcgtaccacgtggcgctgacgtggggccgacaccacggccacgtggcagccacgtgggcgcccgaaccgacggccctgatctaccctcggcggcgggagcgcgcggccggcgcgcacaggtggctcaagccggcccggcggccatggcgtacggcaacgctaccgcgagcggcggtggcaaacggcggcgaccgacggtgagcggcggcgcacggcgggtgacggcggcgcgatgcgacgactaggcggcggcgctaccggaggaaaagagagggggaagaaggagggggtgtcctcaccgaggaggtttgactggcgtggagggagacgacggtgaacggcggcgagactcgacggagagaagtcgacgagcggcggacggggttcgggatgacctaggaaacaaagtgggagaagttagaggggaagagaaagatcaccgagggcgggaacgccggccaaaggcggcggccatggccgaactcaccggcgcacggtgcgggatgggttccggcggcggaatccgacgggagaggggtggatggggtggcccgctcgacggcgaacgcgacggcgtcaacggcgcggctcggcacggcagctagcggcggtcggagcaacggcggaggcggcggagaggtgggcgacggcgctagtgctaaagagagcacgggagcgggtgattgcaaaacgaaaaagagagaggggagaatgggaatgctttatataggctcacaagggtcgatcgtggccgggatggctgcgatttcgccggcggagtggggagaggtggagaggagagagaggcgggattcaaaaattaaatcccggccgtctcgagcgtggacgcgggcgagagagagagggagtgggcgcggggaacgcgggggaaggcggcgacgtgggcgacgtggcccgggaggtgcgggagcgagcggggcggcggttgcgggatgcggcggcggcgaccggaggttagggacgggcccgacaggtggggcccacctgttggtgaccctaggggagaggggcgtgggcggccggcttggctgggccgtggccttcggccggcccggcgggcagggggaggggaagagaatgggccggcggcccattcgaaaagaaaaaggagggaaaaagaaaagaaaaggaaagaaaggattttccagggattaaataatgcttgtgctcatttttaaatggttaaaattatttctagagctctgaaaattccactaaaaatcttgttagcatatttcgacatgtagaactcacgaaaatcctacatgccaattccgattattatttgcattaatttattagggtttcactcctgctcttacaccggtatttttttgagaccatttataaattcaatttagacttgggagaagaacttcagggtgtgacaccatgtaggggagagagaggggcatagagagaagagggagcctgacatgtgagaccacatgggtcccaccctttttatatttttttagctgacatgtgggtcccactgttttttattattttcccgggatccaaatgccaagtaagcgctacgtaaatgccacgtgggtcgacgacctagttaaagggagccacgtaggcgctacgtcatctaaaaccaggcacaatactgccgagagatctcttttacacggttttgtaagttgggggacccgttgtatccggttttgtgatcaagggacgaaaatcggactgggcgacaaatagagagacccagagtgaacttattccccattttgcgcatactcaattatgggccctaaatgcgtaggcccattcagcacgtaggcggcaatcctgttctgggcccacgacatcacggcctgtctagttacgctggtttctaacgtgggctcggaacgggattggcccaaaatggtctacgctgaattcggattagtccatccgcagcaagaatgccacgcttggtatttttcagatggaataagtgtatttacatccctaaactcatccttgattgaatagcatccctcaaccataaaaacgggtataatacctcttcaatttttgaaaactggttcaaatcgatcaactccataggtggtttgggaagcggtttaccgtaggatccacatgtaagcgcctactctagttaacacttttttttcaaatgaacgacatatgtacatcgtcgttcaatctggtgcactctcgccgctcgaccgactggtgaccacgacggtggcaaagatggcttcgtcgacctaggaggccgagtacaaggcttcctcggccacaactggtatttatgctcattcattatcattactttcgctattgcatatttatctacatcaatcgactctctctccatcaaaacaaattggatacatgttaattgacgtacggtagacatgggagcttctctgacagcgcgatgctcaacaacatcattgggctcctcctgcatagcacgaagccactggcacgcctatccgtccacgcgacatcctatgcctcgcaatgcgcattgacggctcgtgcttaccatcgtcgtgccttgctacctcagtgggaacctccgcatgtcctgcatcctcccggcgctcttcccctctctcgccgcacatggccgccacgcctgttcgcctccacacccgcgaggccgtgctagacgtgagttcgccgagtagtgagtactagtccacctatgcgatgaagttgccccgggttaggccaggcatccaccgctaccgtcgtgatttgctcgcctctgcaatttcgcccaccgaccgggagcccgggatgagacaaagagcaagagggaggtaggagaggaaggagtgggccctactatgttctttttattttttttactataatgccacacatgcaacacgtcagtaccaaagtaagtcagcctactaagtaggcaccacatagaatgaaaccattatctaaaccgttgaaggatgcgattcaatcaggtgtaaggtaagagggagattcacaaataggcttaaataaatgtgttctccttattttggcttttcctatttaaatgtttgatgtgttctattttatttgaactacactcttatctcgagtgttactttgtaataattggttgtagcttttcttgagcaaaggttgagatattatattccattattaaaaaagagagagagagaaaaatagacttattcctttttattcctttttagattcttaagccgaactatcatccgttgatgtttgcattggacttttctctatataagccgcgtaacatgaggcccagtaaccgaaagttggctgatgttgtttcgttgaacagctcagcccactccaacctaaacggccgctccctccactgctgttgaaagcgccacgacgcgccgcgccgcgccccgccccgctggcgactgcttctgtcgcgctcgcgcgcagagtcgcctccccggagcaagcgttgatcggctcaaacctccgccgaggcgagagggcagcaaagcgaaaccccgaacattttcaaacgcggcgccaaagcgaggaccgtttcggatcccgacccgatgcggtgcacgcgccgtggtcaccggtacaatcgtactgtagtacagccggtccaccgatcccgatgctctcagcctcaccagtcaccaccaccaacccttccacggctagaaattttgcagtctactactgccaccaccagctgtccagttcaccaccacgacccggtcgcctcctcccgcccgtttaaatacgcagcagctcaagctgcctcccccgcacgcttcatccacagatccctctctgtctctcaactcccaagcagcagagagagcagcagctaaagctaagccgagttctgtcgccgacgccgtcccgatcaagaggaggatacactcgtacaaggagcggaggaggcatcaccagcttacaatgcggagctcgttcggcggcaaagctcgcggcgctgcagcaccggcaccggcgacgcacccgcgctacgtgccgcagagaggagtcgtgctgaagagcgtgctgggctggttcttcggctgcttccgccccgccaagacccggcctcttccggccggccggtgaaagcccgtgcgtggctgaggcccggtgtaccgaccgaactgccaatgtcggttagcgcctcgctttcccgtcccttaggttcttgctgggcgagcttcttcacacgagacacggcaaccgatcacgatggaccgcgcgtgtgtttcattaggattgtttgtacttagctttgtgaattgtatgttgccttcttggcaacccgtgatttcatttgtgttcctcagggccttatcgcattctgaaatctggattcagcttcagccttttcaggtgttctttttcttaacgagacggtgcgaagttctattgatagagcaggacttttcaggtgttctgtttcagatgtttagttatcatttgatgctgcgtctctgaataatcgtagactaaacagcagaaagcgcagaaccagtcaggtgcaaagaattgtttgcgagttgtgatttctttataacagaaaaagactacgtaggacaaaaataaataatggggaaaagtcagaagtccaagtcagcttttagactttgactttttcttgctttgtttagttcttgctctgttgcaatggttggttggtggccggatctgcagccatgttgggctcttggctgcatccagtggcttcaaccagattgattacctttttgtttctggaaaggaatcattagtatttggtaataattccattagcccaattgtacagcgttgcatcagctgcatcatcaataaacttgattacttctgctcaacgcatctcaacattgaccagagtccacatttcctacacttgtcctactatacatcaacatcatcttacttactgtaaacagaaggaaaggatttgttccgaagcagaatggtgacatcgtattccatttcctttattcagaagtgattttgatggatatgtatgaactatgaactaggggacctgtattacatttttttgaagggaaaatagcgcataattgtgacttttcattgaatatagcgtgagagaacactgcatcacattaacttattctgtacttcgagctattacccatttactcatatgaaagttcatccaaactagtactaagacttaagcacgtactccatccgttccaaaataaagaaatttaatatgggatgtgatatataatattactacgataaatctgaataagtctattttggaatggagtactagcttgtggctaaacacatttctgaaattcaaatatccgttcagtacttcagtagtatagtacattctccaacaatttggtacgatccatgccttttatagtcagtacattcagaacgaagaaaacctgccactgggatgaacatgggcaagaactaatgttgcctgcacaagacagaattcgccagctcaaattttgtgagagaagtcagaagtcaaggtcaggttttcagactgaccttttacagttcctcttctctcattagttggctcgatcagagtcattcattaaatccgatcactggacgcgaccagtttctctccgggacactgaccctgacccgaagtcaatctttcaatgtttcttcacttggtcactgccctcatcttcagtgtacctactggacatagaatcaccgctaaattttgcacaccgaaaaaaaatgctttggtaactaaatttccaaagaacatagagtaaggataatctttttttttcctctctccttctttttccaggattccagtgctgttcttgcccagttgccctccctttctcatagttccagtgttatttttattctctccatcctgccgtctgcactatcgtttccatgtaaaatctgccccccagttcgccacttgcggtttgccgatgtgaaacgaacagaaagccatcacctggtagaacaaagtgaccagcgtcctttcatgccagctacaaacaagctcgccaataaactgtagcactcttgagtcttgcctgaccgtgtttgcggcgagagttgagttgaggcatcattgtattcggttttcaccgacctccacacacggccacacacactgctcctgcagatgcttccttcgtcccacagtgcacgaagaggaagaaaagatgatgaatttgatggcgagtgcagcagaaaggcgacgtcttgaacggtttagccgcaaatcggaggggcccgttgagcttttcccacggccatgggcgacggccatggcgccacatggccgatggctactcgctaacttccacctgcggaaaccgcccccaaaaaagttcagacgtagtcgtgcgctcatcatctcgcttacgctctcacgctgtcgccatctcgcgccacttccgctccagttcccgccatcttccccagcctttccttcgctgctcctctgtggagtgccaccatgagttcataaatacgaggttggtatggtatggccgtttgctcactatcaccacgaatccggtgtaaagctcacctcacctcacctctcgttatgctcggcggcggcggagtaggaggggggaagaagccgcctccgccgggagtccaccctcgctacgtcccgaagaggggctcggtgctgaaggggatcgtgcgccgcatgctcggcctcttcgtcttcctcctcccgcagcagggcgggggcggagcggcgaatggcagcggcggcggcggccgcgtgcgcccggcggcgcctccggtggatgatggcggcgagcaggggaagtaggtcacccacggtatatatcgatcgttagaccgggttatcatgtcccatccttttatctgggccgttcgttaatggtttgaatagtagctgttatgtttttcctcctattattgcagggattcatgtcacagattaatacggtcttacatattcgtactactactatgctttccctcgtattattgcagggattatgtaacacgtgcttgatatttctacagtttggaaaagttcagtttttctttttcattctgttgtgtttgtttctgcagaagtgcagaggatttttacaggaatactcaattcttcatcttcaggtgctgtgaacaaacaaaca

SEQ ID NO: 63728 - DNA, 7859 bp, Oryza sativa
attactgtagaacaatcatgctgtggtaactggttactgccatctgtatctgcaactgctagagagaaaactgcacatggtcaaagagactcgttcatatggtgaggtaaaatgaatcattacccatccgacgaatgtctacaatatccttccacggcactatctatcaaagattacatgctatccctgtttctttgtttctgctactgaaatattagtggtcaatcccatgattgcatatttgcagtcaatgccaatatgtcatggctgcactgataccagttggcgaacttggcgaagccatcatctatttctcaggtttccaggatttgggcacagaggttctcagcttaagtggatgctgcagtggagaaggcaagatcagaaacaactttccacacaggctgcattatattggcagtgaccaagaatactacagcgatgatgaaacgaatgaaattccagtttacatcaacatctacacgagccagagcttcttgatatcactatattactacccaattgtactcatcactatgagctattttaaccttactgaattgatatatacatctacttcaatatagaggttccacaatgtcagatgagtcatttgcaaaggttacctgtcaaagatgtctccacctagtaagaagcttctgtcaagcaattgcactgtaatcttctagaattgattacctttaactttcttgtacctctttgggaaaagttcatcgccctcaagaactacttctttatgcatttgttcccatattgctccaaaatggctatgaaatttatcttgaatccatgcttttatctcaggataaagaaaatctggattaaaattccacacatctcttaatgctgcccggctatctattaactttgaaccaatcttcatcctgtcaagaagatcaccaactcttctttggctaacaggccctaggagaacagatggtgacagtgccaggaacttctgaataaccttaagacatggcaagacatctcctttaagcaaagcacatgcaaatacctgcaaccgattggtgccatcctgtataggtaaactatgcaatggaagctgccaattatgccgagaaaagatggggctaacataacagtagacttggtccttttgaggttcgtaataaggttttggatcttccaatggtgcagagaatgtacaaagagaactagcatatttcaaaatccatcctggctttacactggttacaccatgcatatatgatctctttgtatgaagtagttccgagtaaactacaaattctggtgcaattcgtgcaacagaagatgatcggtgtagatatattgtatcattgaaagcacaagattgataatgaacagcccgaacctttttatcatcttttgatggtccaggaaaggcacgaatcctctttgcaaccctatcagcccacccagcacatattccttgtcctagaagctcctcttcatttaattgcattggttttttatcagactcatgcctccaggcctcttctacatcttcagaaaccccaaatttccaagaaaattcttcacaaaatttgctatggtgaaatattaatcgaagaagttgcttcctcaattttgacatctcttccattgttttgagatgaagtgagttgactctgcaaaattccactgggttttctgacaactcaaacaactgcaaggcacgagagatggataaagcatcactgctaggattggaaaattttgtgtgggcctctctaaccatcgccttgagcttcttctgtctcttcctttcctgcctatccttatcttctgaatcagggttatcttgttttgattcaccactaaattcattctgcgtgagaaaaggattcgtaaagctcaatgctgatgcagcagctgctgcatatcccaatatgaagttaggtctggaaaagcaccgctgactgttcaaaattttaactattgtcagaagaagtcgagaatgtcgggggctcatggggtattgtgccatagccttccccatcaatgtaggttcacccttgctatcaagcgcttccaatacttttaagcaacgctcagcttcaaccaaactttccttgtcaggaggtgtagggaaaggaaagttttcaacctgtaattatcatgaattgcatgaaacaacagagaaaagaaagataataagtcaaaagaacctataatctcataaggatgagtaacttgcaagcacattaccttattaatattcataaacttgagcataagcacaacaccatcgactggaatattcttgatctcaggctcagagaactcagggaataattcatctttaccatatgctgcagccgagtagagatggtaacagtgcccaggccccgttcttccagctctcccagaacgctgggatgcagatgccttgcttatccactggatttcataacttgccatcccagtagcatggttgtagttcttaactttttgtttcccagtatcaactacatactttatgccaggaattgttaaagaggtttctgcaacatttgttgcaacaacaactaatctttcaccgtcaggaatatcctgaaacactcgaagctgctgtgaagctggtaacatagcataaagtggtaacacacgaagtttaccatgcgaaacagacctaggttctgtgcatttactggtacaaggaacatgacttgactcttctaaaattgtagcattgcttggtacatcagtgctttccggttctcctgacactcttgatatagccttaaatgatgccttcaatccagatgaaccctcagcacctttcaaaaatgctaatactggtccatcctcttctgtggtttcataaacagaatcatcatcctcactgtcggtatccatctcaggttccatttcaatgtctgaagaatctacacctgggccagcattactctcatcctcatcatattgggaaaacatgtcatcttggtgctcagactcatctctatcaatatcatatgcttcactgatttccctctcgaccacttcttggctcgagccattctcatcaccctcaactttttcagtcttcttgtcagtttgctgctttgatgctctttgcagtttcttacataagtaatcgacttctcgttgtccagtaacaaagacaaggattccaccttgtggaagtttcttgtggatggacataacctttttataagcttgccccaaataatcgtcatgtgtactctttgagaagtgaactgttactgggaattgtcgtacaggtacctttatagctggtgggatcacatcaaacaatcttctgtttgaaatgaagtccttcaattgcaaggtagcactcattagcaccactttcaactgactaatcttatcttctggattaatgctcagaccacaacgtattttttcctgttgctctatgtacaatgactgtcatgtgcataaatgttaacaatggttatatatatatattttctttcattctaatgaaaacgatgaaaagtatttagtttcaaccttgcgaatctttataattctagatagcatcccgataagtatatctgtgttcaagctcctttcgtgcgcctcatccaagatgattacagaatagcgtttcagcagaaagtcactctgcggatgattagtaaaccatgtgattagcaggattctgatatacgtctaaaaataacttcaaactaaaaggaaaataaatacatagacatttcaggatgatcaatcacatgctgtaccattttataaagcaattatggaagccatgattgagtggttatagaaaaatatggatggcgattaatcaagtgtcaaacagaatagctggtaggaaaactaaaccttattagggcagttatgctgtccagggaacaagggagacttgcagtatcgacagttatgaccttgaatgttttcccttaggtgcattttctaatcatgcttaactgttaacctttttctttcacaagttaatcatggtaactaataagtagagtgaagaaaacatgtctcttcaataaatagacaatataggagtagccaagacaagtaatcagattgttacctggacctctcgaagcaaaatgccgtctgtcataaactttattgagcatttacttcctaccattttatcatgcctaacttgaaaaccgacctcctttcctagcttaagacctagctcataggacaccctcctagctgtggcaagtacggcaacacgtcgtggttgagtgataccaattattccttttctgtcagaccggttacttgtgccaaagccagcttcatacaagaactgcagacaacaagaagcatataatgagcaatgaatacaagcagatggtatctgaaggtgcacacacttacctgtggaacttgagtagttttaccacagcctgtttctccacatagaattaccacagaattttcataaatagcttccattatttcctgctccatcattattattggaagatccctccttgttttctcaacctcatgtggccttgacacaggtacaacaattggaggattgaaacactcttgtacagtacgttcttcttgtcctggctctttatcctaacaaaaacaggattacaataactctgaaatgaaccaaacagcttctgactgcaataccactaaagcaacaggtgaatccaacattttttacaaaaaaaaacatgtagaaattgatgaacaggtgaaaaaaaacacagtacagctgtagactgatcacctgtaatatctcttcaccagaacaactaggaacacatgattgaattgcctgatttgctgaaatattcggaacaccatcactaccttcagtttttggttcttgatcgctcagtccaacatctataaccagtttgcattccacaggtttcattgcaacattatctatgtgattgttacattttctttgaggatcctcgttttttgctgaatcgacaatcttgtccaggtaatcttcctctgcagcctcgctgttttcagaagctttctgatcgccgtctttctttaatagtgagagttcttcagggacgttcaaaccagccttggagaagtgcacagcacgcctacgtttttctttcaaggtctcagcctgcagtagaataaatgtctattgaagctttgttttgtacattgagaaaacagcgaatccaagaattatggctatatctactatacttgaccgatagtcccagaagcatggagcagagaatacgcatcatctgaaatcttgtgcttcctgtcatgcaggacaaccatcagaatacactatactatcagtccagacagagtaagtaaagactaacataccgcaaaatctcaatactttgagcttgcagtaacttcttttgcttttcctcctggagataagaaaaaaatgattggcattaacataaacactatgaccaatgatcaacaaaaggaatgtcaagaagggaggcgcacctccaaattctgcagctttttcagcttactcttgctcatcttcgggtcttccttgattttcttaccatcctggcaattcaggtagcataagtcacacatcacacccccaaacagtaggtggaaataaaaatggcagcaccttgtctttcccttgtcctttgttcttcctcttgcacggcagaatcagcgtgttgctgtcctccatgctcgaactacaagcagagcaaagcagaaaaatctcacaaccgatgcagacgagggacatccgagccagtgagcccgggaaggaactcaccctgtaagctggtgctcaccgacgtcggcagcgtccgcgagggggcaagccggcggtgctggcccgcgtggtgaaattggacacctccctccctcaagggacaactcgctggagcaagctgatgctccggcagagagaagccggtgcgccgccgacgccgcagccgccgccgagcctgcagccctcggaggtgcaagcgatgggagaggcggcggcggcggcgatggacctaatcgaagagtagaggggatccagtttgggccgggcttgtttgtgacgcctaatgggccgaaggagaaaggcccataaaagcccaacgacatttcgtcatttcccctgcttgttcatccggctaccgggtcgcggccgtcgacgagacacgagaaaggcgacgaccactgcctcctccactcctccagatcgccgccgccgccgccatggggggcggctccacggcgcccctcctcgcggccttcgcctgcgtcttcctcgccgtcttccctcccgtcgcctccggtgagttggtcctctactgaccatcgccgagtctatatcgctttgtttgctctggactctggggtgtaacaaattctaccgaatcgagatggtctcatgcttcgttgggtatcttctgttatgtgatgcgtttctagggtgaaattgtgtagggggtaggtctcagcgtagccttgaggtgaattaggtagtggactgctaaacctagttagttctgaagcttgggcgaacacctccgttgttgtgctgataggcctctagttgtgctcatggagctttgacatgcgactataattttttttctagtatctcattctaggaagttttgtgattgctaaagtattgtgatgtcttaggtgtaggtttgtttaggttcatttgaattataaaatcgtgatactgcttactgtcttaatatatttatatatgggacacaggtttgcaaagcaacgtaagatatcccaacttatgactgctgtaacattgatgtaccataacttaaggatcctcttacctttctttttaggagatgctgcaacgttggagtcagttccggatcttgtgaaggcaatgtacataaacgttgaaagcttcccttgtgtgaggctgttgaatcactctggtcaagtcggttgttctagtgagtattcggtttactcttattctgtatgcttaaattaagatggctgtcattttctatcatcattgtcaaaggctagccaactctgccttgttaagagtacatggttattggggtctccattatgtaatcagatcctgggcatgacaaggttattgcaccgattgtaagatttggaaacagaaatgatcagttggttcagccgtcggcggttcttcttcccttaaatcagatgacagatttctttctgaggtataattgcttagatagtctaaatctcacaaatgatgttacatatgatcgtctttcaaagttatgtttccttgaggtgctaagagatgagaatatttgctacattgtttgctcttgtgcagggtatccaatgatccagaactttatcgtaagatagctggcgtactagttgaggcaaatggcgttgataacatgctaggtttgtggatttgttttttttatgtattttattgccttttaattccaaaaataatgtactgttctgactttgtagagttttcaccggatagaaaatttccacaacaggcttttgcaccatactcaaatctcagccatcattggaatcccacggtaagttatgcggttgattaaaatggtaccaccctgttgagagacaaacgtgatcagctgatcacatgcattgaatatcactctgttaccctgacatttacttttgtagggatcaggtattatgtggaacaaatatgactttcctgtgtttcttctctcagaggagagcacacagactctgcaaaacgtattctgcctgctcttatatatttattatagttctcatttcttctttacaaactccagctacacaatgcaatgactctaaaaagagattatcaataacagcttgcggacaagaatgagaagagtgccatggatatctagcaa

SEQ ID NO: 63729 - DNA, 8140 bp, Oryza sativa
agcatcagaaaccaataataatggtcactgcatcccaagactctgcatcattctttcgggaccgtagtcttggtgctgattctcccatctctgtaagttcctactaatttgtgggtatgataactgcatcttacattatagttctatgaaataactatggagttatgcacagggattgattgccttgctcactgctgttgatgctctctctcaccttcatgatataagtaatcttaagaaacaggtaagattattactactagaaattattctgtaagttgtgtgcatgttattgcattgggttcttttgcatctgtcatctgctagagcagtgttgcaggtctactctagctactttgtgtttcttttgtgaattatgatactcattttgaacttgcagcccttgacatctcaatcattgtcctttatctaagcatggcgtggtagatttaatatggctattcatatctggtttagtatggatttgtggtgattgattcctaaattgttgtgttcttattctcacatcataccacatgatatgcagcttgtttttgctgttttcaatggtgaagcctggggttatcttggtagccggaaattcttacaggaattagatcaaggggctgactctgttaatggcattagcagcttattgattgaccaggtgagtgcttgataggataacgcttgcaattgcagcactaaatcatttgcaaatgctttcaaacatatagttttccttggatgtcccttgcttcagggtattgtccttctgcagttttttaggttgtggacttaatgaatttaaacctgtgaaatttaccatatagtcctgagtcttcaggcgatacatatatctgtctctacacagttccataacctaattatatgattatttaggcaagtatctgtctacattgttccataacttaattatatgattatttaagcaagtgctttggacacgattcaggtcttggagattggttccgttggcaaggccataagtcagggatatccactattttatgcgcatgctgcaggggtaagccttttttgtggttatttcccctgcctgttcttggtgaatgtaattgcttattcaaaatgttttttttttcagttcctgttagtgtcatagtggttgataccccactctgtacaggctattttagttattggagatggataaacagaaagaatttaggcacagtagatgggggcctgtggacatccatatgtatagtttaggtttcagtgttgcatcagaatattcctttttgtcgaatatctcagtgaactattttttatcatgactttatatgaagatattttattctggagagatttatcaaaatatttgttctcaaattcttgagtaaagcacactgggtgtccaaaaaatagctgtacattggaatttaaaacaccataggcattgttccatattgttcatatttatcttctgctttgacagaattcgtcaatttcgatgaaaatggtagatgcactccaaagtgccagtgaatcacttggttctgataatgttaaagtaaaaccagcagcttcatcaaatcctggtgttccaccatcttcattaatgtcgttcctaggaaaggtaaaacctcaaatatccataaacataaccatttgcttgatagtattgcactcaatatgcaacacattaatttagtgatgttccatctttttttttcttttttcattagaaacattgatttttccaaacaaatatttctctttgaaatctgagtgccatgacctgttcactgttaacccatcaataatgcagaattcatcaactcctggacttgtcttggaggattttgattcccaattttctaatagattttaccacagcactttggatggccctggtaagttcaccatgcagagatctgatgatttcttttgtagaaacccaggattaaacctgtaatgtcttttttttacagcaaacgtcaattcttcgtcaatagcagctgctgctgctttgattgccagatcattatacattcttgctagcgcagacttgcccattgatctcatcacactgaacactattaaagtgaatgtttcactggtagaagaattgattggatgtctactgaaatgtgatcctggtctttcttgcggaattgtgaagagcttcatttctccaagcaactcatgtccaagtcactatgttggtgtttttcaggatttgcctgctggcacacagtttccttcatatgcagatgatatctctcggtttatatggaactttttggcagacagaacttctagtttggcaggtaacagtagctcttgtactggacagtgccatgatgaaggcgaaatatgtgtaggggcagaagtggaaggtggaggcagatgtgttgtatctacaactaggtatcttcttttcttgagacgcatactcccttctagaactaggtaacatttttctatgggcccttttagaacgttgaaatcaaatccctactgtgcgttacttatttgggtgacaggcattagcggtttaattatgaactaggcaattataagtgtatgcttagggatgcaagtgggcaatccctctactcatataaaaacccgcttaatagttcattttcttgcttctagtacaaaatttggaagaaaaaattaactagaattgtgataagggcacacttgcatccctatgtatgctggagcatccataatccagttagtttttgtatatagaaagaaataaaatttgctgacactaaagtaattttgactcgcactcttttttgtgttgattaactaacatgtactggtgttgattaactaacatgtactgaattttgttatcatgcttgtatttttgtggtgattggttgctgttgtactctctatttctacttggagatttactgattgctttattaactttcttgacaacttagatatgtccctgcctattcaacgcggctgaagtttgaggacaatgtatggcatgttcttccagtaaactcttcagacccttttagtgctgcagatcctgtgtggaccgaaagcttctggaatacaattggcctcagggtgtatgcagtgcaagctacatcttatgattggcttgttcttctgatcgggatcattattacggtggcatcatactttgcagtgatcgttggcagatcatacatttcaaagatcataaagcgggactaaaacatcatccattccctccattatttctgagaccttggtccatcagatcctaccaccaaagccatctctgtaaggtgctctgggaattttgagagttggaacagaactaatagtctaacacatgaattaagtcggcaaatcttagatgcaatgtggcacatggcgatagggagaggatttgtaaaactacaaaagccatgtggagccttccagctagaaggagatgtgatcctactacatgatacatgacaccgacctacaggctgttgtgatttgtactgatgtttctggatctgcttggctgattggctctgcattggtaggtataggtagatggatgatgcccctctgggaggatgtatgctgtggattagtgctggttatgcacgtatcatctttgagttttggctgtgtacgtctctccagtcctattttcctactgtgttgggaccagttgagtattgtgctggtttacggaaccttatcgatatcatgtcaagaactgtccctatacaattttaaataactgaaaagctcagattcgccatgtgcaacatgctgtttgtacactctatccaactcgatcctctatccatttggtccgtcacctagagttttttttccccagttttcgacgattagtttttcatcaaatacgacagaattccagtgtataggtattactgtattagtggctgaaaggttaaaattctccagttaataaggctgtgtttagttcacacttccatggatgaaccaacgtcaactgacgaacaaaaagaagggacggatgggggattccgccatgtgcgccaggtcgggacaacggaaccaccagtgaccgggcgtgacgtgttcgcagctaaaactaattctaaaatcatgatgctgatctcggcgtgacgtgttggcagctaaaactattccaaaatcaaggattaggactaccgaatggcactagctgccgtggagaatctctatgcattgtttctccagtgttaacatcgtttctccttggcacgctaagctttccaattcctgctaaaattttattacctttttggacgaaaggtggtgattaccccaagtacaaggaactaaaaacaaattgtcatactccaatatagcaataatagtctgaaacaacttgtagtgtctgtttccatgttgcttcttgttaatgtagggtgacagctaggataattgagagttgacacgtaaggcagcttcgttacgatgcttgcttttagatgccttataaaacaatttacgatttgctaaaaatccgatctaattatgataacatttgccattttttccttaaatcaagcgatgtttatcttcccataaatggttgaatgagcaaggtgtgggaaaaaaaaaggaagctttgatcagtttttttttatcgagctatctttaaaattatttttcataatttattatattttctccatcatttgagactatttcccttaacgagctgggaagccgaaccgaggcaggatgaaaacaacttccattcaaaattaaatagtaaattttattttgaaagaaaaaatagattaatgagagcaagtttgtaccaagctaactaaacgagcttttatttttttttctccaaatccagaatgctgcaatccaattgataatcacatttaccaccggataacctcatgttttagataactcaaatggcgaagcatgcgtgcgattaaaaaagttcgttaaaaacgctataaaaggcggcggtgcctttctccttcatccgtgatactcccaaagattcttatcgattgaagaaaaaaaaaagccggagaaaaggatagagagggaaagcaaccagccatggagtcgctgactctccgggcatcgccgtcgacggccgcgccgttgcgccgcgtccccgggcggcggcacgcggcggtgtccgtccgcgcctccgccggcgccggcgagccggacctctccgtgcgcgtgaacgggctgaagatgcccaacccgttcgtgatcgggtcggggcccccgggcaccaactacaccgtcatgaagcgcgcgttcgacgaggggtggggcggcgtcatcgccaaaaccgtaatcctctcaaccctcgcaaccgcaattctcctggatggatgacttttcctgctctaattttccgttgaaacagcgcacaaggataggatctatgtgatgtagttagcatttcagtgtttgagataagttcgcgtattaacgagagtgccttttggctgtatgatttgattccgatctgggttgggtttggagtgggagtgggagtgggagtggaggtgggggccaattcaagctcacttgaaaacaggtagctgctaacatgatgtcaggaaaggtggcggtgtgagtttgctattttggttgcggcaaaatcgaatcatggagtcgtggctacgttagatttggtggtggatcttatgataggttttgatgggtggccatacgagaattgatagattgatgggtgccggatgagaattcagttagttatatatatggctggttagagttaggatctttgcatattctaggagaatttggtctgtatgtactacttgtgttcactatgactgactactgacaaacgtcttgcttgaagatgagatggcctaatttttgtgagatgagcattgcatcctcagtattaaacatgagaaattagtttcaatttcttttgttctgcattaaccctttgcaatcatcatttccacctttttcacatacacattgttgtttccattgtgcatagtgcctttgcagtcatcactttcacctatcacttccaacggttgaatcatcaactttgtggctaattgttggtatgattatgaatggtaggtatccttggatgctgagaaagttatcaacgtaacccctcgctatgcccggctcagggcggaccccaatggatctactaagagtcctatcatcggatggcagaacattgaacttatcagtgatcggcctctagaaactatgctgaatgaattcaagcaactgaagaaagagtatcctgacaggatactcattggctcaataatggaggagtacaacaaagctgcatggcatgagcttattgaacgcgttgaagagagcggagtggtaaccttcccttatgtgcattttggtgcattcttggtcgaacttatcatgttggaatgttaatgatctgtttctatcaggatgctcttgagattaatttctcatgcccacatggcatgccagagcgaaaaatgggtgctgccgtgggacaagactgtgacttgttagaggaggtctgcggttggataaatgagaaggctacagtgcctgtttgggcaaagatgactcctaacattacagatattacaaaggttagtcaaacatatacatcttcgcagcacttaatgagatcctaaattagtttttatcccacccggttttcacattgttttggacatcgtgttcgcgaattattatttagcgttcgtgtaacatgttttggacatctcttgaagccctagcatcaccatctatggaattaccactacattagaataccaagatttaggtgctttttaagatctaccaagaattagttttttttatgggtcaatgttttcattccttacttgcattgtgcagcctgcaagaatttctcttaagtcaggatgtgaaggagtttctgctattaacacaatcatgagtgtgatgggaattaacctcaaaactttgcgaccagaaccttgtgtggaggggttagattcaattccctgagttctttttttccctatggaacatattcctttactgttaccattttttttcttataaaaaccacttgattccacagttattccacgcctggaggctattctgcgagagccgtgcaccctatagcacttgcgaaagtcatgcagatagcaaggatgatgaaagaagaatttgctgatggacagtcactctctgctattggaggcgtggagactggcaatgatgctgctgagtttattctacttggcgcagatacagtacaggtaagctctaacatggtactaatgttagtattatgcatgtttatattctacttgatgctgctgttattacacatgtttccaatctggcaacctatgtggctccctttactatggattttgaagatcataatgtgtgctgctcgtgtacagttgatgttgaattatattctagattttttcaggcatcatttttgcaattaattgattagctccatgcttatcttgaacagcataataataagacttgactaatggccattcattgtaggtatgtacgggcgtaatgatgcatggttatggccttgtaaagaagctttgtgcagagctgcaggattttatgagacaacacaacttttcctcaatagaagatttccgggggtatgttatcaccacttcccttcttctgactcttgttgatttgttgttggaaatcatctggagaaatcaccttagtttagagtactgtactatgatatgttgcctacgaatgaacttaggaagaaatggaaaatcaccaacatgagtgttcatgaaacttttcttgtaaaagaacatgctcaggggggttacacatcttttcttgcagttttattttccacatttctaagtagaagcaaggacgggacactctattgttaaaaacagacttgaggtaatgattgaaggcagacttataggttgttagcggtagtcattatgggcttgaaccttcattatgacatgtttaggcaagccttccaatggctctgccttgcacgcctgaccctactatgtgtgaatggtgtagattaaagtcttgtgtaccttatgattaattctgggtcactttggccttgttttactcattctcaaggaagcctttcagagct

SEQ ID NO: 63730 - DNA, 22437 bp, Oryza sativa
  unsure (1)..(22437): unsure at all n locations
tttcaaattgtcgaaaagcataatgttgttttattgaactaaaatatggtttatttttttcctttgttaacaaattatcactaatccaagctcttcacatcatctcagggcctctctcccgtatttcaccacacacaccgatttggtacatcggcaaagggaggcgatcaaccagaggaaggctattaggaagggcctggaatcagacaaggactggaccggtgatggattcgtcaaggagacagaaagcatggtgtccaactgattcgactctgaactcacacccccttccaccatacttccaacttgtgattaaacagggaccatgttcagcccaaaacagcagaaacttttgcatcatctcgttcaaataaaaagcataccaaattacttccatcatgttgtcctgtgcttgtccattgcaatcctaatctgtgcatttttgagtcataaacttcgggtcctgaatctggaccaggtcagtagttcagaagtcgttttctacacttgatgatttgtagcaaacatgccgtgctcataaactgttccatgtgaacataaagtcagggtcactgagctttgggatatctggacttgaccttgtaaagcctcaagacttcaagtctctgctggaccgtgtgcctgagtaaagtgtgagcaaacgatggcatcagcatctggtcagattgagccgtacatgtctctaatccttcacacctgccgttttgtacctgagattcatgctacaattatctgtggcgcacactgtcagaaatttcagcatcgatcaatcagaaatccgctgatgaagaaggactttttcttattacttcttctatcctaaaatagaaatttcagcatcgatcaatcagaaatccgctgatggaggactttttcttattacttcttctgtcctaaaatataaagtttctaaataaatatatcaaaatataagcatttttaactactactatgaatctaaacataaacatgtttatataagtatgtctaggtaaataaaccagaagttatattttaaaacaaagtgagtattacaagaaaaacattttagtatgtctgacgggggaagttggaagtttagaccatggtattcatgggagaacatgaactcaatttttctccgtttacataaaactgcattgaagtggtaagtagtagcataattcggatacgttaaattgtaatcgcatggtttcaatttcacaaattttaatggtatttttcaaaacggacaaatttatagtgacatggatccaattaatatatatatatatatatatatatatatatatatatatatatatatatatatatatatatatatatatatatatatatatatataggacactcatatggggcaccatggtgcccgggcaacatggtatctaatgcacaaaattactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatggtaatgcctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatatatatatatatatatatatatatatatatatatataaggcttgtcttctgcctagtactgttaaggtatgaattagtcgatctaggttcgagtttcgcccctttctcaataaattttgatacgagagccccctaacgtacacaccgaagataaaaggatcttgtaccttataaattcctattaaaatcgcacacctataatcttgactacgacaagatggtctatcattttcgcacatgacacatgtatactaatgagttcacattaagtcgagataattttggggtgccaaaaacaatggatgaaactattcaaattacctccgagggatccaaaataaggtaacttttttcccctggaagagcccagagtaaaaaaatacaagaaaaactacgagtcaaccactgaaacgttggttgccaccaccattccactaagtccgttcccatgcccatttctccctgcatattatacatacaatcaactacccgctgatctgatgaagtcgccattcaaacatcaagaagcagccttgttatctcaactaaaaaaatacagattcattcttgcttgatttcatgattgatagctacatatcttagtttcacaccaggaaaccaaaaaaaaaaaaagatccttgacatccttattatatatagcctctgcctaaaaccatcatgctccttcagtttcctggacatgaagctgcaatggcagcatgtctggtcgtagtcaactagccagccaccaaagagagagctatcatccatggccgccgtggcggcggccgagaaggcggtgaggtgcctcggccgcggcttcgacatggccggcgacctgaggctcaagtactgcaagggcggcggcgccggctgcctggtcgagaggcgcggcgagacgacgccgctcaccgtgccgggagtcggggtgatcgccgacgtgccggccgacgtgaggtgcgacaagggcgaccgcgtccggttcaagtccgacgtgctcgagttcaacaaggttagcaccttaccttgtattgagatcatctactttcaaagttatcatacctttgtcactgtcatgggttcatggtttatcaagcccacatatcattgaaaaagtcacgtgatttcaagggtagaggattttcatccagtgccgctatgccaccattaattcaccctacatgatgataatatatatgggtatggctatgaatatatatatcatacgttggttttattctatatttgcttagttttttaaagatagttcaaagttttagatatttttgagtttttaaatatgagatagaaaatgggcaaagctgaagataacttgctcgaagctgctctatttaggtttttgaacaaaaggttgcattaattgaggaagatattcgggttattcataatttcagttgtcagtattcaccaaactgcagaagcaccgtattaacagaaaattactgttccaagaaaaaagaaaattactgtggttggttattggatgctaacagagttttcgcttattaatatttttagatattgacacgacatttgcggttctacgtgtttctcacgaactgtacttatcatcaaccatatcggcactgccaacatttttgcgacagaaaataaacacttgtcctaattttggtgtcccatcagtgtcaaatattcagtatctcaataaaagccgataaaatcaactttacaggaaaaaaatcctctttttttttctgaaagaagactttacagaaaatctgaaaaaagtgattatgtttgcttggttcgttggtattaagttgcatgcacctaaaagcctaagctgatagggaaaggcggacaattcactttatacactccaacactccccctcaagtctcaagcgtggaatattggagtgggctgtaattattttatttaattgcgcgccagccaggattcgaactcaagacctcttactctaataccatattaagctgcatgcaccagccagttacatctaaaaacctaagctaatagggaaaggcagataattcactttatacactccaacagttaggagtagtggtcctgctctaagttcaagtcaaatttgcctcattatctagttttttttaaaaacaagagagtcaaatttgcctgtaaaatagctacacttgtacttgtaaaaaacaggacagtggcacaccttgaactgcgacagggcctttgtttgactttcaccaaaagagatccgtcaaatgtacatcactgaacagaatcttgccaaaatttcagccttcctgaatgtgatcagttcaacaataatcaaaatcaaatagcattgtttctttttaaaaaagtttaaccaaatttgacgcattcacgcatgcacgcagatgtcggagctgttcaaccagaggagttcggtggaagggaagatcccgtcggggcagttcaacgcgtcattcgacctggacagcgggtcgtgggcccacgacgcgccgcacaccaggtgcctcgctatggacgggtacttcatctccctctttgacctccgtctcgaccaccgccacctcgccctcgatgcaggtgtcctcgccgacgtgccacccgcctgggacccctctgccatcgcaaggttagtggctagcttgtgagtactcctttctttaaaaaaaagtctaattctagctattagtttgaacacgcatgatttatagttagaattaagctttttatgtgacgaatggtgtagctagcttgttgcacgtacacaaataattgcattgcaactttacaagcgcatgcatgcatctgaaagctacctgcaaattgctcccttttctgaattctgagtggtcttgactgtcccttttctgaattctgagtggccttgactgacccaagagtggtcgattggccctgctgcgatttgagtgctgcaaatgcgcgctcgtgttaggatcatgatcttgataggcaacaacaacgcaacactcgctagaaatgtcaggtcccaaccagagacaagtagacaaaaacaatgggcagctgaaaaatcaaagcgtcgcatgcatgcaccagctttattcagttcaacccaaaagtttaagctgatcagtaaggatggacaattcacaagggtggctgttcgaagccacacatctgaccatttcatatcgaaaggtacaaatatagagtatgccatttggcatggctgcgacatgtggatggagattgaaaattctggattcctgtgggagttgggacaacaacgacggggactttctgtcgcacgatccagaaggatttaaattaacctgcaaattgcagccatgaagatgtacggaaaatcacttgcagatttgagagttgcagttgctggacttggactaattccaggtctggggatctcaagtcggtggctgaagaaagcagctcgattagatgtccaagtttgctgcaaaaaaaactgggtactgactgaatctatgacaagacaatgcgttacccagagaaacgaataattcagtcatgtccaaatcagggtgcttcatttcagatgattaaatatgatccaataatgcattgacatatacttctacacacatacatattctatctttttttcgtattatatatttgtccgtcttcgttgaaccgattacagatggtatgaactctgcacatgccgtcatttgactagcgtacacatgatttgtattactaggcagagccgtagctttcagagagagttctgaactgacgatgctgccgacaccatgtcacaatgtagtcgatcatgtagcaatcaatcgttagaacgctaatgacttgttcacgcaacacatccaagattaacctgatcctgattgattgatgcataattgcgtatgcagattcatcgagaagtatgggacgcatgtgatcgtggggctgagcatgggcggccaggacgtcgtctacgtgaagcaggataagtcgtcttctctgtcgccgtcggagatcaaggagcatcttgacaggctcggcgatcagctcttcaccgggacatgcgccatgccacctctgcactgcaggtccaaggacaagttcaaggttaaacatgtcaagtattgttaatgtacagtaattactctagaaattcagttgtcattctcatcagaagttgaaggtttttgtgctgaaattcagtgtctgtgtggtgaattgtgatagataccggaggccttcaacgtgttcgatgcacaagtagctcagcagaggcttcacgggatcaccactcttgtatcaagcaaggaggtaattaactgaatcactgtactctattttctagaacaaaaatggctaagggttctggcattctcaactcttgaatctttcgatcaattatgagataaactttgcattgcttgtgacataaatttctactatatctgtttctttttcttcgttggtttggacaacgagtcaatggcacagtcttcaatacatatatctcatctttacttttttttttccaacaccgtggctgtgtttagtgtatagttccctttaaatttctaaaaattccgtcacatcaaatgtttagacacatgcatggagtattaaatatgaacgaaaaaaatcaattacacagtttgcatgtaaattacgagacgaatcttttaagcctaattacgccatgatttgataatgtggtgctacagtaaacatttgctaatgaagaattaattaggcttaataaatttgttttgcagtttacatgcgaatctgtaatttattttggtattagtctacgtttaatacttcaaatgtgtgtccgtatactttaaaaaaaattggacagggaactaaacacggcctgtatttatgaaacttataaaaaaattgaccatatgaaatgtttttcatgaaaatatcttttaatatcaattttcacatattaaatcctactccctctagtttttttaccgataataccgttgacttttaaacatacgtttgaccaatagtcttattgaaaaataagtaattatatttattttactgtgacttaaatctattattaaagttactctaagtatgactttcattttggcatatttgtacaatattttcaagacaaatgattaaatatatattcaaaagtcagtatcgttatttattaaaacccaacgggaataatacttttttatttttaatgatcgaagatgtcacgacttgactgcgtgtatttgaggataatattttctttttgataacggaggtttgaccatatcttatattatggaatagagggaggactagctaattatatgagtttgctcatcgtgtgcagggtgtgacggtgatatactccaagaggggagggaacacgacggtgagcagccactcggagtggctcctgaccgtgccggcgatgcccgacgtgatcaacgtcaagctcgtccccatcacctccctcatcaggggcgtgcctggcactggcttcctctctcacgccatcaacctctacctcagatgtaacaacagaacagagcttaatgatttttcttttttagacgagtttatttactgttgattagtttaaaataacaaattaagcatgtgattggattgttacagataagcctcctgtcgctgacctgaggtacttcctggatttccagcatcactgcgtgtgggccccggtgctcggcgagctgcctctgggcccttgctcacaccggcaaggctccagcccggcgctgcatttcagcctgctgggctccaagctctatgtcagctcaactgaggtcagactctgaaacagcctctcactctgtcactgaaccagataaattccattctgtggttcactttccatggcgtgtgtgatccttcaaaataaaaaaattgcaggtggttgttccgaagctgccggttactggcatgaggctgcatctagagggcaagaaaaacaaccggtaagatttcacaggtttatttaaatataattaaatacacatgaaaacttgaaaataggtttttcttttttatagatgcacacccacgcactgagacacacatactactacacatgcacacctcacaaaatgtggctccccacgcgctcaatgaaattagtttgggggagcttatgtcagctctgcagctgcaagaaactcctcgaaacaaactagatgatcttcattcagataccaagaagttttagttgtagaatccagaaaataaactaaaagctagaagctagatttcccagattctttagattctcactagctaacttttcaccagctgcttctcagaattttaagtttccaaaatagaacataaaaccagcgacaactcagttatcagtccatcatgacataggcacctctgcattatctacaaacattttattattgtccaaggcatcaaacatcttccaggaaaaaacattttattatttgtcacccttatctcaatgacacgtgggtccatatgtgtcataacatttgggcccactaataaatggttaattgccacatttaatagtggcgaatagttaaatttctaaaaaaaaacaaagactacgatgaaaaagaaaaccttaaaactaacttttaagtaagttttaaactttgattggggccgatcagaaagagcatagaatgaaattgcatgttaacaagtttaggtatgcacagtacatatgttttgcgtcggatggtgtgtgactaaagtggatttcattgtgtcgtgcgtcaggctgggcatccacctgcagcacctgtcgacgacgccgacgttcgtcgccgccgccagggccgacaagccgccggtgtggcgtggcacggaggcggtcaccgacgaccggtactacgagccggtgcagtggcggatgctggcgcgcgtctgcaccgcgccggtgaagtacgacccgcggtggtgcgccggcgaccgccgccgccgccccgccgcctgcgtcgtcgccggcgcgcagctccacgtcgtggcgcacgacgccgccaacaacgtgctccacctcaggctgctctactcccagctccccggctacgccgtcgtgcagtccaagtgggcgcgcggcgcggcgcggccgccgtcggggaggtcgtcgagtttcctgtccatacccttctcggggtcgccgtcgacatccagtggcgccgccgagaagggaggccggccggagcagggcgcctcgccggtgggcgtcgccaacgtcaactccggcgtgttcgccggcgggccgccggtgcccgtcggcgcgcagaagctgctcaagttcgtggacacgtcgcaggtgaccatgggaccgcaggatagccccggttactggctcgtcaccggcgcaaggctggacgtcgacaaggggaagatcatgctgcatgtcaagttctcactgctagcccaagtttcttgacgacgagtcgacgagggtgtcaagatgttcatgaccatcccgtgatccagagtttgtacagttttcagctgccaaatgcagatatgctaacaactgaaaaaacagaatattccaaaaaaatttgatttttgattttttttttttggtttggaccctgaagatgttgcaacgatctgtaaatgaaaaaagatagtaggaaccagaggtatcattctaacactgcaagaaaaaaaggattcgttgatctcagatcacacattcatatatgggactcgcatacgattcacagcaacttgtcttacattactactactgcagttcgtcttacgcaaaaggcgggaacaataccaaatttcattacaataaaccgaaggcaccaagtgaacgactgaatccaaaggtttgtggaaacacatatatacatcacaagctagatagcagttcgcccgcattcagtaagcattcaagcaccagaatagacatgttcaatgcaaaagttcagatatatgtataagagcaaacatgctggccacactcaaattctcaagttgtggagagagaacaactcgggctgcatcttcctgacgaacttcctcctttgcttaatgcgcaaaagcttctcatagatacaccatggaaagctgataaagtgtggtcgctcatatccttcattgtagcaaccccagaattcagggtggtaagtgacatggtaccaggcggatgccttggcttcggaggcatcatggccatgcccattatcatctaagctcatctcactgaaccttgaccttgcttccttacgcaaagatctcaccgccaatctgatagcatcagcatcgcttttctttgtgaaattctttgccatcttaagaatgcatccacttattatctcggcctcactttttattccatagtgatccataagattacccaatttgaagtcgtactcgtccttcaatgccatagcttcagtgatgtaatcttcatagccatcaacaatcatatcggtgtcataagaccgccttgccacctcccttgtgaagtgctttatgtgaggggtgtgcttctttatttccctgtagagcttcccgattactccttttgattcataggtgactttgtcaagcttctccatgaaatcaggatactccttcacatgtagttcaggaggaatcagggctggcactccagttttgggaaagtcaacagcaatggagaagagcttggccagctcaatgcatggtgaactctctgccttgaggtcttccttatccgcaaatactacatgtgcattggcaatcattcctaaactctcattgactatgtaatttgtgaagtactcttctacttcctgcatggtgcaataatgaagttacagggcagtgtataagatttgctaaaactcagttctaacaaagataaatttatgacatttattttcttaattatgtgatttccgtgctgttttattgcaagaaaaacaagtgactgctatgtagacaaattcagaaacatgaagctggtaataattttattccaacaggcaacataatagtattatcaatttgaacagcaactgtccaaccaaatgcagactacccctagacttgaatcagactgcatggtttccaaatacatttttttttcaaaaaaaaaaagaacacagaatttgctactcttataagtgagcacagtacgtgtttacacaagataaccagggaaacaaaaaaaacaactagcttaagacaaattctctcagttgacagtagtatcctcattatgaggcaccaattacaaacgtatctctagaagttaaatattctaacaagaaagaggcagcatatcttccttctaatattcaagatttattacagaaaatagggaaatagatgtgtaatattattaaatgaaggattttgaataaaaaccatatatgctgtgcactaggattagtttgtttcctcctgcaaataaatatacccaaatcttgcagtgccagaaaataggagtaaatgataatcttaaaaaatacaagagctggactcgtgagtccaaagaacagcataacactagccagccaacaattgaataaaattgctagcatgagtggcaagaaagagtggacaattctggttgaaaactgagcttacctcaattgtaacatcatggtctaatgtttctgttggtgctggagtatagtccataggtgtcaccatacgaggcggaatgagagatgggtcccaagaaacaaaatatatgtccccgtcaagatcactccctgaacactcattaggatgcggcctgcacaaacaatcatgttcaaaataattactgcctcatgttttaaatatggcaccattgactttttatttcatttgactatttgtcttctctataaatatttgtacaacagacaaatatgacaaatctagtggtactctttgcactttacttaacaaagtcaatggtggcatatatttaaaaccaaatgtagataacaaaatcgaacagacaagaacatgcatgcatgggaatttaacaagaaaaaaaaaggatcaaatatcgcatatccatgaaatcgcaggtggctaagcttcacaaacaacgaagttcttcaacctaaaatatatgaaattggagaataagcttttctccaatgaatatgtggtttcattaaaatgtgaaacccagacagaatttgtttccagaaaagtggggttttgcagtaaaaagcatactactagaaaacataggagtatgtaatacttgccttggtccttgctgtggaaagacgacacagttaaacatgtggtgcaaaacaggaacatcaacagcatggagaatccgtatatcacctgggtggaggcaagggtttttggcaatcacaacttttcctgtcacggtgaacctgtcattgtcatttacacccgaagtagctcgaatgaacacttgcccatacttcagcgtacgtgtttcatccaagcatcccatcattgctcgtccttttgggattaatatccttgacttggttttcagctctagtaatttggatgccctaaaagtttgtagcagcatagaaagatatggttcatcatcaggctggtagccacacaacaacagctctttaactgcatttgttatttctcccatgggcataagttcaattgcttcgatagcagcttgaggatcagtaaccattttgttcaactgattcactgcttcttcttgcttctgttcaaagacactatctctaactccaagtgtcgaaagaagagtaattagctgccgattaaggaagcctggctggtacttgctgtatgcaaggacatctactgtgatattgtctgactgaaactttagcatgctttttcttaaggaaagcttccagcgtgatgtagggtcaacagcaacaacacctttataaccaccataccttatttgaaaagcagaaggagcaaagcgtttcaggttgcacttcatggccacttcattagcaaaagcagatgatatctttccaatcccatcagagaacacatgctgtgtaccattttttatatctgagatttcttccacctcatacttctgaacctttaatgtttcggttgaggaactaaaagactgaccaagtcttgcagcatattttgctacatttctgatgttacggaaatcccccatccatgtcctaatgtcgctagcagctaatccctggcgagaagcaaacatccatgcagagttatctcggagctggcttgaagaaaaagcaagaaactcaaagttcttgccaccaatagtgatgccatctgaaaggactgacagaactctcttatacagagcagttctgtttgcatcatgtcctgaagcagaacggggggataaatcagttgcacggagcttctcgcagtcctcgtcaacaaatgaaatgcgaaggaaattctctatgtcagaagaaaaattccgcaccacacgattggagacattaatctcaggtccataaaaatacactgtagacataaaccaatccatcatccagagatatgttaggtgatggttggacgtagcgtgatctccggaattttgagtattgttcagatagccaacttgttggattcaagcaggtctttttcaaatatgacatcatttcaagtgcacgctttatatggtcaataggtacaaaagctgggctgaccagacgaaagaagctgtcatcaactgtcggtccgctaagtgtcccattctgaaccaaatggttgatcttgaagagtatctcataggggacataaccacgagatttcacaatcggaacaaagcgagtatcacttgaatatggataccccccactccggcactcgaagtcatgattgtactcatgatagtaaaagaagtagtcacgaatgtttgggagatcacatcgacgtggtacctcaagacataaaatatatgattgcccaatgctagaagatgaagtaaaatccgttgtcctggtccattgatcatctgtatgatccctaaaatagttgaataatggatcttcgtacataacaccagaacggcgtggtgtctgttcataaatcttaggtgcagcttgaacctgaaacatgaaacgatttataaatttaaggttatctaaactttaaatcaagagataacaactagaattggtgactggggtggatcaacattttgaagtggaaatataaaggaaaatactggataaaagaattcagtgcttcagcatgatcatatttttttttacataagaacacgatcatattttcactccagataagtaatactcaagtagcatatctttatacaacttcattgccgcatattttgaaatgaaagggacaggcgagttagagagcactcataaattcattagcatgaagaattaaagaaacacaaagattagaaatgcaatttcattatccagtaatttatgattgaacagtataatgtcgttcaaccatgctaaagtgcaggttgtgagccacagcaaagcaggtaggggaacaagaatactaacagaagaaattcaaatgattcttttaaaccatcacagtaagctcctaaacacattaacattgtccatttgtatatcaaataaggaccatatgatacatacattctaacagaactcccatgtaactttcaccttccgaaaacagcaaaatcaccattgaccaaaattccaaaagtcatcaccatgaactgttgtgactaaaccgttcttcgtcaagccttaatagcagaacaaaacacagtacaggcgaaccactttaatatttactaaagaaactatctcaacagcaagattagtcaatgtgaacatgtggtcatacaataattgtacaatttactgaaaagaaatcagcaagtgctgtagagctcaagatacctggatcaaaagaaacttcgtttgtgacttgggtgggcgttgaagctggatctcccatatgctctcatgggaaagttcaagtttatattcgattgagctgttgggtagctgcaggtaaaagtaaatctttttcagattgaaaccaaactcaacagaaactccttttcgactccacagagcagataaaattgtttccttaagcaggcaaccaaaatgcagtgttacatcctctagcttgaacattgaaactcttggtcttggaacaatgtcacgatctgaaggatggactttcagataataatgcccacggcggagtatctttctttgagccgcattttttacaagtgaagcatgttcctcggtctgaaactgaactatagcatatgctcttgaggtagcagtgacgttctttggatgcctgagctttactgcatacacattcccacagccaacaattcgctccaacaaatccttgacgtaatcagcactgtcatctagagcaaaccctgatacctgtaaagtcttgacacccatggcgcatatcacaactgcaggaactcatcaatataaacaattattgttaagaattacgcacagctctttagatttacggcagaatggtaagtatcgtctacagaaagaacttaaaagctaaattttatcctgtttctatcataatcttaaagtagtgaagtaaacaaggtactgtaatgtatcaaagaatacaagcaaaacaatgatcatgcgaaccatctccatgcttcctttgtaaactattccctgatactaactattgcacatgccagattcctttttgtaaatcaggtatccccaagggcggagctgcagtaatatcgtcagggtcaggtgaccccgatggtattcaatcgatcaagtgaatcgtgcaggattttgcagctaatgaccccagcagcaaaagcttcatgaccccgatcaggtcgctaaactactggagctcatgaaagctgaaatagtacagcttcttctttggaagcacaatttgttagctaggttatgctactgtcaacccactactaatgcggcaattagacctatttcatccattaaccaactctttgttttagctatgtgttgtgtatatcaatgcattaggcctgtagttttgctaatcaactactagatgttagctgtgttttttaagctactaactccgtctcaaaatatgttacatttaatgttcaaaattatcttaaaatacaactaattttctatgtaccgttccatctcaaccaatcacaattttcccaattcaattttttcacctactttcttttttcaaccaatcataactatttcacaccctaacattaatcttttaaaaaagagagtaggtagttgtattttgagatagaggaagtaataaacaactttcagaacaaacttttatgtctgaaaaaacgcatggttgttatgcctggttttatagtcttaacttttaaatttttggaccttaaaaaacctcctgcattcttataaaataattataaaatatagagtttaaacatttatttttaacaaaatgaaacgatcccaacttcctcattgctctagctccaaaataattttgatctaaagatatctagcttcgagaacaattagagttttaaacacgacattagtacaagtaaaagccatgacccagtggctcaaaatcctggctccgccctgggtatccctatcatctatccatttctatactctggactatacatatttaccacatgttcttgattccccaaaattagagcattcctttttcccccctttcaaaagccaaattatcatgcaatgcagtgacagaagcatggagaaaaaaactaaaaggatcgatcaaattagacgagcacaatttccacaaaaacacatcatgaacgtacattaccagacttcctcatctttctccaccacctgcccttctccacgcttgccaattccactcccccaaccaccaaaaagtgtaaaagagcatgacaacaaccgaatcgatctcaaattcacatcctccactaaaacctccctcaaaacccttcatattccccccaccaacgaacaccaccgaaaaacccaagagtataaaaaaaaacccgacacatcaacactaaatcgcccgcacataatacgcatccgatcgaacacacaggttcgccgagcaccgacgccaaactggggaaagcacagcactctagagcgctagtacagctagtaaagcgaacgatcgcacgcaccgagcagtggcggagatggggctcggcggcgactgcgtgggcggcgagtcgacggcggctggatcgcggcttcccttcccttcccttcgctccgccgctgctgcgccgacgggtgctcggtggttttcgtcgccgactcccgcaatataagcgagcgcgacggtagtgagcagagggattcgaggacgaggagtcgcccggtcaatgtgcacgtagcatttaaaggaattaaagcgaagacggataaatgaaggggcgcaggaggccagggccggaggtgtcacgtaccgttgatgttgcttcgagattcgtgcaaagcatggaaaagaatggaacgtgaaggcctatatatatgtgtggcttttattatcatagcagcagtattgcacaagatctattgccacggataaggttacatttttatttcttctttaaaagatatactactatataagtggcttttactaggatccggttgccaaaaaaaaaatgaaatgcccctcttggtaaatgtttatcccaaaacaagcccaacacattactactagtacacatgatgatacggtagaattgatattgtgttgaccaattttagaaggggttgttttgtcattctgatcattttcaaaattccttttgaaagaaatcattttaaatttcaagtgtacatgtgtgcgtatataagttgtcccaatattgtgagtatagcatgtaagggtgtgcgtgctcgattatatgctcatccgagaatgaagatactttaactatagttagaaggaaatattgtcacataatttccaacggagcctcacatagtcacattggtctcatttgaaaatggcaaaaacaaaaacaacgtgaactgtaccggttcaactcgaatataggaaatgcacatggtttgaacttatgtttcataatatagaaagacttctagcatcatcggttacccatatttcttagtaaaccaaaacagtttattagaaaataaaatttaatttgtaggtaaaacttttatatatttatccttaacgacttaaaaaccaatataaaaaagaaactacgttgaaaatattttaaaacgaactttaaaattaaatttaaaaaatcaaattttagctttggttaattagggcacatcggccattctttgctcttggctttcttgcaaagctgaatcaatgcaatttgatcccattattttttataaaaaaaaagctacagttagaatggagccttaccgatgaagctaaatcgtgtacgactctgaagatgcatactccctccgtcaaaaaaaaaaaaaagacaaacattgatttccgtgcctaacgtttgaccgtccgtcttatttgaaaaaattatgaaaaaaattaaaaagacaagtcacgcataaaatattaatcatgttttatcatctaataacaataaaaatatgaattataaaaaaaattcataaaagacgaacagttaaaattggacacggaaattcatggtttgccttttttgggacggagggagtagtctggtctgtaaatatactgatgcaataggcaatggcaatgccccatactagtactccctccgtcccaaaatatagctatttctagcacagtgtcttgtcccaaaataaagttatttcttcacctacctcctcctctcaaccaatcacaaccattcttcttcacctactttctcttttcaaccaatcacacacttcctccaatcattctcacctactttcttaatacccatgccaacctcagaaatggcttcattttggaacggaggaagtagcaagataccacaggctgggaagaaaccgcaccatcttttgcatctcctttttttttcttgcggccccagttctacggttactgaacctccttttctagttttttcccccaaataatcagttgatgatcagcccaagaaccgaatgaacagtcgttgcccatgtttactcagtacattcagcgaatagaagatcgacagcgaaaaaaggaagtggataaaggcaaaagagaatatatatttttagaggaaaactaaatgagaactatagaccatatagataacaccctaggcccatgtaagcaaagtgacgcaaccgagtacatagccccatggccatagcatcgctttgcagattccttcctccactcgcggccacggagagaggaaaggaaagtctcactggctgggtcattgacttgactcacactcacagagtcacagggccacagcctcacggcgaagcaaccgcggcctattggcttcgtatactgttgcgaagtagtacgtccacaactccatcgggagaaaaggatgtgaaaccgtcgtggaaagcggatcctgcgagagaaagttgtcgggagaaaaggatgtgaaagttggccggcgagacagagaaatgcaacgcagaaagatgcttcctgctcccctgcctcagtcccacgcaggataaaaatatatacactaccacgaatgctgcatgtttacgaattttacataaacgagtagcgtcatattgcagtttgcaaagtagcaaaaggtaccagtgaggccaaaaagaaaagcatagacattttccaagacgtaaagaacacaacagcacaacacattcacccggagggaagtgaaaccgaatggggaagtagtagttccagacttgcagttccgtggcatatcatacagcccattccaaacaagatccaaaacatggaccgtcggcccagacaaccatactaccttgctcgttggcaagtggctagtagcctagtactagttagttcattgcaagcaagaaaccaccattctgattcagctcgaggttgaaacaaaatatcaagagttaattgtgctacatcagttaaacacgagaaatcaattacagcccaaccaagctcaaatagagcgggagagggtgaccctaatatattgcgataataatatattcacaaccctgacaagcaaaagcaaacacactatctaaattacagaagggaagaagacaaggtcctccagcctatacaaccacaacgtgcactgccttgacaaaatgggagcgtgccgcaaggttaaaccttaccgaaggattaccttcactacattacagcaaagccgatgtcagatgcaagcctactctttccccaatctaggtgtcgcagggtcatctgtgctatctcaatcacaaaattaatacgaacagaggaacaaatacaaagggaaatccgaaactatcgaagaaattcatgctgactggtgttagaggtatgttattgaaggttccgagtcaacccaccccgtggtgcatttctgctgcaaaagaagacagttcaagatgatttagccaggcattaattaataaatagaggctcaatatcaaacagatagtacaaattcaagaactactgatgccaaaaagagaataaaatcttaattatatggatgtgtcatgtatcatctaacgcctaaagtaactactattgctactcaggaatctgtaaactcaatccaagggaaaagtcaaaaggttgctgtaatgctgtgtctaagaaaagcaactcgcagccaatctaatgagatcaggcagagggaaatgaagtagggaaagtcagcagtcttataagtagttaagcacaactgtgataaaatatctcaagggcaaatgaagtatgaatctcgagaattgaaatggatgacaacatggcatatttaagtttacaaaactttccggtatcagaggtatatgcatttgaatatccctatagctgaaatatcagcttctcaaaatatagaaggcattcatagatataccttccatgaggcgcctgagaagtggttccaggtcctttgaaatttccaggccgcttagccttgttttcttgatccttgtcaagacgcatagcagcaacttccttctccatagcagctacctctcgcctcatctttttagcctccacttccatagccttggttaatgtatctaccttttttgccaacatctgtaaacaagaggcagttagcaaaggcatgacccacagcattggtcccattaaatccataataaacaggaattctagtgccatacctcaattgcatcatccttgtcttttagactttgatctttctcatggcatgcctttctcaatgaaatgacctccttttgcagcatgtcatagagtacaccagatactgtgtcagttgaactactatttgtggcctcgctacctttttcttctgtgttagccgccttccaatcatcagttgtctcacaatctctaacagcatccgtagatctattgagcaaatgaggtccattcccaaggacttttccacggtctaatgacctggtaccaccatcaaatgaccttgaagttccctttgcatgcttgagaccaagctgctgctagtagaaagagaggatcttgaattaaatgatggagatctccttgccaacatgccattcggggagatttttgacatattatctgcccacctagagacaaccgacgggatggtccattaccgatactctttccttctgtaggacgactagaaccactaggtggccccctcaatccatcttctagaacttttaggcgcagctggtacttttcctgagtagaaggattttgaaacagtgcacaattaagtaacttgcttccataaaagtttagcttaagatgaatgccagctttctcacctttagttgagcttcagatcgagctgttcgttctgcaatagcaagtttatcacgaagttgctgcatctcaccctgaagaaacatttgtcatgccataaaaattgaatatatgatgtgaagtgtgactttgcatggacaaccgtagatgagcttcaaaaaacaaacagaagtatatcatctttacctgcagaaacctgcgctcttcaagccactgtttgacaggcattactttgtcattagcatctttccactcatttgcaactacaacagcaactctgtttgctgtaacttttgcccgcgcaagctcacggtcaagaatttttctttcctcctaagtgtgccatggttagagattagcatgggtcaacttttttgcgtacagaacagtgaagattatccgaaagcaacagtaaaggatgttacattcatttcttgaactttccgctggtaatctctgacagcattagcagctgcaccaccagcaagaacagcctcttccagctctcttacagtttgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 63731 - DNA, 2050 bp, Oryza sativa
  unsure (1)..(2050): unsure at all n locations
attcgctccaaaggagatcaaacatagggcctcttatttaacgtagaagttccactagacttttgcaggaaccaattcaattttgcgaggaatcaagagcataacatctcattctgcgataggcaactggccaagttgaactatctattggccaagtagtgactgaaactgtagcgggatttacgctgggctagaagaattctgcaaatggaaagcccaaaccgacagaagcatagacccaagtgacgaagacctccgatgagaccccgatccaggcaacgttgactttgacttggaatggacagttcaaattttgatcaagaattcggttctgattttatccaaaccccctatcttgttccctgtgaatccaatccatcacccttttttttttttgtcatgtcgatccgttatgtatagttttctagcttagttgcacatcaatatcatcatgcactttaacttatctactcagcatagcatggtcttccccatcatcagaacaaatgctgctaaaatgctgtcctgccaaattccgtttccttcagccaatcagcaaaaagaaactcccaattccacagtgagttccatgaaggttataatgaattcacaaaattcaaccagacaattcatagtgccaagtaacaatgcaggcctactacaagtccaccactgatatgtcatccaaagaatcgatcaagtgtgttaccatcaatcaaaatcagcaaaatcagagctttacctcaagaccgagcaaaaaatcaagcgacgttttgaacagcgacaccgactaatggcaggaccggccatatctatggctctctctgctatgcattaccactacggcgacctgttagaacagtctttggttttcagaaaagtatgagatgtgaccaggtctctggtctctgctcgatcgatcgatcgatcggtagttccagtaaaatgtcactgtccgattacctcagtatcgttttgggtggtgttgaacgccatagaattatgctagtagctgctcgcggttggagtaagtgaagtgtccggcccttttttctaacctcacctgcttgtcctctgtgtgtgcagtgtgttgttctaattgcttctgagtttgcaatagaattttataagtcatgtcgctaggatggcgacggtagatcgatcgatgccgtgccgtgacgattcagccgtcaagatatatcggttttatgcattgtccttgttctttactactattgtgtagtaattgatcaaagaacgagaccagtcagtgctgaatggtgcgcaaatgtcacttgtatgactaggattctgcttagtctagtctagattggtacagttatcctagaataaaatgcgtgcgtgtgtcctcttaggttgaactggtaagctgcagaatgtgaaaaaaagaactgaaaattagcttgtgaaaacattgttggtcagtcgtaattagcttgtgaaaattagtaactttgacggtgaaaattaggcggttcaggtgaaagtgacgcgagcctggaatgtacttactagctagtgtggcaccacctatcagctcatgaatcacgaagacatgatgcaagtgaacaagaatgaccttcttttcggcgtctcctgatcgagtcctgaactttttgtttcttcagtgcatctcttgcagaacattgattattagattggcatgatgagttcgtgtttcttgcctaataaaagggttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63732 - DNA, 989 bp, Oryza sativa
tcaatctccatccacatgtcgcagccatgccaaatggcatactctatatttgtacctttcgatatgaaatggtcagatgtgtggcttcgaacagccacccttgtgaattgtccatccttactgatcagcttaaacttttgggttgaactgaataaagctggtgcatgcatgcgacgctttgatttttcagctgcccattgtttttgtctacttgtctctggttgggacctgacatttctagcgagtgttgcgttgttgttgcctatcaagatcatgatcctaacacgagcgcgcatttgcagcactcaaatcgcagcagggccaatcgaccactcttgggtcagtcaaggccactcagaattcagaaaagggacagtcaagaccactcagaattcagaaaagggagcaatttgcaggtagctttcagatgcatgcatgcgcttgtaaagttgcaatgcaattatttgtgtacgtgcaacaagctagctacaccattcgtcacataaaaagcttaattctaactataaatcatgcgtgttcaaactaatagctagaattagacttttttttaaagaaaggagtactcacaagctagccactaaccttgcgatggcagaggggtcccaggcgggtggcacgtcggcgaggacacctgcatcgagggcgaggtggcggtggtcgagacggaggtcaaagagggagatgaagtacccgtccatagcgaggcacctggtgtgcggcgcgtcgtgggcccacgacccgctgtccaggtcgaatgacgcgttgaactgccccgacgggatcttcccttccaccgaactcctctggttgaacagctccgacatctgcgtgcatgcgtgaatgcgtcaaatttggttaaacttttttaaaaagaaacaatgctatttgattttattattgttgaactgatcacattcaggaaggctgaaattttggcaagattctgttcagtgatggggcgcaggaat

SEQ ID NO: 63733 - DNA, 1066 bp, Oryza sativa
taatagcggagccaacacggagttcccacgaagcaggggaggctatataatatgcatgcagatcgaccacactcgacacctcgtcttgtgcagagagctcgcaggtagctattagctaacgagttagctctgaactcgcctttggcttaactaagcagtgagctgcaaggaagtagatacttgtgcaagctctgagcgagagaaacaccagtgtgcaatcgtagaacttgtgttagacacacacacagagagaggaagagctcatataatggccttggtgaagaggtttgttttgccactaatgatggcggtgcttctggtgttggtcgtgtcaggatcggcgcggcagttgggcggcgacaaacgggttggagtggccacctccggcgatcatctgtcatacagttcctcaaacatctgtacctgcagcagctagcaggtccaggtcactcgtgccaaaccaatgacccaaataacccatcatgtactgcctcggccaaccaccactaaaaaacagggtagacgccaaattaaatatcccaccatgtatatatattgccatcacttgcatgctaacaccaaattctaaagtttggttgtgatatttctctataggagacaatgtagtgtatatatataagatctttcaagaaaagacaatgtactgtatatgatctttgaaaaaaaatgcaatttagtctttttggattgctctgtttcttgttagattgtgataaactgcaagtatatgaattaataaaatggcagttttttgtttgtaacttctgttcttcgtactaccttgcccaagtgttaatgtaaatgttgtccaattaattcgatgaatccatccagtgttatgtgagatatataatggatttgatatatatgggtgaaactggaagctagtctgaatatatatcccacgcagtagaccagtagagatataacagaaatgctatctgagtatctgacgggatcccgtcccaatcgtgatagacatgatagggcagccaccaactaatccaccgattctatctccttctaccttatgggctgcaggaat

SEQ ID NO: 63734 - DNA, 1138 bp, Oryza sativa
tgcaattgaacaagaagtaaactatattgcattcatctctacccttctaggaagtacacggcgagaaataccataaaccagactatagagtttgccaatttggtgcctaacatgttagtgggggtgggaagggcaacctggtggcggtggaatatttgggtcattgctcgtgcacgagggccttgatggtagctgctgcaggtacagctgtttgaggaactgtatgagaggatgatcgccggaggtggccgctccaacccatttgtcgccgcccagcggccgcgccgatcccgacacgaccaacagcataagcaccgccatcatcagcggcaaaacaaacctcttcatcatggccatactatgagctcgatcggacttgcgcgcgcgctggtgtttctctcgctcagagcttctctcctctcctgtacgtgcagtgtgtctgctctcttgcagctcactgtcccgggcaagtcacgactcacaactcacaagcgcgagttcagtgtctgatctgtgcgagctctgtgcatgcacaagatgatgtcttttttttttaaactaactgcacaagacgatgtcgagttggtcgatttgcatgcatatatatagcccccctgcttcgtgggaactccgtgttggctccgctattacgtgcgtgactcgtcggtgagctaaactgaaaaaaactcggcacgggctgaactccgattctacggtcttcagaagggaaaattcacgcggccttcgcgtgcatgggccgtgtacagatacacccacacacatcgatcacggccactagcaaaactgtagtgaaatctgcatgggcacaagagaagcttacctttatttgcctatgtaaaaattccatgctcatgctcagctcgagttacgtgcgtgactcgacagaagacgctgtgccgtgcgcttctccctactacatacgccgatacgcgggttccaattccacggtcatcgcttcggaaggaaaaaattgcagggtgcggagctaaagaaaacgaccggtttgtcgcgcgccgaggtgaccaacgcgcgcgccggtgccctgtgccgcgggtcgtaaatcgtaatgcgcatgtcaacctgttacgtaggtgacactgggacccggggcctggtg

SEQ ID NO: 63735 - DNA, 1322 bp, Oryza sativa
  unsure (1)..(1322): unsure at all n locations
tcgatcgataggttcagatagcgcagtgtacttgggcaaagtgggacagaaagaaggaaaagaagtcagatcctggatgttggcacgagggagcttttcggtttcatttgacttgcagctctgctccgtgaaatatgcagtttctggtcaggcattgcggtctacgactttacggcagcatctcatggtcttaaactttgcattttctttttttctttagtacaaatcaaaacgttcatagcgtcggtcagatgtgctatatagttgccaacacgaggaagccgcatagtatttaccgaggactgaattaatcttttttcgccgggccagtagcgaagaattgcctctgcggattttattatctatgactgaattttaccctcggttgtaagttcaagccaaggaactagcaaaactcaagagaatttctgttcgatcccatcattagaagtgaaaaatatcgaaaggatcgaacagaaattcttcattagaagtaggcaaggtgtatgcaaacaaaacggtattaatcaatgtctttttctatttgatataagcttttctatacacagctgcagggttatccactgaaatttctacaccacaagatcgtttcaacaagaaaatttcaatccctatcgaaacaacaacacgttataatctacttagccggaaaaaaaatcaccggggaaaaataatatctctagtttacaagcgaaataaatctacaaattgaactgttgtatatattagcaaaaagaaaaaaagaattgctgtatatatgtctgtgttacaaattagctactagctagcttccaagccatcttcaccatcgatcaccatcagcatccgcagttagnnncgtttggggctgtaggtcttgcaggagtgacctggaccagcaagcttgtgcagatacagctgccggagaaacctgacgacgacggagtcgtcgccggcggtgtcttctccggtccattcctgtcccaccaatggccgcgccgccgcggtgccagacacgaccaagaacaccatcaccatcacgatcagtgacagaacaagcttcctgatcaacacggccatgatcttttacttccctttcgccgctcttctccctgatctccttctgtcttttctactcactttcactaagaaaaaagctaagaaactttactgaactttacaatgttcttctcaaaattctgatatgttcatcactgaattggagcaagcctatatatagatattagagtggcaggcggcggttgcttgctcggtacggtggccacttgaatcggcgttagtaattggagggctgcaggaat

SEQ ID NO: 63736 - DNA, 1533 bp, Oryza sativa
tatttattaaaacccaacgggaataatacttttttatttttaatgatcgaagatgtcacgacttgactgcgtgtatttgaggataatattttctttttgataacggaggtttgaccatatcttatattatggaatagagggaggactagctaattatatgagtttgctcatcgtgtgcagggtgtgacggtgatatactccaagaggggagggaacacgacggtgagcagccactcggagtggctcctgaccgtgccggcgatgcccgacgtgatcaacgtcaagctcgtccccatcacctccctcatcaggggcgtgcctggcactggcttcctctctcacgccatcaacctctacctcagatgtaacaacagaacagagcttaatgatttttcttttttagacgagtttatttactgttgattagtttaaaataacaaattaagcatgtgattggattgttacagataagcctcctgtcgctgacctgaggtacttcctggatttccagcatcactgcgtgtgggccccggtgctcggcgagctgcctctgggcccttgctcacaccggcaaggctccagcccggcgctgcatttcagcctgctgggctccaagctctatgtcagctcaactgaggtcagactctgaaacagcctctcactctgtcactgaaccagataaattccattctgtggttcactttccatggcgtgtgtgatccttcaaaataaaaaaattgcaggtggttgttccgaagctgccggttactggcatgaggctgcatctagagggcaagaaaaacaaccggtaagatttcacaggtttatttaaatataattaaatacacatgaaaacttgaaaataggtttttcttttttatagatgcacacccacgcactgagacacacatactactacacatgcacacctcacaaaatgtggctccccacgcgctcaatgaaattagtttgggggagcttatgtcagctctgcagctgcaagaaactcctcgaaacaaactagatgatcttcattcagataccaagaagttttagttgtagaatccagaaaataaactaaaagctagaagctagatttcccagattctttagattctcactagctaacttttcaccagctgcttctcagaattttaagtttccaaaatagaacataaaaccagcgacaactcagttatcagtccatcatgacataggcacctctgcattatctacaaacattttattattgtccaaggcatcaaacatcttccaggaaaaaacattttattatttgtcacccttatctcaatgacacgtgggtccatatgtgtcataacatttgggcccactaataaatggttaattgccacatttaatagtggcgaatagttaaatttctaaaaaaaaacaaagactacgatgaaaaagaaaaccttaaaactaacttttaagtaagttttaaactttgattggggccgatcagaaagagcatagaatgaaattgcatgttaacaagtttaggtatgcaca

SEQ ID NO: 63737 - DNA, 1175 bp, Oryza sativa
ccagctccccggctacgccgtcgtgcagtccaagtgggcgcgcggcgcggcgcggccgccgtcggggaggtcgtcgagtttcctgtccatacccttctcggggtcgccgtcgacatccagtggcgccgccgagaagggaggccggccggagcagggcgcctcgccggtgggcgtcgccaacgtcaactccggcgtgttcgccggcgggccgccggtgcccgtcggcgcgcagaagctgctcaagttcgtggacacgtcgcaggtgaccatgggaccgcaggatagccccggttactggctcgtcaccggcgcaaggctggacgtcgacaaggggaagatcatgctgcatgtcaagttctcactgctagcccaagtttcttgacgacgagtcgacgagggtgtcaagatgttcatgaccatcccgtgatccagagtttgtacagttttcagctgccaaatgcagatatgctaacaactgaaaaaacagaatattccaaaaaaatttgatttttgattttttttttttggtttggaccctgaagatgttgcaacgatctgtaaatgaaaaaagatagtaggaaccagaggtatcattctaacactgcaagaaaaaaaggattcgttgatctcagatcacacattcatatatgggactcgcatacgattcacagcaacttgtcttacattactactactgcagttcgtcttacgcaaaaggcgggaacaataccaaatttcattacaataaaccgaaggcaccaagtgaacgactgaatccaaaggtttgtggaaacacatatatacatcacaagctagatagcagttcgcccgcattcagtaagcattcaagcaccagaatagacatgttcaatgcaaaagttcagatatatgtataagagcaaacatgctggccacactcaaattctcaagttgtggagagagaacaactcgggctgcatcttcctgacgaacttcctcctttgcttaatgcgcaaaagcttctcatagatacaccatggaaagctgataaagtgtggtcgctcatatccttcattgtagcaaccccagaattcagggtggtaagtgacatggtaccaggcggatgccttggcttcggaggcatcatggccatgcccacttatcatctaagctcatctcactgaaccttgaccttg

SEQ ID NO: 63738 - DNA, 714 bp, Oryza sativa
attcctgcagccctgtgctccttgatcaacttccatagacaacagagtagcaccgaaataagaattcaattagcatcacgcaaatgtttacaaaagtttatcattgctctagcaagattgcccaagacattagggcagaccaaagtttagcatgccaagagttaaactctatattaatacatggaaatagctcacaaaagttgccacacataacatcttccagtttttactttgcatagaagctccactatcccttcggcgccggacgcttgccgacagctttccaggtgactttcacagaaattgtgctaaaatcaccaagcttcaccacttcatcttcaattccatgaaaaccagcaccaaatctgtgctcccatcttacacggggcagcttctcaccaagaccaatacctgctggagacccttcgatacaaagatcaaggtgactacgtcgcaccaccgccacaacagaactaattctatgaccagattgtgcagcaccttggaagagacggatcacatcgctgaagccactagttttggcatataacttcaaattaaggccacaaggaggtgaatgtataatctcaacatcaactgtagcttgaactgcattaaccagcagagcaaacttcaaatccaatccacacttctcaccgtacagacgaacagttttggcgaatgatgccgatcttaaaatgttggtgaattcag

SEQ ID NO: 63739 - DNA, 1985 bp, Oryza sativa
atttgagttattcttcagtaacatcacataccaccagtaaatgtgtaataatgcaatcaagagaagtgctattgacaatgaggatgttactttaagttttactattagattgttactgtgtacagtgatgatgcaatcaagagaaatatccaaacttacaaaaataatgactaaatgtcaaacatgccaaaagataagtatggaagtaaaaagaaccaaaccaatgcatgcgtttgtcagtgagaggatcattgaatgcacggaaaagactgagtggtgaagggcctcgaagacgaagatgtggaatatcatagagtgcatcagtctgcacagaatggtcactactaagccttggaaaatcatcaacagtaaatgggcggtgcatccctatacaaaaaaatcataggaaaatcaatcaactgaaacaatttccatggctctgtagtttgatctaccaccatctatcatatgtatgcaagctaaaattagacgcttgacagaaaacatagcgatggaagttgattaagtcaaaaagtctgtaattatgtatactgaatatagaataaaaggttgcattttttttcctttttgcattttatattattgccaaagttcattacaagtaggattaggtaggaactaattcaagcaagatattcttagtgatgttccttccaatgtcacccaatcaaagagcaagaactgaatcctaaatcctaatccaagttgtcaatcacaagctaaaagtattaaggaaactgatgagcaccttttttttttcaattgtatttcagtctgaatcaaagaggggaatgggaacttataaaaagcaaggaggcactagattaactgaatggtggactgccactgcactgcattgaacattatattgcggcatgtagcattgaatcgctaacattctcaaagtgtgtaactgtaactctgtagagaaaaggaacacactctgcactgcactgcaacttgattgccgccttgatagttcgatacaagtacatattagtaactgcaagttgttattgccaggttttttctcagccatgtacctaatgaagtaaatgatcctcttctgtttctgcaacttgtacagtatggaatgaggcaatatgtggaacaacatttcagttattcagcagtagcagacttgcattatgctatcccccctcccctctctttagcatggtttatcaatttatcataagacaatcaaattcctgaaattactttaaaccagaaatatatgttgcctatcatcaagaagagcaagaactctgtggctagcgcactaactaaataggaaggggaacatttaaaaccgagaattgaacaaggtaatttcagataagcgatttagaactcatcatgtaccttcttggtcctcttcgtcttcctcttcctcttcctcctcctcgtcgctgacagcccagctgtcgtcggagtcctccccatcgtcgctcggcgtcggaggagtcgagggggaaggcggcctcttcttcccgcggccggggtcaggggtcgccgccgacgactcgtctccgcctccgtcgacctccatttctcctcaactccgccgcggccactgccgccgccgctctcacccacaaaccctagcgagaggagaaatcgaggaagcaaagcaaagggcggcaataaaccacgcgcgggccgcagtggggaccacatcgctgccgtgtggggcccgcggcatggcgttttgtgtcactgacgggtgggtccactgatttttggagggggaaaggggatccacgtgtcgactttgcagggcactaacgctaatcctactgtacataagcttttgtatagcttcctactccaggtgggagagaatttagatgaattttcgtgcaaattgaacaaactgcagagttatttgtgcgagtgagcaaaatgtccgggaacttccgatgcaatgcgtcacaaaaattacatacatgcgcctccttgag

SEQ ID NO: 63740 - DNA, 2324 bp, Oryza sativa
gcccataacactagggcagatcgaagtctaaagagttaggagtaaatgctatactaatacatggaaatagcttacaaagatgccactcagataacactccagtttttacaatgcatagatagaagcccctctatccattcaaggcggaagcttgctgacagctttccaggtgactttcacagaaatggtagtgaaatcaccaagcttcaccacttcctctacagttccatgaaaaccagcaccaaatctgtgctcccaccttgtacaaggcagcttctcaccaagatcgatatccgctggagacccttcaatacagagatcaaggtgactacgtctcaccaccgccacaacagaactaattttgcgactagattgtgcaacacctcggaagagacggagcacatcgctgaagccactggttttggcatataacttcagattaaggccacaagcacgtgaatgtataatctcaacatcaactgttgcttgaactgcatttacaagcagaagaaacttcacacccaacccacacttctcaccatacagacggacagtttcggtgaatgatgttgatctcaaaatgttggtgaattcagtgcatccttcaatcaatgtgccacctttgggctcatcctcagcctcaggtgagtctatagtccgaatacagagtcggaaattagaccacgcacggcttgtcatgcaccatcctaccactgggctagtcaatggtcaacatgccataccctacaatgatgaacaccaagtattacatcatgtatttgagttattcttcagtaacatcacataccaccagtacatgtgtaagaatgcaatcaagaaaaatgctatgtacagtgacgatgttattttaagtcttactgttagattggattgtgctacatgcattgagagaaatatccaaacttacgaaaataattactaaatgtcaatatgccaaaacatgagtatggaagcaaacagtcacatgtttgcaaactaaattaccgtctttggtttcacagagacagcttcataattgtcaatcgcatgcctaaagacatagttgcgcagaggttccaagtcatcccgcaccgcaaaaaacccgaagattttggcacgtccaggctgggtatggcgatatccagagatttacagatcaatcaactggagcagattcatcgaatggcacctacacccatttaagcaatcaacggtccgagcgctgttgacattgactgcaaaattgatgactaaagaatgagaaatatgtgcaggtttacagtaatctatagatgatgatatgacaaaagaaagcaccagagaactcaaagaagttaatttaaagaaggcatttactttcagattcgtcatcgagtcggtaatcagaaccaaaccaatgcctgcgtttgtcagtgagaggatcgttgaaggcacggaaaagaatgagtggcaaagggccttgaaggcaaagatctggaaatctataccgcgcttcagtctgcgcagaatgatcactactaagccttggaaaatcatcaaccgtaaatgggcggtgcatccctacataaaaaaaatcatgggataattaaatcaactgaaacaatttcaaatgctctggagtttgatctaccaccatctatcatttgtatggaagctaaaattagacgcgtgacagaaaacatagcgatggaaatcgacaagtcaaaaagactatacactgaacgtacatgaatggttgcacactcatttctttctttgtgtgtgtgtgtgtgtgttattattaccaaagtttagtaggatcaggtacgaactaattcaagcaagatgttcttagtgatgttcgttgaagtgtcacccaatcaaagagcaaagcaccggttcctaaatcctaatccagatagtcaatcacaagctaaaagaaccaagtaaatagataagcaccttttttcccattatatttcagtctgaatcaaagaagggaacttataaaaaaagcaaggaggcactagcttaactcaatgatggactgccactgcactgtatgtaacattatattgcggcatgcagacattgaattgctaacatcctctaagtgtgtgagtgtaaccctgtggagaagaggaacacacactgcactgcgccgcaccttgatagttcatacaactacacattagtaactgtaggttgttagtcagatactcagatatttctcagctacgtacctaatgcacatcttctgtttctgaaacttgtactgttgtacagtacaatatggagtgagggcacatgccaacaagtgagcagcatttcagttattcagcaat

SEQ ID NO: 63741 - DNA, 2292 bp, Oryza sativa
ataatgatagctactagctgatacgagcacatggtactccctccatcccctaatataagggattttgatattttacttgcactgtttgaccactcgtcttattcaaaaaatttggacaaatataaaaaacgaaacattatttttaaaatactttggataataaagtaaatcacaaataaaataaataataattctaaaattttttgaataagatgaatggttaaacagtgtaagtaaaatgtcaaaatctcttatattaagggacgcatggagtataagtatcaaatggtaaagtgcagggaaaggacacgtggcaccgctaattggccgaccggcgaaccatctgccgccagcgcctcctctcctcggctccaacttttccttccctcgtgtttgctacaagcatcaccctgctactgctatggccaacgttgccagtttgccacctatgtcagtgcctcccagcagctgatgcctcctgctagcgtcgttctgctcaaggtgcggagcacaagcacgcagcgtaggacatgatggaggggcagatcgactcacgagtatgaagtggagacgtggataatgttagcgcaattagttaatttgtgtagatgagcaaagttaccctgatgggacccacccctcctgcacataaaatagagtgactttttaacacatgattaattacgtattagctaatttctttttaaaaatgaattaatttgatttttttaagcaactttcgtatagacaatttttaccaaaaaaacacaccgtttagtagtttgaaaagcatgcgtgcgaaaaacaagggagaaaggttgggaacatggggttgcaaacacagcctcaagcatcatgctaatacagtatgttgcattctttgtgatggcacttagggcaagtactgtaaccgcttcatgttccccctaaatttaccacataggattaggtgatgagttggagaaaagttaggagagagagaatgagccacccctcatgcaaggggcaacctccacacaatctccaagaaaaatataagatgatgtgagagcaggtacaatagcaggctataagccagctgcaaacatattttaaggagataaatcaggagagagaagagcagcgggctacagatttgtagccagctgtagcacggacttcaagacgcagtgtgtctatgacaggtgagactaggtattaatagtgtagtatgtaactattgtatgaatgagctattagattggctataaatgaattagagctagtagttggctatactattgaacttgctctgagaagatgacatggtttaaattagatgtgtcactcacctccactttaaaacttgcccttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttacagactcttcaccttttttagccagccggtggtgagtctctgccactctgattggcccgagacttttcactgcacatttctctgcagttctgcatgcatgactgaacattgaacaaactgttcaggaacttgcaatgcaattccacgcctgatggaaacctacaggcattgggtaccaaattaaagctatgttttgtaccaaactgcaaatcaacgtgcattcttcagaaacacaacggcggtctcttcacaaggcagcaagaatgtcatctactttacaacgtttcattcagaaaccataaaaattctatcagtctttcacaaagacattgtcactgtttacatttcagtatggatggatcaaacagctaatggaagttttttctttccacacaaattggctactatctacaaaaggaaccatatcatcagtaaacagataaatctgttagtcggctgcgagcagcagggtccaaagttctattgacagatccatggccaccct

SEQ ID NO: 63742 - DNA, 1212 bp, Oryza sativa
atttttcagagctcaattcctaaatgatacaaagaacagttcagtaattatttgatcattaatgatctaattataattgttaagagcttttcttgtttaaaaatccttaaattataaattattgtttaaaaggaattattagaaatgatcttaaaaacctaaaagagaagatctaattttaatttgttaaatctcaatataaaattgggctagataaaattttgttaaatactttgcttaattctataattcctagatttttctgggatttatttgagctaaggaagtatttttaataaatggaattgcatttcaagaataatttaaattgaaaaatgtttttaaatcctccttttggctttgggccgaaagtcggcccaaaacctctcttcttctctctccctccccggcccagtcggccaagtccgccgagccgccgctctcctctctctctcagccgctgacaggcgggacccacctgtcagtcttgtcttcctcctcgcgccgccgccgccgccagaaaccctagcgcaagccgccgcagtttccttccaaattcggtcgcgtctttccttctccggtgaaatctttagaggggaaataatctcctcgatctcctcttccttttctcttttggaatcatcgtctaaatcgctttggaagttcgtggattcgaggtcgattcggatcggtctctctctctctccgagcccgaactttccatcccgccgccggtcgccgtgggccttcgtcgccgctcgctagcccctttataaggatccccgagctctcctctacccgccgccaccctcgccttcgcctctcgtcgccggtagcgctctagcgccgtgtgacctagcgccaccgtcgtcgccgtcgcttcagccgtgtgccgccgccgttccggtcgtcgtcatcgctcgggaagaccgccatcgtggtcgccaagtcgccgccgtcctcgtccgccccttcgccgccgccgaagaccgccagagcaccgccgtcaccgtcgacccgatctccgccgccgtttcttcctcgtcgccggcgccgtccgttgcccttccgccgttgttttggtcaccggtgagttcgccgcgtcgccctctacccgttggtgtcctccatttgcgtcgtcgcgccgtcgttcgccggcgagcacgcgaggccgagccggcccgcgtgctgacgtcatcgctgacatcatcg

SEQ ID NO: 63743 - DNA, 710 bp, Oryza sativa
ttcctgcagccctatacgtgcaacgtgctagatatatttggcccatccggataacggcccacggcccacgtccaaacagacgggtgtgctccgctgcgccaagctctatttttacgtgtctcccttctgaaagcgtactttggtggtttacgtattcacgcggcggaagcttttctgttttcccccaaatttgcgcttccctccctcttctcgaaccttccgaccgccaccgttgtcgccatcgccgccggcgccgaattccgccgcgatctcgcctgctccccccagtggtaagagattcgatcggtctcgtagtaactccggctcgctcgggcaccttaggtgcgccggttcctgctcgattcgagctaccggctgccgactttgccggcggaacgtaatcggctgcgctgtcgcagtcggcggcgtgcttaaccgctcccggaattctgcttagctatggcgatgattcgatgtgccctccttcgtgctaggaaatcttgtgctgtgattttcaggcttcaactcgtttgatgcgtctatttttggaagttattagcagtagcagtgtgttcgtgtcctgcaattgacctagcctgcgcaatctgttgcttgctgctaaatgtgtgggttttttccccctagccattaaattcaaacaactagtagacaactcgttattgccgaagtacagtttggaatcatttggg

SEQ ID NO: 63744 - DNA, 1121 bp, Oryza sativa
aaattctaccgaatcgagatggtctcatgcttcgttgggtatcttctgttatgtgatgcgtttctagggtgaaattgtgtagggggtaggtctcagcgtagccttgaggtgaattaggtagtggactgctaaacctagttagttctgaagcttgggcgaacacctccgttgttgtgctgataggcctctagttgtgctcatggagctttgacatgcgactataattttttttctagtatctcattctaggaagttttgtgattgctaaagtattgtgatgtcttaggtgtaggtttgtttaggttcatttgaattataaaatcgtgatactgcttactgtcttaatatatttatatatgggacacaggtttgcaaagcaacgtaagatatcccaacttatgactgctgtaacattgatgtaccataacttaaggatcctcttacctttctttttaggagatgctgcaacgttggagtcagttccggatcttgtgaaggcaatgtacataaacgttgaaagcttcccttgtgtgaggctgttgaatcactctggtcaagtcggttgttctagtgagtattcggtttactcttattctgtatgcttaaattaagatggctgtcattttctatcatcattgtcaaaggctagccaactctgccttgttaagagtacatggttattggggtctccattatgtaatcagatcctgggcatgacaaggttattgcaccgattgtaagatttggaaacagaaatgatcagttggttcagccgtcggcggttcttcttcccttaaatcagatgacagatttctttctgaggtataattgcttagatagtctaaatctcacaaatgatgttacatatgatcgtctttcaaagttatgtttccttgaggtgctaagagatgagaatatttgctacattgtttgctcttgtgcagggtatccaatgatccagaactttatcgtaagatagctggcgtactagttgaggcaaatggcgttgataacatgctaggtttgtggatttgttttttttatgtattttattgcctttaattccaaaaataatgtactgttctgactttgtagagttttcaccggatagaaaatttcca

SEQ ID NO: 63745 - DNA, 1725 bp, Oryza sativa
tcaccggtaactgcgcggttgtcgggcttaccacgggatacggtaatataaataccacggtagcctccttaaattcataaatttaaaaaataatttgaatttttgataaattttgtacgattttttacgattacggcgcgtggtaaccgtaattaccgccagggcacggtaaccccggccctggaggtttgggaaatcctaatctggtggttacgggtactaatttgtatattcctctggtccactagccattaatatctctaaaatgtatgcacagtttttccactttattcttttttaacttgcgagcacaaggatattttacttctactatcataaagttagttgctcgactgccctttcaataataaataaaaaaaatgtgtctacaggatacgttgatggcatatgcatgcgcatgcaacatatgcaatgtcgacctactgtccttatatatatactaatcgttgttgtttggttgtaccttttgttttctaaccttgagtgacagactcttaggaattttctagagcatgacggaaaacatattaatagcaattagcataggcaaatgttgatgaaataaaataacattatttactgtggtgggccagttaattagtaggatggctcctcctggtcacatgatcgagccttgggtccactagcgtactatggtttgatcatttgatatatactctctctgtcaaaaaaaaaaaaaagaagacaaaccttggtttccgtgtctaacattcgaccgtctatcttataaaaaatgaaaaagacaagtcacgcataaaatattaatcatgttttatcatctaacaacaatgaaaatacgaaatataaaaaagtttcatataagacggacagtcaaaattggacacgaaaacctagagtttgcctttttttttttggacggatggagtactttgatgtaaactctagctgctgcggccacctcaattcaacatcttttgagattgagatagtacacatctcatcgggttagactctatttagatgggactaaaacttttaagtccctatcacatcgaatgtttggacactaatgatttatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagagactaaagttaagtcgctgatgtaaacaccaccttcaacttgcacactcttctctcgctcgcagctagctagtttgtcctctcctgtacgcgtctcttgcagctcactgtctcaggcaagtcacaagcgagttcagttaactcgttagctagctagctaccgctgcgagctctctgcacaagacgatgtcgagtgtggttgatttgcatgcatatatatagcctactgcttcgtgggaaccccgtgttggctccgctattacgtgcgtgactcgtttgctgagtaaaactgaaaaaactgggcacgcccggactccgattctacggtctctacaagggaaaaattcacgcggccttagccgtgcatgagccgtgtgtaacatatacaccaacacacatcgatcacggccactag

SEQ ID NO: 63746 - DNA, 1887 bp, Oryza sativa
ttataaatcatttttaaaatatttatctttcaaatatggtgacaacatatatagattagtcttaaaaagtactttaataaaatcatatatctgttaatacttttatacatattataataaaaaataatggtcaaaattgttttttggaaaccgtgcccttgtccaaaacgataagtattatcaacccggaggaagtatctcaataattctatttatatgaaaaattagtgtattgtggcatcatatattaatattaacttctcataatctttttcttcaatattgttaattaaaattattgtttttttacaaaattttatcatcaaaatatacactatcctatactcgatcgagcttctcgagccgagcctgtttaaaacctcgaaggatgactaggctcgattcaagctcggctcgagcttgtgtcgagcttaagcctaggcaggcaagattggctcgttgacagccctactccgatcctaagggtacctactccgatcctaacgtaccctagctacagccattaattgaattaaatgtttctcaacggctgcacagtcatcaaggtctccatgctgatctcgatcccatgtcgatgccagtatatatatagttctttttttattttcggggagtatatatatatatagtatgcgagtattgattatttgcgtgtatatgcacggctttgaattgaccttccaacctctcgtatgacaatccatttggatcattgtagcacttgacagtactgtgtatgctgaccataagcatgcatggaacttgttatgtactctaccttagaatttattagtaagatcaggctgatttgctcccgatgtagggaccaaaaatattatagtcacacttccaatttgatatatagtagattttttggtcttccaaaattcatcatctaactggtgtttactcgtttattagtgcaaaaataaatggcatcatagtatatcagttcgtttatatgtgcaggagtaaaatgtttgttgcatatctgctctcttatctatgtaggagtaaatgacatcgtcgcatatctaatcatcttgatcgatgaggtttaatctcagaataaatgatgttttttttgttttggtcttaatgctattttcaaatatgatgactaaattgggatggagagagtaacaaatttttattaaacttgctctgttcctataagtataatgttttgaacgtcgatacagtctatgacacatatgtttcatcattattttttaaaactatatatatgtatttattaaaaagatactatatgaacgagattttcttgataaatctagcgatatgattcttacattctaaatcatgctaattttggcacctattaattaatgattttaaattttaattattgcacatgttttaagaatcaattattttaagaatggatattattaataaaaaagaacgggtcaagttctactaatttaatttaacaattatatctaatcttatataaccttatactaccattttgcaaggtttggactatgagcattgtctttagggtttgttgaaaccatgccaccctatatttgtaaaatttgagatatatcacccgtatctcaatgacatgtaggatccacatgagtcaatgacatgtgggtcagtgaccaggttcttgttccaatttcaacaacatatatgtgcttaatagtatcttcgttttttaatatatgacacgttgatttttaacacatatttgattattctggtcttatttaaaaaaatcacgcaattattatttattttattgtgagttgttttatcacttacaaatattttaagtatgatttatatcttatacatttaaatttttttttaaataagataaatgattaaacgtgt

SEQ ID NO: 63747 - DNA, 2466 bp, Oryza sativa
attcctgcagcccaaaccatctacaatgcttccttgggtaagaagaagatacacatcgttgattacggtatacagttgggttccagtggccgtgcttcctgcggcggatatcacaaagggagggtgggccaccggaggtaaggatgactggcattgacctcccccagcctggtttccggccaactgagcgtattgaggagacagggcaccggctcagtaaatacgcccaggagtttggggtgccattcaagtacaatgccattgcagcggttaagatggagtcagtccgcaaagaggatctgaacattgatcctgatgaggtgctcattgtgaattgccagtatcaatttaagaacttgatggatgagagtgttgtgatcgacagcccaagggatattgtgctcagcaacatccggaagatgcagcctcatgtgttcatccatgcaatagtgaatggctcattcagtgcaccattctttgtgacacggttccgggaggctttgttcttttactcggccttgttcgatgttctggatgcaactaccccaagggaaagcgaacagcggctgctgattgagcaaaacatctttggacgagctgctctgaatgtcattgcgtgtgagggcatagatcgggtggagcgccctgagacatacaagcaatggcaggtgcggaatcaacgggctggcttcaagcaactgccattgaatccagaaattgttcaggtagtgcggaacaaggtcaaggactgctaccacaaggacttcgtgatagatatagatcaccaatggctcttgcaaggatggaagggacgaatactctatgccatctcaacatggacgccaaatgatgctctctcttatttttagttgtttttttttttggcatcgcgacaaatataagatctaggtatttcaataagatggctagtggcagtatgtcatgtatgaagatcgatggtgttggtgttggtttgatggacccaatgacttgaggtatgcctatctagaatttggagtgcacttgtgattccaatgggttggttcttcttctgattcaaaccaattcatgcaatgcaggctatgagggagaattggtagcccaagttgttgaagccataagataaccaagcatgcatgtagatatccatgtttttatgtgatgttaattagttgcttctgttgtcatgttgcagcttagtgccacactaccacttagaaaatagacttaggtcctggtccggatgatgttcgctgcagcgtcaccggttcttgcgatcaatccagtcagttgatccggttgtaattgacaccagttactctgttttactaggtgcttactgcactgtggcagacagtaacattgtaatatgctcaaaatgttgaactgggttttggctagtcttgtgctgttgtcaacgtgagagctatcctttcggccaacttatttggtatattcatgatccatgttgcaacagagggtcatcacatttttgcccattgatgtgtgtgatagtgttcttttaattattatttgcattgatgtgatattgtgcttccatccagtgacatacctaggctgtgtttcacctatagttcttgttcatcacatcaacatgtcatcacatcacacttattttgctgtggaggctagtaattcccactttaattgaagaaaaagataaaatctactccgctagatcgtgatagtcctaaattataacggttgatatttaataaggctacaaataagttttgggaactaacctaaatgcaataggaaactaaaaggctacattggactgatctgtctacatatactagaaacataaattgattaggagtaggattctgacgtataggtgttggtcctgttgaagcctgtaatcggattaggacttggcaatacatatttgaatgcatatggcgctagagcctgaagtctgtaattagagtcatttaaattcaccatatatatacggccatgcattgctaggagaataggaacaactaaacagtacatacatatagcataccatatgctgtatgcacaagcctagcagtaaaggccatatacatgtggctgcactggcttacgattaattaggcagtataaatgcaaaacgccagtggttaaaggcatgtgcgtaattcaatatatacttaattaataatttcataaaaaatgagttgtcgcaggaaaaaaaattttatgtcataagaccttcaccttcatagcagcttcatcagtcagaagtgcaatttgatatatgtgtgcacttttgggtaaaagaaaaaaataattgtaattcgataaaaagaatattaaaagaacagtctatctggaaaacaagacaagattaattaaaattcgaaaataataaaataaatttcaacattagaaaaatagtagtagtttatgtaggaatacaatttagaaatagctaaaattcataattaaaaataa

SEQ ID NO: 63748 - DNA, 1221 bp, Oryza sativa
attcctgcagccccgcaaaaaaaaactaaggaggcaccgccgaacgaatcccacatgcaagcagagcagccgcaatcgaagaattcattcgttaattaacatgtagtgagggggcgcgggtggacctatcgcggatctggagctggtcgaccatggccgccatgcgcatcttgtcctcctccgggagaccgtcgaggtcgccgagcatgctcttgtccatcgccgccgccgccgccgggagaggaggaggaaggctagggttttggaggaagagaggagaggaagcgagatctaaaacctcgggaaattcctttttattttctttttattgatgtaatgggcttgttttaattgggccgggccacatgggcttcgaaattaagcccagtatgagaagtgtgaggcccatttgggatggaatcccacaagtttgtgtacaactcgaatgaattcttgcagataaaaaaaacgattctagtatatatttgttgacaaattttcttctaaaaattttgtcaaatgtaaatgtagtataattgtagcttacatttaactacaatgtaacttggttgtaactttcgtatgatattaaatcgtttgatttgcttcatgatttgtgcgagcgaggaagaaaaaagatcatggcatgcatatagctgaagcgatttggtcatatgacctccacttcgtggaatagtgtattactgtatataattgtgggatttttaaaagttgcatataaattatattatagttacatgctagttacaatataattacaatatgactgtattattttcttttttagataatggaataaacagactgtattatatttacatcaaacaaacatttatcgacaaatatatggacagtcttaaaaaaattactataatagaatggtgagtgcaagagaaaaatgagagagtaaaattcacatacacaaaacaatatttatatttcacaaacaacatttacataaagctagaaaccacatggatttccagccacgatttttgacacctgattcacacatggttgacacaaacacacacacacactgatggattcagtcacactcacacaggcatgagccatcacactggatggactctttatttattcatcatgtagacaggctggtgcattggcaattcagtcatagatcgccttggccttagcagttgcaggggttgcacctgcagctggagccacagctgc

SEQ ID NO: 63749 - DNA, 1843 bp, Oryza sativa
atcgccggcgactcccgccgccgctggacggcgacgagcgcgtctgcgccggcgggcgatacgactggctcctcgaggacttcgccgacaagctcgtcaacgaccaccaccgccgaatgatggctgccccgatcctcccgccgtggatgtcgtcgtcgccgtcgtcttcttcctcgccgtcggtgacgcttagcctcgcgtcggcggcggtggcgccggcgcatgcggcgccgccgccgacgtggggtggtggtggaggaggggaggtggtggtggcggagttgatggagtgttgcaggtgcttgaaatcttttgctccctacgtttttaaatatttaatactctttgatttttctaaaaaaaaatatttaaccgctcattttattttttaaaaaattaattattaattttgttcctatcatttcattcatttacttatatttattaaatatacttatatgtatactacatatagttttacatatttcacaaaaatttttaataaaacaaatatttaaacatataattaaaaagttaacggcgttaaatgggggatttcttcatctcattcgtcttctttgacccactatcatcgattggatctcctcttttatgtgtcgtcgcttgactcgcatctattgttgcagggagatggaggaagggcagagggcgtgggcggcgcacaggaaggaggcggcgtggaggatgaagagggtggagatgcagctggagacggagagggcgtgccggcggcgggaggcgacggaggagttcgaggcgaagatgagggcgctgagggaggagcaggcagctgcggtggagcgggtggaggcggagtaccgggagaagatggccggcctccgccgcgacgcggaggccaaggagcagaagatggcggagcagtgggcggccaagcacgcccgcctcgccaagttcctcgaccaggtcgccgcctgccgccgctggccgcccgtagagatcaacggcggcggcggcggcggccccggcggcggccggtgagccgccggacggtggcgctgcatgcatgcgtagttggacacctcgctttcttgcttcttcttctcgtgtcctttttacaactgttggaattcacttctctctagaaatatgtaatcttttgagtctcttttgatcattccaagtttcctactagtagctctattgaataataaatggaccaccaaattgcaaaccaaaatggttacaaaagaatatcttgagcagcagtagattgcaatggaaataagtttttttactctgtggttttgtgttgggatagtgcatgggccaaatgagtcgcatcacgatgaaatggttctgtaggatctttgaaacaaaatttctcgcaacaacactatctgcaacgaattcgaataagattcagtggaattgaaccagacgattgtttttaaagcgcctttggaatacaggaattttttggcatagttgaattctcgtgaaattccagcaaactttcttcattccaacgacggtcttatgtttatttttttacatgcacaagcatatcagggagtaataagcaagagaaaataacaacataagttacaaaatccattttctagttttaatataggtcataataaaacgagttacctgctaggcagggaaataaagaatgggacaaaacatcataatctagtatataggagtataatagaacaacttgaacatggtaaggtggtacccatcatcacaaatggtacgatgttaaatgatatcgactgctcattcccaacttgcgtgtggtcatcgcaaaccgtttccttttcagtcaaacaaacacatttacggggtgcaggaa

SEQ ID NO: 63750 - DNA, 3857 bp, Oryza sativa
gacctgagaggacactcgtggcacgaccaggaacttgcgaacctggttcgtctcccactggcaagtgtactctgcatcacccctcttaacacaatatccatatatggtgatggccctatcaagatgaaaaaaacattgaccttagcgatacttcaacaacttaaattcaagatatcaaacagcaacaaaaagatcagcgtactcaaagattatcagtaaacatatatgcagctgttcatgtcatgcaaatggaataccagaacagtcaataaaggactaacaatatgctaatatacatatgaaaaaaacttttctgaaagaactgctgcgacttctaagtcatgtactattttcaatcagttatgctatgcctgatgttgaacattgcaatctttaaactgtcaaacattccagcaaatacactacaggaaaaaggtatgcaacaggatctatttaagtttgctcctaatgattccgataccatctggcacacaactaggaggctacagatcagaggacagtgagtacttgggcatcggagtgcaagttcttagtttggataaagtggggacatggagccattctagttcatttcggtttttaattacatataccacatgaactagcaattgcagaaagttgtatttttagtttggataaagtggctcaatcctgaggcataccttcaatagcaggcaaatttgtgatgaaagacatcatctgtggagaaagtcttttcaatatttcatcaatctcctttgtatacccactggctgtggttgagaagtctgggcctgacaaaaataaacaatgatattttatgtgtgagaaaagttgacaattgtgtctgaatggaatggctggaagcatttgcagcccaaactatgaaaaaaaaaagttgtcaatcccatcaagtaacattatgcaattggcagattagatgttcatggtagcaattaaatgagataaccaagtgataataattttttgaccaagcattaggcagtgtaggctggcagctatacctaaacacagattacgagttgactcatgattatctgaaattctgcatactgcattattaggtgtcaatatctgatcaagacaaatgatacaagagtgggtactactatttcatcaccaagggaatctaggacaaatgtggaatatggaaatatttagaacactgatttgtatacctttcatctgtctaggatcatagataaccattcgagaaatctcaggacgaacaacctttgaagattgtgggaacgactttttattggaaccaactcggatatcacctttatcttagccaaacaaccagcaaacataattagcaactccagtagtatttacattgacatgatggcagacagaacaaaaaaaccttacctaaagtagcaccgccagttagcacaactgatttgtcacccctattagcaatgttttttgcaagccactgtggtattgacatcaagaaagcgttacaagtgagatttttcaatggaaatcaaactgttacaatgtaaaaacctgcatcagaaacattaagtagcaaaaaataaagcattttcaagtagactgaaatattaaggactgactcaagagagatatctcaaaattgcaacatgaaatagattccgactttctatttatgaatgttctcacaatctcgcacaagaactgccaagggatacatgagcatatccttttagataattacttggtatggtttatattaagtcctaagtccaacagccagtggcatcagagcagagacaagggaaagcaagagtaacgctcagccttgtacgtagatgcattaaaattgagcttgactgtgagttccaaatatgagcttgttacatttgcttcggatgaaatatgcaaggtagttgtatatttgagatagtgcaaacctcatgtcttgatagataatccaattctttggttgagcatggccaaagatccatatagctgtatcgagaaacaacgtcataaagtgtgttttccaaggcagataaggcgtcttcggatgtcctagataaagcctccttccttctttgttccacctgagaaaacataatttagagcaaggaatgagggaaaaaatatttttctccaaagtcaaattaaataaggctaaatatatataaagcatgcacatcctaatccaattgtgcatgagctgttattaggaaagcaggaaatacacaaattccattgcaacaagcacaatataaagtcattaaaggatcacaatacaataaattgggtgagatcaatacaaaaacagtcagaagattaaaaaaaattgtatgcccacaatgtggtttcaagattttacaatgtgtaattattgttccaaaactgaccaaaccaagcagcagcttagtatttctaccatacttgacattgtcttgccccgatactatgtaaaaggtttttaataagtgctgtaagttatgtcacagatggcaacttggcaagtccaaggcacaaccatggagcacataaattttaacacaagtatgcctttgcaaaatggattattctatcctgcaatggtaacatatatataagttttgcctagattcatacaattatgagcctcatacctttaacatgcttgacaaatccccgtatgtttgctcaaattgagcaaatcgtttccacacctacaagataatagcaacgtgcattactcagacaacataaaaaaaagtgtttatattcctttgccatggaagctaattacacctaactaattttaactgaactgcagtattcccctttgtcatggaagctaactgtaactaatgcacaaaagttattgcattttgcatctctctaaaacaaaaatccaagtatataacttaaaaggaggaaaaaaagggtcatacataagtgcaaatttgctactgcttaaaaggctccgatgcaatacttaccattctcagaaaatgtattgcaactcatgagttgtgatttatatcaattttgagaacctttcgctagagaatgaaatagaaactctacctctatagattcttcaggaggaagtaagctcagagctcgctcaaacaaagcacgcacatttctgtcgtcatttaagcgacacaggaagtctgcatatctgtatcattgcaccagtcccaacaacacaaactttgattcatatctcttaagtaaagcaaaaaaagtgcaagaaacctttcccaactgttaatttatgaagatagcataccaaaatgtcatatcaatgagcctggaagtgagaacttactcaaggatatatcctggctcatgcataaatcgctttaaaccagcttcaaaaacactttgggctacctggaacagaattgtagcagatgaactaatgcaaaaataaaaacagataaataacctaaaaaccatgtttgcattttttatattaaaaaacatcaagataattcctttcacaacctttgcatccttgtcaaggcaaaatgccattgtagcgtaagcaacatagacatgataagtgcagcctggcaatttccgagcatccagaaagtacttacgagctgcttcaatgccttcagttctccttagaaatcgaataaactacaacagaaaaccagaatgctaaagctctcacatacattacagcaataatctaagtatgccaaaagtaataacaagttagcaactcacctgaatatgtgcaagtgaagtcatcccgcattctcagctataagagactcatatattgctttagcaggctgcaatgcaattgaaggagtatttgagaaaagtagaaaacaaaatcatttttagcgtagctgtagctatccaaaaagggctgcaggaat

SEQ ID NO: 63751 - DNA, 1167 bp, Oryza sativa
aagtatgcaggacacccccaccccacccccccccccccaccccccaaaaaaaaaaactgtggagttaacatatgtaggttcgatcaatgcctggtgtaaagcaatgttagaacctcacttactgattaccttgtaggagcctgtggggggaactgccagcatgttccaatcaatatcatcaatgtatttcttacgctctctatatactgctttggcactgttaaactttggctgatactccgataacaaaccttttgcctggaatacagattgataatcaacaactccatatgaatcaaatgtaacccagttacattgttttagatttgataatattaattttgaaaacaaagtaaaagatgaaacctgctaacagaaatactagaactattgatacaatgaggatgcactgaatctgcaagtgtcatgttcatgaagaactacagcaccatatgttttaccagacagcgattagagtcgtttgctagctaattttcacaaagatcaaagattcaaatgaaactacaattaccaaggtgcggctaacagaattctcaaaattctcataatccttccatagctgcgtccacatgattagttggaactaaaattgccttctgatatactttccgtacagtagtcatacgatgtgattcttcctgcggtgtcacaacctgaagagtatgcaaagaaatatttacacagaataatagaagggatgaatgttaacatggggaaggacaggaaacaagaaggaagaaaacaaaccggcattgacttcaagaaagcaatataatccatccaaacagggccagaagcaacatcattgcctggaaagtttaagtgtccaagttaaagaaaaaacaaagagggattatctatacttatggcaccacatttttcaccaaaaaacagtcaaacctttcagccagtatttacactgtaaattccatatcttgcaatgtaattttcatatatttacagtgtaattttcaaatcttacactctatatttttatcattccctatataagagaactacgaaaaaggttgatcatctatttgaatcattgaaaaaggtactagtgcaaattaacacataagtagaaggacaaacacaaaagtcaataagaaagagagatgagaaatacaagtatagttacatgta

SEQ ID NO: 63752 - DNA, 1415 bp, Oryza sativa
gaacgggtatttgaatttcagaaatgtgtttagccacaagctagtactccattccaaaatagacttattcagatttatcgtagtaatattatatatcacatcccatattaaatttctttattttggaacggatggagtacgtgcttaagtcttagtactagtttggatgaactttcatatgagtaaatgggtaatagctcgaagtacagaataagttaatgtgatgcagtgttctctcacgctatattcaatgaaaagtcacaattatgcgctattttcccttcaaaaaaatgtaatacaggtcccctagttcatagttcatacatatccatcaaaatcacttctgaataaaggaaatggaatacgatgtcaccattctgcttcggaacaaatcctttccttctgtttacagtaagtaagatgatgttgatgtatagtaggacaagtgtaggaaatgtggactctggtcaatgttgagatgcgttgagcagaagtaatcaagtttattgatgatgcagctgatgcaacgctgtacaattgggctaatggaattattaccaaatactaatgattcctttccagaaacaaaaaggtaatcaatctggttgaagccactggatgcagccaagagcccaacatggctgcagatccggccaccaaccaaccattgcaacagagcaagaactaaacaaagcaagaaaaagtcaaagtctaaaagctgacttggacttctgacttttccccattatttatttttgtcctacgtagtctttttctgttataaagaaatcacaactcgcaaacaattctttgcacctgactggttctgcgctttctgctgtttagtctacgattattcagagacgcagcatcaaatgataactaaacatctgaaacagaacacctgaaaagtcctgctctatcaatagaacttcgcaccgtctcgttaagaaaaagaacacctgaaaaggctgaagctgaatccagatttcagaatgcgataaggccctgaggaacacaaatgaaatcacgggttgccaagaaggcaacatacaattcacaaagctaagtacaaacaatcctaatgaaacacacgcgcggtccatcgtgatcggttgccgtgtctcgtgtgaagaagctcgcccagcaagaacctaagggacgggaaagcgaggcgctaaccgacattggcagttcggtcggtacaccgggcctcagccacgcacgggctttcaccggccggccggaagaggccgggtcttggcggggcggaagcagccgaagaaccagcccagcacgctcttcagcacgactcctctctgcggcacgtagcgcgggtgcgtcgccggtgccggtgctgcagcgccgcgagctttgccgccgaacgagctccgcattgtaagctggtgatgcct

SEQ ID NO: 63753 - DNA, 1175 bp, Oryza sativa
cggcctcgcgggtgtggaggcgaacaggcgtggcggccatgtgcggcgagagaggggaagagcgccgggaggatgcaggacatgcggaggttcccactgaggtagcaaggcacgacgatggtaagcacgagccgtcaatgcgcattgcgaggcataggatgtcgcgtggacggataggcgtgccagtggcttcgtgctatgcaggaggagcccaatgatgttgttgagcatcgcgctgtcagagaagctcccatgtctaccgtacgtcaattaacatgtatccaatttgttttgatggagagagagtcgattgatgtagataaatatgcaatagcgaaagtaatgataatgaatgagcataaataccagttgtggccgaggaagccttgtactcggcctcctaggtcgacgaagccatctttgccaccgtcgtggtcaccagtcggtcgagcggcgagagtgcaccagattgaacgacgatgtacatatgtcgttcatttgaaaaaaaagtgttaactagagtaggcgcttacatgtggatcctacggtaaaccgcttcccaaaccacctatggagttgatcgatttgaaccagttttcaaaaattgaagaggtattatacccgtttttatggttgagggatgctattcaatcaaggatgagtttagggatgtaaatacacttattccatctgaaaaataccaagcgtggcattcttgctgcggatggactaatccgaattcagcgtagaccattttgggccaatcccgttccgagcccacgttagaaaccagcgtaactagacaggccgtgatgtcgtgggcccagaacaggattgccgcctacgtgctgaatgggcctacgcatttagggcccataattgagtatgcgcaaaatggggaataagttcactctgggtctctctatttgtcgcccagtccgattttcgtcccttgatcacaaaaccggatacaacgggtcccccaacttacaaaaccgtgtaaaagagatctctcggcagtattgtgcctggttttagatgacgtagcgcctacgtggctccctttaactaggtcgtcgacccacgggcatttacgtagcgcttacttggcatttggatcccgggaaaataataaaaaacagtgggacccacatgtcagctagggctgcaggaat

SEQ ID NO: 63754 - DNA, 992 bp, Oryza sativa
attcctgcagccccacgagagcgagggtgttgcgggtccaatcacagcggcgcacaaaggcgcgtgtggaaaacagactctgtcgcgagcccaatcactgcgtacggcaaggagcgtgtgaaaagatgctggcccaattaatttgcgcgcgtcatagcggcgtaagaaaaaaaggaaatgatttgacagaaacataaaattaaaaccgattcaaacacggatgacgtaccaaaattccgatgaaaatattttcaattttcataatagtagagatacattttaataaaccgtaccaataaacacatttttttcgcgaaggcgcaaaaagattacacgtcaatatatatgttagaaaaagagaacaaaatttgattacacaacgcacactgtcaaaaggccattgccaggggtcaagaaaaaaaaacagataaaaaaagataagataaagaaaaaaaaaactcctatcgtaagggagggtggggtagggtaccactacactccggcctgcctccggagcgaaacgatggaaccatattcaggaagctcgatcagcccttccatcgctatttataggagtgatatcacacgcagcaaagtcgcggcaggacagcagcaaaccagaacggaagctagctagtagcaagcaacgacgacgggccatcgaaattgctcatcgccggccggcgcgcgtgatgcggcggcttgacctgccatcgccgccgccgcgcgctgtcgtgatccttgcggcggccctcgccgccgccgtcgccaccggcggcgtggaggctgcaggcaacatgtacgcgtcgtctgcacgcgcgaccaccacctcatcatcttggggatcatacgccggcggcgccatgcacggcgccgaaatggcgctggcggcggcggcggcggtggaggacgaggtggcgccggagttcttcccggtgggcctcgtcgtcggcgacgggcacggctcgtatttcgacgggctgaacagggat

SEQ ID NO: 63755 - DNA, 2850 bp, Oryza sativa
tgtttggcacagctccagctccagctccacccctcctggagctgaagctcagccaaacaatttcagttccaccaaaactaggagtggagttgggtggagctctcacaaaatgtactagagttgtggagctgggtttagacaactccacaactcaactcctggagttatatttaggagttggaactgtaccaaacaggccatttgtattaagagtggtgcacacataataaaaataaattaggtacagctaaaaaattttcttaaccgagttcctgggcaccccctaatatatactctacctccacccctcacaatggcggaggttgagcccaaattcaagaggaggccagatactatagtgaaaactagcaaacctcaacattttaagtgctcagttggaaatctcccctttctccaaaaccgatcgtgatactgctgaggcatgacgagacttgcatgtggatcaaataaaatctgaaagaaaagttggttatatagattgtaatgctatgaatatatacaaacgtgcaagtcagagggtgtcttaatttctgctaaaactcttaaaaaacacttatattttgaaaaaaaaataaaaggagcatacggtccctttgaagacaccctctgaaaatcctgcatgtgcgttgtgcaggtctgtgagaactaagcagccattggaagcaactctatatagttccctttttattgagagaactctataaactatatagggtgtgtttacttcacattaaaattagaagtttggttgaaattggaacgatgtgacggaaaagttgaaagtttgtatgtgtaggaaagttttgatgtgataaaaaagttggaagtttgaagaaaaattttgcaactaaacacaacgatagttgatatatgtatatctttagccctaaagtaaatgctatttgctagtgcactaaagccctaagcaaaatggctaattgatgacaaggctggccactcctgctagatggtccaaaggagcttgagatcgagcttgttaatggaagccatgaagtcgatcgtactgtagccactagcttgtatgcgccagtcctgtgtcatgcataagtcagccaagtgcagtaatccttaacagagtcttaattatactccctcattccctaaatgtttaacaccgttgacttttttaaatatgtttgaccgttcgtcttattcaaaaacttttatgaaatgtgtaaaactatacgtatacataaaagtatgtttaacaataaatcaaataataggaaaaaataataattacttaaattttttaaataagacgaacggtcaaacatttttaaaaagtcaatggcgttaaatattttgggatggagggagtagattggaagattaattaaactggatttggcagaggcggttcctgtttaacttcagtatttctttttttctagaccaagtcacactggaggggagtttaatttcagcagttcagcataagaccccatgcagttttcagagtttcagtttcgatcggtgtttgatgttgttccaatgttcttgtctggaatccaagtaataattgactatagctcgattaaggttcaaaaactaagtaaaatacattaagtggaaatcaatcaccaagattaatttggtccaatcgtttgttggtaccacacacattccatatgcacaaggggcatgccagtcttatattaacttttgtagaagctagacagctagtggctccggtagttcaagtgtagcactcgcaaatatgatcatcatcatcgccacaaaattatttatcgtgcgctgccactggtgatcagggcatgatcgaagcatggggcatggattttaaacgccccacgggatgtctctttgctctttacgtgttatttaaatagttataagaaaaattagtagtatagattaatatgtgatatatcactctataatcatacaagctaaaagtcgacttctacaatttacaataaaaagataaattaaattataactagttaacgtatatttgtagttaaatttgtttctttttgcaacttgtataatttaatttgatttttttatgtttgtagagttatctattatatagtattaatttatgttgttaattttttttgaaaaaatatataaccatttgaaaacaatccccaagaatagtttctcttgacgcatgcttatgcattgcttaggtaattaagcaagctgcaccggcaagaagcatggggaggcctacacccagtcgtgcgcgtacaggagcggcattgacgccaagctcatgcaggggcagagctataataaaatggaggggttccagtcgtttgctttactctcgtttaaatcaaatttagcttaatacgagtgaagtttaaactaacagggtatatatggtaaaaatagataaactatagttaatatttttttaaccaggttcctggacacccccagctatacatagctccgcccctgtgctcatgctcacttcacgtgtactcccttcgtaaaaaaaaatgtccaacctagattaagatgatataacctaatacaatgaatctgaacaaccatctgttcacattcattgtatatatcatatcttatttaagttaggttttttttgacagagggagtaagcacgtgccatcatacgtgtgccaatgtaataaatgagagtgatgttcatgtcaactctggtcaagtgtctaaattgttttagaaactagatgatgtcccgcgctttgctgcgggatatatgttatataatggagaaatgatgaaatgatttggattgaaatattatgaaaatgatttgcgaatggtgatttagcatgtgtatgtttagtt

SEQ ID NO: 63756 - DNA, 1774 bp, Oryza sativa
ttacctaaagtgatatccttagattgtctcaacttcatcctcgtgtattctcgggccctgttcaatcgtttcctttcaaggcatggtcgaatggttatattgctaggatactccaatacagtcggtagcatcgtgaaacaatatagatgttgttagttcgtccacaaatagaagtaccatatacaattttattatgcaagttccgtatacaccaactaacatggcgggtttcactaaaactttgagagaatattttgcacgtactttcaatttcaataatattacatctatctataaagtataatttcaatttcattatattttagcaagataaaattctaatagatatgttactttttttatggctaaaacataacaaatatgaagttggtacttaatttatatgtgtatgcaatactattgaaaatacatgtatattgtttatataattttttatgatatatattatctggtgggtacatagtgtgtaaatttatgtgtatatacgatacattcccccacaaatataagcatttatatgagctttagcagagaataatgtttagcatttactagtaggggaaaatcccactcgaaatgtagcatttataataaaatgtaagaaacaatggcatatgatttgattctgttttgttttgtcagttgattttctctcaatgtatctatcttctttcacttccctcggatgcttggctattattttttatactctttggtgctttcatgtccacgagcctccctaatttcaccaccatcatctttaatttatatgccttatctcgcctcacctatcccccctgtatctggcagctcatgtgccacacgtctactagccactccgatgaatcgtctcgtctccaacatcgactcaacgcactcctctatccccatggcaatgttgggctatagtggcaccgctggtgcatagctgcccaccgcttgctagccactccgacgaatcacctctgtctccaacattgatccaacgcactcctccagccccatggtattggtgggttctggcggcaccgctagtgcatcgccatccactgctagtcgtcccttaaatccccaccccctccccgaaattcaatggctaatgtaattgactgatgttttttacaattaactgctgaacaacaaaggtaaaaatttaaacgctataaatcttatattgctggatgaagggagcaatatataataataaataaatatgagaaaattcgattggtagcataggtattgtccgagtaaaataatagcacaagaaacttgtttcttcgcctgaaagcacagctctgttagagatttctaaaatttagcacttccgtccactaaaaagaccaaaaagaaaacccttaggtcaatttcttcttcctcctccttccagtccctcactgcatacctcttcccctgttcatcgcttgcctcttgtctcttatgcatgaccgagacaccacgcataggcaaggtccaatttgtaaaatttaagtttttatcttacatgtgtatggtggttattgaagttgaaattgattagtttttaaggagtatatggtccttgcaatttttggtcatgctcacatcttcacctagcaataagccctagcagccgttgcaagcaagtcggccactgccagcgttgagctcgacggcttaaacaagctgctagctactcgtattccctaaccctcagccagtcgccatcttcaagcaaccaccagccatcgttgtcaacaacattgaaatagca

SEQ ID NO: 63757 - DNA, 4335 bp, Oryza sativa
tgcccaccccctcctctgtctccccgaggggtcgggccgctcctgtttcggcccctagggctggggcgccccgaccccctgtggtattggcgccacgtgtgtgggttaggtgggcacagcggcgctcaccaaaccacatttattgcggaatggacaagcgcgccacgccgcatttaatgcagcacggcgcacgcatatccggtccgtgaccggtcgcagtgtgtgaccggtcacagaccggtcagatcgcgggttaggtggcagcaggcggcctgtcacacgcctcgccccgtcccgtcgaaatgatgagagcctcttggcactcgtccctagctggagccggcgtggtaactcctggagttagcacgtcagtcccggctcgattcatgccaggcttcatcgcaaccattgcaaggaagtcactgtatgaagaagggcagatgtgcggcatgctaaactgacgcgtggtggagaagaatgaccggtctgtgactgggctgatgccggtcacgtcatcggcagacaaccgtgctcccgcgttgcatctgcttccggcggagtggaggtaggtatgacccatcccatcggagggtcattcagacagcggccattgcagatctcctcccattaatgaagaaatgacagggtgatcccctgtgtccgacgagtgacggcgctgggcatcactcaaggacaagcggtgatttagcttccaggcggaggcgcgagtgaatatttggtcaagatagggtgggtccccacccaaaagaagagtagatagaagtagtgcatgtggtatccccttgagatataaaaggaggactttgcccacctaagaagagaaaaaaagaggggggagagagaaaaagaactagaggagaaggaagagggggagatcgagggagaaaaagaaccagaggagaaggaaaaagagggattctagagcttgaactctcttgctctccatttgctctgtaactccttcacacacagatccaccagaacacaggagtagggtattacgcttctcagcggcccgaacctgtatacatcgcccgtgtcttgtgcatttgctctctcgcgaacgttccatagatcgagggtgaagaatctcactcagcgcccccggccgaaccggcaaaggggggcctgcgcggtctcccggtgaggagccccacgctccgtcacaagcgaatgaaacttgcagagttcgtgcggatatcacgtacgtcgttttgcatagatcatccgattctattcgtattacatggcacgattccttagacatgttagcatgatttcaagttagtctccacacatgctcgtacatattatcaggataccgttacaaataatccataagaatcaattttactttcaaaaagaatatgccaactgaaataaaggatgatcgaagctgctgattccgtccatcatcatttcttgcccgatttgaagtaaagctggacgacaattcgagctcgtgtttgaagtctcgttatttggcttatgcttattcctataagccaaagtttaaattttagaacttaattttgaatttgaatttttggttttcttattgtactttattttaaagcatttgcttttgagtcgctaagaatatgtatataaaagatttgcacataaatagtcttttatttgataataacttattcggataagcacatgaataaataaaataatgagctatgattatttatctactgacatatatgtataaattaaattggccctaccccttacaacgcacaaacatcttttctagtctacttaaaaaaatacgcaagtattcctgtagaaattcttgtacgttgtcctacactcgatccgtatccaatcgctccaccacgtttgttcattgagggcgaaaccatcctataccaagcggttgaatcggactcactgttccgggcgaaaacctgcttgacttaatgtaacaccccaggtaaccacgtacctagagtgccacaccaaacatacactcaaaccgctaactcccaaaattattagaaattttggcagagtctcccctgtaaatatggacatccacgacaggcaattataagttaaactaataacaatatcattcccacaatacgatccatccttataatccatggggaagaaactattaaaaatctaaaagattattacaagaccgaaccatgatatagtttaagtatcattatggacctaagcaatatagtttgatagtatacagataaatgtgtatataagggtgctacttcccgcccatgcatgtcggtctcaatatgtacctaaaaccaattaaaacacaatagtgagtataaaaatactcaacaagtacaatatggagctagaaaacacatatacacattattgacaataaagcgtaaacagaaggctttctttctttaataggaaacacattttcaaacaccaagtcaaagaagatagtagttcccatcccgggcaggcatgaattaaaatagtagtttccatcccggacaatagtgaatacatcctagcatttgccggcaaagccgagtaagcgtgatcaacgcttacccacaggaacttgaataaagaaccaaattgcactcccatgactacgcatggtacttgaataattgaaaccggaatcaaagaaccaaattgaaaccatattgcacattcatggcaaacagggaacttgaattatttacccagaaccagaatccggaatattgaaacaagaataacatcgtaaacataggataaacatgaaaacctaaatggcgcgaataacaatatgaatataagcggtcacatgtcacatagaaatatatcggaaataaatagatagagcaaacaatccatcaatcacacacttagttcgtcatgcacttgccttcaatgaagggttggtatcatacacgatctgaaggaccaccacctaatcacaaataaaacctcagcaaacacattcaaacatgcatataaaacaatgaaaaaggtgaacctactgccccatcctatcaaaacgcaataacaaggaacgccgcttgcactataaacaatattgttgcttcaaacctttatatcttgaaatatgaaaaggctatgaccgcaaataaatatattttggaaatctacagaacaatgcctacaactcttatgtggaaattatatttttattatgccattaaaatggtctaatttgcgcttgaaagcaggcttcacaatctgtccagaaaattcagactatccgcactaaaacaatcataactggagttctacttgcccaatcagagtgtactttaccaatatggaaagctaagaaaaatctctacaactttgtctataggagtcttggctgttccactgtttagcccatccaaaaacagttcaatctactactatccagattatggcataaaaacaacagttatactcaaaaattcgtatcgtctaaaccacttgagataaaatcgcgcccttcggtcagaagatagatataaatattatctacaactttctagttatacactttcgcagaaaatatcatttagctctccgaaacttcaaaaaaccgaaacactgtaaatctgccaacatgcagaacagccaattcgaaccacaacaaacaaaactccttctctaaccttccttatccacaaattaaaccactaaaaccaccctagaacaactgatataacaaggggaaaaacctcacctataatttctttagagaacttgtgaggagacaataggggagactctgatctaatccctccttttactcctctcctcctcctcgttccatttttctatttcgctttttgatccaagctatgaaggtggagatctagggagggcaatttgttgtagaggggagagatgcgaacataggagaaggggaggaaggaggcgccggccagggagaggggtggcggcactatgaggggaggtgggagtcggttcccctctctcttggttttagggagaactaatgggctgggtttatgggccttctcatgttggcccacttctaaagatatttttcttttatttatttctgttaacatctttattttaacaagttaacccaaactaaaaaaactaaatatcttttaatatacggggtattacacttaaatacttaattaaggagatcgagctatagcacattactccatatatatgtggggctagctggccatttgtagtgtgatcgatgaagatgatagagacgatcgagatgcctaacttgcgttgctaattaattaacatgcatacacatatataatctaatctaactctacttaagaaaacactatgggctgcaggaat

SEQ ID NO: 63758 - DNA, 2581 bp, Oryza sativa
tggggggggggggggggggacaactgcaaggggagagccaatggcgatggtggtggcgcgacaacgaaggagggcgcggtaacaacgacgagcttagataggccacgccgcccctgatccatgtgcgggtggaaggggagagccgggggcgtggagaaagaggaagaatgggataattcagtggaaggggagagctgccgccgtgtccctctcccgtcgccgccatgttcctcctccggcgccgcgacttcaatctggacccttgcgctaccgccgcctggacgtcaactctatcgtcgctaggaacaatgacttgaaccctttctcatcttttctctcccgatcctacccatcccagacttaacggttagatgtgttttggtacctagcggtaccataaagatgctccatggtacgagcgtgatatgacaagtagtagtactagtacagtccatggtacattgagattcaattacaacaatcaattataatgagtaattaaacaactatataaacaatattatagtatactacatgataagatcgatagctctatagcaagctagcttactgcttgcaattatttctgtagatgcagccatggccggtgtagggcatggcgaacgcggcgcacgagtgaccctgcaggcagacttgcttgttcgccgtgagcccgctgaaggacccgccctgctgcagctgctcagctccgacgaccgccatcgccgccgggaacaccacctcgtcctccagctgctgccgccgccgccgcggaagcagcagcatcgcgcctgcagccgcgtacctgtcgacggccacttcgctgccgccgccgccggcgacgacgacgacggtgacggcgtggaggaggaggaggaggaggagggcggctgccagctgggcggaaacggccgccgccgccgggacgacgcggcggcgcatcgtgcacccgcgctttatatattttttcctcctctggccgatcgatatactaattgcgcgagcgagcttatggtggtagtagctgtgaacgcttggagtagaacaattattggaggttaagttgttgctgtcttacaaaatgtctccaagtgccaacaacagacatgtgagtccgtgactaactagcagtatactccatttgggtgcattgggaattggattttcatccctggatggacatccctcatttctgctatactctctccgtactcgtaaagtaagttgtttagaacagcgacacagtcttcaaaacataattttgactccttatttttataaaaatatttattgaaaagtgatatatgtatacttttatgaaagtatttttcaaagacaaatctattcatataatttttatattttcaattgagggttattcatgatttatattttcaaggtttgatttaaacattgtcctaaacgatttcctttacgggtacggagggagtatcatctaaatagttataaaaaaagtttgatgcaatttaataatatggattaatagaaattatatcattacacaaacatgcaagactaaattcaactttcacagaaaaaagaacaaattaacttcacaattatatttgttatttttgttccaacttgtagaagctaaatttgaacttacatatttgtggagtgatatattttatattaatctatcttatcatttttttaaaaaaatttattactatttagatgacatgcatgcaagaaataaggggatatcttctcaaagaaattgaaacactttcccggtgcatcgatcaaacacaaagaaatagtaataaaaaaaaaggccccatcaaaattggcaaaattcagaaatttcagggaaaaatggctacctttgagccaaatttctaataagcattaagaaaaactagcatattgtccgtgaagaaaataacattaccatgttattatcatatcttaattgttgtagatatttgttactcatatgtggacatttttagctcacactgttttttccttcccacaaaaattaaaaactgatgaaagtagttgacatatggactctctagccctaaatatcatttatttatttattttaaaagttgggaattggtagtaatgttggtagcaaaaccaccaccatcactagctattctcttttataaaaagtatatatatggtgggtgaaagtgggaggtcaatagacttgtctgaagctgcaccaaaatgaacgaaattcgccgaatgtcgaccaatgcagtccgattcccaaaatactgtcctacgcagaacagtcccgctacagaaaggaacaatagaaacgctcgaaaaactcagctttcctatggttatgacgaagatacttgcagtgtgttgtgcgctgcttggtggctaaacagaatggcggcctagggatcaagaacgtgcctagacaaagtttatcagtaatttagtaatatttacaatatcaatcaataattaaatatattttcataataaatttgtcttaagttaaaaacgttactattttttcgataaaattaattgatcaaacttaaacttaaaataatatgactttgatcaaaataaaaacggcctatta

SEQ ID NO: 63759 - DNA, 1720 bp, Oryza sativa
gcgtgcttatatatatacgcacacataatgttactccctccgtttgaggttacaaagatgttttgatttggtcataggtcaaactactttaaatttaattaagtttatacacaaacacaaatataataatatttataatactaaattagttttattaaatcaataatcgaatatattttcataataaatttatgttgagttaaaaatattattattatttttacaacttgattaaatttgaaatagtttgaccttgatcaaaatcaaaaatcaaaacgtcttgtaacctgaaacgaatagggtaattagttagtgctactaattaatgagtaagtttatgaagttatatattgtcagttttttttcatgaaacacagtcacagtacagacgtatatgctcatatattaattatacacgtgcacgcactgctacaatgaacacatgcacacgtacacgttgagcaccttcgaaaactggaccaatatatatttagattgacaaagccactacatatatctcgtcgtcaactatacgtgcacttagtccccaatgaaacactttctagtccaacgagtctaggcagagagtttcatcggggatttggtacgtaacaatgttttaagacggatgaagtattaactaaatatatatgagcacacgtgctaaatttaaaactttatcctagctttatgtcgccgttgcaagtgaccgtgtttgcttaatactctctccgtccttaaatgtaagggattttgatgggatatgatacatcctagtacaacgaatctgtacatgcctctgtttagggacggagggagtataagcaatgcatcagcatatgttttgatcaactggaacgtacagtggtgctaatcgatcatgatcatcagtgccagcgcacgataaatatttcgtggcgatgatgattatatcccaagtcctactacacttgaactaccggagccactagcctctacgaaaactataagattggcaccttgaatatggtcatgtggtacccacgattgcaccaattttggtgatatttcaattccacctaaattaaaattaccgaaccccagttctacaaatcctgctctcttttagaagaaaatgcaacattaattttttactggttacaaacttacaattacttggactccagataggggaacgacagcaagactgaaactctgaaaattgcacaaaggttttaattaattaattaaacagaaccgggtctactcaatactcccttcgtactcataaaggaagttatttaggacagcgacacggtctccaaaacacaactttgacttcttatttatataaaaatatttattgaaaagtgatatatgtatactttatgaaagtatttttcaagacaaatctattcatataatttttacattttcaaactcaacaacttgagagctattcatgatttatattcccaaggtttgacttaaacattgtcctaaacgacttcttttacgagtacggagggagtacagtttaatctaccctgttacgaatggattactgtttggatgacttatgcatgatacaagcctggcgcatacaagctagccactgttatatatgggctatacgcacgcttccattattaacaaagctatctctcaagctgctttggacacaactactactagtacatatataggagaccaggaatggcctcccattttattgagggct

SEQ ID NO: 63760 - DNA, 709 bp, Oryza sativa
attcctgcagccccgcgcgcaccgacctcaagctggtcgatggccgccctcttgtcgcgctcgagatcgctctcttaagcagaaggtgatggtgaccactgagctcacttctcaagttctctccatgcaatggctgtttttctgactgatgttcttatccagagctcaagttaaatggtcactggacaactccattgaagatcttctgtcatctctgcaagaaaaggtttgtatggttactagtactactaatgttcattcactgtctcataattggtccatagatcttctcacacaaaaatgtcaccttgttccatgtgtaggatctgaatgcagtgaggctcctggcagagaaaaccagagaggttggggaggtggcctacagatatgccatggaaggtcgtgttactgtgttggcaatgctgcttctggtggctgaagagaagatatcggcaccagtcagtgtagttatagagggcgtcaggacaaagaaatcaatctactactctattgtggatgaggctctgtccattggggatgctccagcccgggacagcaatgagaggagaaaggccctgctcagtgagattcagctacttaaccaatttggggcagcgttatggagagatcgcaacattgacaagagaagctggccccctctgcttaaagctgccaaagtacctctgttcatattgctgttcttgttgac

SEQ ID NO: 63761 - DNA, 990 bp, Oryza sativa
attcctgcagccctgagtttaatgtggttcaagttgcaaaaattatataaaataaagatctacatattaaaattgtccataaattgaataaatttatttaattctttttaaatgggctttaattagatttaatcttgtaaaattcataataaattatttgaagttagaatgaggccgttcaagtctcataattcatctaaaattatgatctacatgtttgtttactttttatgtatggtttatttggtttttattagtctttttctttgttttgcgtgttagcttgtcgtttccgtcgttgcgaaggttcgcgagtgcgccggaagtattcaagaagattaattgaataccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcttgtttgcattgattactttattccttgataccttgggttattataacttgactaattgagctttatatattggttcagctagatattagatataattgcttagccatgcttagaaacattagcacactattgggataacttatgactcactattatttaatgatggtttaaagatagttcacgatggtcaatcgtgattggttaattaattacttgtcaactaaaacttgataatggtgggttgtgagcacatggttttgagagtcgtgctcatgacaattaagaaccggttcgcgagctactattgtgaaacattaatcgtgccaaccacaagccagcgtgggcaacggctttaccttttgtataacatgattcattacggagcaccagactgagaagtggcggagataagcccacgggggtcgctggggagtccatgccttgttttatgagggggtgattatgatccaggaatggtgcactgtggtgagttgtg

SEQ ID NO: 63762 - DNA, 9344 bp, Oryza sativa
gagttgtgttatgcagagggtattgtcacagcctctattcgggtactttccagtatcgcgacgcatagtagacatgatgttgaggctgtgtcttgtgggtacagtggtacacctctggccagagtaaaactattcgaatagccgtgcctgcggttatgggcgggttgagcaatgtttttcgtgattagtctcacacctctcacaatagttatagatgttatacctggtaataatttgcttagctcctggtttggagattagatctgtacagccgggtatggttgttcaggatggttgggcctgtgcagcatgggtgtgctgttcagtgttgattaaaatttctgattaattactccactgttttacctctcttaaatgttttgctaaatgctgcttttgcaaatgagcctatattatgccatcctttggtatccttgtgcacgtgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttatcgttgtaattaatttgatgaatctgtatattaaattgtcagtttgtgtacctcggctgattcctggacgaggattttatgcacaaataagttcggaaattactagtgaatttccgggcgtgacaaactaggagggaggtagtgcaatagttgaacacaacgacgatgtagtaatgggacaaggaagcatgacagtagaaatttcaatatgccaagttgtccgataataggtaacccctacgtgaggatccctctcctctctcaaaccgcgctttagtaaccctgtattgctctggtagttcaagctgcacaacacggctaggtggagttagaacctttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttccatggagggagtgccgtagttagcacctgccagtcgctctgttgttcacgacattgtcgttcataagccgcgtttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccacataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggttgtatgcgccaaatggcggacaaatactcgtatcacacgcgaacaaaggaggctgcatcggtacggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccccgccccgcgccgcgaccacgcttggtcctccgggcctgtgctcgcgcgtggtcctgggagtaggtgaaaagatccggtggcacagtacgggtagcacgagtgtcccgcggaggagtggcctgcgcctggtcctgcgtctgcaccggcagtgcgcctcccagctgtgaggggccgatgacgtcctctgtcgagcctgaagcgaagtcgaagtcagtgatgtcgaagaggaaggtggaaggcaacaagcagtccgacgaggtcccagcatggtccagtggtggaccctgactcgacgtgccggctgcctgtgacgaagtcccggtgtactgccagaactgcgctgagtgcgaggtcgacacagctgcctgagatgctgaccctgcagcctgggagaagtgggcggcctgcgttatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggtggggtgctgaacggtgcacgaaaccctgaagcaatcggcaagtgaaacggctcacttatatgtgcgaggcatgtacagaaatagtaataaaaatacctacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcagctgctcctctacgggtaccggaatccccgcgcctaaacgttggatcgtcgttgaaccatcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcacggtgcctggcatagaggtctctagtgctcgcaacgtggggctgctactccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctaactgctgactcttgcgcgagtacctgcgaattaatgtgtaatattagtgtgaaacgacagatgttacaaaatattgtgaacatgcagattttaatgcaacaacggaaagcgtagtgcaagatcttaccggtgaacagcagctgggacggtggtcggaaacggtactgtaaagggctaacggaatccgaactaccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgtggcactgtagggctcccacacgacgtcagtcggcagaaggcggtcgaactccataacaaactcaggatacgaccgcctaacctggacgtgagcccatcggcactacaatacgagacgatcgatgtgatgtacaatgaacttatcaattaacttaacaatacgataagatcgatgcaacgtacttgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccttcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcagcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaagtccggtgttgcggtggtgtgccaacggctcgagcgggaggtgcggtgcgcgctgtactagtgcgaaacgtgccgtcagatcgtcctgccagtccacagccgtggttactggcccaacagcgtctcccgcgagcggtagccccaacaagtacgatacgtcctgtagggtaggggctacctcaccgtacggcaagtgaaaagtgtgcgtctctggcctccatcgatcgaccaaagctgctaggagggacctgtccacagtccatcgtctggccgggtccacgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtaaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattataaaatagtaataaaataatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtctgacgttacatcacgagacctaaagacatgacatgccgaagtctgacattacacgacgaaacataaacacatcgataagttcgaaacgaattacaagaaaatccacatgccgacatagaacataagaactacaccacgtagccagacgtggcacgacgacgcctaggacgtggtcgagtggaggtagtgccttcacccgtaggtcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctgatatgccacactccactgcggcagcaatgacatgggtgcatggcctgtggagcagcttcggctttgcacaagagcaatgacatgtgccgtcggctttgagaacacactcctgcttcactctcttgcggtagatacccctgcctgacttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttctgaatctccaatccagttcttctaaccaatgttggactatccgttgggagaggtccaagagcttgaggagggtcagcaacggcggtcgatggagccgctgcacgctgatcactgcatttggctgtcaactcatctaatctctccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgttgttagtatctggccccgatactttcctatcaagaatgtcccatcaatgcagagaacaggacgacagttcacgaatgccatcttgcatgcatgtagagctaagaacgccctttgcagcacactcttgctaggatgttcaattgaggggaatttcttcacttcgtaagagctcccagggtttctttcctcgataacaccaagcaggtgtggcaaattgtcatacgaggcttcgtaagttccaaatctcatctctattattttctgtttggccctccaggccttggcatagctaatagtatacttgtatgtctcttcaatgtgtcggattattgaccttggttcatatgtgagattatcgatgacatgcgcatacatctcagatgcaacaaatgcacatgtaatgttcctgtggtatttctgaacactaggtagaaaacatgtatgcttggtaacaactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataaccttattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcgccatcatccatgttcgtctgcacacctggatccttcgggtgaacaaacggaaccaaagctagaggccacccgcgttgcaatgcattttccaaataccatctccacactcaagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaatttccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctataacgtaatatcttcttgtgtaagccaatgccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggtttcgccccttcttctcttctccttccctctcttctttttttttcactggaattgaggagagaagaatgagggctgggggctgggcagcaggccttctataggcagcgaggcctgccgcccggccagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgccgccccagaggtgggcggcaggggctatttctgcaatttttttggtcgatagattatttctgtaaatattaaaaaaaaatctaaaaccgaaaaaaagtcagaacaggaaaagaaagcctatcttggcccataacttatttccttatttatgttgtcaccgttatgggccaagatgcatccgggttggcgagttcagctaacggtgctagagatgacaacggggaatacatcctatatatgaccataaggcctgaggcctaataacccagcccacggcacggccatttggctcagctcaagcatggcacgatacgattggtgtcaggctcgtgccggcccggccagacagttgggccgtgcctagccgatgccttggcatggtgggccgacccggcccggcaggattaaagaaaaaaagttgagggaccctatatagacttaactcagccatataagacacggcccaaagagaagaggaatacaaaatagactattccagccatataagacatagcccaaagagataaggaaggaaaaataggcttattctatggagaagcacggtggctattgtgtgtttggtccggcccaacacggtccgagtctgactcgagtcgtgcctaggccatgggtatagcccgtgggtagggggctgcaggaat

SEQ ID NO: 63763 - DNA, 1426 bp, Oryza sativa
actttttttttctctgctagaaaaaaatacatatatagtcttatgttgtcgtatttgtacatgtccatatcttaaaaaaattgtttcggcctaaaacggtcgtaggtctactcctggattgaaaataattgttgtgttcttgcagcacaagaagtctgtcaagagagaagcactagcatacaagaatactgcaccctgtcaaccattttaataagagataataaatatcataatgataaagatatttaagatgatttaggacagggtcagctcatcagatgcgtccaggttactctaatatcctgcgatttaatttcatattcgttttgattcccccaaatcagcagcaccagcatggcaaaatcacacaagatcgcctttcacctgaatacaaatatttttggatcacacgagattcgatccattttcagtggtttcttggcctgttgctcagctatgttcttgtggtcaaaccatttttctgaacctgtcatcctccaggatcagtgccaggttctctgaatgtctcatgttgctctcctgttttttcagtcttcctgatctccatttggcttatctctaggcatccaccggatcacagcatgtgatggaaaaatattcccctaatcttgtcgacatttttgcaggattgattcagttttaactttagattttcgccgtattttgcgaaagactccaaatccagatgctcctattatgcaactttcaagagcttctggtatgtgctgcatgtacatacatgatagttactaggaagattcattttgcatttacaggtaatgtaaagatgaggctgggatgcctaggtgcagttatagcatggatcgtcacagaatcagctaattgaggctaaaaggagcatatcttgatgaattattgggatggcaatgcaggaatagcatcaatcaatgtggggaaacaagaggttttaatcacctgcattcctggattgcaaacaacacatacatggcctgccttttgctgacgagatatttaacatattatagacacaaggacccacatgttataaacgtattagtaacaaattgttaaacgtcacatctaaaagcggtaaatagttaaatacttaactgcccagttgttgacagtaggccggaaacatgatctgtaatgaacagtcttgatttggccatatagcagatactagtagctactagtaacatccacattctttatacatcttttcatgaaacagatgtgcacatcaactctggcatataggtccagctggaaccattccaagaatctggtgccatatgagtaatacagaagggctgtgtctagttcagcgcaaagtttggattttggttaaaactagttgggtggcccgcgcaattgcgcggctagcacccatataaaattatatatttttaatataatttta

SEQ ID NO: 63764 - DNA, 896 bp, Oryza sativa
attgctgagaattatgatacacgtgtcgaggatatcataaaagctatgagaaaggacactgatgtgaagttcacctttgttgtggatggaaagaaaatgattgtcccagtaactccagctcaaaatttaactgatgttaatggaatatacatcatagaaattacagatggtaacttgaggctctgtttagtagctgataagtatcagaattggttcagaggatttattactgataaagggaacagatttgagattgatcacgacactcttccaaacataatgaagaactctcagtcacttcataccaacgggatgtatcctagtttacttggatgcgaagtgtcagagctgaagattgggtaccatcaacttcttgcagcattccatactttggctagatatggtgagggtaggagagatctgaagaaagctaaagaagcggtcgccattttccttatcctgctctttgaaggccctcggcttctacctgtggaacaaaaaatgatgaattcgttgacccaaaatctggtggcagtggttggaactgataaggagttgataaacaattggtgtggcatgagcaggaacttctatgatgagaacggttatgagatggaggtgattatctcagaagaaacctcagagatagtgaagaatgctgtgaaaacttttgggatcatgtgccggtcaaggtgggatgaatgggtgggtgagcagactgaagctgcgcatggacgacaagctcggaaacaatcaagaggccagggcagcagcagcagcagcagcaagaagcattgaggagtctggatgctattcttgagtcaaaacaactaatcagggtgctaggaaattccagtgctcactcacatacatgctctgaaattttgaatgttact

SEQ ID NO: 63765 - DNA, 2931 bp, Oryza sativa
tgtcagttttgtagtggcatctacaatgctgctatgtacatatgcatggtagcagatgttgtttctagaggagccccctaattgagcaggctttataagttttgtcaatcagaatattgaagtttgtcagatatcgccgttgttggccgatgggatcgcggcctcctacgccgagccgactggtctcttcttcaacgagctcgacgccctggccgcggagtttggtccggctgtgccttcgccgcccagggtatcgcctgtgccgccgtccgcctccggtgcaggcacttctctgccgaggactgcctgcacaccgcctactggtggggagtggctgaggcctgagtcgccgcttcctcagcaggctccaactttggtggttgatgtgcctgacggcgtcctctacgatgtgccgatggttgtccttgacctcgatggccgcccactggcgcactcgcttccatcttctgtggcagacaacgccgctcttcgcgccttcctcaccagctgctccaggcctctccctcctgcgctcctatcgccgcctttgccgctgccgcctctcgctgccaaggcggtgggagttgtgccgaagcgcagtgagcgtatcgctgctaagatggcacttgaggcgcttgaggggccgatccacgcagtgtcgcgcgcccagcgcaacctgatgcggaagctcggcctagttccggagaggggcccggtcacggccgaggcggtcgcggcttacaacgccctcttctccaagccactttcccaggagcacatcatcgcgctctcctcgctcttctctagctccttgcccccggccaaggctgcggaggagttggtcgtgtgcggctgatcggtttcttctcttctgctctcggtgtggtccccctcaatgggatcatgcaacgagaacattttggtgtggaacgtgcgaggtctgaactcgcgcgcccgccgggatgctgtgcgtgatgtagtccgtgatgagcatgtctctcttctctgtcttcaggagactattatggatgtaatcccctctcgtactattctggaaatgctaggcctcgactttgattattctttcttgcctgcggtcggtcggagtgggggggtgttgcttgcctggcggacgaccgtctggtctgtctcagatgttcaccttgcggaattctctcttaccgcgttggttcgacactcttctgatgtcgccccctggtggctctccgtcgtctatgggccacaggaggagccggacaagcttcgtttcttagatgagcttcgttcgctgcgctcctctcgcacggggccgtgggccgtcgtaggcgatttcaacctcattctcgaagctcaggataaaaacaaccttaatctcaatcgtcgtatgatgggtcgttttcgtcggctcgtcgacgagttggaactccgggagctgccgcttcacggacgtcgcttcacttggagcaatgagcgtgagtcgcccacgcttgttaagctcgaccgcgttctcttctccgcggattgggaggagcttttcccctcttgcctcctccaagcggcctcttctatcgcctctgatcactgtgctcttctccttcatacctgcgtcacctccccgaaagcgcttcgttttcgttttgaggccttttggcccaagttcgacggctttcttcaagtcgtgcaggacgcctggcatccccctgccaacctaccccctcttgccgctcttgcctggtgcttctctaccacggccaagcgcttacagagctggagtgaccgtcacattggcagtgttcgtctacagcttcagatggcgaaggaacttgtcttccggcttgatgttgcgcaggagagtcggtctctttcctccttggagacctggctgcggcgagatttaaagttgaagtgtcttggtcttgcctcgcttgagcgtactatcgcgcgtcagcgttcgcgtttggtctggcttaaggagggtgacgccaataccaagttcttccacctgcacgccagagctcgtaggcggaagaacttcatcacacgcctttgtgatggtgaccagcttgccgtctcccatgatgcgctgcaagagcttgcctcctctcacttttgcgccatcttggggacgagcgtcgagcgtgaactcgccctagacctccactctcttggcctccgccctgcgcagcttgaggggctggactgtcccttcacagaggatgaggtctgggcggtgatcaagtccttgccctctgataaggcgcccggtcctgacgattttacgggccgtttctacaagtcttgctggccggtgatcaaggtcgaaattctggcggctcttaactccttgttcctgaccaacggccaaggtttcgcttccctcaacgacgccctaatctccctcttgccgaagaaggacgaggctgttgacgttaaggatttcaggccgattagccttattcacagctttgggaagctgttctccaagatcttggcctctcgtctctcccctcgcctggacgagcttgtggcgcctaatcagagcgctttcatcaagggccgctctctccatgacaacttccgctatgtccagcttgcggcaagggcgctccacgccaaacgcgttccccgacttcttctcaaggtggatatcgcgaaggcctttgacacggtcagctggcctttcttgcttgaggtgctagcccagcttggcttcagtcaacgttggcgtgattggatctccctcattctcagtgcctcctcttcccgggtgctggttaatggggtgccaggtccacggttcccccatcggagaggtcttcgccaaggagatcctctttcccccatgcttttcattctagtcatggatgtgctcaatgcgatgctccgcaaagccctgactcgggtggttttcttcccctcaatgatcatgct

SEQ ID NO: 63766 - DNA, 1400 bp, Oryza sativa
ctatagctcctgacctcctccacgtcgtgcctccacgcttccggggatcgcacacagttgctgctgggttagcgaacaactcctgggttggtgacatacgtggcgccctcactgtcccggtcatctctcagttcctgttagtctgggacgcggtggttcctacccagctctcgccgggtgttgaggatcacctcgtctggtgttggacgggtgaccagtgctactcagcgcaatcggcgtatcaggcgttcttccttggccagcactcttttgcctgtgccgacttactctggcacgcgaagggccctgctaaatgcaagttcttcctttggtttgcatttcagcagcgctgctggactgccgatcttctccaaaagtgtggtatcgatagccactctgcttgccccttttgcgctcaggagcttgagacagcgaaccacatcctcatcgattgcgtgttcgctcggcaggtctggctccgtgtgttgtcccctcctggctgggctgccctctctccccctcatggcagctggctccaggattggtggtcatcctccagggtatgtttacctgagcaccttcgcagcagcttcgactccttggtactcctagtctcctggcagctgtggaaggaacgaaactccagggttttcgactctgcgctcgcttcggtcgcagtggttctagagtccttccgctcggagggccagctgtggtctttagccggtgttgcttgttttggggatttcttgggagtgtagcgtggctctgccccctcccgctgtttggagttgcgtttttaaccgtcgtagtagttcctagcttcaagtccccccccccctttaggcataagccagtctagctgattgctttgtgtaacaaaaactcttttcctgctaatatattgacgtgcaatccttttgcgcgttcgcaaaaaacttttgccggatatcttttctgtttattcaagatgtgtgccactgcacattactgcatgcatgacaattgctttgcttggttattttatttcgcgactattttcagagtcaattgatgtatgtctctttaaatcatattatttcttctttacttcgatttgtgcctccaataattagacctcgtctcgtgtagagtactaatccaagcagtatgttatctccaattgagaaattggttggtgaaaagtgaaatttttgtttgttcctttcgatacttttttggatcatgagtacgggagacatagctaaacaagttccatgttgcgaaacagaaattgtatgcctcagatcttcattcctcggattattgtgaggatttcaagttatttcttatttcacaattagcataggaatctctagcatttacatcttattaaggtaaaagcttcaagataaacagca

SEQ ID NO: 63767 - DNA, 1083 bp, Oryza sativa
ttggtgaatgatgctgatcttaaaatgttggtgaattcagtgcatctttcaatcaatgtttcaccttgggctcatcctcagcctcaggtgagtcttcagtccgaatacagagttggaattcaaacagtgcacggcttgtcaacagatacctcaagcagggctagtcaatggtaaacacgccataccatacaatgagggaacacgaagtattacatcatgtatacgagttatttttcagtaatatcacatagcacaagtaaatgtgtaagaacgcaatcaagagaagtgctatgtacagtgacgatgttaataagttttactagattgtgattgtgttcttgcactgaaagaaatatccaaacttacaaaatagtgactaaatgtcaaacgtgccaaaaaataagtatggaagtaaacagtcacatgtttgcaagttaaattacagtctttggcttcacagatacagcttcataattgtaaattgcatgcctgaagacatagttgcgcagaggttccaagtcatcccgcaccgcaaaaaagccgaagattttggcacgtccaggctgagtatggcgatagccggagattttcaggtcaatgaactggagcaaattcttcgaaaggcacctacacccatttaagcaatcaacggccccagcgctgtcgacactgactacaaaattgataacgaaagaatgagaaatatgtgtggttccacagtcaaatatagacaatgatgtgataaatgatagcacaagaaaatttaaaggagtttatttaaagaaggcatttactttcagattcatcatcgagtcggtaataagaaccaaaccaatgcctgcgtttatcagtgagaggatcattgaatgcacggaaaagactgagcggtgacgggcctccaaggcgaagatgtggaatatcaaagagtgcatcagtctgcacagaatggtcactactaagcctgggaaaatcatcaactgtaaaagggcggtgctttcctacataaaaaatcataggataatcaaatcaactcaaacaatttccatggctctggagtttgatgtaccaccatctaatcatatg

SEQ ID NO: 63768 - DNA, 1507 bp, Oryza sativa
atctgcaacgagttgcggatttttttgttttcttgctgctctctgaagagcaagtgcggatcttgcattctcggtcggatctctgcgtttctttgcaaccatcgattccactgctttgcttcttgtaggtttctttggttcgatggaactcgctttatgcatgttctttcacttctgttcttgtgaatccttcgatgtgactcctgcggtttttttcaactatattattttgttttatgtgctgttgatttcccttccagtttactaattcctactgcattgtttaatctttacaggtgggcttcaggactggtggtgataactggctgttggtaaggtgagggttttactttttaatgtcatctgcaacaatttcatgttgctcaccaattttgttggactgtgtgtgggctgtttcttggtgcttatggttgtgggattgagtctcctgggtttgcttccacttagacactagcagtataatgcacataaagttgggcaaataagtttaatcatgcacataagttgaatttgatgcacatttttcattactttgatgcacataagttgggcaaaattcaagtgactgtcaagtcatattctgttgcctattgaacctgcaggaaacatggcagagaccagaggcgtgggtgggcgccttgcggcattggcttctaaggtggactcgaagatatattatctcaaggatgtgttggttgagtacatggacatgaaaaatgtggttgctgaaatagcagaggagagggagaggttccagcttgaacagcgtggttcgtggccttctcacgaataatgttgtgcttcgtcgattccaatgttgaactattatttagtaaaggtgtcatatgtaacttgaaatggttatggcaggaaatgacgcacttctggaagcaatgaaggaggagcttgtggcagcaaacaacgagctcgaagcagcaaaagaggaaatctctcgaaagaacaatgagctagagtctgtaaagaaacagcttcaagagagtgaagcgagaaatattcaggctgagcagcagagcggcattgtggttgagcttatgcaaccaagaggggtaataatctatagttcctgcccccaaattattcataatttcttcatggcattgactaaccacattatgttttcaacttattttaattcttcctatttagccatgtaacttaacacctcacaaatgtctatatttttcacatcatgccttagcatactttttgtactaataaagtaataactagcattttttttttgcttggagcaggtgcaaacaagatcgatgcaaaaacgcaaaaggccattgcaaggaccttcgggctgtgaggctgatgaccaagagtatacgagtcaaatcaatgtccaatctccacgttgcttggaatcgatgagaactcctgatgtatggaacattttgtttagaatatggattctcaattcttgatattttcattatgtgcctaccaaatctataagcta

SEQ ID NO: 63769 - DNA, 966 bp, Oryza sativa
catggattataattgctgattgatctcatatatttactgcttcggtagcaattgtttttatagtaacaaaatgtgggatacaaaatcattgctactggtggttaactgattgtatcatcactcatcagggtggtcaacaatctttctagcactgatcagaaattcacaagtagatggcagttttacattttacaactagcagatggaagttttaatttttgaaaattagcataatggtactttcatgttttttttttagttttaggcctttagctcgctttgattatgtttagtcaccttagaagctgaaacctaccgccattcttttaccatcaagtgttcgacgagtgaatgctacgtcaaacattgcagcctatatgaaacactttccttcacccccataaaatcttataaggaaaaatgcttgtgtgactgcaggggaagttgacctgctggtggcaccacaacaacacaagggtatattgcaagaatgaacttgtaaacttcacttcaatttcttactgcgtgatgttgtgaattttactacctttttctttctacgaataaaatccttgactctcactttttctggtagtaactagaaatgggactgctcattcttcaacttatgctattggagtacccacactctccagtacctttgccttgatgttcattttagttcccacaaatcagttctcaagaacatgttattgtcaatgtatatgcatttatatttttaagaatatttatacgttgagctcatttcgccatattgctgtttttgcaggtggtgagggctgagttttgggggcagtgtatgactaatccatgaagttcctgagcaagaatgggaagtcttagcttgcttatgtcttttgtaaaaatgttatgactaggaagtacgaatcctgaagaacctgatcgtatgaagcaacggatggaaaactatgaactactactact

SEQ ID NO: 63770 - DNA, 2067 bp, Oryza sativa
acggcggcggcgtcgtgcgcgaccgcgtcatcgcccagtgcgcgcggtcgcggcggtgcgggctgctccggtgcggggcgcgcgggaggcgcgacgactgctacgacccggggaacgtgatgcggctgttcaagagcgctgccttctgcctccagccgcggggggactcgtacacgcggcggtcggtgttcgacgccatcctcgccggctgcgtgccggtgttcttccacccgggctccgcctacacccagtaccggtggcacctgccgcgggaccacgccgcctactcggtgttcgtcccggaggacggcgtgcgcaacggcacggtgaggctggaggacgtgctccggcgggtgagcgcggcgagggtggcggcgatgagggagcaggtgatcaggatgatacccaccgtcgtgtacagggacccccgggcgccgtcggcccgcgggttcacggacgcaatcgacgtcgccgtcgacggcgtcatcgagagggtcaggaggatcaagcaagggctccctcccggaggcgacgacgacgacgaccaccggtgggatgcctacttcgacacgcagtgaatgatgcgttgctcgattttttttttttggtttgattttgtaggcagagaggaggatgaaactgaaatggtagagaattttagaattttttgtttggaaacaaatcgatgtagttcaaaaagaaagtttaagaggatttcaattcaaaacagagcaatttttgggcctatccaaatacttatattcatgtcattacaaatcataccattattaaataaaaaataataattatgtggttgtatttagtttgttgccgaatattggtaatgtctattaaattttgataaccctagcctatcttacggaaacttaacaatgttgataatttgtcgaaattttgggaagtgttatttttaccttgtaaaactcccgaatggggtgaaaaatatgaccgttggatctagcaccaacggtacggacgttggccgcgcgccggagatccacccacggcggcgcccctccacagccacgccggacgggaggcggaggcggcggcattgggcgctcctgggccggcgaggccgagggcgagggcctcttcggcgacgacagcgccgccgccccggtgacggcgggggccgagcgtcgacgagggcgaaggcaccggcctcatcccgctgcgcggaggcggaggaggccggcctcgtccccgccggtcggcccggaggatgccgcggcggcgcaacgacggcgacgcttcgtttccctacggtgagaaagaccgtcgccaaatgcactacttatattgagtataatcatcaaagagaatttggaaagcttttcatttcgcataaggaatcaagaatgtgtgtgagaccggatgctgaaagaaattgggaagaggggttagttagggtatatatgaacttcaaaacttgctgctggctgctacttcctgtcaatatttccttctttgggaaacgattcaaacattttgtatgaattttggctgcagttgactagctgaagagatcaagaagactttgtatggtttctaaaaaggaaaaaaaaaaggcatgtgaggtaatattgctgttccacactaatcttgccaagacagtttacaaatcaaatatttagtattcttttttattaaattcgggtttatcagaatcaaattcaaggggaaaaagaatacaaatccatgctccagccgaaagtagagtatactacctgctcttttcaaggattgaaaagttccacctagctgataccaatgaatatgcatacacaaatcttctttttaaacattctaacaaaattcaactttgaccttcaagaggaatctgacatacacaactgaaatgcaaagaaatcacccaacggacttagcatgccttacaccttcaatctatgaacaattgcaagatatacatggaatgctccctgtctgaaaccaagtcacatcatcctggaatgatagatcaagcaagcagaacggttctgatcctaatttcctgaacacattaaaaaaattcatgaacgcctg

SEQ ID NO: 63771 - DNA, 1207 bp, Oryza sativa
agttacctttggaacctcctggctgtggtgcctgaatggagcaattttctggatttctgcaggcaaggatcctctagcaacagcatcctttacctccactctcttcccaagcatgtacacatgatgagtttcctttgcacttatcacatcctcttctcttttgaactttacaaaaccaaatcctcgagattgcacccgatcacccatccttatcccaatgactactgcttcctccacaggtccaaattcagcagtgaagaactcagtgaggtactctgccaggaagaacaaaacaaggtaagtgttagaacttagaaacacattagttctaactttattaagtacaagtagttcaggattctgaagtttaccagcgcccacagaaggtgggaggcccccaacaaaaattttccgagtgtagtcgtgcttcggccaatgattaggctaaaagaaaatcttataagaggcagaccatgtgaagaaaaagggaattggttaatataggcagagtatgtttgtttacccgaggcacaaacttggaaccttgcttgggagcacaatggttcttactcttgcccccttgggcagaaccattactagaccggaaatcccgatggcttgctgatgttttaagcccagtaaagctgccacattatcaaaataaatatattagtttgaaacgtaggatgagaagcaaaggttctagtatgcaaaagaatggaagatctaatataaatcatgcagtatgcaccggacatacctttcatttaaatcatcactgtcataatcaccaaaatcttccaggaactctttgcagctttccttattcgtcacacttttttttggatgtgagctacggttccctacaaacagaatatatttcagttgaaaaggtatttgccgcgtattgatcgttatgcagtaaaaccaacaggaaaccaatcttgaaatctttttcattgaatcgaacactgctaattgtatgcactactacaaatatttttgtgatttcagttgataaatatctttaaatgtcagaaaatatcttacatggagccacatttgcagaggtaagaatgaaacgcatatcttgggacgttgccacgtctattggtctttgctttctgtttaatgtcaaaggatcaaaggatggtaagtgcatcaagtcgtcaaacagaagcatattcttcttaaatccaaatattac

SEQ ID NO: 63772 - DNA, 1276 bp, Oryza sativa
gcaggctcgcagcaaaaaaaacaaacgaaacagtatgaaaccacaaaaacttttcaaaaacgcgctgaaatttcgcacgcccgctgaaattggtcgaatcgtggcaccacaaataggtggaatacacacgaatgcacatcatcacaaaaacccaaatctccacgaaaaaaaaagaggaaaataaggcatgaagccatgagccatcaacgaacagcacctaaaaccctagcactggtcaatccaagttccagaagctccaaaacactggacgacgcatattagcagtacgcatggatgacttgtgcatcggacaaatccgaatggaagttctgaaaaagaaaaaaaaatgatgaagcattcccctactttgcacgggaaagggtcaaaaatccttgtcaaatgaggcaaaatcaatccaaaatccagaaatcaaaccgcacgatcaaagcatccgcaagccagtcacaaattttcccaaacccgcacaaaacgcaaaaagcacaagcgaaaaaaaaaagagagaggcagggataaacaaaccgtcatcatcgcaatatacataacggcaagtttaattcacgaggattcgtcaaaccctaacatctcacgacgaaaccaccagaattggagcaccatttcctcccccctctcgtcgcctcggcgagcaacagaggcaacgtacgccatgctcgcgagagctccgaggaaacaaaacgaaactcccagaaaaggccaaaaccacacggatcccagcgaaaatcctcgaaaaacccaaccaaaatcagacgaatcttcccctcaaaaaaaaataaatcagacgaatcggagaaacaacgcaaccaaaaccccccaaaccgaatcaacatcaaaccaaatgctctctcaagcgaaaaaccatcccctcgatcgatcgctggacgcggccgcctcacctctcccatccgcgctagcttctccccgaaccgcacccagcactgcaccaacctcctcctcctcctcctctccaatctcaaatactcctctcctcctcctccaccaactcaccacggggaagaaggagacaaaccaaacaaaagcgaagtactcgctgtctgctccacccctctctctcgtcctctctctgttcgtgtgtctgatccgctgcgactacccactcctgccgctgcaaggaatcagcttttgcatcccctctctctcgagagaaaaaagttttgtagctttgccgtttcgggcaagctaggctcgcagcggtgatcatggcggacacgggaacgcc

SEQ ID NO: 63773 - DNA, 1309 bp, Oryza sativa
atcccccgagccctcctccctcctacattcttcgttacttacctctaggatctcaagtcgcattgccttatcctcgagcatcaacgattccatgactgttggcgagaaaaaatccatggccaaatcgaccacaatatgcattgccgtagatccccttcggccaccgtcggtctgccgtggcccactaccggtcggcaagcggtcattgggacttaatgctcatcctttccctagccctagcagcaagcgctccttatctaaggccctatgtacagtggttgaggacgaaatagagaggatgacttgtgggatccactaggtgcaaaatggagattccgcctttgcattccacgctggacatccataggtcaagccacgctacacaaaaacttaagaagtatgaggtgtttggatggtgaccacactttgtcacaactttgaccaacttaacctagtgttttgtttgattaccacatgattgtcatgccacacttttttgttttgtgtccccacaagccataggcacatctctttgccaaagcttgcctaacttgtggttaaggatttctcagccacatcaagtgtggcatgccacatcttagctgtaaaaagtttgacagactgaaacaagcatcccctaggaaaaaaccataagaacgattctagaagtgacatttgaagagcggatgtttcttagattggcaaatagttgaatccctccatgcaagatgagtactacctccatattttaatgtatgacaccgttgactttttgtctaacgtttaaccattcgtcttattcaaaaattttatgtaattatcatttattttattatgacttgattcgtcatcaaatgttctttagcatgaaataaatatttttatatttgcacaaaaattttgaataaaacgaatggtcaaacgttggtcgaaaagtcaacggtgtcatacattcaaatacggagggagtacttcaaagcgaatatatttgtctacggttaaattgacctcgtttttactgtatatataatatttgacaaaaaataacatcgtaaaaaaactgtcaaatataaatataatatagtaatagtataatttcaatgtgatcagtatataatcataatataagtaggatataactggtatgtaacaataagaaaaatgtggtttgctcagtggtatcggccactgcatgcacatatgttatttgttgttcccctgtcgctcacgaatctcggggccaatctcaaacaacatcctcaatggtaaaaagagtgcaagatttagcagtgaaatttccgagtcaaca

SEQ ID NO: 63774 - DNA, 1563 bp, Oryza sativa
ggctagggtaggctaggcagtgattttccatgcatggtcaatgtagtggttggcaaaaacaattgaattgatggtcaatgtagtggttggcaaaaacaattgaattgatggaattgattttgggataagtaattatataatcaggtgttaattaaacttgttcgataatccatgacatatcatgtaggggctacatgttcaattcaatggcttgtttggatgtgtttggacttaggagtgagttgggatcctgattcatcgcagtccaatcatttggtacattgtccagcacggtaaggacatcttgaaaaactgttgctgctgaaataaagtgttctcttgacttctggtcacctgtagcttttctacagtttgatcaatcactcaatcctttgtactataacacattaacacttaattttacttttgtgatctcgcagtcgctgtaatcttttcctggcataaacatccctattgctactgaaaagagaatttactgtggattaaagttacagcatatagttccataaaatctgtcagctccaccgtttgctcttcactttattagccgcaaccaaaatctaaattctaaaactttcattttgtagttaattttaatgcttttgttatagtttatttttcagtgtcatattttaaaacgctaagaacacatatataataaaaaaaattactcatcagttaattctttttttctcgctaatgagcattatggtttacgattgtggattattttccttgctgtaaatcgaacaattgtcgtcccctcccctataatctgctttgagagcttggtgctctagcctgtcgtttttcctttgtccgctgattgttataattggtactctttaggcctgttcactttgataccattttcaaccatatcattttttttggcaaagttatcaaaaaaatatccatgtttagtttgttgtcaaatttgacaaatacataagaaatcccgcaaaaatttgacatttaccaaaatttggtaaagtttattttggctacaatctaaacaggccctttattccttctaatatatcatgcggaacttctgctgttaattgttttaaaaaaataaattgaataggtggtaacaaatcagtaggtgatgcttttaattacttttacacgaggatactccctccgtactcgtaaaggaaatcgttttggacagcgacacggtcctcaaaacataactttgacttcttgtttctataaaaatatttattgaaaagtgatatatgtatacttttatgaaagtatttttcaagacaaatctattcatataatttttacatttttaaactcaataacttgagaattattcatgatttatattcttgaagtttgacttaaaaattgtcctaaactatacgaagggagtatgatgtgatgtggtggctgctagccgcctcgatctccaacatcatcagcaaattgggccaaagggacatcgcagccgtcagctacatcgaaagctgctatatatacggacaagaacggctgctagcttaagtatccaatccatccatcaatgtg

SEQ ID NO: 63775 - DNA, 1663 bp, Oryza sativa
tgtataaagtattatttatgttttatcattaacaacaataaaaatactaatcataaaaaaaattcatataagacggacagtcaaacatagaacacggaaacccaggaattgagtcttttttttggacggagggagtatgtcactattactagcttgtagtaaccgtagcccgtgcaactacaacaaaaggacagtcgaataggacctatatacgattcatacacaaagtattgtctccattttaaaatataagacacaaccacccttaactcaaagaccaagaaataattattatcacatcatagtttggattaccgtaataaatagaatgcatgcacccaacaaaattagagatcttgataatgggggatttaaataataatattttagtgaaaaagatgtgttagttaatggcatgtatgcatgcacgcttatattatgaaacaactttaaaaagtaattgtgccttatattttggaatggagggagtagtataaaaggtagtgggtgggggaataaaatagtactccctccattccaaattgatctacatatagttttttgaggttattcctaaatgatctacatatttgtgtttattattaagtatattcgttatttgtgtattggagtaaatgggcattgatgcatgcatccatgcacacaagtatttataacccacatgcactatcttgatttgctattggctagaaaatattagggatgatgcatgcatcgagtttgttgctagaataaatatagtatgagagagttattagcttttcttggtcttggtgtgcctataaaatatgtagatcaatttagaatggagggagtataaaagttggtaggtagagaataaagtaccgtctcagtattccaaaacaccttataattcatgataaatttagaagaactcccttatattatgggatggaggatgtatttgccaccacgatgactatacatgaatagtgtttgcttatgtcacctattggcatccttcaatatccaactgtatccgacacatttttgtccctattgatccgattcatcaccgagctagctagagtggttgcatgcttatttatgccaattctattctacacccttctagttcgagaatacacgtatttatgacactagacatgaatatcaaattaagcattaaggttgtagtccacatataggactatacaatgaatagagatgtattgcgtagctgaaaattaagtagcctagtctgagaggcttggccaattgctagttccacccttgcttaattccaaacaaatttgcaggagatataccatatatatagctgctacaactaaattttccctctttacttaggtgtatatgcaaatgcatgtgcaaatgcacagtagtaaatcgagtcatcggcatcccatttgatcacgtacgacatcaatctgataggtcatgcctaccgtactatcagaaggctagcgaccagatcgatcggtctgctgatatctaccccctccgtctcttatattgattttgacattttgcttctgatgtatgaccactcatcttattcaaagaaaatttgtataaatataaaaagaagtactttagataataaagtaagtcacaaataaaataaataataattttaatttttttaaataagacgaat

SEQ ID NO: 63776 - DNA, 1173 bp, Oryza sativa
taattgattcgctaatttctctcattttgttccatccgtcttctttctgttaacattttctgttatgtgcttcagacaaaacaatgaggaggtacagcccaccatatcgcagtccccctaggaggggctatggtggcagaggaagaagtccccctaggaggggatatggaggacggagggagcagggttctggaagtctcttggtccgcaacatcccattaagctgcaggtagtgaaaattgataactatgcaaaattggcatgtcgattccattttgatgactgtgttcttcatgaaagagacaaatgtttcaattcacaagttacacacttaattcaatttcattgattaccttaactgtggcagaggggaggatcttcgagttccttttgaaaggtttggtcctgttcgggatgtttacctgccaaaggattattacagcgggtaaggcattactgaacaattatattaacataatttggtttgttagttgtcaattgctgaacaacatttatcttctttactctagcgtagtaaatgtagattgtctatatttgtctgtgctgttggcctgtcgttgaaatgattttagaagctgttctgatgttatgcagtaaaccacaaatataaccatttttttcatgacgggaactctcagcaaacatcttccagctttagtgtgttgtcgaattcgtcagtcacctttgtgcatttctgctcaaatagaatgctttaatcatttttttttgggtctggtgatctagttaatagatttattgttgtctcaagacatgtaatgcactccttgccctgagtttttcccctgaaattattcccagggtcatgttggattgaagtaaatacaatgttgaaggataccttttaatattcctaacaattcatttgtttggcaagataaagtcttttccgtacgaagttcttctatgaagacaagatttgtttcattgagaaaattagtttcacgaagagaagataagagagttgtactgggtggtccatgagaagataaatatgaagtgaagtttatttgaagtactatcatgacttctcaaacatttggaaacttgaagcgaatgattttgtgaagatactctttatgaggatcaccatgcgtagtgttacacaagaaattcagatactagagcctggac

SEQ ID NO: 63777 - DNA, 5451 bp, Oryza sativa
agggagaaggtactgtatgctatccatttaggatatgggtgtgactattgcgaaaccataccactgataccaacgcacatttctcaccacttaagtgttgtttttattctcgttgaaggtgcatccacaggtggatgaattgacctatcattatctaaggttttgttcgattaaaccctatctcaaggggatttgaaggatattgattatacacttctcactatcccctccaatctattactcctatgaaggctttgttcggaggcacttgctacggctgcggcaattcaaatcggctgtcagttgcaaccattcacaactgctgcaggctacggtagctagtctagctaaacgcagccgaattaaccaaacaaactctaatatggttaagggtttgggtttgtctccattttgatcatttttgaagaagttcacgtagtagtagtacaatactaaggctgtgtttagatccaaagtttagatccaaacttcagtcattttccatcacatcaacctgttatacacacaactttttagtcacatcatctccaatttcaaccaaaatctaaattttgtgctgaactaaacacagcctaaaatgaggaaaaaaaaggatttgaattttttcaccctccgaggggagacgcgtccggtttacccggggagggaagaagatgcagaggcgcagagcaccaatgcatatgcagcagctgcaggcggcagcagcgaccacttgtgacctgcactactacacgtcctccctcctcctccttcctctgctggcttcttgctgatttggtgtgatctcttctgatacgcatcaacacgagaagcatcgaatcgagtgtacatgtacagtagtcgacagtactactacagtatggacattcagccagctgcatcgatctgcgccgttggatcgacacgacgtgcggcccggatgcatctgtcggtcgtggactgtagcaaaccacagccagtgatgtgatgagtgatcaatcgatggatctctatatcagctgacctgatgcgttgggggatccaaggttactactgcgcgtgtatggatcaatctttggtggtagccagggtttacaaaaccatcttattattacgtaacattctcagttttttaaaccacggcatactttgttgtaaccgtaaccgtgcggttaccgtaataaccgtcaaactatagagtgacggtaactctacacaaaacagtttgacgaattatggtggtagcgtgtcctcttgttttctagggaacgaaagatgagagagttggttagaggggtccgtccattggagtactagcttaatttgatctcgattgatacttgcaaaggttgatgtttaatcatagattcggtcctcgatctaataacaatatctaacccctctgctcaatctaatttagtgctagtacatgtatctatctggtcccgttgcgtgtcttcttttctactactgctcatttgctttagttgtgttctttagttcatcggccagctgaaaaatgcttttattttcttagaatccctgccgtttaatttgaaaatgatgtgaatctgaacatatattcatggtagttcatacgaaattaatagtggtcttcatataatgaagtttactgcattacttaggatgcatccatttggaatggttgggatctcctcttctgccgtacgtaaaatgggacgagtcactagcacataactaattaaagtattggattaaaaaaccctgaaaatatattaatataattttctcaagcaacttcatatataatttactagtgccaaaaccgaactgtttagcgatttgaaaaagactgagttcctgcttgaggttccaactctcctccctcgtttttttttgaaactgctaaacggtatgtttttttttgaaaaaaaaagttatgtcgtttgcattaacgttatgtcattgtgtgcttgatttgcaggggttactctggaaacgaagggcgccgctcttcatattatggtatttttagcattagtcattatttgtgataaggcctttcaaaatgcatatctataaatctatgccttttttaactgtactgaggaaatatgctctcgtcttatcacaacaaaattccttcagtttttctcgagtttcttctgaaaagttctgtttgctaattccttttgttgccacaccaaaattactgataggctttattgtttcatacagggaggtctcgttcccgttctcgctctccccactatcgaggtcgtccacggtcaaggtagatgaataatgtccatatatcaatcctcaagccattcaccttgtactcatgaatccggtcgcttttaaaaggtcatactctcctgctccaagacggcgagatgactactcagcttccccaccgagaaaggatacgcaccccacaaaatctcctaggcgtcagccaaaagaacatgatgaagagaagaagcggagatcctactctcctgccagtagagatggcgaccctcgcgatgctgataacggttatgagaagtaagcatagtatttcatacttccatcactttttccttaaatgcaatatttgttttcattattgcaatagggccatttacacaccaatctggtgttttacgagtagtaaccttctgtagacttgtaaagtatgatgaatatgaaaggatgtgggccttagggtcacttgaactatgggcagcattttaatctttgctgcatactcacgacagattttgttagtcttattctgtattaattaacaggaatacatagagtgaaagtgctaactatggtttatgttcttcacaggaggtcgcccccacctgacagcgatggatcccctccacaccggaggtctcctaggcactcctcagggtcgcctccaggatcccgctctaggtccgccgatgtttcccctgcccgcagcgactgacagaactttgaaccaacgaaatgggatagctgcatgatctccacagcacctccaattctagtcagtctccatcttccttctggtccaaccaagctgtttcaattaaaccgaagccctaagcggcgtgttgtattattgctaagtgtgcttgccatgagtttggtatggcacatcgcctgtttgtgtgctcatatgttgggagtccaggatgttgtagtcttttgagagctgctttgtttggtggtcatttgctttttgctgaacattaacttgaaacaatgtgacattggtgttgtgtactaccactagtgagccttgaactgggtaaccgcctatttccacatctatctatgcttgtgagtgcttagcccaggggcccatgctgccatgccaatattgccatcgactttgtttgggaaaaagcttttgattggatctaccactgactgggccagcagtacactacactgcctctcttttcttcctcacactgcaacgattggattggacttgtgaatgcagcagcatcatgctgctgctgcaaacgcaatcccttttaatcatggagcaattgttgggttgcaggtgatcgatccatggcgtgcattgcttccatggttgttgtcaatgtttgcaatttactccctaaatgtttgacattgttgactttttagcacatgtttgatcgttcgtcttattcaaaaacttttgtgaaatatataaaattatatgtctatataaaaatatatttaacaatgaaacaaatgataggaaaagaattaataattacttaatttttttttgaataagacgaacggtcaaacatgtgctaaaaagttaacgaccgtcaaacatttcaaaacggagggagtatttatttatttatttttactttcatgatgcagcagtgaaaggcaggggttggtaggatgtgtcacgcagaaagtgtactgctttttgtgcgtggttgggtttgtgttgtgttgcttgattgcaggcactgcagatacgtgggctttgttgtggtggccggcctgaaaagttgacaaatctgtctatctgtccgctgctgactgctgtctcatctttcggctgagaattaaaagtggcaacggttcatcgccctgacgaccatcgttgatcgatccatcatgcaacaggatatatatactgcatgagtactggtactcgtagagtcgtagtgtatttctcggagtagcagcatagcatactcattagcatgctgggtaacgattaatctaggagctgtccgatggcaatgatcgggtgtatcagacccaccaacccccccccccccctaaaaaaaactgttgcatctaaaatttgcagaccttttcttttattttttatggatctcacgaaatgtactagattcaatcaaattttatattcaaatattctaaaattttacaaaattcagtcctatcggttttctccgatagaaatagcctaaccaatactacattaaaccttggtctacaccgatcataatcaagtagcctttccctcgaggacgcaaatcacacggttataggttttttttccctcaacccacacctagggtttaacttttcggcttgaccgattgtatcggaggtcaccggtagaccgaaaattaggaatttttgaataaatattactaaaattcacgaaaagttaaaactttttaaatattttggccaaaataatatcgtaacggaggggtccaaaatgactgaaatttcagaaatcaaagtccgaaatttccaaccttgcccacacctactccctccgtaaaaaaaaaacctaaccaatgacttgatataacataggacaacgaacatgtccagtcctatattatatcatatccttgtctatgttgtttttttttatgaaaggagtaggtgggtaaaatacactcgatgggtgacctagaccatgcaaatagaaacaactggataaagtatagcacatatgaacaatcaatagtttaagttaacaaaaataaagagcacacacatatatataaattgaagtgcaaatttaaccattatagtgtatccaattccacaagttcaccacttaatttaaaaggtgtataaactattctagattctactttatactaatgcatgttcatgcttcatacaaccaatagtatgtatatgtgaccattcaattgttgtcgctacatgagaaagacttctctttatctcatttctttaaccttattggttcatcatccttaataagctcctattgtatgaggaccctaactcatttctttgaaaatggtgtatccaattccattatagtgtatccaattccacaagttcaccacttaatttaaaaggtgtataaactattctagattctactttatactaatgcatgttcatgcttcatacaaccaataggactgtggagaacaaaaggccattgccatttgccagtttgtcacataacaatttacaacatgtcataatatatattcccttctatat

SEQ ID NO: 63778 - DNA, 712 bp, Oryza sativa
attcctgcagcccgcagaggccggagatcgtggaggatcggagtcggagagagagggaggaagaagagacaagagaagcgcaccgccggcaatggcatggcatccgcattgcttgtcgatcagccacagccacaatatgtcgcgccggccggccggccacccacacagggacgcactacaacagaaacagcctatagagacggcttgggaaaccgtctttatcaaagcccacctcctatcccactctattactagatacagatggaagagacagatgaatgaaccgtctctatagttaaattaatccgtttgatgaaaatttgataagacgggggttaaaatccgtagacacggtccttccgacgggtgtagaaaaaccgcgtcaaacgcgtgcgaaaagatttgtttttggcgcccgttcgctaaattttttaaatctacgcgcgttttctgatgaagttcgcgggatatttttcgttcactcggaaagtcggaggtggttacgatccaactaaggtacaaaaccaatctattatccacttctttcaatctttcaatacccaattcctaggaacgccgcccagccaccgcccaccggcagggctccagcctgccgtgcgcctgcagcattgccgcgccccggcgtcggtccggcacgtgcatcctaccaccagctccggcgcgcatattcgtgcagccgttgcccagcgcg

SEQ ID NO: 63779 - DNA, 1167 bp, Oryza sativa
attcctgcagcccttgcttttcttatataaactctttgtaaaacaaaatacactacattaagagtctacaatcttttccaacgtagaatgaagtatatatgaaattggctgagaaaagagtggattgccaagaactcagtgaagctgattttgaacaagctatgttagaagtgcttggaaaggatcataggggtagagttagaggcatgggtccaaccattactccaacaaactattatggtagaagatttttgaatatatcaggaagcaatgaagggaatggctccagtaatgtaaatggtttcattagttttatagtatcatatttgactgagaaatatccagaggataatttgatttctaggttgccaccatcagttgctagggtcattccaagacaagaggtatggccacaaaattactaattttaaatgttgtaacttatatagccataagcttccagaataacaaattcatgcatgtatcttcaggttgatcagaatgaaggaagtcagccaccaaatactgctacatcctctcttccatttgatcagaaccatgaaaatcagctaccaaatactactccatcctctagtgctagagcatcatctcagtcttgcagtgaagaagagtgatttacaatggcaattgtaccattccgtactacttgctgcattagaatataattattttttgtgttaatttgtttgaacctattgtttcattgttatatcagaaaagatgttgaagtattttcattgtgaacaatgtatagatattgcttttgattttaatgacaagctactggcgttaaaagtcttgttaatgtggtctgatggtaattcaatctgttggtattgttttgtttatgggttttctgaatgaaagatgtattgattgttggcatgtggccaatagcggggttataaataataagtgtagatacaggcacaaccgtgtctatagaagcagaaattgtctctaggaaagaaataagtaataaattcattatgaatagagacggttgtgaccgtttctagagaaaacgtagatgtatctactataagctagacatggaaacaaccgtggctaagatcatcaagtgtctctacatgatcaatccaaaaatttgtatttcaaatttgacacggtcataatttaaattag

SEQ ID NO: 63780 - DNA, 8764 bp, Oryza sativa
  unsure (1)..(8764): unsure at all n locations
cagttgagagagagagaggggggggggagagtactccctccgtcctaaaagacctaacctagaaggagatataacccctcctagctataacaataaatttgaacatcccgaaccattgtactgggagggtcttatcccattatagaaaatagatcttctgattttgagagactgacacaagaattttatatcttgggaatccacgtatattaacaacccatattagaagatactactagcagtactatgttagagaagtctacagcatctgctatacgaagattaagtaccgggacgcaatacggaaaagccactaatgtatgattaattgagttttgattatttcaattgagttttaaagcaccttttacatagtactcaaatttgaaagatgtgctaacagataaatttgagataagagctgtgtctaaatcaaaaaataacggacatggatcctctgcggaactgtatttgtagtagcagtagctgatagttggacccgatcctacatgtcagctgctgctactacaccggtactactgcaaacaatctccaatgaaaaaaaaaagaaaaactgatcatatgcagtggtcagtggagtggccctagagagagagagagagagagagagggagagacgagcagaggggtgatggaccgatggtgcggtggtcagtcgctcaccggtcagtcgcatcgcatcgcatcgcatgcatggacgtggagtaggctggcccgggcggcctgccacatcgtgccagcaaaacacggagtacacaccgaccgcagcccgtaggagtaggcaatggcagtgccagcgacgtcctcgttgggttgcgtgccatgccacgccacgccatgcagaaatgcagatgcagccatcggaccagtactctccctccccagtccccagttgcataaaaaaaacaaaaaagaaagttaacatgagatggaacgtagggtgtgtttagttcacactaaaattgaaaagttggaagtttgtgtatagaaaagtttcgatgtgatggaaaatttggaagtttgaagaaaaagtttggaactaaactcggccgtaatagaaatatattaaggggatatttagataagggttttggcgtgtcacataagatattatagatattatatagggtgttagggcactaataaaaaactaattacagaacccgtaaataaaccgtgagacaaatatattaatcctaattaatccgttactagcaaatgttcactgtagcaccacatgttaaatcatggagcaattaggcttaaaatattgttagtaaattagtcgcaatatgtaaaattagttatttttagcctatatttaatattttgcaggtgtttaaacgttcgatgtgataggatgcaaaattttagggtgggatataaacatgccctaaaatttaaattataactagaaaggtagtagtacgtttatttagaaatataagagtatatattctagtaattcaatcttattttaggtttggtttttctgagagaatgcgagtacgtgccactacggatcgagttggcctgctagcagcagcaaagcatgcaggccagccagtggccctgtgcgttgcgtacgtgtaggtcagtacggtgtgacccgcccgatactactactgcactgcacacactccctccgtccgtgtagtactcctacttgcttcctcctatggaaaaaaaattctaaccttgctacccgtcctaaaataagtgcagccgtggatatccatacccaacgtttgactgcccgttttatttaaaaaaattgtgaaaaatttaaaaatatttagtcacacataaagtaatattcatgttttatcatctaataacaataaaaatactaatcataaaaaattttcaaataagacgaacggtcaaacgttaaacgtgaatagtgcaaaactgtacttattttgggacggatggagtatatcataagtactataaatttaaacatgtagtagtaggagtaactgttcagattcgtagtattagaatatgacacatctgatattaggttgattgagaaatatctaggggttttccgactatctccacaagttgatgggctaggcaatataggttcgaagcttcactcctactaattatttaatattaggtcattctctaatatttgcgtctttgacaaggttcacaattccgacgaaaaccgatcgaattccgcgaaattttgaggtttcgacgaggctcgaaagtagaagccatctgaaatttcgatgagtttcattcaaattcaaatttaaattgataaaaaaggaaaaaaatatttaaaaaaatcttataaatagaatgatattcatataacctattgggatataaatttttgaagaaattgatgtattccgtgtatttgctgaaatttaccgtaggaaagaaaagaataaaaattaataaaaggaaaaaaatcatttgatcactttttctaataaccgattgaaatttcgataatttcgctcggaattttatcaaagccaatcggttttcgcgagcttatcggtaaactcagggaatttgtatttaaattttggtttataaaatttgttcagaatctatcagctttccaccaaattttataaataccgtcgttccaccaaaccctgaaatggaaggccatcttgaaatcgtaaaccctgatctttgatactcctactacgtggtactcactatactagtatatctctgacccaggtgggccccatccaacccctccctcagtccctccctctagagcctggaccctgtttatcttcttctctctagctaccactaatctctcttcagtttttgtttggtttggtctgttctggtcaccgtctgcatgcatatggctcattcgatcgatcgaccggcgcggcgccaaagattcacccacgacgctctacctaccctgtctgctactgcccatatatgctccctccgttttataatgtaagactttctagcattgcccatatacatataaatgttaatgaatctaaatacatacatatgtctagatgaatatggacaatgctagacaggggcgtactagctaggtggcaccgtggtccatggaccacctaaaaatttgaaattatagtatatgtgctagttaatatagtaaaaattatatagtggaccacccttttaattgacatattacatatagatgaaacacttttactttaaatcctagttacgccactgatgttagaaagtcttatattgtgaaacagaggaagtacatactacgtgtatcaacaccatgatgcacaccatgtcgatctgaacctttgaccatgtcggtcgagatgacatgacaaaacaatcctgtcacgctggcttgaatagtgtggcaatgttatttggtactatcatcgcgcatgtgtgtgagtcatagtatcataatgtcaaattcatagttactaggaatatcctaatacctatgtcagatttattatattaggatgttaaatttatagtgctcctagaatatgtacttatcagatttataatgttgaattaacttggtgtgtatttagttctttgggtgtaaagttttaagtatatgaatgcacatttgaagtattaaacgtagactaataacaaaacaaattacatattccgcctgtaaactgcgagacgaatttattaagcctaattaatccgcaaatgtttaatgtagcatcatattgtcaaatcatagcgtaattaggctcaaaagatccgtctcgcaatttacatataaactgtgcaattggttttttctcacatttaaattaatgccctatacatgtgtccaaatatttgatgtgacgtttttgactaaaatttaggccttgattccgaaatggagttactatttgatgcgttggtcccaaatacgctaaaccatgtttcttttttttttcgactggccatgggcaacgagtttcgatgattggcgtttccgtttagaaataaacacttttttgtgcttgcttgcgagcattggaatggcttgaatgaaatgaatattaagataaataaaagaaagaaaataaaccattgagaaagttatttatttttatattagtttcctatacttgactgaacaacttccaattccgttatttcaactacaccaaatgatcttttgaattagtcaagactcatatttatggccccttttatatggttattgttttattgaatttgcttcaggcttgcgattcgactttgatcgtaatggattggtaccaaaccaagatcaaatcctaggcaagtggatctaattttaacagccggcacgataacaatgaaaattgctccttctttagtgagattaattatatgagaagattaattatatgagtgaccaacgaggatggattagctaggctaggcaagcagtaattgctacaggtgtaatgtgacccagcacatgacacgaccgctgtgtaaaggccgtcaaaagtcaaccatactgtactggatataccgcccggcccgttgtacgtactgtacgtacgtagacagacatggcgatgtcaaatcaaatcaaatcaagtccagtacaatactccctccgtctttaaaaaaaaagacaaatcctagattttcgtatccaacgtttaactatccgtcttatatgaatttttttataattattatttttattgttagatgataaatcatgattaatactttatgcgtgacttatccttttaatttttttataatttttttaaataagatgaacggtcaaacattgaacatagaaatccagagtttatttttttttgaacggagggagtaatccatatgcaatcaatctcacatacattatcgtaaaaggggacgcatcgactcctcctaagttgatttttttccgaagggagtaggtctctctagcataaataccctgtatatctagctcagctacagcctctgatcattcactccatctttattccgccttcatcaattcgatccctgcatttcgctaagctattgtggtgtttgtttctatcgaaaatagataaagtttagatgtgaaattaagacacggaagacaataagatcgttaacgcatggttaactaagttttaattacttattgagaacctttaaatgaatagatttaagcaacttctacataaaaagttttgtacaaattacatcgttcgatagtttgaaaagtgtgctaacggaaatcgaaataaaatatgtatcttagtcagaaaagaacagggtaacctcatcttcagccgaatccacctccacctcagcttcaatcgtgcccatagaacttacgctctctgcaaggtccaccatctcagcaccagaggtggcatcgagcaactagagctcgcactagtgaagtggctgctcgccaaggagaccgaaaccgagctccggccatgtcagctggctacatggcaggggtgccacgggaggagggggttagtgctaatgtctttggtgtcgatccattggaccttggcgccaatgatgcttgcgctgagctaaggttctattcctgaataatattttttataggcttatttgtaaaaacaagttttctataagggccaaatatacacattttaggcaaatcaaacctgaagtggatgctttctcaaatttcagaaattcattccccaaatttagcaaaatttactcaaaattagtcaaaatatgtttacaaattattttcttttgggccaaaatattctgaaatattagatctatcggccctctcaaatttgtttagctttcaccaatatagaatcctgctcactagctatgtgatgcgattctagctgacctggcccatgccctacccactccgtataaattagtgtacgtacgtacatacgtgcaccgttcatgcttgtaacctaaagtaaatacatgtacaccaccctctgtataaacgtataagagaccacaccctgcagcaatgcttgcccaattctagcaacacctctagcccgtgtcaccttcctttcatagctaaacaaaccaacaaaaaaaaagtactagtatactagtagtatacagctagacggtaaaagaaaacaagtttatacgtactccaatggaatactccagtaatttaaaatttactccgtattatagcatagtatcagttagtactagtatactccctcggtaaaaaaacgaatctaattagatgtgacacattttaatacaacgaatctgaatagagatatgtctagatttacggtactaagggggtgtttagatccaggggtataaagttttggcgtgtcacatcgggcattatataatgtgtcgtatagggtgtttggacagtaataaaaaaaactaatacagtatccgtaagtaaaccacgagacaaatttattaagtgatccaattaatccgtcattagtaaatgtttactgtagcaacacattgtcaaatcatggagcaattaggcttaaaagattcgtctcgcaaattagttgtaatctgtgcaattagttattttttagcttatatttaatacttcatacatgtgttcaaacgttcgatgtgacagggtgtaaaattttgagatgggatctaaacagacgggacaagatattaattgtatagtaagcgactattatataaattagctagtattaaattggctatagatattttaaagctagtagttggctatactattaaacttgatacgagagagggagctagtaattagctactccattaaacttgctctgagagtgaggtgtgaggaggggaaaaaataaaaaaaattggagagacaagacaatggatggagatatcacgtcacatcaccgacacgctgcactgtatacgtacgctgtacagtacagtacagtaggagaacgtactccctccgaaaaaacaaaccctagatttacgtgccaacatttgactgttcgttttatataaaaaaaatttataattagtattttcattgttgtcagatgataaaacatgattaatactttatgcgtgacttatttttttaatttttttcataattttttcaaataagatggacggtctggacacggaaatcaaggtttgtcttttttttataaggagtagctccctagggcgtattcgtacaggcctcaagcagcgcgcccagccaatgggaacccgccacgtttccgtctcccatcttcatttcttcctgatcctctgccactttgatggcggagtagtaaaatacgaagtctctagctttccgctgcgacgtctactcgagctctgggcaacttgtgatctcatctcctgaatgctgccatctttggttaattgatttctcttatctcttttgttcttcttcctctctctctctattcaatataaataccccgttcctaaaaaaaatcaattttgtgttcagattcaatactaggattgtactctctccgtaaaaaaaaacaaacattgggtttaaatctggacatgatgcatgtccagattcaaacccaaggtttatctttcttttgggctggagggagtattttttttgacggagtagtataatctaatatagagtctcattggttacctatattttctaatatataagtcaaaacggtatattagggaatacaaattaatttatataagtaaaagttttatatatttttatagcgatttaaaagctaacgcaaaaagaattacgttgaatatatcttaaaatcaactctaaatataggttctagaatttaaattttacatattgctttggcttattaggtcaactgataaggccacagatataacatattctacaactacatatatgttgcacttattttgagatggagggatataatctctagcaagctaaggtcccgttcttttctctaataagagtcggataaagattaaaattttcatggcacgcttttcaaacggttaaacaatacgtttcgtgcgaaaactttctatataaaaattgctctaaaatatcatattaatctatttttcaagtttgtaataattaaaactcaatcaataatacgttaataccatatcgttttgcataaaaaacttaatctccatctttaccttcagaagaaaagaacaccacctaagatttcgcgtttgagcaagggagagagattggagatctttttcgagcaaggctgtgtttagttcctgaaattggggagaagtttggggaaagtttgtgctttggaaaaaaagttaggactttatgtgagtaggaaagttttggatgtgatgtgatggaaagttgggagtttgggagaagttccgtgtgaactgaacagtgcgcaagagaaggatccgatcaaacaagaagaagcagcagcagcagaggttgtagaccagtgacggatgtagaatatacaatttttagagtgaacgcctccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatga

SEQ ID NO: 63781 - DNA, 957 bp, Oryza sativa
tcatattattgcaaacattggtatacaagaggtacatgcagagtgtttgggaattaagaaaggggcaactgatcaactcgattgagctacggaaaattcacgcaatcacctatggtatgtgtacatgaagaaaatgcaaaatgcccttgtcgtttctacgaaagctagattgcttggggctcttttgaaacacagaaagtttgtaggattttcacataaataattgagctcagtttctaaataatttgttctaattcctctgtttcaaaggatgcatgccttcacacgaatttactacggggatgtcgtgagtttcctacatttgcacatggagcttaatcgtagatcaatatgaaatgcgggaactatagtcctatcagccgtttaaatcagagaggccactgctaagaaaacaaaaatttcacgaacttctcacataattaagcttaatagaacttccctccaaacacgcctacatcaatatatttcatgcaagccattttttataatccctcagtttcaaaataaatcaacttttgttcatagattgtcaattgatttattttgggatagacatgagtaactgaactcctagtggaaattaaacagaaataacagaatgtacaaccaactacttactctatcccaaataaaccaatctcatacagaatgtgatatattctgtacttactccatcccaaaataatgcagttttgcattattcatgtccaacgtttgaccgttcgtcttatttaaattttttttgtgattagtatttttattgttattagatgataaaacataaatagtactttatgggtgactattttattagttttttcataaatttttcaaataagacgaacggtcaaacgttggacacagatcctcacaactacaattattttgggatggaggtagtataataaatttgaaaagaaagttattttgaaacgg

SEQ ID NO: 63782 - DNA, 836 bp, Oryza sativa
tcagaaactattttagtttcagttttcttcttctttttctggttacagatcaagtctaataactgttcctacttttggtcaggggttgtagctttcatgtattcatacagtagctgtactagtatactcctactgatgagaaaggcacacaatgcaagcacggtggtttgtttttttgttttgtttcttccctgcgtttttttttactggccaagaaatgaagaaacgaacagagaggcaaaggcaggcatgcaggtagaggcagaggctgccatgacaagacgcaacggacgcatgcaggatgcagatgcagatgcatgtccacaccaccatttccagaatctctcctctgattgattgatctcccgccacctttgcccccattcaatcagtttttttgccccccccccccccccaatcggatgccctaatcagccacaaaaagagttaaaagttaaattttaaacttaattttaagattgatttaaagatattttcaacgtaatttctttttagcattgacttttaaatcaccaagaacataaatataaaagttttacctataaatttatttttatttactattaagccgttttgatatattagaggatatgagcaaacgatgagactctttctttatttctctctcaaaagaaaaaggcttatttattattcccctcacttttaaaacgtaaagatttttaggattcaaattttatattaaatgtaagcattccaaaactgattctcatgattacaatcattttaatgattccaaagccaatcagatgattgaaagtgaaattgcaacaattcaaaatttaaaaattgataac

SEQ ID NO: 63783 - DNA, 1823 bp, Oryza sativa
tcatctggactcacctagagtatggatcatctcccctgtccatgcatgcatgcatgctgcaagaaaatgcatatacaaacattcagaaaattatatttgatattgatattcatttgcctcccatctccctctccaacagtgccatctctgatcacacccacactgtgaagtgaagtcagtcatctccaagagaagcaaaagcaaatgcaaagccttcacctctcacctcacatccattgctgcatggaccatggcaccaatgcaccatgcacatctccagcatctccatctccatgagtccatgtgcattcaagcttagcagcagcagcagcagcagctgtatgtgtgggtgtggccatggtgctttctttgcattgcattgcattgcaatgcatgcactgtttgctgcagctgctgcagctgcagtgactagtctagctctctccatctctttctttctctgcttctttgtttctttctctgtctataaatacagaggcctctcctttccacccagcccttttcctctcctcctcccgtcttttccaccaccaccaccctcgcgtgccctaatttctcgtgctccttgtcccccacctcctttacttgagcttgctcaccactgcctccatatacagagagtcttctctgtatttctctctctcagtgggaggctcacaagaatctttcagctcacatctcactgtccttgcctttctctagctaggtactactactgctagtactaaccactgctcgtgttcttgggacttcttcttcttcttgttcttgttcttaaaatcatttggggttttgagctccagggaggtccaagaacagagcagcaggatggtgcagtggcgtttctgtaagtgaatcctactaccttcagtttcttgagcagtttcagtagtgtagagcttatgatgtaatgcagcaggtgccatgtgtgttgtgctctgaagaaagctgttctgtgggttgctttgttactatgttttttgtgttcatgtttcttggtctgtatggctctacatgttgggtgtttttggtcagattttgtctctcctatatctgctagtctgtttttctgcaatagatctttctgttagatttcttgtcttgtagggaagttggtagaggatgtgctctcagggtaaggattgattgtcagtttgcttagttctttcttttgattcaccagttgggatttagttagtatggatagataatctgctaggttggggttaaatgttgcctctgatatggtgagtgaaactacttttgtggattttgtatggattgtggttagtgggtgaaatttgtgttcttgattgaaacatctacctagttcttgaatcttcaatggcagcattattgtactgattgttgtatggtccaataatgtatttagggggattctacttactgctagtctgctcccagatatgaagatttgattctgttttttttcctcttcaaatgtttcttttttataattagttgaaatatgctattatccagagtacttttgggggtttatggattgtttcctcctactcaagagaggtaaacaaagtaacttcttcagtacagattttccagagatgccatttcttcttcatcattcctcctttgattacttcatgattgtttttacctgcttctcagcccatatcccttggaacattcacttccatgaaaattaccacctaaggaaaaaaaaacaaaatggtcagtaattgagaacttgctatattagttacctgaaagatagtaacacccagcaacacagatccatgtttcagtatacttgtggtata

SEQ ID NO: 63784 - DNA, 1402 bp, Oryza sativa
cctttgctcaaaaagaactacagccaattattacaaagatccactccagaagagagtgtagttcaagacaagttgaacacaccaaacaagagaagagaggacccaaactgagaaaagcaaaataaaatgtggagctagaaggcctcgtcaaggcctaggactgaagttcgaagccaatgcatagaccaatgacaatatccttgcacgaagaggtttctccaaagcggtgcccccaaggaggatgcgacgtggatcgccgccaccactcgttcggaaccgaagcaaggttttcacccagagaatatggtagggaaaggaaaggggtatgctaaaacaacgcctccaaggaggggaacgacgccaaacggcgtcgccgttgtcagccagccaaatggctcggcaaggctttcgcccgcgattccctgtccaaacccacaccaccaatccgcacaagaaggatcgtcgtcggtcaacaacattgtcccttcagcgattcggccaaggccaccgcccacagttgttcccgccgtcgacagcgcgcccgctcccggactcctcctgccccgcctccacatatcgccgccgccgacgacgcaccgtcagccggatgatggccttcaaccatcgccgccataggtaccatcgtcgacagccgccatcgccactgccacagccaccaccatcgccagccgccaccgtcagccaccatcaccaccgccaccgccacggacacccctgtccaaccaccaccgtccagccgccaccgtcgctagccaacgctgccagacgccaaccgtccagatccggccggggtggcgcggatcggaggtgcagcgtgaagcacgggtcgccggcatcatggaggaaggcgtcacgggtacggcgttcacagccggagcattgacgagggcgccgcgccttcctcgtggcggcgaggttcttgatgagggccggcgtcgcggcacgcgccacagtccgccgccgtcgtcgccaacttcgtcgccgccacatccgccaccatcgccgccgctagccacccccctgccaggtccgcggagtggcgccagcgacgaccgagcccgtcgccggtcaccccggccaagcggggagaccagatctggcgacgccgtcgctggagccgcggagagccgacaccgtgaccgccgcgcccaactccgcgccgtcgccgcgccgtccctgtcgccacgaccttgccgtcccgccgccatcgtcgccacgcccgcgccggggcgaggtggagccgaggaggatggccccaccgccgccatcccaacgtgtcgcccggctttgccggcgacgagctccggcggcggcgaagcacggaagagggaggaggaggggcggcggcggcggctaggatttcgccctgaactccctgata

SEQ ID NO: 63785 - DNA, 1975 bp, Oryza sativa
  unsure (1)..(1975): unsure at all n locations
gcatctggagatagaatttgctgacgtgtgaaagtcagggaaaggtgagatggacagcaccaagcatgttggattggcctcatctcttctttatatcatcaattgacaccatcttatatattcttatcccaagattatacaatccattcaatttggttctaatgcactctcactcctcgcttttcttgccaagattttgccagagaaaaaaaaaggacatttgagtgatttgttcattctgaaatgaatggtgggcaagcacgcgcaatcccagaaagtaacatttcatgcttaaatctgtcccttattggggcatttgacttaagtttgtcgcttattggatggagctttataatcataaaaaggagggaaacgatatggtgtccatgggatcatcaatggatgggcccgatcgatccaaacctatccttccaaatccctatccaacacataagcaggtagaacagcacaatgcataatgcacagcactctgctaaaatggatcacatattactgttactataaagacccaaaccttatcatacagctcaagtgttcaactagcccaagtacaaatatcgcaggaatttcacacgaaacagaactcgattccgctaataattgagcctacatacaaatggcagcattatctttttttaagaaaaaagaaagaaaagagaaaaacaaggtattctaaatggcaactcgaattttaccagaaacagaacttaagcctacggatgaacaaacgcaagaatttcacaggaaatagaacaaattcgagctggacggaggatcatgtcccggccatgcgtgcgtgcatggggatagctgaccttttggtccctggaaagccaggccaagaagatggatggatagatagataggctaccagcagtagtagcagagaaatgctgggtgccattgccacttgcacaggtacccttgctttgcctttccatctgccaaaaacgtgccgtctcatgtacacgcatgtcatttgctttcctgtgccagcacaacacatccaaagggagctacagatctagcagtacaggccaaaggtcaaacaaaaaaattgccagcattggaggaggcagtgcaacttgacgatgcaaaggtaatgggcagaatagtagttgtgggggaatgacatgggagcaactgggcagcacactcactactgggttctggaaactacatgttttatctgaagtcgccgcgattcatgagtcattcatgggcagcaaaggagactaattcttgacactagaagtatcggctgagatcatcacagcaggaaacatcatcttccctaacgaaacagtcaccaaatggtgtgaatatgatacatgatgaacaaattcaacagaagtgctatcatagttgatccataacaagaaagaagtcagttcaattgaagttgagcctgggtaagatcatgattcattgacccaagtgttgggaactatagaagcaatcaaatatcagcactacaaagtgccttaggcagcaggaaagctggtggccaacaagggaaagaaacagatcacctccagccatcatttgaagccactatatcagattcaaacttatttaggcagagcagcattcttatcgagtagcttgagctcagctctttccactctcctcctctttcatctttttctcccatctacgtttctgaagaaacaaaaaaatcaagtacacaagagcaaagaacagccagttagatattcaatatttttgccaaggcatattacagtaatactccctccgccccattttaagtgcagttgtgggtntntatgtncancgtttgactgtccgtnttatttgaaatttttttatgaatagtatttttattgttattagatgataaaacatgaatagtactttatgtgttacttttttttaaattttttataagtttttcaaataagacggatgacaaacattggacacggaaacccac

SEQ ID NO: 63786 - DNA, 1793 bp, Oryza sativa
ccatttttttaaaaaaatagctaatacttaattaatcacgcgctaatggaccgctctgtttgccgtgtgcactgttaaagttgggaaccaggctgtccgaacacagcctaattgggcttattcaagtccgatagcatcaacaataataaatttacaagaccacaaagccactcccagcagctgatttttttttatctggatatggacttatgcttagcttaggtattagaactaagctgatccgaattcagttttttatacttggagaagaaagcttatgtttaacttaggtacgggaactatgctgatctgaatgataagctaggtatcaaggacctgaactatgccacaaactgtacctagatgcctcatgtttagttgaaggggcttttttgggctttaagtagatgggtttttacgttacaaggttgataggcgcagcttcttatgattatgcttgcaactgattaggcacaaatactaacactctctgaatttcattatgccagtaatacaagctagctacagaaccaaagtatattgcaaaacaatctctagattttcttttacaaggtgtaagagagggcctaaattagaactgaacaacttgtgcatataagacaaattaagaaatccagctaggccaaacaggccctgatacaaggcaaacaagtcctagcatcttctcaatatagggtataacatataagcaacatcatcatgtgttatacaagaaattaaggatcaaaaggcaggaaaaataggcccttatgttagacaagccagacatgagtgacatgacaggttctcaaatatgtatcagaattagtgaactatgaaactccatgtttttctccacagctcatatataagactatactagataaaagaacccaaaggaatgaatttgtactttgtagtaatacgatcaagactgacactgagatactgcgccatctatagacaaatagaaaagattatgcaaaataccgcagccaaatgttaacattggcagataaaacaatacacctaaactggagccatgcaaatgcatagctagacatgataatgagctcggaaatgcatactacaatatacgaagattagtaataccaatgcaaagcgtggagaatggaaaagaacaggcaagatgaggaatcaaaccttgtagtcaaggagcatctggggcatcttcttcatcagctcaaccgtgttcgcacgcctggaaaaccacgggatcaaaacaacaaaacaaatcaagccacggggcaacaaattcaagcaatcgaaaaggaggagggatccaggggatgcgcgcgcgtacttctcggcggagatgcggtcgcacttgtggcccttccgcttggtgcgcatctcgccgcggggagggtcgtaggtccagtcctcgccggcgaggaggacctccttcctgaggcgcgcccgcttccgggcgctgaggccgagcggcttccatgccccgagctcccagtacccccacacccccttcgtcagctcccccttgtactttgcaagcttctccctccacgggtaaaccctcgccgccgcctccgccgccgtcgccgtcgccgccttcccggccatcgcctccacccgcgctagggttttgcctctcccacctcggcttggtacacttcacccactggacccaattaaatgggccaaaatatcatccggcccaacttaaatgggcccaattgttatgggccgcgtgaggcccggcccattagaaacccttcttcttccccgagaggaagagagagaaaaacctcgca

SEQ ID NO: 63787 - DNA, 1863 bp, Oryza sativa
ggagggaggagaggaggaaggtgaagaaggagaagaggcggattaggaggttgatggagacggaggcggcgggcgaagtgggtgaggcggcggcggaggaggaggaggaggaacatgaggcggaaacggagggtgaggaagaggcggcggcggaggagcaagttccggccaaggtggttgagaaacgcaagcccaagtcggagcccaaggtgaagaaccagaagcagctgcaagtagctgaccatgcagttggatctgacgatcccgtcttgtcggaggagaggtgagtaatcggtgcttcaaaagattgtgtccttttcgtattccaattcattgtttgtattgccgcttgtatgtcatggcgattggtattgatggtgagatgccgttcttgtcaaaagataagagaaaatagcatagcgcatgtcggtctgatgtgaatgtgagcatgcaaacagtctaataggagtggtgttaattacagttattaataataaattgtttttgtgaaaatatagcatgacatgctgatttgctgtggttgtttgcgtagaaatggtctaataggcaatgtaaaaatctagtggttgttcctagattaccattattttgatttgtcatggcttgaagtataggttgttccacaattcagaataaattatgtgaccgtttgggttggttatgatcaaacaagtctgtttataaaagtatattctttaagaagcccaaccattttttaactctgacatggagctgtaaaatgattgctttggagtttagaaaggtggtttctttgtagcggaatcttcatcgaattgataagaagtgcgatggagctatttaactgcttgctgtctgtcggacttattgagattagctctgtaatggtattgcattcttgtttcagcgagaaaaatgcgaagaaggtgtatgttgggggcatcccatactattcctccgaggatgacataagaagtttctttgaagcatgtggcagcatcacatcagtggattgcatgacatttcccgagagcgggaaattcaggggcattgccattctcacgtttaaggtcagcctcaaaaccttgtttgcttccttttagcccattgtttatgttctaggaaggatgtcaactcacaaatttaacggataacttaagataattgttgatccagtaaatgtctgaatgtgcatagttttgatggtactggaagagtttgcttcaactaactacattccaatgcagtctcgcttgttttcagcactgttatagtcttgtagaaattaatgatttagtttcagaataatgtaagaaattcctctctgtggtcttgtagtaactaatatggtaacaatgcatctcgttgtcacctcatagtattgttttgaccaagtttgccgcttggtttaatttcatacaatggatcaaaaccatctagatgcaagcactgggtgctcctttaatctgttactactgccaatcatgcacatggcttgttggctgtggcaacatgctttttgccatttttccttaaacggtaatttaaacctgaccgatttttcttgttcagactgatgctgccgcacaaagggcattggctcttgatggtgcagatatgtaagcacatctgcttctgaactttacttcttccttttttgttttcaccataagcgataaccttcttgttgactacacaggggaggattttttttgaaaattcaaccatacaaatctgtccgtgaaaaggaagattttgcaccaaagatgatagagggatacaatagggtttatgttggaaacctggcatgggacataacagaggatgacttgaagaagttcttttctgattgcaaaatctcat

SEQ ID NO: 63788 - DNA, 1985 bp, Oryza sativa
tgttaggacgtactccctccatttttattctttgcttagatcaaaattaaactaatcagcatcaaatatttagggaaggagtaatatataaacatggcaagtaaccatcaaattcatatcacagataccatgaaagaccaataggaaatatgagtatgtaattttaccttccaggataataactattggttgcaataattagccatgaaagaccaataagaaagaaatatgaagtctttcaagatagaaaaaaattacacaaaatatggtacctcccgatatatcctcaataactgtaaaatcactttcaagataatcatcaagattagttgctagcgacgttagaatatattaatcaacaagaattagctataagtatgcaaatttttccttctggcggcaatgctgttgttgccacagatgttttttagcaaatagctagtcatgtaactgacttgtaatccccctcttcttaatataagctaggcaaaatttgctgcatgccactcaaaatttataatctttgtaggacaccacaaaacacatggtaattaactattggacaatgaacatgttattttattatatttggtctaaatagagagagaaatttttagaaaagacaagtttgcccgtaggatatgtttctttttaataaccctattaggtttatttcgaattaccatgactaggggagtgagaatggactacatcgacggagtgagaatcgattgggtctagttcgacctagaccaagtcgtcttacaagccaatggataaaagggcaaatttatactttccgcgttgtttctctctctatttgcaccggatataataaaaataatgtgttaagtgtccagcagataattaccatgttttcacgatatcctgcaaccaatacatattttgtgggtgtcctacagtaaagacaatgaactttaagtgtactgtagtaaatttgccttaatataatggcagagttcctgccaaatgttaatttcaaagaaagtgtctagtttacgtatgtcaactgtgcacttttcaaaagtttttccaataatggcctaggaaaaaaatgttttttccaatatgtatgtaaaaagagtaggtacatgaaaaacatattagatatgttgttaattgaaaatagtttcaaaatattgcactacaaattcactatgcctgtgcacaacttatatttcaaaatacttgaaataaagtacataataaaatggtaaagtgtagaacctatatttcaaaagtcaaatacaaagctaacttcaagtcttgatcaacacaaaatactttgatttaactcagctttgcatggatatctcttattatctctatgtatatgatgcatgcaagctagaatgtgggctgcatgcttgccctgatccttttttttttgtcaatcatcaatagagaacaagttctctcattctttttttcctttagaaaagaagcaaggatattcttaagaattgcaacatgcgagttaataagtaacatagttgcagttgctagctagctattgatcgtctagaaggcgtcaagaatcatgcaagacatgtaaggggatctccatctcatatgtgttgacttgtctaagaccatattagagtgtcatctctccactgatttgaaggtagggaggccggggcgttagaacaattgcaacaacactcgctagagagccactgattatttttttttaaaaaaaaagatgctcaaaactatgcagctaattgcatctctacatcaagagcaaataaaactcaaggctaacccacttaccagacacgattgcatcggccaacggagtctaacatatgctctagatgcaccatcacctaatcaactaatatgtaacatctccaatttttcaatatataacgttgtttacttcttgataaatgtttgatcattgggattattctttttttttgcaaatataaaaaaatgaagtcatgcttaaagaacat

SEQ ID NO: 63789 - DNA, 6242 bp, Oryza sativa
acaacttgagagttattcatgatttatattcgcaaagtttgacttaaacattgtcctaaatgacttcctttatgagtacggaggaagtatttgaataagataaatggtcaaacatatatataaaaaaatcaacggcgtcatatattaaaaaataaaggaaatactacgtaacaccaaataaggtgatgcaccaatacaccaaaaatcgccagacatgtgaggcctttcctgtacgttcaccctaagtcatacagaaggcgaaagatgagaagtgacactttgatttgttgttggtagatatatcaagattgctatacactgattgacagggcggaaccaggagtagggcagctagggctagagccttactcctggtcctaaatacccattgaaagcactccaaatttaagaatttagaaaaaaaaagaaagtaaacctataaaaattacatcaattgagccctactcttgagaaatttttggctccgccaccacccattgttactatctaaccccgcgcatatcgtgagccgttgttggtgcttctgaaacgttggagacagagagagaaaaaaaaaggtgatctaggacctgttagtcgtggcagtgagaggcgacaaatgtgaaatcaccaacactagaagcagcagaagaagaagaattcgaagaaatgggttgttgaacacgcatatgacagcaacaatactgcagatagttgcaaatggtccttggaggtatatacgacaaagaggcaaagcaaacaagcacgatattgggaaatagaagtgtcacattggggaattgaagggtcagaaatggccggggcacgagccaggcacgctcaaattaattgcagccatcgatcgatcaatccatggatgcagcatgcagcgatggatcgatcgccatcatactctccagctagctagctcgtcgatcgttgcaatcatggaccaatatagatagatcgatgtgcattgcactagctatagcttttgctaagctgcagacatcacggcgcactgatgatgtgagatgatatgatacagacggcaatgcacctggcacttggcacttggttaattccactcactcatcacttaatttgctagctagtagcttatttgtagtcgattgaggtttgccaattgtccatgtctgcttgtcctcttcctccaccctctatatatatcccaagtggccactacagagcctccattattaatcatagctaacaagtatatcctctcttcttcttcttcctcctcacaactcacaatatttcagagtagtatacctttcttgctagctagctagcttgttcatcgatcttgttttgaggtgttgagatagctaggatggtggtgaagaaggcggcgacgatggcggaggcggaagcggaggaggagatgatgatgaggatgatgtgtggttcaggaggcaacgagatgatgaagacgaagatgaagaagaagaatagagaaggggaagaagaagaagaagtaagtggaggaggtaggatgaggaaggggccatggacggagcaggaggacgtccaactggtatggttcgtgcgcttgttcggggaacgtcgttgggatttcttagcaaaggtctcaggtttgcgcggtggcgggtgacctagctacatgcactgcatgcctccctctctctctatatatatctccttcccatcaaacatccatccatccatcgactgcttctttttctttctttttttttctcttcttgattgttcttgttcttgttcttctttctctctctcttatcatgcaacacccacacatgcatatatccatccatccatctatccccttatcacatttaatttcttcttcatatataccaatttggcaacagctaatgattctttttttatttgaaactctgaatgaattgatttagatgcatgcatcaatacaaataattgatttctttttatctggagctctgaaattgatttagatatgcatattgataaaacaaaatttgatattcatctgaaactctgaattggttaagatgcctacacataaatgttccattttcagttgtggggatcgatgtgatggcttttacatatatgcatgcgtaaattaacatgcggtgttgcatgatcgaagttaattaatctagaggcggtcgatgatcgatggatgatacagtacttaactaggagatggaggcatgcatgcatgagcttagaacgcacgggaaactgaggtgttaaccatctgcttcttcttcttcttcttcttcctcctcctctggatggctgtctccctggcacatgttggccttggtggtttcacctttcaggtttgaagcgcacaggcaagagctgccgtctccggtgggtgaactacctccaccccggcctcaagcgcggccgcatcaccgccgacgaggagcgcctcatcctccacctccactcccagtggggcagccgctggtcccgcatcgcccgcagcctccccggccgcaccgacaacgagatcaagaacttctggcgaacccacatgcgcaagatcgcccaccacgccaagaagaagaccaattcaccatcgcgggcgccgacgacctcctccggttccttgtcctcctcgctcaccacggcgacgacgacgatggcgacggctgcggcgctgcaagaaagcagcagctgcggcggcgacgacgaggccgtcgaccagctggtggcggcggccaccacgccggcgagccagctgctgacgatggactacaccatggaccagctctggaacgacatcgcggcggcggaagccgatacgagctgctacgacgcggcggcgatggcctcgccgccgtcgccggtctgggaattctgcaccgactactcgctgtggaggatcgacgacgaggagtactacaagaagatgctcgatgcctcgcaatagtactactcaaattgcaaacaagcaacgccttaattcaattgctgctcttagcttaattagctgacgatcgatcgacgacgactctcatcatctgatgaacgaactgcgaaatctatatttgcactgcatatccttgcatctgtctactgtaattacacctgatgatgcacgtattatgcattgcttgtcagacaactctgctttatatatatctagctatagcttgatcaatcagcatgcctagcttgtgtacatgtaggggagagagtattagtagttaagactgatgggatcaagtgctatatgtatattgctttaatttcatggtatatgtactatgattgtactatgtgtcatatattcagtgtaagcagtggtttgcaattaacctgttctacctcgtaaaaaccggccttctgtgactggttttaatttgcttgtattggtgcagtgctaatgaggtttttcagatgagagtggacccattattaagtgcttaacagagtttgacatatttgaagaagtagaatttcaattgtaccaaaatacagtcaaaagtagactcatgcaattaatatattctattccattatctaaaaatatatgaagagaccatattcaaagaaaattatgtatatgaagagctcattccagggacttttttttccagtgattcactaattaatactttaacatctcataattaaacttcccctaatttacatgaggagttaattccagggtggttagctgtgcaaattatgttcgtcaccaagcatcaaacaagtactcatggtgctgccatatcagatgacctagatatcatctgaaacttggttctatatatcccaagaaattaacacaaaagaatcttgactctctcccaacaacattgagagcgcatatagagcatgcacaatatacagaatcttcaccccccaaaaaattttatatattccaagataccagcaagcaatcacagtatagctagtgcatggcggcagtggtttcatgggaatctaataatacaactctctccaagcaacacacaagtcaagagagagtaactcaaaaagatatatgccaagctcagatcaagaggccatgagcagcaggttgaaatggtagggaaggaattcagaagccagggataatacatccatccattcatcaccatgcatccccaatatgccatatattgtgcatgtccctttccagcttttcctcacatctaacttttccatccctccaatagttcaaaccacatctcatacagctgtttttaatctcactgtcattaggagagtggattaatggctgatctacaccgtctattgggctatgggcaccaaaaattgctacgcgcgctagcaaaaaaactcggtcgcttatatatatatatatatatatatatatatatatatatatatatatatatatatatatatatatatatatatatatatataaaatctatcctaactaacggccgcaatatatatatttattttctcttctttggtgaataattagttctagtttttgaagaattgatcagataacatgtcttcacattgcaaataattaattgttagttattagaatatggcatatatgacatttacggagccatcgtttcgcttgttcgtggaataagcgaaatggtataatagcaaacgaaaagtaatttgtgaataaaacttttatatatgtgttcttagcgatctaaaagcaaatgttggaaaataaacttcgatgaaaaaaaatcttaaaatcaactccaaatttaaggttaaaaattcaaattttggttgataaatataagcataagcgaaaagatagtgcccttaaattgaaaaccacaaaaccaagccctatctagttagcctaaaatccagttaattaatttgcaactcatgcttagaattttctaaaatccaaaatctcacgcagcaacacgctgagtttccacctagtagtcatatcaagagctagcttccctttaaaatgctccactgacagagtgtgtgttactgttgacaactcactgagaggaatttcatgccctatcctatgagtttattttgtaggtgtagctctagcataactctccacggttgatgcaacttgcaagaaaggaaaaatgccaagtggctttggtgataagggatgaattgaataaaaatttatggtgggaaaggtggtgataaggaggcaggccaaggcctttcttttctccttttgcaatcactttatgctcctaattctgattaacctagcattatctctgtgatttgtttacaccactagtggttaaccacaatggcattaattagctagtgacaaagtgtgtcagtaaccccacacaagatcagtgagctcacctccgttaattatgttcccccacggtccactgttttttttttttggctatcaaattctccaattattttgtgttttttgagagtaacatcacattgatattttctgatggcccctggtagagagagcaagaatcatgcctgcccttgtttctctcttaccggtacatcataaagtagagctagtgttattttttttgtgggaagaaacatgttacataaagctgaatattcttggcttattattcatcaaatgtacacagattctgtcagttgttgcagctgaataaattccccccctacgcgtttataaacttttcatcctccatcgatgctctactttctgttactgaaagatgtgcgtgatgaccttacttgtactagtagtatatattgttttttaaataatggttgtgttcgaaagtcacagcgctataccgcaagtctgcaataactggatcagcaatagagacactgtttaagatgctgcagtcttgccacaataactggcttccaaacaaagggtgtgtttagttccatgctgaaattagaagctcgattgaaattggaaatatatgacgaaaaagttggaagtttatgtgtgtagaaaagtttgatgtgacttttttttttcaaacttgggaactaaacacgggcatagccaatagaaactaactcctataataaatttatgatacaaggagacacgatatggtattgtcagtatagctagatataggagtttattgcccatgtttcagtttttatttttttttaacaaaagggataatgatggatcacacagtctacaacagatacagctgacatcagcgagcaaattagagggtccttttgattcaaacaaattaattatctcatcctgggtctgtggatagcatagtaagattagatgcgtcagtgag

SEQ ID NO: 63790 - DNA, 1639 bp, Oryza sativa
cagcatgaggccttttgttccttgcaaataacgcaagactttctataccaatttccagtgctctgggcctggattactctgaaatctaccaagtaacccggtaacaaatgccaagtcaggttgtgtgcacacttgcgcatactgtaggcttcttacaactgatgcatatggctttgttttcatttcattgagctcatactgatttctaggacattgcgccccatacttttcgcctttcactataggagcaggtgtagcactgcatctgtacatgttgaatttcttcaacaccttttctatatatgccttttgagaaagtcccaatgcatactatgttctatctcggtgaatctctatgcccaaaacatatgaagcctcaccgaggtctttcatgtcaaactttgaggacaagaatttctttgtttcctgcagtagactgacatcactactagccagtagaatgtcatctacatacataattaggaaaatgaatctcccattcttaactttgaatcaatacagttgtcctcgatattctcttgaaaacccaaatttctttattgtcccatcaaacttcaagtaccactgtctcgaagcttgttctaatccataaatggatctctttagatgacatcccatatttttgtttcctttcatgacgaaacctttcagttgtgccatgtatacttttcctccaaatctccatttagaaatgtcgtttttacatccaactgatgtaattctaaatcataatgtgccaccagtgccattataattctgaaggaaactttacaagagactgaagaaaatgtctcattgtaatcaatcccttctcttttgcgtgaagccttttgccacaagtcgcactttaaacttttctatattccctctggagtcatatttggctttgtagacccatttacagcctactgttttggctcctttaggaatttcttctaaatcccagacaccatttaatttcattgatttcatttcatctttcatggcttccaaccattcagatgagcgagcgcttctcatggcttcttcatatgaggtgggatcatcctccatatgcgactcttctatattataaacttgatagtcatcacggataaccgatcttctgactctttcaggccttctaggggtctcctattctggcacattatctgtttgaggctgttgcagctcctcctctggtgtggcaataatttctgttgaatcctgtaaaacaagttcctcactttcattcattgttgccacaggagagataacaacaggtgttggtactgcaacatcatgcattgcaagcacaacattaacaggtagagagaagaaggctcttgaatcgactgagagggctcagacacccacctctcatcaagatcaatttctcgaactaccgagctccccctaatcatttcgtcttccaagaagacggcatgtctcgtttctacaaactttgtataactgtttggacagtagaaacaataaccctttgatctttcaggatagccaataaaatggcagctgactgttttggggtccaacttcccaatatttgggttaaatactttaacctctgcaggactcccccacacacggaggatccatagctcatacggtgttttgggca

SEQ ID NO: 63791 - DNA, 2758 bp, Oryza sativa
attattataccatagttcacattttccatttccaaaatggcaatcatatccatcaaaatccaatttgggtacacttatttctttgcaaagaagggacataaaaaacatctcgaaataaaagtgtgaagccattcgcgagctctaggcaaagatctccagcaacttcaacttttgcttcactccattggcaactctaatggatctttcgcttctttgcatagtcctcattgaacggaatccctttaaacaattacacatatgaatagttgctctagaatcaatccaccatgtggatctataataactaatcataatgagattcatttacaaatgtaataatgttctcacctttttttgccatgatcactatcaggaagtcaggatgatctttcttggaatgtcttgtcttcttgcagtggagacactaatcctgtctcaactgtgaactgttgttgttgaggcagatactgaggctgttttgcttttgaggagggtgacctgtggctcttttccttgatatctttaacaaggttaatggagtcaccattggtctctttgattctttcctcctcttgaaccaccattgatctctttgattctttcctcctcttgcacacaattagagatgagctcttcaagattccatttttctggacttattttgtaattgacaacaaagttgtcaaaatgctttggcaatgaggttataaccagatggaccagaaagtcatctgagatgcccaaatctttttgcttcaacttggaagccatgttgctcatcctaagaatgtagtcttttacaccatcaccatggtacctctctgtcacaagctgctttattagctgtgtcgcataaaactttgaagaaccagtaaactggctctttatactctcgaggtacttagagacggtgtcatactctgggattgagcccaatatggttggctcaatcatgttctttaccgcagccaaacagttcttgttggctgaggaccatttcgcatgctcaatgtcatacgacatgatgagggaagcattgtccctctctctcttttgccattcagcatctaactctttttcacctttgaaaagtttagcaggttctacaggacatggggtagtcaacacccagtccacctctcccaagataaaagcaaggtcgagttctcttttctattctccgtagttatctcctgtcagggtcagaatatctttaatgtaacccatcaaggagtaccacctgagataatcatgtattgtgagaacaaaattaacattaaaatatatgtattaagtctacatcaccgttgggcagaaaatagacataacacatagagccataactataacattgcaatttatcaacgttggtcagaaaattacaacatcatagcacataattaatgttcctaaaattaaattctcccgttggttcgaaatttaattttagaaacactaatttttcatcaatttcatctatttgcagcggaagatctatatacaattcatataaacagtaacaacactctgttatttactctctgtaaaaattctcccgttggttcaaatttaaacagaggtaaaacatgcaaaaacaattcaaaattctattgtaatttgcatgaaaatatacaaaatacatgttcagaagcatttctcacatttatctattctctaaacaattttcacgttgaagaaataaacacatttaataactataattgtaaatgcttctgaaacagggacctagaccgaacttcttttcttttgattcggccccaagggacctaatatagacttatttaggcgcagccggtcggcccacggccggctttcgcgcgcgcggttgccccctccccccaggctgcaacctgggcctgggctgagaaaggagcccccggcgcgcgccctcttgggccaaaatcagcccagccatcgccggccgtccgatcttaggttttcgatcggacggccgggcacctctttcggggtaacaaaaaccccaagccgccaaagacgccgtccgaaaccctagccgcttgctggccggaaccctagccacggcggcacggcacggcggcagggcggcacggcgcggcggcgccgtcgcacccccctttgccggcgcgcgcactcacccgagagtgagtgcgccgccgtcgagcggctgtgcagcggcgcccggcaagccggcggcgcggcgccgccccctcttttctctcccgcgtcggcgtgaggacgaccggtggtggcatgactcccgcgcgcgtcggcggcggccggcggcggcggtaggtgagtcttttcttttcgacccgtgcggatcgtgtgctgttctttcttttgctcttttccggggatcaattcccctcttctttttatttggatttctatccccgaaccgatctaagccctagggttggtctgataccattgttagagttctctgttggatcacctaggtttagatctagtcgggttgtctctattgggttgatgaacgacattgtagatgaaagggagagggtttagataccgaccggttgaggtgttcgtggaggaaagggcgccggacatcgtcgctgtcgttgcggctcgacgtggacggcggcgacggtgtgcttggtgccaatggcggtgatgcagcagcggtcgcaggcagtgacgcggttgcggcagcgatggtgtcgacgacgaggcgtggcgcggcggtggacttcccgtcactggctacgcccccctcgagatcggtttaggg

SEQ ID NO: 63792 - DNA, 1466 bp, Oryza sativa
catccatccaagtcgctcaatattcattaacctatagataccttggctacatgcatgcatgcgtgctagcagcttttaattcaggtgagaataattaacgtatatatctatatgatccggatatgtgcttggctgtttttttttttcaaacgtataaaatgattgcatgtcagtatatattagaagaaagcaaagtttcgattatgtaacacaaatggctagaaggctattgccggatgacaagatcttgtaagaaactacttaaagaaaataaaaactcatataacgagagagtgcaggtgaagccccattaaacaccaacaagctagcacccccaaaaaaaacaaataaaaacattgctatagtgctttcttgcttggctgttcgaatttaattactctctccgttctaaaatataacaacctggttgctactattagacataactttaatattacaaatatgaacagactttgctatactagattattatattttaggaagaggagtatataaattctattcgtgcaacgcacgtggcctatgacgcacacacatggatacagcatcatacgtacattatcaagtgaggatatgcgcgtatgtactcttatatacacattcaagggacggaaactaaagataaattcaatttctgagcttatattaactactaattttgtactgaaaattcactcgtgtgtggataactattggcacaaaaattaatgaaaagaacttataatcatgatcactagatacagtctgcgctgacaactctaccatcacaaccttaataattagcgattggaacttaatttttttaatttcaaacaaatgttagttccgatcattatctaaacatttaaaaaacattcctttttaaataaggaattaagagagagatgatgattacatacggataaaaacattaattagtttcgacagacgatcgagtgcgacgtacgtgcgcccccgtcatgtattctttaggcatcaatgcagcaagaataattcagcgtataattgaaatattatttttgctaattaattgacgcagaccgaattgaaatgtatgcatatgcataatatgatatgaatggtatacgtacgcacatactatacgtacgtacatttacaacgtatagtacgtatatatatacacagtgcaatgtggtccagtagacagggcgacgtgcaggggatcgtgagaaagcaaggaataattaatgattagtcgatgtgacaccttatccaagaactaaatgcatgtgtacattatacacagctatatataatattgtaccgatattttgttgttgtaatataatttgtcattaatttggctgcagatatatgcaacaagagtctctgtgatggatgtgtatgtgtatagctaggcatactagctagccggtcaacatatctctctgtatgtaacatgcactcgatcgcacgagtagatg

SEQ ID NO: 63793 - DNA, 3958 bp, Oryza sativa
caaggagcttaggtgagtcgacatgaatacacatactacgactacatgtattcatttcagaattcagattgcgtgtaccgatggagagtgcatttcttacatcaccacactgcatacatcatccagaggtatggagctagccagtgagatgaacaagaaacaaaaataacaggctgtgggatgcatgaacacgttctgaatttctcttcctgtcatgtcaacgggagagcaagattcagcacgcactttgttcagagactgtgtcgagttcagttcaaacgaattgatcggttagggctatgtttagttcacactgaagtatagaagtttagttgaaattagtacgatgtgatagaaaaattatgtgtgtatgaaaggtttgatgtgatggaaagttggaagtttggaaaaaaaaaaactttggaactaaacagggcctagatagctagctggaatatcgaattagtggataacatttgggaatattttggggctggcatctcgtggctatcttggttgtttaatccatggacagtagtacacactacacacagtatagttagctgcagtaagacagttttgtagtccaactgaacctagctgatgggtctagataatgtgttaatgatggtgttagatgcgtgtattgtactacttgtacatcgaagatgcgtgtattgtactacttgtacatcgtgcgtatgaaagtataattatttatgtatgtacgtataaatatacaggatgttcgtggggacgtggaacgtgggaggaagagcaccggatcaagggctggacatctcaagctggctcctggaccagcaacctgcatcctcccctgctcacatctatgttcttgggtatgcactcatctagttgctgtagtattatcatcagtgatttgcatttgcatctttatatcttatcttcaatcctactaattcactgcatgtaattaagtttgtttaattacctcggattctaggatggaacacactgctttcagaaactggtaggacaaactggtaggatggagtagtattgacttgtgaagatgggcagcaaaaatagtgggctgcccatattcagaagtgaacctcaaaaaattctactgatgattcagatcatgaaacagtgtgctagcaggttaattaaactgctatggatttcagtgtaaacccatactccgtactgaccagaattatggcattctgttacttcttttaacataggaacggtcacctgaagctgtaggttagcatagctgcagagctatggccatgggtttcagtgttttggatttcaggacctaatcatgattattccatcacctggagtattcaccaggagatgtaattatactaacggtgctactagtaattaatttgcttccttccattcctgacatatgccttgatcaacataaacaagacggcattgttccatgaaacagtgacacaatgatgcatttccatttgaccaacagctatgactccagagggattttactaattaatcatttaatctgtctgtgtatcggtaagcctaaagtttgattatcctaagtaagtgttctttactatcatgccacaggttccaggaaatagtgccgttgaatgcgggaaatgtccttggggctgaggataaggggcccacatacaagtggctcgatctcattcgccgagctctaaacccttcctcctctgaaagaagccatagttttcctagcaattacccatatgccactgaagcaagtcctgagcgacccaaaaacgatagggtcagcttctcggacttgctagcgatggaggacagactcagcatggtatcagagctagacgacgacagcgagccgtcgacctcgaacccagaatcgagcagcgaggaggaaacgacggatgtcgcgacgcgatacctgaggtcggcggggcaagggtaccggctagctgccagcaagcagatggtggggatcttcctctgcgtgtgggtcctggctgacctgatgccatgtatcacaagtctcagggtgtcttgtgttggcaggggcatcatgggttacatgggtaataaggtaattaaactgtgaacttattacttgccgatcaatttcatcaattcataagatgatgatcaaattgtggcgtaattaatttgtttttaatttggaattggtttgtgatgatgaaggggtcgatatcgataagcctgacggtgcaagggagcacgacgatgtgcttcgtgtgcacgcacctggcgtccggcgagaaggacggcgacgaggtgcgtaggaacagcgacgtcgtcgagatcctcaagaggacgcgcttcacgcggcggcgccggctgtccgcgccggcggcggcggtgccgtcgccggagaccatcttggagcatgagtaagacactgaacaattccatctgtcgtccctgaccctgatcgacttgatcttgtatggatgtatgtctgaatgatttttgaactgcatgattatatttgcagcaagatcatatggctcggtgatctgaattaccggctgacgggcagcggcagcggcgacacgcaggagctgctcgacaagaacgactggcaagcattgctgcagaaggatcaggtgcgaatcaatgacagtaaatctgaagctcagaactgaagcagtacaaattcagagatgaataatcgtgcatgcatgtaagctaaaaatttgatggctgcgtgaatctgctgcagttgcgagtggagcagagagccgggcgggtgttcgggggatgggaggaagggcagataagcttcccgccgacgtacaaatacctcgccgactccgacacctacgccgccgccgccgccttcacctcctccgccagcaagaagcgcaccccggcatggtatgtaaatgtaattaaatttctcctaccattactgtcacaaacaaaattactcttgttatgttcagacaaattaactaacattaataacccctgcaatagggatcagataggatttagctagagatcacatgcatggttcacgatcgatccaaaaaaaagaatgcatgagaataatgatgcagtagctagggcgggctgaatgcaatgaatcattaagtcagtcattcatgtgactacgtgaggtagctgctacgcaggcacatgcatactgattcctgcatatattcctccttaatagctagatcgtgcacagttttgacttaatccatccgcaatactctccatcaccattgcatgttgatatgcatgatatatgatgatatgcatgtttccgtcaccattgcaacaattaagaatgagattctacaaatcgtgaccaatcaatcgagttactgtcgagtactacagaattgggaatattcagagcaacagaaggttatatatatatatatatatatatatatatatatgccctccatccaactgaatttgattagcacgtatactagctatacacacagaatgttagcactagcttaattatattccagtatacaattgatcagacctggggtagagtagagtagactccatggtgtgcagtccttgtcacgctctgctaattaatctgcctctaaatattgctatactcctaattagtattaaaatgtatggtataaaatataatattttttagtactatgagtctagaagtaacacgaagaatttggcttaactgaccctaaaaatgcaggtgtgaccgcatcctgtggcgcggttcggggatggagcaggtgcggtacgcgcgcggggagtcgcggttctccgaccaccgccccgtcaactccctcttctccgtgcagctcgccgccggcggtaacaacgccaagtccgaccacctccacctcctgctcctccgcccacgggccgccggacctgaagcagcagctggcatcggcctccgctcatccagattctgacacacacacgtagatgagcatgtagtatgcct

SEQ ID NO: 63794 - DNA, 885 bp, Oryza sativa
cccgaaaaaattagtggtcgaattacagaccttttcttctttttttttaaataaacctcaaaaagaggatgagggggaccatattaaaaagaaaaaaaaatctgacaattgcacgattagttaaaaggaaaccggcaaaacctacatggttaattatagactcacacagtggtgttttaattactgatttttttatgcaaaattaaacccgattactaatcctataatcggtatttttgtgaataaaataggactgctagccacttggtcagttgctgaatatatgatcagttgctgacagctaatataattggtgcctaaatatcatgcatgtgaggtcactgatcagctcgatcgataatatcactgattgatcaaagtcagacaagcgctgatcagctaagctagctctttgtgctatcttgtaggagcatcaagttagtagtgcggcagtagtaggctactatagcacgacgtgcttggcactaataccgtatatgttttagcttagtacaattactcagtttattaagatgatcattagatcagatgaaactgacattaccgatatattaaccgctcagacggccgtctctcgccgtatatcagtaaagtaatttacacctatcttaaatagtaggaaagagtagacatgaacatgttagagtgcgtagctcggcccatcaactatgggccacctaggtcatattgggtctgctctggcttcaagcccaaccggagccacaactttaggtcctaggtctacataacccaaaagactagtctgatagagattgttccgggttccaaaccttgggctctgataccacttgttataaaaccggctccgaaatcacatcggaaaccaaacgcagaagaaacgcc

SEQ ID NO: 63795 - DNA, 1698 bp, Oryza sativa
attaagatataagtggtatctgtcatattaattatttcgtgaggccctaagaaatggtttcacaaaaaagaggttaacgaagaaaataattaaattaaagtatattagctagaggtgcagaaatgaaaaaaaaaaagagaaaaaaaaacaaagcttgcacaagctgccacgtacaggtacatctctctggcgaacatggggcgcacaaactaactctggattctctcttgagtttaatactgtgatttgtttttggagcctgtacgtgcttagaggattaggaactacagtaattaacatacatatctaggactaacaacatctaccactaagtttagcaatagtcgtactaattatactatacaaacagtatattactaatatactactttcatattttaatgtatgacaccgttaaatttttgtctaacgacgtttgacattcgtcttattcaaaaatatttatgtaattatcatttattttattgtgacttgattcatcatttaatattttttaagtatgacataatttttttatatttataacaaaaaaaatgaacaatcaaatattaattaaaagatcaacggcattgtacattaaaatacgatgggagtattaattaagagtataacataaccgcgtgtctaacaacaagcatgcatctacctgtaaccaatagcaaggcttagcacttagcaggagtaatagttaattaattaattaatcgattaattagaggaggatttgtattagtaaaaaataataaattattaatagaaaagtagagggggtggggccgggcatgcggcgcccgacgcggttgtcgtattgagagcatgcacatgggggccatgtgtggcgcccccgccgtcagctcccattggcccacgtgtcgcacgcaggtgcacgtgcggcgcgctacgcgacaaagctttgccctgcgcatcgcaacgtgtcacagtcgccgccgctgcaccgccccgactgacagatcacccacgacgccctatccacacagccttaaatattttcagtgatattaatattgtaaagttgaaaaataaaattatttgattatttaagaaactatttttttaaaaaacacacctttatcagtatgagaagcgtgttaacgaaaaacatgaaagttgaaatttggagttagagtacaggagtatagaacgcggcctgaatatagaagattgagaatacggcaacgaggtaagttattagtgcgtaattaattaaatattaattattttaagcttgaaaaaaatattaatactacatctgtttcaggttataagactttctagcattgcccatattcatatagatgttaatgaatctaggtaaatgctagaaagtcttataatataaaacggatgagtatgattttaaagtaacttttatatataaatttttttttcaaaaaaatgcatcatgtatcatttcgggagatgttcgcacggaaaacaatgttacagatacaaccagacaacctacacgtactctctccgttccctgacacaccttgaacaatcttgtctaacaacatggtaaaaatcaggaaattagaaaaatatcttcatatgtgtctttcatatgtatgtccggttctcacgtatcacttgtattttgcagaaagagcagtgactaaagttcatgcatgaatagtttttagtgacaagtaaaat

SEQ ID NO: 63796 - DNA, 4736 bp, Oryza sativa
atgagcaggctaaatgcgaagaaccggcaaccactgcttcagctagctctcgatcgttaattaaacaaatgcttcatgcatacacttttctgccacgtaaccacacttccattcactaccattagtactccaatatataacggcatgctaaatatatgttttgccactaaattaaataagaaaagttgctagctgatcgatgtccgatcgatcgatcaacacctgtacacgacagccataacgcatttctttattgtttatttctttgggggaaaaatggcatagtgctttaatgatgctttcgccttctggctgggctaccctctctctcccgtggcagctggtttcagggctggtggccgagcaccagggcctgcttaacttagcatctccacgctggctcgaccccctggtgttgttggtttcttggcagttgtggaaggaacggaacgctagggttttcgactctgcgctctcttctatctcagtggttctggagtccatccactcggagggccgtcctgtggtctttagctggcgttgccgcttttggagacttgttgggagtgtagcgtgactctgcccattcccactgtttgaagtcttgtttctctagccgcagtagttttctaagtttcagccttttattttgccttttctcccttcccctggcataagccggtctggctgattgcgttatataactataacttttttcttctaatatattgacgtgcaatccttttgcgttttcgtgaaaaattaatcattaattttagtacggagagagagaggggggggtaatgattgaccagccagctatctgtgttttcgttgcgaaacacatacacttatcctaatataattaatatccatttcctaattaatatccgaaagggattcggcatcggggcttctagccaccagagaagatgttaattaagaggagaagaagcacctcatctagacttcaccatgatagctagcagttgtggattatatcttacactagaaaagagttattagtcaagtcaaggagaattctttgcatgcatatggagtgagctcgatctttgttttgaaaatgatcgatgttgagacattcaatgcatttagttgctcaaactcaaagcaatatccttaattaattaaataccgtgccgatcagttagacttagatcgttacttgatcgaccacatgtataagttttactccacaaaataaagtgtatgggaattattatacgactatgtcgaactatgaattgaacaacttccatctctcttgtttcttttgggtggaatcttcctagtcactgacacgtgggccgtctatgtatttaaccagtctctctcactctgccaatactctgaacctccattaattctctctaccgtaaagcttttctgtttgaaagtttctcaatgaaaattttccagtctatattttgaattttttttgcaacaaatgttttctataaagttttaaaataaactttttctcatattcttttagattttagttgtatgtcaagttttcctataaacagttttcaatttaatttttcagtttctacttaaaggttttcttatagaaaataagtctatattttaaaatctaataattaagctgatgtgataaataatttgacggtatagacaagaggccagggtggggacctcgagagatgccaacacagcggcagtgctctagcatggtgacaacaacactgtctttattatctatcagatgggtttaatttttcttttcttttgtttcttggcgctagaattgtaaccgtttagagaaggcgttatgtaatgtgataagctagatttgaacttttcaagatcctttgtcactgtttagacgggactaaaacttttaagtccctatcacatcagatgtttggacactaattataaatattaagcgtagactcactactacagaatctctaaacggtgccggttgggaaccccccttcggtaccagttttcccaaccggcatccaggaggcggcactgttaacccaaccggcactgtttgccggttttggaaccggcacctttgaggtgcccatgagccaaaaaaaaatcggctcaatgcatcgagccgagtgcattgagctgtcaagccgatcccatctacacccaaatcccaaaatttcctcaaattcatcaatcaaacacatcaacatcacattcatcaagaacacattcatcaagaacacacattcatcaagaataaattggagaggagaaggaggaggaggagccggatggagaggacgaggcgccaccaccaccaccattgtcgatgaagccaccgtcgccacctcccgccgccgagccgccgtcgccgccacctcccctctcgccagatctggcggaggggagggcgccgccaccgggccgtcggaccgccgccgccaactcttccgccgtggggccaccgatgcggcgacaccacctccccccctgccagatctggcggaggggagggcgccgcccgccgctgtcgcctctcctcttggcgccgcctgctgcagccgctacctcccgccgccgcctccccctcctgccgccggcaggggatcaggctcaacccgcggatgcaccccttgctcctacagtgggcctcccctcccgccggatctggcggaggggagggctcccctccagctgccaagtcgtcgcctccgcctccacggcagcgcgcaggagaggagggagagagagagagagagaagatagcgaggtgagagagaagggagagagagagagagaggagaggagaggctgagcgagatgaccttatccgatggttgtggggcccgccggtcggctcagccggctcggctcgatccgtaaaggtgttggttttttttacccaaaaccggtacctttaatttattataggtgtcggtttttaaaaaaccggcacctttgtcttaaaaccgacacctatgtgcagggcccaccaacagcagtgtgggaggtagaagattaaaggtgctggttttgggtctagaaccggcacctttctctgacacaagttttaggtaccgtttttttttaaaaaaaccggcacctatttggacataaaggtaccggtttttgaatatgtggcgtgtggaggtgggtgtatgggcggggaaggcattattggtgccgggttttggtgtgccggcacctatagtggcgacacctatttacctttttgtagtagtgatattaataaaacccatccataatcttggactaattcgcgagacgaatctattgaacctaattaatccatggttaacctatgtgatgctacagtaaacattctctaattatggattaattaggcttaaaaaaattgtctcgcaaattagctttcatttatgtaaatagttttgtaagtagtctatatttaatactctaaattagtgtctaaatacagagactaaagttaagtccctagatccaaataccagatgacggttaggatcatctatagagggtgtttgtctgtggtagtttgggtcgcaatcaactcactctttttattatcaggaaaaagaaaagaaaaacatatatcgccaactaccggtccacagatcaatttccttatggtcgatggtgtagctaacattgtgtactatcttccatgagaacgccactatttgagtgaagaaatatattgcaagacatgaaaagatcgagagggcccaatgcaaggtgtgtgcatatatatatgcatgatgaatgcatgtcacaaccaaaagacagtgatacgaaaaagaaaggatgtttgtctccttttagcttcttgtagcgccgttcatagtctaatttgttttatatagtgcttctgaatcttgatagatcacaattttattgaagattttgtcaaaaccgtgttcaaatcagtcatatatggccaagctgggtatatatagagttagcttcgtaggctaattaggatgcgagacttttggtcttatacacatcatgctccaattaaagaagctagatcccaatggatgtgcaagttgtggatgcatgcttgcattgtgttccttgtggcctagaccagaggccatgcaggtctccatccaagataggaaaaatgaaactcaattctttgcaatacacatgtccctaatcaacatatatacatggatgcatgcatgcataaatgtactaattactacactagctaccatgcatgatccctagagcattttttactgactattgttgtgaaaactaagataaataaaccgcaaatgtaactcaataagtacaacaacataaaaataagagcattgggataaactttcctgccataaaaccatggtggtttattgactatacactcccaccgcttcatattataagttgtcttaccttttttatagtcatattttttcctagtttatagaaacattagccaaaatctatgacattaaatgagtttcaataaatctaacattgaatatgttatgataatatgtttgttttgtcttaaaaatactagtaatatatttttctataaacttgatcaatcttaaataagtttaagtagaaaaagtcaaaatgtcttataacatgtatatgaatatgatcgttaactggcgaccggacccattgtaaaagaagatatataaaccattgccgtggtggatctagctagattaagattgagtgttagcttttataatgaattatgtgttaaacactag

SEQ ID NO: 63797 - DNA, 3118 bp, Oryza sativa
agggtttcgaaatggggacgccgggggaggcggatccggcgaggtgggggttggcactcacagtcgccgagcgtgtccgggtggccgacggcggccttgacgcacacctccacgcccatggcggcgacgacgacctggcgcttctcacgtacgggaagagaagattttgggtttcgacggcggcgagctattggcggcgagatgaccggagaaatgggggaggcgggatttatagggagggggagctcgccggagacggagggtgtgagaatgacatgtggggcccaggaggcggtccccccgtgttctggaggcttcggtattcgggacggggagggtagcgtgattgtcatgcggacgtggcggcccatgggccaagacaaaatgagtgaggtggttgcgcctagtccttttctgtttcgaaaggaggaaagcatgaagcatcgcaagattcgagttgcttttttttttcacaaacaatttaggcccgttcccaaattttttttccgtaaaacatcaaatctttatatatatgtatggagtattaaatgtatattaaagtaaaaactaattgcacagttaaggaagaaatcgcgagacgaaacttttgagcctaattagtctatgattagccataagtgctacagcaacccacatgtactaatagcggattaattaggctcaaaagattcgtctcgcggtttccaagcgacttatgaaattagttttttcatttgtgtccgaaaatcccttccgatatccggtcaaacgtccgatgtgacatcaaaaaattttcatttcgcgatctaaacatacccttcctatgaaaaaaaattgaatagtatccattccattgacgagttttttttttgttacatgcaattgtggtagtactactattgaagtgtgattatggctccgtttgagatagctgtaatcggtggattgacgagtaatctgatttctcttatagttgtctaaaagtgtaaacttgatgaataatatggaattattaaaaagttgaaagtttgctctaaaatagtacctaagaaaactttatataactttcttttcctgaaatgtgaaacgcaccgttgagaaacttagagagcatgtaaacaatgtacgattagatactcaaaggggcagacaaatgggttttttcccacttatctcgcttatatttcttttttttccttataaatttataccatcatatataaaatgaactagcaagctgtttttatataggaagtgttgcccacctgcaatcctatctgctatgatcaatgttttggcagcaaaatctacggtgagctttagcgctattccctccgtcccaaaatataagaagttttggttggataagacactttctgatgtctcgtagtactgggatgtatcttatttcagctaaacttcttatattttaagatgaagaaagtagaagtagtgtaaaggagagaatgtagacggtgaaagtgaaacagggctaatcatccgatgagaggagggggagagggtcaccatcaaacacaaaacacgtgttgcatctaatactcctcccacttaaaaaaccaaaaaaaaacaaaagaggtagggcttgtttggtttgaatccaatttttgccctaccaaaatcttggtagtgccaaaatcttggcaagttttggcactaccaaattaggtagtattgaatttaaactattgtgacaaaaaattgatagcaaaccaaacatgtatttgctactattgaattagctaagaaattggtaggacaataagttggtagcaaaccaaacagacccataatatcatccatggtcaggaccatagttaggaccggaggtgtgcgttttgtggcacgttgtgatgttttgtggttgttgatggacctgcagggcacatcctgacgccgacacaatgagatcagggagtaccagcaccaccgtccaccgatcacaattatggagtagcatggcattgtagttgcttctctcttgtccggttctgtgagcacgatgggatgcggtgcctcgccattgacacctcccttccccgcaaagaaaatatctaacgccattgatacgcagaatctgtgtcacttacgcaagagaacagcatgattaaactctaaatatgtaaagttgtaccatagtagatgtatgtgaaaggtcttacacattctgaatctttctagctaggttaacaattcatacaaccccgatgatcgtatcgatttttttatctgattcattgctttattttctttgacaaaaatgacctgtaaaataacaaagtaagacaattttacccctttaaattttataccaccaatagtcttatgatctatttaaatggaaaattaaaccgatgcataccgttagatcatttataccgtgaatatatgctatactaatatgtcatactataaaagttctcaatcataaccataggaaaccaaattcaaaacttgacgacaatagcatggtttcaattttatacgtatttggatacaattagacagaaatagtaatggcattttttaaaacaacacctttataacgtagaattaagggttaattagatctataccactgcaattaaccctatctgatatccgtaggccttctatttgttcctaggccctggcccctgggtgctcgggccgcgtgaggcagagagaggcgggccgcatgggcttttgcacggcccccgtcggctccgaagcgttccgcatctcacgccgccgccgcctccgcaacgccatggccgatctgcaggaggacaattccaaatcctacaaggtcgccgctttcattgtccgattcgattaatcccgcgctatctctctctctttatgcattatctggttgatgatggtgcacgtgtgtatgcattaatcaaaaactaatcacacatggcgtccgacgactcttctcctccagacgccaagaggctacgccgctcgccgccgacctccacctctcccgaccacctcctcgtcgacgagatcctcacgcgcctccccatcgccgccgccgtccgcctccgcgccgtctcccgcgactggaacgccgccctcacctccgaccacttcatcctcgcccaccgcgcca

SEQ ID NO: 63798 - DNA, 5395 bp, Oryza sativa
tcggtgtacgtgccgccgcggctgtcctcccgaatgtgccacctcgccaacctcgacggctcgctgtgcgccgtgttcgacaaccgcgtcgaaggcgacgtctacgggctgttcacgtgcagcgagccctcggcgtcgccgtcgccgtcgtggtcggtgcgttgctccatctacctgaataggctgccgcgagaggtgagcgacgagctgatggaggagcgcgtgatcgtgccgctctgcaccgccggaggcaagatcctgctcgccacggggcaccacaaggtgttcgcctacgacgccgagcggaacaccgtggagcgcgtgttccgcatgcaggagttcgtcgatctacggcatgactacatcaaggcccccctgctgatcaacattggtctccacgacgaatgcatcgccgacgttcacaatggcgacggcggcggcgagaggatgctgcgtgtgaacatgggacgccgcgacaacatggtggtgaagcaagaggtggccgtcgagtaccacgacgctagcaatcgtcaattcaacgtccttttgaaggatttaaagaggatagctgcctgcttccgccgcacatgaacatggtttttgaaaatcaaataccacatccatttcatattataagtcgtttgactttaactttctctagtcaaaatttgttcagtttaaccaaatttataaaaaaaattagcaatatctagaatatcaaatcaattttattaaatttactattaaatatattttgataatgtgtttgttttgtactgaaaatagtattatgttttcctataaatttgatcaaatttaaagaaaattgagggagggagtaacactttatacccgatttcaattttatggtagaacgtgacattatggtagatatcctcacccccggtggtggggttttagttattatgattttatgtgttgcgggagtgaataaaactgaaagcatataataactaaagatacataaagtggactttccccctcattgctatctttccccaactcaaccttcgacgcggttgtcgaacacggcgcaaagcgagccgtcgaggttggtgaggtggcgcatgcgggacgacagccgcggcggcatgtacaccgacccgaactgctcggcgccgacggagaacgacaggatccgccggatctgccagtcgccgggggcggctggctggagcagccagtagaggtagccgttgacgaacaccggtggcaagccggggaggaagttggccgcggacgccggcactcggccggtgcaggggcgccacccgccgggctttcccagggtatacacctagcagacgtgctccccgttgcgtttcttgaagagcctgaccaccttgtgctcgccggtcgccgcgtcgaagccaagcccggtggtcgagagctcgaaggggtcccatggcgacatcgacgggagataactcgtgatgccgccgggtaataccctggctattggttccgagtgtagctccgcggccggctggcacggcggcagcgtgacgtgatcgccggtggacaggttgaggaggtgataccgcggctcgcggccgtcggagacgagggtgaggcccctgcacggcctgggcgacgtgacggcgtgcttggcgctgaagcagtcgatggtgaggagctcgcgggcggcggccggcgcctcgccgccgcggagcgagcaggcgtagaaggtggtggtgctgctggttctgcggggttccggcggcgcgaagaagagaagctccgggtggcggcgcgcggcggcggccctggcgcggtgggcgaggatgaagtagtcggaggtgagggcggcgttccagtcgcgggagacggcgcggagtcggacggcggcggcgatggggaggcgcgtgaggatctcgtcgacgaggaggtggtcgggagagctcgagctcgggctcggtggcgagcggcgtagcctcttggcgtctggcggagaagagtcgttagacgccatgtgtgattagtttttgattaatgcgtgtcacacgtgcaccatcatcaagcagataatgcatatatgtatagagagagagagagagagatcgcgcggggttaatctaattaagctgacaatgaaagcggcgaccttgtaggattcggaattgtcctcatacagatcggccattgcgttgctttggatgcgacgacgacgacttgggtggcgggcctggcggcggcgtcagatgcggaacgtttcgggacggcgggggccgtgtgaaagcccatgcggcccatctctctctgcctcccgcggcccgagcaccccatggcccatgaacaagtagaaggcctacgaataatagatgaacttattcctaatagagtgggaccacctatacatttgttgacaaattttctcctaaaaattgataaatgtaattataatacaatcgtagtgtaattacactgtaacttgtatggaatgacactgtagcttacatttaactatagtgtaacttgtacgtaagtttcacgtaattttgaatcgttagatctattataagatttgttttggtgaggaagaaaaaaaatcacaacacaccatatgtgaaagaatttgttcccacaacctctattttaccgaaataacatgttatggagagatttttgaaagttacatacaagttacattatagttacagtgtaattatatgcaagttacagtgtaattacactacgattgtactgtaattacatatgtcaaatttttaggggaaaatttgtcgacaaatatatagcaaaattgaatagagtagggttaattggatgaataccactattataaaggtgtcattttataaaaatgccattcctatttttgtctatttgtatttatgtcatccgaatacgtataaagttggaaccatgacatttccatcaagtttttaaattagttgtgtgtggttatgattaagaatttttatggtacgatataatgatagcatatactgctagtataaatgatccaacggtatgaatcgatttggtttcccatttaaatagattttaggtttgtattataaaatttagaggggtaaaattgcctgggtgtccctgggtgtgcccctggctcacgccgtccgtcgcccgtccgcaaggcatgcccatggagggaggcgcgacccccacgaggggaacgcgcgcctccacaccctttacctgaggagcagctcatggtccccgtctcccccacctcctccctctatatttttcccttcttgctcctcttgcctcggccgcagtcggaatgtgagttccaagatatgtcattgttaagtgtgagttccataaaatgtcatcgtacaagcaactttgtcccaataatgtgagttctatgaaatgtcatcgtacaagcaactttgtcccaaaaataccatcaccgttagggttctattagcaaccctctgttaagtgctataggatgaacagtgtatttaacagcgcgggatagacggaaccgtaacagcaatggcatttctaggataaaatcacttgtatgatgatattttatagaactcgcacttgtcgatgtcattttttggaattgggcgcttgtcaaaagcatttcttatattttcttttttttaaaaaaaatcaaagataggccaaagccctctctcatttccatgatgagaaacgtcaggtttagcactacaggttcaacagagaaagaaaacaacgccaacacagcagggaagggtgagatgagatctagcgccaacccacttggtcagctccaagcctccccctgcagcaactaccactacaaactatcgatcaacattactcaggggactcaacacatggtcccagctcccaggagtctcaaaagaacttcagcatgaaccttttctccacgttttctcacattttcgatcctcttgaacttcatttgtcagcttcaaccccatcagtcagtcctccagcccgctcctatcatgtcgctgtccatacttcgagttgtatacttcaccgaccacccgtttcagcagttgcgttcccaacagagttcttctttgtatttcttccgacttctgcaacacacccccaagacataagcaaagaacaaacaaaatgtatcacttcagctggatattttggcaactcattctgaaaacaggctttatttctggccttccaaatagcccagatgacagtcacaattcccaccatcaccatcctttgtctctttatcaaatctccccaagcccccaaacaaatggtcaaacactgtaaattgctttcagattaataaaggcacatttcaccacattccaaacaaaacgagctagcaatggccataaacatatactataaaatttgacaatctgacggctatgcacacacacacaaccttgcaaggtatagtaaaaaaaaatagcataccacaattactagctcagatattagggcacatataaaatttcaactatattatgacatataatagcataccacgactgccggtacctcacctccagatgttctacctcctctgcttctgggtccaatggaaccattgccacgacgtggtcttcaggaatcagtccttccgttggaaatgcaccaacgagctgcgttgatgaggcaggcctatgggctgatcgactacctagaaaggacagaatggtgatttcagtttgtaaaaatatgttttcttccccctcaacaatctaactgaactgtaaaactccctgtactaccctgaactcgttgcgatgatatgaatacatatacaggtggggaactctacacttcagcgaattgttaaaagaaagaaagaaaaccctttgtggatttcaagtcggatgcctgtttcccagaaaacaagaagtatgcatctcccaaagaagaaaagaaagaacaaaaagacttacatttatttttttgcctttcttctccagcttgagattcacatttcctgttcttctccagattcaggttcaggtcaagttggcgcagcttccttcatataagaatcaatgatccatacacgtaacgtacatgggaccgcgacgggagatctccctccaactcccgccgttgcttgctactccgcaaaagaaaagagaagcttcacactcacacaaccagcttgaactccctccaactcactgcaggcaaattgctaagccgctagggatccattcctggttgaagaaatgcctgcctctgcctgctcccaaatatcaaatcggctggctctcctagtcctaatacgatggagtgggggctctttggcaccatcagcaggaggcatcgagctcgaccatcgccgccgaccgatcgaccggcggcggcggcggcggcggagtggggaaaagataactgaccgacgaagacgaagagagaagaa

SEQ ID NO: 63799 - DNA, 3949 bp, Oryza sativa
ttttgtatttccgttattcttggcttcttcttcttcctcctcctcctcctctcatttcttgatttcttgggctccttttctttcttggcatcttcttcccggttcttgatttctacttccagttcttgatttcttggcatctcctcttctttcagggatcgcccgtctcggacaggtggttcatgtttggggacgcacgccaggcgcggtgcccggcgctcctggcaggtgcgtgcgcggttgtgctcgacgccacgcgccctgacggcttcgccatggtcggtcccgagggagacgtcttcgccgtcagcagcgacatcggtggtgctgggtctgatccggccggcggcgcacgggagatatcctggcgcgttgccctcttcatagaccccaacgccgccggcgttctccccttgccagacgggccctacctcgtccacagcacgaggagagggggtcgctggcgcgtgttcgtccgcacctcccccgacgaggcctccggcgtgcgcgtctacgtcgttgggacacgttcccgggaagacttggctgactctttgcacatcgccgtcgacaccacggacgacggcggagaggacggattggcccgtacgtggcgcgtcatggtggagtcggggctggacggggacacaggctcttggcgtaccaccgtccacaccggcggcagagccacagcgacggcctcggtaagaaatctcttttttcttgccaagcagtctgggcagccaatcgttcatgcaagaatctaaaattttgttaaggagacaagcagtttcatagttcttaggaactccagttctttaacaagtgctttcaatcatgagtagtagtttgcaatgcgaatgcccaagtgtaaaaaagaaaaaatggaacaacttattagcagtagtagtttgcaatgcgtatacccaagtgtaaaaaaaaagaacaacttattagctccagcactatatgctatacaacgctatgttggagagaagtcaaaaacgatggtttcttaatacaaaactggaattcactaatacagtttaatttctgcagcacgagcacgtctccagacccatctctggcgtcatacgcagcagctcgtccagctcccattcccgatcccgatcatcggagggcagcagcagcggccagcatcagcgccagagcaggtgggaccagccaccaccgcctccttgttgctccggctgtggcaccacccaccgcgtggagtgggtcatgacgtgctgccacaggctgctgtgcgtcggctgcgcggaggtcaatccatgcggatgcccagagtggcagaacaggcgggggttcgccgttcccatactgcctcagcttgcgcttgaggaggaatgcgtggtcgagggagccatcgttccacagctgccgaggtggcagatcttctacgccaggcgcaccggatcggaggtataccacgccttcttccgagtgcaggacgtcatccacgacagaggcagcgtgctctgccagctctttttctacgagatggacggggatagcagacgttggcaccaggtccgctttgagatagtggaacttccatctcgatacacatggatgagatttcctcccatgaccgaggaggatacactggcttttgagttcttggttatacagtacaggcaccgccgtcgtcagtagtccgttcgtatgtcacgctctgccctgcacatagtgtcaatctgtgtgtctgtcctgattttctgactccattttatcccatgtctatagtatatagaactgagccttgagatatggtagtatgcatgattgcatcctcagtttccaccgaatagttatggtggtgctagattctattctgtccatgccatcttttctttacaactttgtaaatcatcatccagagcagttgaaccagaactatgtgtgttgcttgctcgagacaaatcggatatgaagatactatgccttgctttttctgaagttacatgaatctcgttcacaggtagcatgtttttcttgccagcttggatgatagattcatagatctcccctttttctgctttgtttttcaaaatggtgatctactattgacatggtcacttccagattcattagtgcctcagtgggtgcattcaataaatatttccgaatgggcaggttacaaattggtgtagattgtttccttccctgtaattttgcactgttggtatctgaggtctggagaaactacgacctagaaaatttcctcaatgagacagctcttgaatcttctttacagtgaatccctgccttccaaccataatacctgccttctgtacattatcatgattgtagtttgtttctgatgaaatcttgtgggtggttacttttgctgcatctctggctcctttggtacattaaacaacccgtcatgttcaacacccatgctagagcagttgtcttgctcaaacaatttggagtacagcaatccactgtgaccaaggatgtgccctgagaatcctggaaatgcaccactgttctcctgaaggattttagggaaaacatcctttttggagtacagtaactcaagtgcctcactaaactccttagaattcctatgggcttcatctgcggaaagacgctttgcatgtggatccaagaacttatgcctcacaaattacaaatcatccttgtcactcctgggaaaagcctactcgttccctgactgcaaccccatgcacatatcattattttccatctccgtgacctcgaaaacatccttagtcctgggagatggtcagcactgctgctacatggttgatcctcagatgaagcatcatagacttgatcacttctagataagtgccgctgcatgttgcacagaatgtcactttggcattggtcaagagctttattgggctgaggcacaatgtcaagtcccaagagtcaggcaacaataccaggtgaacaatgtgtgaactccaactgttgtggtactctccccttggcagatggtgtatttgcaggaaccagatttcttttgctagagaaaccctgcaaaacacggaaaggaaacagacaattagcctcagtcgggagctcatcaagcaaatggttttcctgcagtaatgcagcattgttttgttgcctctttttttttttttggggggggggggaataattttgttggctcttttagaccctcgattgatttcaaaggcgaactgttgtaaggaagtaaacatcgggacaatgaggacgcacggtgaatcttagcaacattatttgctactaaaaaaaatctgaaacttgagaatgcaattaagcctactggaacagagctagcagaagcacaggtaaatcaaatcatacaccatacatagctgaaagctcgaatacatgacatgtaaactaaacagtgtcaataacatggtcgaaaccaccggatcctcctcctcctccctagctgacacgcccttgggttcggggtgggggggtgaatcaccagaacccaagcgagccccagaaccagtgaacaactcgcacctcggcgcgacggagcaggcgaagacaggggggggggggggggcttcgggcgacggtgcctcgccgcgggtcgcgagccaccggtggcgccgccgccttttcctctcgaggcttcgcggcgcaggccttctgttctgcccttctctctctgtctccactgactggtgggggcagtcggggtggtgggtccccccatgagaatgggcggtggtgcgctggatttttttgcacgcgacgcgggtagataactcaactgcgtgttgtcagtcaatgtggagtcgagagggctgccgcctgccggtggtggggttgagttggggagggaggccatatgatatgatactctacttctgattgagatccttctatcttaagacagtagtttctgttagatcaaatattacaaatattacatagagattaa

SEQ ID NO: 63800 - DNA, 4985 bp, Oryza sativa
  unsure (1)..(4985): unsure at all n locations
caattttggcatgaactaaacacagcctaaactcggctgaaaccatacttagaattgtaatcctatctttctatatagttaaggcccacaaaattctaaaactcaacatataaagatgccatatcatccaaaaacaattattacatctcaaatctcatgcaagcatgataatttattaagttcaagaactttataagacttggtacatggtgggtcctgccgagcttagtcaactattattagatatgtggtatctataaccaagacacatcccacataattcatacgatattccatcacttcttgtaatatcctatatggctatacagttcatcctcactcaaattttagacctttaaaattccaagcatgttaaatcatcattccacataattctcaaaatatttcaatacatctctccatccttttatataatatctatatgcatatacaattcattctcaattagttaatgttatttcactattctctcattaagttatattatctcaattatttgtatccctcaaatgattaatctatagttggaattatcgtcctccttttcttctctcataaagccacatcatacaacttttacatatcaaaaatgatttagcaatcccgtatttataaacaaaactaaatctaatataaatatgcaaatagtatcaactaaatttgggcagccatcgtggccaaatccttgaaaaatacattgaaacgacgatcgctgtcgtcgtggtactcgacgggcacctctcgcttgaccaccgtgttgccgcggcgtcccgtgttcacaaaaagcatcctctcgccgccggcgcccgggtgaaggtcggcgatgcattcgtcgtggaggccaacgctgagcagcaggcgagcctcgcggcagtcattcggcacatcgacgaactcctgcatgcggaacacgcgctcgacggcgttccggccggcgtcgtaggcgaacacctcgtggcgccccgtggcgagcaggatcctgcctccggcggtgcagagcggcacgatcacgcgctcctccatcagctcgtcgctcacctctcgcggcagcctattcaggtagatggagcaacgcaccgaccacgacggcgacggcgacgccgagggctcgctgcacgtgaacagcccgtagacgccgccggcgccgcggtagtcgaagacggcgcacagcgagccgtcgaggttggcgaggtggcacattcgggaggacagccgcggcggcacgtacaccgacccgaactgctcggcgccgatggagaacgataggattcgccggatctgctcgtcgccgggggcggctggctggagcagccagtagaggtagccgttgacgaacaccggcggcatggctgggaggatgctggccgcggacgccggcactctcccggcgcaggggcgccacccgccgggctttcccagggtgtacacctcgcaggcgtgctccccgttgcgtctcttgaagagcctgaccaccttgtgctcgtcggtcgccgtgtcgagccgagcccggtggtcgagagctcgaaggggcgccatggcgtcatcgacgggagataactcgtggtgccacggggtaaccatgctagcggatcagggtgcgccttcgcggccggctggcacggcggcagcgcgacgtgatcgccggtggagaggttgaggaggtaataccgcggcgcgcggccgtcggagacgagggtgaggcccctgcacggcgtgggcgacatgacggcgtgcttggcgctgaagtagtcgatggttaggagctcgcgtgcggcggccggcggctcgcagccgcggagcgagcaggcgtagaaggtggtggtgttgcggtggtccggcggcgcgaagaagagcagctccgggtggcgcgcggcggcggccctggcgcggtgggcgaggatgaagtggtcggtggtgagggcggcgttccagtcgcgggagacggcgcggaggcggacggcggcggcgatggggaggcgcgtgaggatctcgtcgacgaggaggtggtcgggagaggtggaggtcggcggcgagcggcgtagcctcttggcgtctggcggagaagagtcgtcggacgccatttgtgattagtttttgattaatgcatacacacgtgcaccatcatcaaccagataatgcatagtatatgcctatatagagagatcgcgcggggttaatcgaatcggataatgacagcggcgaccttgtaggattcggaatcgtcctcatgcagatcggccatgacgttgctttggatgcggaggcgtcagatgcggtaggacgcttcggagccgacgggggccgtgcgaaagcccatgcggcccacctctctctgcctcacgcggtccgagcacccatggcccagggcccagcaacaaacagaaggcccgcggataatagaatagggtttattggatctactaaggcctcatatagttcgcgaatagaaaaattttggggtcacatcgaacgtttgatcgaatgtcagaagaagttttcggatacgaatgaaaaaactaatttcataattcgcttggaaaccgcaagacaattttattaagcctaattaatccgtcattagcacatgtgggttactgtaactcttatggctaatcatgccctaattaggctcaaaagatttgtctcgcaatttacatgcaaactgtgcaactagtttttcattttatctatatttaatgctccatgcatgtgtctaaagattcaatgtaatgtttttgggggaaaaattttgggaagtaaacaaggcctaaatgtgctgttttataaaaatgtcattactatttttgtctatctgtattcatgccatccgaatacgtataaaatgaaaatcatgccatttctgtcaagttttgaattttgttatgtttggttatgattgagaacttttatggtacgatatacttgtagcattatatcatgtaatgctgatataaatgatctaatggtatgaatcgatgtggttttccatttaaatatatcgtaagtttgtagtataaaatttaaaggggtaaaattgtctttctttgttatttagtgaggtcgtttttgttaaaaaataaagcagttaatgtagatcaaacaaatccgataccattgtggaggttatacgaatgtgttaacctaacaaacattcaaaataaagcggttattacttattagtagtcattgtttgcttaatgtatatctaccatatctaccatcggataagaagggattcgttcaaataccattatttagatgggcttcgctagaataccacccctaactacgacatctttgccaaaatagcattccggacaaaaatacctctatttcttcttcctcctcccttttgtgcttgaagaggttgctggtggccaccggggcgaggttgtcgccggccaatgagtcggggtgggccagcggctgagatgacgtaagcgacgtcacacacgagacgcatcctgggtgctgccccctctcccgacacgagcgacggtggccatggacggcgcgagcaggcacagacacgaccaccgtcgccgcgcggagcgagcgtgtggcggggatcgtggtaggatgagcttgatggagatgggagttggtgcggatgtccttgtcgccctgggaccatgccgacgagtgcttgcaccatcacttcatcctcccggcgtgctcgcgtggcggcgccgccggagctgctcaccacaccctgatggcgccgccatcgttcttttctggagttggaagaggcagaggtaagggtatttctgtccacgatggtattttgactaagatgcactagttgacgatggtattatagtgaaacccaattaaacaatggtattcgagcgaatcccatcctatgcaatggtagatatgtaattttctcaatgcaaacacacttgcagcatcaagcaactattcagagagagagagagcgctcttagttaaatttactgctgatgtgaatgtttttagcccgcagccggttactctaaggattcaaattagtatcatattatctttttttaaaaagaaagttttcaaataatcaaaatttcggagagtattctatagagtccctattctataccgtaggctttgtgtgtttcctcctcgggtgttgggggccctcacgagccagaaagaggtgggccgcccgccgcatgggctttcgcgcctccccgtgctcaccttttccaactccaacccccaccacccacacatccccaccaactctcccccctccacagtcactgacaaacatacccgactttcccctatggcccacccgcagtgacctgtgtctattcacccccacgtatcaaaagcctccgaacccaccgccccagccttgcgggtcccaccacactttgaactttgaattgcttcctcaatcctcatcagtggagagagagacgagcaaagcagagcagagagagagaaggcctgcgccggcgaagcctcgagaggaaaaggatgctgcgcggcggcggcaccaccggtggctcgcgacccgcggcgaagcaccaccgccgctcgaggccgccgtcttcgccggctccgtcgtcgcggcgaggtgaggagttgttgaccgattcgtgcgtgctcgcttccggttttttttttttttctgttcgactgagcaaactggtttcgccattgcccttggtgatcgattcagcggcacggacggcaaccacctcaccggagtcgaagggcgcgacggcgttgcaggatccggtggtttcctccatggaagagacctctgtaagcacaccatttttcatttgagttttaccttcccactgtgctgcgtgttgttgccgtaagcttactatgagtagtacgtgctaatgtcggcgagcgagtatggcgtatgctttgattcgtttgatttgcctgtacttttgagtagctctgtttcannnnnnnnnnnnnnnnnnnnnnnnnnnnnnnnn

SEQ ID NO: 63801 - DNA, 773 bp, Oryza sativa
tgtgattgcctcacctgagctcaatttggtgataaagaaaattgccattctgccgtccaatacactgacaccacatgtaatgtccttgatccaatcttttatttctgcttgacaaaattgtatatatgtataagtactgatcgatgagcagtttatagaaagatcagtttagagatgaatctataagctagtttatgcattgactcattgctatattctgttcctgtctaggttcagagaaaaaagattgagcttttacttggattcacacgtacatgtaccaacaattaatttcttttttttttgggaagtgtatactcctgttgctcaacagaaggatagagaacgacgtgatctctatttattagggccatgcaattacagggtcaaaaatatgtttttttcaagtgcagtgcgtggggagctatctagctatggtaatctccgttaaattgttgacaaaaaatctacatggatccaatttcagttagcgagaagagatttactctggtccaacaaaaggtatctcgaggtaccggtacctcatggtaccaaatcgtttccgatcgttggatctagctaggtaggatggatattgttatattcaatgattagaaatgatttggtaccgtgaggtaccggtacctcaaggtactttttgttggaccggagcaaatctctactgagaaatatgcaatatggggtaggtggatcactacttcaactctacaagtaggggaaagtatattgactctcaaggggacgtcccctca

SEQ ID NO: 63802 - DNA, 3448 bp, Oryza sativa
tgccatgctctgttgtattaggaactaatatattctaccgctacaaaatgtggatttctcaacaagaagaagaagaaatgaaaagaaaaagaaaaggtaaaagagaaattgcaccaagattaatcggtgcatataagtattgtagtatccggcaaaaatccggcaaagagagctagtagccgacgcagtcaacggccatggctccggtatccaagaactggtggaacgtgatgccggcgccggcggcattgtggccgcactcggcgtcgtcgtcgccggcgtcgtcgcagggtggatggttcaggtcgagccacaggccgccgcgcttgatgccgccgtcgtcgtcgtggccgtggacgtggacgtcgacgacgtcgggcttcttgtcgacgacgatcgcccgcggcatgccgccggtcatggcgcggtggcgcctcatgtggccgccgagagcctggccaatggcgaactcgaggccgcagatggagcagccgtggagcttgggcttggacagggagaggtcgccgtcgccgtcgagcctcggcttcttgtggctggcacggtggccgccgagcgcctggaacgacgggaacacgcggttgcacgtcttgcagacgaacgcgcgctccggggcgcggtcgccgcgcgcggcggcgagcggcagctgcaccggcaccggcagagccagcgcctgctcctgctgcccgtgcgacgacatgagcatcagcacgcgcgccatatcgctgtcctcgaatgcaaacctcttcatgatctgaatgaatgctttacttactgaaactttgtgaaccaacctctctgttgtctgaagactgaagctgatcgaaatctgaagcaagcttgagatgtatgactctccaatggagaagaagcacacccaggaggagtatttataggctggatatcatctcagctcactgtgataaatgcaacataaactaattgaccaatggcagtagtagtaaccagttggtgattaaacaaagcacaagttggctttatgagaagccaagaaccagtttaccttttgctttttattactaatctgttgcaagaaagagtcactactctgtgagaggaatactaataactatattattctacattgattcgatcatgaattgtaagagctagctatagctagcaatgcatgatgcatctgctgttggtgaggatgattggaattggagaagcaggagaccgtagacggcgtcgagttttcgccgtgccgacagctgttgcttggatcgatgcaagcgtcggaatgaccttgggatcggacacttttgttttgggtcatttcagacacggtgtcagtgcctcgttgacttgatttatgcgtcccttggttcatggagaaacaaaattctgaatctcactcactcagtctgctgctgaccttgttcatgcatgcgtgcagttcatctcatcagtgtctgtactttgtagattctgggtcaactcattcttttcttgaaagaaaaaagaaagtttgagatcaagtaggaatcacatgtgagtttcaatattttcactacaaatgtagaatcttcataaagcatggtaaactgacaagaagataacagcaacaccatttcagaaaacaaaacatatgacaatatgacaagaaacagattgtagcacaagctgagagtagtagtacactaccactagactaaatatatgtagatcattgaagaaaatgtagataatggcataatgctacatgtagtactttgtttgttactatgaggatatcttctttttttcatccactggaatatatgatgtcccattggactagttgcagtactgtagagcttaccttctgacagttcagtttggttagatttttttttttctgttcgtactatatgtttagtgttaatcaggaccgtacttacttctgaataccttgcaaggaccggagataaactcgtttgattatgcctagacatatgctgctgaatcttggaacgacaactgtacatcttccaaacgatgatcacctgcttgcttgatgagtgatttttttttagacaatgttgattgatgaatgatgagctcatgaaacgtctcatggctaatccaaatggcacatggaacagtatcttgcacctaatactaacttttgcactcactcactgtgcatgctgttgctgctgacagtatcagaaacgactcttccttatttgcatctgagtgaaacttcgtcagcacgaacagccatcttaaacaaaaatccagtagtggcaaatgaggctgaaactcgacgaagacaattgtaccagttcaataagagaaattattcctgttaaaataagcagttcctgactataattggttcttgaatagttggattgcttgcattggcaccgcacttgtctattggactgaactgatcaattattgctgcttgatgtaagcagaaaaggaagttgggggcaaagttattgtgttgtttacttctgctttctgtaacttgcattccgaactagtgctttgctgttttgatggattattatgatctaagagtttatgccttctgcaattgttccacacaatgtcagtgtttgatggggatcaaatggaatcttgcctctgttctgttgacatttacagggaagaaatgtagacaggagagaatattaggtcaataacctggctaatttgatcaaactccatgtgtatgtctgactgcaactctgaactctgcaagaagtatgactgaatcctagattaaaaatgtctctggcaagtaagtacttctgagacttggacattcagaaaagtactaactaattacagaaagatcagaaaaaaaaaagcttcatctgtttgctgcatctcatcatgttggcagcacatacaaggagcacaaacaatttgcaaaggccagttggcaaaggtggtcctttgtgaatcctgaagcaacataatccttttcctttctgttcgcggcgatacgatcaagccaatatagaaaaacaggaggaacaactgttcagtcagttgctctaaaagattcatggagctttgtgtgcacagcatgatgtccttttgccagagacacagatgagcaatttgcagtttcttgccaagaagctactgttcagcaactgcagatgattggtagcttgaattgggagttcaacttgtccctgcaacttcttctcattggtgcagcaaccctaatcagtatgaacttgtcagaggagacaagccatgaacatgactcattgcatgattataatttataagtagactttgtgtcactttcactccgacgctgcatcttgtgttgcgcctgccgttctccgcataaaagatccaaaatagaagtttgccttcattgtttgcctggagattcagcaacagttgcatcaggaatctcaaaaacttgccatcatgtcaaacttgtcctaagttg

SEQ ID NO: 63803 - DNA, 9639 bp, Oryza sativa
ggtcctcagggtgatccaactcctcgggcccgaggggtgtgacggggcaccccgagcccgaggggaggggaagaaagcggaagctctctttccgagggcgtggcccattcagggggactgggcccaccgtatccgccacacgagaagggctttcttttcccctagaccagggacccccgggcccatatcactgacaacacccaaaatttgattttgatcccttccatacccctcccttcagttgaccgtctaatttctataaaaatgaccattttaccctttagatgaacatagaaatttatgaattatattattaaaaatataaaagtttgtcacatgagactattatagttatgagttttttttatgatgcattattcatcacaaaaattatttttagataatgtgtggaggagtgatcctctctagcgaatggtcgtgagacccccccccccctttgtgagttcggccgggggagatggcacgatgatcaagggcctacttccgcttggcgtttaactgctaaatcgctctcggggatgtgtggaagacgtgtgattatacaggttcgggccgctatggagcgtaataccctactcctgtgtgtatgaaattatgattaactttcacaagaggtcatgtgctctggagggtaatctagatgttcttcttctaaagctcaagctatccaagagtcgtcccctttcctggggagtgaggtcctccttttatagttcaaggggataccacatgcaacgtccatgcctacccctccacgggagggggacccaccctgacgggattaggccaccatccatgtcttcagtcggacgtatgatggtcgcgcgtcctcgggtggggcccagtgctgacccccgcttgacacgggggtcacctctgtcattcccctttaaatgaatggagattttggtggctcaccacgcgcagaggttactcctgatagtgctaagatgggacggggcatacctaactccactccgcctgacatagggcggaatatgggggcactgcggcccgtccaatctcctgtgaccagtcatagaccggtcatgcccgactgacaggggtcagtcgcgctgcgccgcacgtccacccacaccgcattaaatgcggtgagggatggttggggcgccgcgcattgaaggcgctgaaccgcgccttccgcgcgcccgctctcctcaccacatggtggccgggcgagggcctcggggtagtatgcttcaaaagcccgaggggtgtgacgtggtaccccgaggccccttggccacttcagcgccatccgaggggcggggaaaggcgaggccgcgtggccacgtgaccagagggaaggatacttccctccgctatgtatacccccgagtccatatcaccgacataatgaaaaaaatatgtatttatttttaaaaaagtcataaaaaactaggagcattcatacaaagataggactaccaatgcttgcaataatttttttatgaatgctcccgataaaaaaatccattgtcctattaaaattttaaataaatattttaatttattacatttttttattttcaaaatttatgtaaaaattttctgcaataattatttagtctcactagtttcataaaatacacatactgtatactcaaaccaaattttcaatcggatttcaagtttaaattcaaacctaaaacatcaagggcaaaaaagatatttgcagccaaacgtaatagtgaaatgaaggaaaatgtaacggtaagggcatggaagggatcaagttgaaatttgaagggtatagaagggatcgggtaaatttcagaggtatgaaagggattaagtgagttttctggagtacatagtgaatttactcttgattttattattagctactaattcatgatcagtgcactcttcattaatttcagcatgcatgtgattaaccagtttgccatcagaagaatgtacagattcttttgctgatggtaatgagatacacatagctagactagtgacacatgcacacacatataatccaagtagtaatatagaaatgaggacagtccagggtccaagtaattgggaggtggtggttggcttccaagaaaccagcaaacaaatcatgcattgttaatttcttaattacatatatatcagacggagtcactagttagttaattaattaattaggtagtgactgtgaggtaatgtgaaagtatacaaaatggctttaatcaattggtgggctcacatgctaatcaacttttgtgatggcgagatgtgcgagtcctacttagctgtaggttgaaattagcttaattaagcttgcttgcttaattaatatagtaaattgattaaccatgcctgcatgacgatatatacatgaggtagcttgatagctggtcggcgtggtgcacgcgggcggtgtgttaaaataaatctctgaatgtttcagtcatcgatcgtcgtctctactcttgtttcataccaatgacttcattaattacctccttgatttgcctttttgagcttgtaattaagataatggttttttgttacgaaaaggaagaggtgaaggctgaagagatctgggttggttgagcatttttgatcgccttgctgtggccatcggaagcatcggtacatctcccagcagcaaaatatatctgaacgtacatgtgagcatcgtgtcgcaattcgattcctgcgagaatcctgtctcgatcgtgagttaagttcatccatgcagcagcatgtctgaatatataagttctccacttgtcgtatcctttactcaatactccgtagtaaggaacaactgatgtttttttttatttttttaataatggatttcaattaatccggcctttatattcacgagggatatacacaaccaaaaagagaaaatccatgaaatgccattgacaagcaccctaatcccagaaatgccatcgacaagcacaacttcccagaaatgccattgtacaagcctatttgtcccagaaatgccatcacagtcaatgtaccgtttagtccacaccgttagaacaaaaattttataaaaacgaccaaattgccctcactccaaattatactatctcagtccggtaaaagaaaagaaattgggaaaatcagagacaaccctaaacctaaccctatgggcgacggggacgatgcggcggacctataggaggcggcgtgggggcccccggcggcggcgcggctcccaggcggtggcagggcgacccctggtggcggcgcgacactcctaggccgcggcgatgcggcgctccaggccgcgccgtggtggcgcgagggctcccgacggcggcgcgcggctcccaggcgacggcacggcggcccctggcggcaatgcggcgctctaggccgcggcgtggcggcgcggggcccccaggcagcggcgcgtggctcccaagcagcggcgcgtcggccctaggcggcggcatgtcggcaacagcctctcaggcgacgagcggcgagaagatagcaaaatttctgaaataattttgatgccaaaatttgtgaatgtaattttggaataatttgattgatagcaaaataattatgtctgaatttaaatatgcatcaatgcaaaataatgttgcatgagcaaacaatacagaatgatgtgtgagcaaatgtttgcctagtggtaagattgtctttccatacaacctaacggagaggagttaacagcagttcggctgtgatggtatttctgggacaaataggcttgtacgatggtattttcgagaagttgcgcttgtcgatggtatttctgggattagggtgcttgtcaatggcattttatggattttctcaaaagatataagagtacttagactcacacctcaacaagaaggagaacgcacaaccgaaaaagaaaagaaaaccaaacgacctcaacacatccctgcttctctgcttcccgtcatattctcctgaaacggccaaatttgacgagtgaaagtcatctagtcgcctctagtgcgccgtgcaaacctccgttggtgccatctttatccgtttcaggtgagttgacgccacgcgccgccaattagcccactttcaactatcatcattcatcgtttagttagaactagccaactagacacgagctgatgggatcggtttttacttcgtcgcatttctaaacatccactattcatagtgcttagacctccgccgtcccgggccgtcgacgccgacgttgaccgggtgttttttttataccaagaacaaaagttattgatgccatatgcatttactgtcccacataagtttcagtccaaactcgagatcatgaaattctatcatgaaggtcggcagtacgagcactaaatttgtttttttttttttgggtgagattgtctggcctgaatctggtcaaacgctataaggtccaaagtgatccagcatatagtatcataggccaaatgtttaggcttccaatatgggctgcaaaggccgataagacgggctacgtgagcccattattgtggcccacatattggtgccgggccggcggcaggttcaggtccagccaaccctgcgtacttgggcctcacgatagcgaaatcccaatacggtccaacaaaaaatgggccgcgcgaaactccaaataccccgttctttgggggaataagttcacttagtgacccttaaagtgatcgaaatcacaaaaccggatatctcgacctccaaactcttaaaatcggtataatttgactcccttaacggttttggaggacggttttgctgacgtggcgcctatgtggtggtaattatcgggtctcctttacacgtgatgttgaggtggcatttagaatttaaaaatatatgtgggatccatttgtcagcgacacataaaaaaaattgtgggacacgtctctcccctccctctccctccagttccttctctctcctcgccagtcgccactccctctctctctctccctctctcctgcggcagtctggcggacggcgagggccggagcagcggcgggcggagacggcggcgagcggcggaggcgcgggcgtggcgcggcggcctgcgactgcgagcggcggagatgcgggaatggcggcggcggcgcccggccctcgccgcccgcggtgggaggcacacgctccctcctcgccgctccctctctttctctctctctctctttctctctctcccgcagcgggcggcgagggccggagcggcggcgggcggagatggcggcggaggcgcgggcgtgacgcggcggcctgcgactgtgagcggcggagacacgggagtggaggcggcaggcactgaacgacgggcgtcagcggcgcctaggcggagcttcaccgcctcctcgccgacggcgaccaggcgttcgagcaggaggacgacggtgggaggcacacgcggcctccctatatacatggcctaccgtccagatacgcgacaagaacgccgcaccggaagacgtcgagagcggcgagcacgagcggaaaggtgcgtacgtgttcgtcctcgctggttcctgatttcttctccccggtttttttggggggttttcttttgactggttacggcgtgcatgccgcatggatgatcggctatttgttttcttgggacaccttgcgagttgggttgagattgagaattgtttggttcgtttgcgccggtgacgattccggttaactgggtcttttttgcaggcacggtatggacggagacggcacacattgttacggcggtgatcggctccggcgtgctggcactggcgtggagcgtggcagctgggttgggtggccgggccgctcgccctcgccggcttcgcctgcgggcaccggcatcgacttggaccgcgtcgacatgagcggcggcggtgacggtggaggacgtcgtcgtcgtcgacccagccacgtgtgccttccgccgccgtcctcctgctcgaacgactggtcgccgtcggtgaggaggcggtggagctcgggccgggcgccaccgccgccactcccgcatctctgtcgctcgcagtcgcaggccgccgcgtcacgcccgcgcctccgccgctcgccaccgtctccgcccgccgctccggccctcgccgtccgccgcaggagatagagggagagagagagggagcggcgaggagggagaaggaactggaggggaggggagagagaagtgacacgtgggtcccacaaatgttttttagtaccaccgacaaatgggtcccacacatatttttaaattctaaatgccacctcaatgccacgtgtaaaggagacccggtcaataccgccatgtaggcgccacgtcagcaaaaccgccctccaaaaccaccaagagagtcaaattgtaccggttttaagagtttaggggtcgagatatccggtcttgtggtttagggtcacggattagatttcaatcactttcgagggtcactaagtgaactttttccttctttgggccgcccgaaatggaaatcccgttccggcccaactagtacggtcgcacgtaagttccggtccaacaagaaacgagccgcatgtaaatggaaaaagtacactgaaggtccctcaagttgtcatcgtgtcagtgcggccacatcatcctcctctctcctttcccctcttctcacccttcctcatctctatctctctcccttctctgcgagacggcagaggaaaagggcgtcggcgaccggcgacgggcgatgagccgcggggcgggcagcgggggaggggcggcgggggaaggagcggcgggcgggctcccccgccggccgtcgccttgaggaacctgcacgtcgcccaccccatctcgagcaccacctcgcgcggcttctcccccagccgcgtcggcccgaggtccggcaccgccgccgtcgccgtcttgtcagcggtgtccgagcactccaccaccctcgtcgccgcctccgctacggggcgcagcgcaggtgacgtcgtgctgaccccctgctcggctggcggcggcggccgtgtacttgtcggcaagcaacgacaacgccaacgccgacgaggcgcgctggcccagcgccgccggattgtgcagcgtgtatgccgccggagtggctgcgtgagctgcgagcccctcgcaatcctcgaccacgccatctgcttcccttccccccccccccccaccacacacacacacacacacgaacaactcaaaaaaacaattacagaattaccaccagaacctgcagatcaattcacagaattgtcaatttgaatctcacataactgatttgatggcaacaacagcatgagggatatatatacacacaagaaagtgaccccaaaaacatgatacacgaacgagacttggcttcgcttttccttggaaaatggagcccagtgagaaaagagagctactagaagcacatcgcttttcctcagagttggacgacaagacggcgacggcgacggcggcggtgctggacctcaggccgacgcagccgggggagaagccgcgcgtggtggtgctcaggacggggtgggcggtgtgcaggttcctcaaggacgtggacacgagcgcctacgacgacatgcaggttccaccaccgccgccgtcgccggcggccaactggaagcgggacgtgcaggttccatcgtcgacctcctctgggtctctgctgggtctaacggcgacggcaacttcgctgggtctaagccgaccgccaccgccaccgccgcccaactccacttccccagccgccgctcctctcccccggccaccattcctctccctcgtgggcctcatgggcgacggccggcgggggagcccactcgccgctcctcctttcgccgcccatgcgctgttcctccgttgcccgcgcgcggcctctacaccgccgccgccccacagctcctccccctgccggccgagttagagaagagaagacaaagagaagagtgagagagagataaggagagagatgtgggtcccacgctgactcagccgccacgtaggacaaaaccgggtcaaaaccaccgaaggacctattgtgatcggttttgattagttaagggacggcggatatctggttttacggttgggggacaattttgtaactcgatgacaagttgagggacctttcgtgtactttttcccatgtaaattgaaatccacggcataagtcaacttaccatccctcatctatgcgtcgagttcaattgacatccctaaaccataataccgaaaatctttatcccccatcttaaaaaaatcattcaagtcggatccaacataagttgatagctgatttcgctgacgtggcatccttgtggtggagtggggccacggtgtgtcgaacaaatccatatatttttttttctttttcttgattaggatactgcgtcaatgaaatcagctatctatagtgctacaggatctaacttcgatgattttgttaagataggggatgaagatttcagatattatggtatagggatatcaattaaagccgacgaaaagataagggaaggtaagtgaacgtactactacttaactgcaccgttcttgggccgcacgaaattgacaccccgttttcggcccaagtgattaatacgggcgtcccggcacaaaacgttaagtcgaatcccgtttcggcccaataaacgtgcattgcatttgcatgggccgtttctagcacgcacaccatcgatctctcgccgtcgccttccccgtctgcgacggcgaactcccggccgcgaggtgcgacgccggcgtgcccctgcccagcagcgagtgcaccgccgccttggacgcgcagttcgccggccacgatgcggctgcgacgttcacctcgtgccctgccggctgcgcggccgatagctaggtgccctgtgccaacgcgaccagctagctgtgatcggagatctcgccaatttcgccatgatccaaagctccctcatgctcatgcgtcgtcgtcgccgctgccggccaccttcagctccagcttccaataacctcttcctccattaattaagcaattaagcacgggataatgggctagctactagctagcaagctgatccgatccaatcaaatatctgattaattaattaattactactcgattcacaaatggatattcgtaaagattcttgctggattctcacagtagtactagtagatgactgtggaacggtgtgctcgcatgcgatcagaacaagggtatgcatgcatgaatcatgatgaattcatgacgatcgtgcattatgattaactgccagcgtgcattagggttaggactgagattatttagctataaaatcaacttgtacaaacttaattactactactactactgaattaattatacctcaaagttgccagctttaggggttagctatgggcggttcaatgggaggctggatactgtattcttctcttcgggtgcagtgtgatagtatcaatttaagaagaaccagttgattacgctagctaagctagctcaccgctgtttcacttcttaattaattaattacaattaacacgctgacccctctgcaagaaacggcgacgaaactagcatattactccctccgtttcgaaatatttgacaccgttgactttttatcacatgtttgaccgttcgtcttattaaaaaa

SEQ ID NO: 63804 - DNA, 992 bp, Oryza sativa
caaaattcaaaaagaatttgaatccaaaacttaaaacagccaaacatatccactggtatccatccacctgccccacggtttcatcggccgagctaaaatccaaatcgaactcaggtcgcccactgacatgcgggccccactaaggtgacggagagatctcaaccaacccctcccacgcgtctggctcgttcggttgccgccatttccgtgagggaaagggaggaaagcagttaagctcaggataaaccgcctcctaatttgagataaatccgttaatccgactcattaatccacggataatcactgcggcatcgtaggccttttttgagctataaatagagctcctgatcccctcctccactccacaccaaaacctctccaatccccaaatcctcctcatctcctcttccagaacctttctttttcgatttcgtgttcgagttctttgtgattgcagcgatggcgtccgtggatctgaccccgaggcaggcgaggaaggcgtacggcggcgatggtgggacctactacgagtggagccccgcagacctgcccatgctggaactcgccaacatcggcggcgccaagctgtcgctcaacgccggtggcctcgccctgcccagcttttccgactccggaaaggttgcgtatgttcttcaaggtattcttacatcgatcgcccaaaccctctacccccatagatgatcttgcggttctgattgcgatttgagggatctaaaaaattttcgaagattgaagtggaattgtggttattttgggtagtattgttttgatcgtggttataatctggctactgtgtgatgtaaaaaactcaaatattagggaaggatctcatattaaataattagaaggggtgaggctttgaacccaggtcgtctagcgcatcatcttgtggagctagctggaagatcgctgagcatttcttagctactgtgtgatgtgaccaatgcagttttgtcgttttggtttaatct

SEQ ID NO: 63805 - DNA, 3008 bp, Oryza sativa
ttaactgatatgttgtgctgtacttagttgactgatgtactagtaattttctattcctacatttgttctatttggaattacttgaaaattaatttatcccctgcaataatgatgacttttttctatttggaattacttgaaaattaatttatcccctgcaataatgatgattttgcttagtatatttcaagatgaatttgactgatgtatcacagtatagtaattttcttttcctacatttgttctgtttgaaataattacttgaaaaattatttatctccttcactaatgatgaatttgcttagtatctctcaagatgaatttgactaatgatgtttcactgtgtttgaccccttctcaggcaagggcacttgtggcattgtcctgccggaggcgagcaaggagaaggtgatcgccgtgaaggagggagactccctggcactcccctttggcgtggtgacatggtggcataacctcccggagtccccaatcgagctcgtcatcctcttcctcggcgacacatcgaaggcgcacaaggccggccaattcacaaacatgcagctcaccggtgccaccggcatcttcaccggcttctccacggagttcgtcggccgcgcatgggacctcgccgagtccgacgccgtcaagctcgtgtccagccagcctgcctccggcatcgtcaagatcaagtccggccagaagctccccgagccgtcggccgccgaccgcgagggcatggcgctcaactgcctggaggcgccgctcgacgtggacatcaagaacggcggccgcgtggtggtgctcaacacggcgaacctgccgatggtgaaggaggtcgggctcggcgccgacctggtgaggatcgacggccactccatgtgctcgccggggttctcgtgcgactcggcgtaccaggtcacctacttcatccgcggcagcggccgcgtccaggtggtcggcgccgacgggaagcgcgtgctggacacccacgtcgagggcggcaacctgttcatcgtgccgcgcttctgcgtcgtctccaagatcgccgacgcctccggcctgcagtggttctccattatcaccacaccaaagtaagcaatctccaaatccaatcaaaactattgatagaataatcaaaaccattgatagaatattagaatcagcattgcatttgtgtaaatccaatcaaaaccatggatagaatattggaatcagcattgcatttgtgtaattccaatcaaaacactgatagaatattagaatcagcattgcatttgtgtaagtccaatcgaaaccatggatagaatattagaatcagcattgcatttgtgtataattgtgctcatcgattgatgaatttgtgcagcccgatcttcagtcacctggcggggaagacgtcggtgtggaaggcgatctcgccggaggtgctggaggcgtcgttcaacgcgacgccggagatggagaagctgttccggtccaaaaggatcgactcggagatcttcttcgcgcccaactgagcagcttccctttgccattgcgtcgtcgcgtcggtgtcgtcttaaattaggattaagtcattaataatttcatctcttatcatgagatgttactaccttctgtcagtcttatgctattgcggttgaactgtggtgattcgccacttaaaattctattctattcgagagtgccttctggtgcaaatttgctctgctttgtttcatctgcaatttgctttgctttgctctgtttttgttttgttttatctggaatgcttgaatgcttgaggtgattgattcagagaagaggagaacagctgcgctggcaaaacaatggatggaaactggataaagaggaccttatattggaatgagatgcaacaactagtcttcatctctctttgctttctctgtttaatattttgctctctctgcttaatgggttgatttgcagctatcattgttgtgtttatttttattgattttccttcagacttcagaatcgacaagattagcacatacaatttaccttttagtaccacataccttaattaattctttaaagtcaacttctcttatgctttgttactcttgttttctatgttaaatctttagtcagtggagaatatttaggagacatgacaagcttttttttttatatagttttgttctaccaaaagttttgttcctattttgtttgaagtattattaaaaaatcaaattaatccatttttaaaaaaattagctattaattacgtgctaatggactgttccgtttttcgtgcggaggagatgggttttccgtgcgacgtgtatcatgctcatggacgcatctcttggggcctgttcactttgatgccatttttaaccttaccaaattttggtaaagttaaaaaaaatatgcctacatttaatttgctgccaaattttggtaaatttgttaaggtttttttttggcatcaaagtgaacagtcccttgattttcgtgctcatgtagccaacacaacgctcgtttcttgtgaagtcaaccatccaattagcaagcagattaagacaactttaaaatactaatcctactcatcttctgctgcaatatggatattgctggtgataacgtgcagccatggggattaaacaaaatgcaagtggagtgctccacatgatatgatattcgtttgatgctatcaatagtcttgtggattttgtaatgattttacaagaactaagctgggacaagtgcagctcacctactgctatgctatctccagccttcactccaaaggatgcctaaccttatcactaatttgcttcaagcgtgaatatacttgggttccactttgcagcaatacaaactttttaagcacatagatgtactatcaatggctaaccaatccatccattcaaatgatcataaaaaattttatcaaaattcaacttcttttttaccaggaacaggccaaaaattactgatcagaaaagggaacacaaactgcactacagaacaagaagagc

SEQ ID NO: 63806 - DNA, 2073 bp, Oryza sativa
tgcgttctactccatgactacatttgacatagtttttagaaatttgaactctacttcatgaccatacttggcacaattttaagggcatgttcactttaatgccaagaaaaatcttaccaaattttgctaaaattttggcaggatttcttatatagttaccaaattttggcaacaaactgaatgtagccatttttttggcaactttaccaaaatttggtaaggttgaaaatagcatcaaagtgaacatgccctaagatattgttgccccctaacaattaggagtatccattatcatccaacagtcattaatttggcaccgttaaatcagctgctattcgtaggatagtttagaacaaggcaagtgtattatgttctcggtttcttagtgatgatttttttgaagcttcatccaaatgaacatggatggatcaaataggcaatacgtttccggtaaattcgagaaacgcctaaggatcttccggctagcttcacaagatggtgggctagccgacttagttttgaagccccactcattctaattatttaatattaggtctttccctaatatttctttttttttgttccggttaaattccgccaggttactcgcactcaaaccacatccccatgctctacttatagatagagcttgagaaatattggttttgattagttactagattatctctttttgaatgaatttcaaatgtttatagccattaggatgtaagggattttattccaatattcaaatctgatgggggcctaactgcaaaatgtgcacctgtcatcccatataaaaagttgccccaaatgattccatcacacaaactcctaaacccacaatatacaacccaagatacccgggcacatttacagaaatgccccccaaactcctcacttatctcatcctagccctcctcgccgcctccgccgccgcagcgcggcgccacccgtctccggcgagctcagccgccgccggggagcccgtctacctatggccgctgccgaggaacttcacctcgggttcccggaccctgctggtcgaccctgacctcgcgctcgacggccagggccccggcggcgccgccgcggcggtggccgaggcgttcgagaggtacagatcgctcgtcttctctccatgggcgcacgccgcgcgcaacgcctcgggtgggtacgacgtcgggaagctcaccgtcgtcgtcgcctccgccgatgagaaggtaccgtgtgtgtgtgttcgagctgctcccgagtttggctcgacggttgcttcgtctggatcagcacgcacactgtgaatttctccgtgtttttgtgatgtagctggagcttggagtggacgagagctacacgatctatgtcgcggcggcgggcggcgtcaattcgatcgtgggtggagcaaccatagaggtgatttcatttcctcttctccagattatgcccttttttttacagtagtgttgtgttggtgaagtgttttgggagaatttgacgtgagggctactacttctccctttttgaagtacggtttaactcctagcgtagttatggagcaagtagagtgagctgagtgagtggtaaaaagaagacttcaatgtggaattactgcaaatattgatgaactggtttccagtgaaattcagcttataacggtatagcatagctaaggctgaacttctctaatgcaatgaacttgattttttttaatgagctagctatttgatttttgcgcacttctcagtagatgcatcaactcttgtggtattcttggaaactctgatatgaaatgctcatattattgtgggttttatcaaacgaaactaacggttggtactgtttgtggagtgtgttgattgatacgaacatcatctctgaatattttagagttctactgccaggcttggggtcttggggccttgggggcatgggttcaactaaagtagccctcactcatatacagtttagctttgccggttgtgccccctgcaaactttcagagaactgaagacaaacgttgctattaagttataatattgtccaacatttctcttttatgcacaagtgtatgaa

SEQ ID NO: 63807 - DNA, 2207 bp, Oryza sativa
catatcatcgacgagcaatcttttccattagaagtaccatcatatccaaaactatggaagggttcatattcaaaattggagcgctacactgtggaagatgcacgtgatattgtcaggtatcaagtttatcatttgcctttcgcattctctgtatcttctttatattctattgccaagttctttcagttcacttataaaaggtgttctctgatttcacgtctgaaacttcccgactctaaagctatgctaggaaaagaggtatgcttatttccaattacatatattttctttcatctagctgggtgtagtatcgttctattttagttggaagtttgggactctcagccgcaggggattgtatgatactcatgcaattacatgtttattgaactctttgtcacagtttccctagttgttgtttgtctagaatgttattgctctacaaggaatgtgttctgattattatttacatctgttaggtatccatgtcatggctgaaattgacgtgcctggccatgcagaatcatggtgagtttgcacgtacaatttcctattctgttagatttctgcttgtgcatcagtgaggtttgtcccagttgcttttcacgtgcaacagaattatcttatgtgcaaatcaacaaataatcacatgctgtttctttgtgtcgcttagagttgcaatattatgtgattaatccaagctcttagctctagcatttcagccgttatgttacagtaattcaagtgtcactacgttccatttgatccagtgatttaattgagtacattgtatatttgtgtacataaccaagcaactgggattcagttactaccttatatgctgtagcaagcatttcagatttggttttgccctgttgttttgctctgttgtgcttattatatgaagttgacttgttatctactcagagatacttatgcaaatattaatttctgcaggggaaagggatatccaaagctctggccttctcctaagtgcagagaaccgttagatgttactagcaatttcacatttgaagttatttctggaattttgtctggttagttcctctttccttcttaagaaaaaactggctcaatttagggattggttgttactcagagacacatgccttcatattttcatttatagtcaaactcaaatattttttgttttcatggagagtggatgcaaaatcactatagtaatgaattgtgacatgtgaaataggtaaggcactatcaaaatgggtgtacttaccccttagtgctttatctactagcgctgcaccaaaatggactgatcaattcaaattttggccatgtttgattactcatcactgtaaactcaaaacacaaagggattcacatgattagtccttctgcaggacagccagtaattctatattcctatattaggttcagcattttttcggtcactttagcatgcaactgtttgacaactgggtgtctgaatcactacagcagagcaagatgtgcaaaattattagccagagtaggaccatccttctgtacaatatcttcccactaaatattcattataatgttacatgataagcagcgagccaacgacagagagtgcaagttatacagcattctgtctttcctgcaatttaaccaaattaacttcttgcccttttcagatatgagaaaaatctttccatttgggctcttccacttgggtggtgatgaagtatatacaggttagcctgcttctcttgtttaataggaggcacttcattaataagagtgtaagatgctgggatgttgcaaacttttggatttgagtgtgagccaactatcttccattaaactgatatgttagaagctagatcttttatttctaggaagaaaatcttgtctctaatactccctccagtcaaatatatttgatgttgggacttgggagagctaagtcaaatgtatttgacattgggtgagctaaacttaggtctcccaacatcagatatatttgacttgagtgagtaatacttttgccaaacaaggctcgctgtgttgtaagttacaactacaatttatgtccgctttcctttaatgttagtttaaactgtaagctatatattattatccagaatatttattcgtaatctgtgcctacttcataccaaatccagtagagtatcttgtaaccgataaatacattatgttcattgatgtgactggtgaca

SEQ ID NO: 63808 - DNA, 2447 bp, Oryza sativa
tttcctgagtttggctttgacctgatacttatgctccacttgctggtccaagatttcatttatgggggcgggtaagttacgaccacctgttgctgcttggtgatctagatgagagatgagaacaagttttggtcatttgttacaggtcactgtcctccaatgtcaccatccttggccatacatatctacagctgctgtttttttctctctatccagagctcagttttttcgtaaggtgggcagtgaatgtgaagaaaggaataccacctataataagcagctgtgtgaaactttttcgttaaaaggaagagaaaaagattggccctttggactgagaccagtgactgtgactcttgaggcagactggagaatggccttttgtattgatgttcttcattgcactattgcggtacatatatttttcttcctatgtgaatcactgatgtgactgctggatgatccgtagaatacctatggactatgtgggtaccatgtaggagactagtagtcgatctgtagtacatgttgtgcaagttgagatctttttgtccctgggagtatttgtagtaatttcctgctacaaagtgtgtgcttgtgctctttcacagaatcatgtaaacctgtgtttactcgatctacaactgtagctccttacacaggaagcaagggatcctgtgtgacaccgagattaacattactatatgatatagttgaaacaatgttgcactcaacttagactgtgggccttgaccaatggactggtattgttatatgtacaaaaacaaagggtaccccgtggttgtaatgcaacgagcacaaatggactctttcattatgttgtactatgtaaaactatttttttaagaaacaccactcatgcacaagcgcgcacgcctgtctatgtaaatgtatacatgcacactttactcctataaacactttcgaggaccggcctggtcagtatatcttgaaattaataaagctataatggttacctcactatattgtgataataattaaccgtaaatacgagcacatattttatcacaatgaatctaacgaatgtaatagtaatattatgctttgggaatagaagtttaattggataacatttttggtgtgtatagaaaaccaccctttcctataaacttgggattaaacacctattcgattagcacagctacatataataaaattattttacaaaactcttacaaatgatcgtatcaaccaatcaaatctagaatcactcgtagcgtgaaacatcaatgttattaagagtttagtaagataattctagtacgtatagactgttcactatatacgcataccatccccctaccaccaccaacacctccatgactatcaacatcaccaccatgtgttcttcctaagattacatacaatcacatttcgtatgcatgaattaatattcaatttagaaaactgctctatatgcttctattaaatccacaaatctatgatatatttacgggcctgattggtagagctctaattcttaaatttagctctaggagttgagcatggagtggagctgtggagctgtctaaactcagctccgtctctctaattcattttgtaagagagctccacctagctctgctcttatttttggtggagttaaaactgtttggctgagagctggagctggagttgtaccaaaacaggcccacgcgtacttatcttaaatcattgcaaagttagcaaccgcctttcatccaacacatgtccagttcctgagtgtcagtgtccaaagagcaggtgtacctaacattatagccaagccaaggagaaagagagagtggccgttttatgtttttccgttccgttcccctagcgcttaggcttagcgctccatgtaagaccaagacccccgcgtcaaaccgcgggccccaccgcgcagccgcacgcacgaatctcggcgcggatcggacggcctctcccgccctcaaaaccctcacccacttcccctcctctcctctcctctcttctcctctcacccgcgacctcgctgctcgcctcgatctcccgatctgctcgtccccaagcgccgcgattcgccgcgggtggatccgacgccgccggatttgagcgtgggattcgactcactcggatcaggttgggggttcttctacttttgtttttttttctgattttttttggaatttttttggggggtgtggaatggcgtgagaatcaccatgcgggtttggtgcgatttcgtgtaggtttgcgtcgccggtggtccgattcgggtggccatggccacgcccgacgacggcggagggggtgtcggcggcggcgcggggaagaagttctggcgctccgcgtcgtggtccgcctcccgggacacgccgcccgatgcggcgacgcctgcgggggcgggcggcggttcctgggcggcggcactcgacgcggtgcgcctg

SEQ ID NO: 63809 - DNA, 3012 bp, Oryza sativa
catcctgcgcaagaacgggatcacccacgtgctcaattgtgtcggcttcgtttgtcctgagtacttcaagtcggacctcgtctaccggacgctttggcttcaggacagcccgacggaggacatcaccagcatcttgtatgatgtgtttgattactttgaggacgtcagggagcagggtgggcgtgtcttcgtacattgttgccagggggtatcaaggtctacatcgctggtgatagcgtacttgatgtggagggaagggcagagctttgacgatgcgttccagcttgtgaaagctgcccgggggatcgcaaatccaaatatggggttcgcttgccagctactccagtgccagaagcgggttcatgcgattccgctatctccaaactcggttctgcggatgtaccggatggcacctcactcaccttatgcgccgctgcatttagtacccaaaatgctgaacgaaccctcacctgctgccctggactctaggggtgcattcatcgttcatgtgctctcatcgatctatgtttgggttggaatgaagtgtgatcaagtaatggagaaggatgcaagagcagcggcgttccaggtggtgaggtatgagaaggtgcaggggcatatcaaagttgtcagggaaggaagtgaggtaccagaattttgggacgccttttcaagtgcacctgttaattcagacagcaatacaaagattagcaaggatcagattgattcagcatccaagactggcccggggaaccgtagggtggaatcttatgatgctgattttgagcttgtatacaaagcaatcactgggggtgttgtgccagcattctcttcttcaggtgctggtgatgagacccatcttccagcaagagaaagtacctggagttcactaaggcgcaagttcatctctaggtcgttagctcgagtctattcagattctgctttaatcagggacttggatccgcgggtggaccgagtacaacacctggctgcagaggcatcaacatcaccacctttcctatctccgagctctttgtcatcagattcaagcatcagttcaaagtatagttcagactcaccctcactgtcaccttcaactagctcgccaacatcacttggtctttcgcccgcttcatctaatttttcccacactttggtgccatcatctaggtccccccttcaccaatcatctaacgaggaaccttcaaaatctggcctggggtcaatacgctctccctccaagacctcttctatagcagaaagaagaggagggttttcatctctgaagttaccatcattccaaaaggatctagtattaccaccaagggtaccgaccagccttcgcagagaagaggaagtcacagataagagtaataataatagtgtaaaacagcttactggtgtgtgttgcccagagaaatgcactggcaatacttcaacagtgcacactaaaactggaataactgagcgtactgacagtatctcagaggcttgcggtaatttacaactattagtctaccgttggcccagcaaggaaaagctaactactttcactcgcaaggatcttgacccaaaatcagttttgatttttgttactcctgaagacagcagaagtgaagcagttaaaacggtacacatttgggtaggaggtgaatatgagagcagcaaatgtgttgacactgttgattggcagcaagttgttggtgatttttttcatctaaaggagctcggcaatactcttcctgttaaggtgcctacacttatactatacaatatctattttgtttactctactttgcttttaaaggttcagtgctagttgaattttatgctctgtaagaggttagagaatactaaattctaactttacgaagctagttgaattttatataccgaggatactaaattctagctttactaccatctcagatagttttccaccactgccgaaactttgctagcagccacccattatttatcattgctttgagctcactgcgcacactagtctgccttgaactctttgccttttgcgcgttgcagttatggaccaaatattttagtggaatacagaaatacagaatcatatgttatgctattactgtgtagaaatattgcaaataggtgaaccattttgtggctcattgagaattatatattcagaacattttcaatttgcatagactccaaatatgtttaagtccgataattagttactggacatggactttttttctttcatttatggaccatgacttcacaatcttctcctagattattggaccatcttaggaagggaaaatggaaacatgaaagcttgactttttttttcgccggtatgtagagtgcctagtgcggtagtgccagacaactttatcagatattttatcctctggattatattatgtcatgattcatgaccatatacctctagttttgtagtatatgcccatatgaacctaacaggcatagccatgcgtatactacaaaactgatgcgcatatgaacctagcaggcataaccacgcattggttgactcttctagcgagaagcacatggtgaatccttccatatcatcttacaaatggaatctataatttctgttttctatgaggcttcacattccattccatcttcttgtgaaataatattatgtatgaactggcatggtccgtaaacttactgtagaaaaaaaaagactaatacttctcttgattatttttcatatcggtttactgtagtagcacatggaagtatggaacttaggttgatgtttcatttattgggccacaccacaattctgtgcacttctggcattcactataaatcctcataaatttggcatgaattgtgtgaaccactgaaccttgcctagaattaccttctcttacttctacttggctggtggtttctcctgtccttacaaatgtcacgaataccaatcagcatctgtggatttatgttataaagaaatgttacaaattccacacctaagtgcaatacttcttcatg

SEQ ID NO: 63810 - DNA, 3694 bp, Oryza sativa
atacttcttcatgccatgcaacattttgttctgcctggaaatgtataactggacactaattggatcggaataatgcaggttttcaaagagcatgaaacggagaatcttttggaagtgctgaatgctcgttaatggtaggctcaggctgtaggtatcagcatattgtagtagcttaacaaagtcagccgtgaagtatgattgaatgaaggcatctcctccagaatcgctccatgcggtggtgattttcagcgaggtataagccgttacaactattccccttgaacatatagaccacagattccatttagtagaactgatgatggattggcaattgtgcctacctcatatgatttgcttatggtcagaaaatgggcaggaggctgccagaacgttgtatctgtgagttaaaacacacatggatcaggttttggcacaatttgggtgtatattctccgctcccctgtaatgtaagctcagaaactgggaggcaacggtgtcgttttcaccctaaaaatttcttgtacatctcgaaaaagaaacagatcagatgtgtaatcctcttgtcttataagtccctccattggtcttaacttttaagctaacacttggttgttgggtgtaccttctctgattgtgatttagtactcgatgatctcccatgtttattagtcaaaaatcattgcacgataaagggaaatttggttgaagtgctgacgtccattttactgtagaaaatcactttcatgggcttcacgttccggcccaatataaaaggcccccccgcaagtggtccacagtaccgttcctgcctgtaaatgggccaaattctctcgcgtgacgcctgtttacagttgggccggaaagaaatatggctgcgcgtgacccgagcggcagaagccacggccaacaaacaagacggcgtccagcactatattagtacttgtaatctaatgactgcaaagataattttacattttatatatcaagcacctgcagtgcagagaacggcctggataaagcctcaaaaacggcagccaagtcatttcactaccagcaggctgggcttcctcaactatttgccactggatcctcctaagctaatagcctaataacccttgagccttctgagctccatgttaacacaaccctacaacctgtcgtccagttaactcatcaggatgtcttcattcatatctcacaccaagactttggtgtttggtccggtgcagcaaggcaacaaatggggtggatctcttcttatgtcgtttggtcagctgttgttagcagaattcgacgggtttgcagcggctggcttctgcggtttacttctcaagaagctttttgtgtacagggctccgaatacaatggcctgttaccgaaaacatgttaatcataactgaaacgaacaatgtgtaatatcatggaatgatttacgaaggctaagacagatgacttacggcgccaacccactgcatccagctaagaggatgtacaaaccacacacaggacaataatatactcaccagctacaacaatacatggaaaataactgttatggaaaggttaaataacacatctatacacatttaaggatgataaaaacagcattcacctgtctagtcgtcattatcgtagcaaatgtgagagccccaaatgttcgtatggtgtacgatatgaagaactgactagctgttgcaacctggaatttgaaacacagtaaaacaatatatcgtactaattatgcaaacagtcacaatctagcttcaatttgtgggttaagtgccaaatatttaaaatttgagacagttcagaagattattttttgtcctaatttaatgtcccaccagacgtactagttagtattaaatttcatctccatttacagcttatgtggagaggtggtgacatggaaacaaggaacaagcaacaaaattgcacgttaaaatatcaaaaggttagtcttacactggataggattatgacgtcgtagaagcaatctggatgacgaaacataaagtccacagctggaatcatctgattctggagaataagtcctgtaatagaattacagcaacagagatataaaatcatgaccgtagcagttgttaataatgtactccctccgtactcgtaaaggaagtcgttttgaacagcgacatggtctccaaaacacaactttgacttcctgtttctataaaagtatttattgaaaagtgatatatgtatacttttatgaaagtatttttcaagacaaatctattcatatattttttacattttcaaactcaacaacttaagagttattcatgatttatattcccaaggtttgacttaaacattgtcctaaacgacttcctttacaagtacggagggagtattgcgctgtacagtgcagatgtacagggaaaacattgatagaatcatgaaagcaaagaattgcaggccaaatttctgcagcacataataaaagaaaatacagcaaccataagggcaagcagttaccgctcaaactaagaacacaggagcacattgtcgtgtagaatatttgattgtgtatttccatgtcataccctttaaagagtttatcttggaaggtgcttgtgaaaccatcaaatctaaaatcaacaaggaaatttgatccaattagatagaagtctgagggtcagagctgatcaagagaaagtaaaaagggaaagaaaacacaacagtgaattttaactgacaataatgtaactgtactaatactccaataccactgtagtaaactcattttaggggattgaactgcttatacttttgtattccacgaacgatattgaatcatacagtggaaagattttatatttcctagcccagattttttatgtgccagcaaacatgtattggtgtatatatataacaaaagaaaatagttctaacatggcaaaattatttaattgtattttgaatgtaacagtgtgttatatgattgatgagtgcaagcaaaagcagatttgcatgccaaatagagctgagtaatcataagatttcataaatgtaaactgttatagaatgctatgatttgcctcgctgagtttaagataagaaggattacccaagataaccaagcatgagtgaaacgccccaaatagtgttttctctgcctctgttgaatggactggcatccattgatgcctgtatccatgaagacaacacaggaaaaaaaatcacttcagaagaaataccaaaatctaagcaaggtacaaaattttcaattattaagattagttcttcggatgataaaactctcacctccatactgccaccaattgaattctagcgcatgctctattcctattataattttgtaatgcgtttggaaatggtggcaattgaaatttcttatgttttccaacacattttctatccgtgtacatttatctagcacgaaataatgtgatattcagcagtaaatgaacagagatggatatgggaattactgggtatagaatgaacaacgagcaaccaacagtcacgacaactgcaaagaagtaatcttttccaccgtacttcttcctcattataattgtgccccaaatctatcaaaattaaaaacaaggtaatagatataagaaaagggaccatcttaattgtcagggaaatagaactcgaacatggaacgtgtaaagtagagaagacaaaaaacgattcacat

SEQ ID NO: 63811 - DNA, 6634 bp, Oryza sativa
tacggcaggctacaattgaagggggcggatgccaactttcttctcatcattttagtggctacttctcgcgatgatgttttcttcatcataaggcagtggcgttcagatctaccatagaccatcgtcagcttcacttcgattaaaggtatcgcttatctatatctcatcctttagatctaccctatggattttgggcgtgtgcctttttggcttctcgcgacattatcttcgtagggtatttagctatagcctatggattttgggtgtgtgcctttttggcttctcgcgacattatcttcgaagggtatctatagaaggatgcaggtaatgatgttcgtggccttttgtgattgtgttaagtttggggtatggaggttctgtctcggaatgagggggcaacaatactagtgggcttcattcaggcggtacttgttactaattctttaactccggggttaaatccctaagtctgaccttagttggttgtacttggcaatggatgttctttccttcttgaaggcattgtctggagttcacagaatttccctaggtgaaaacctatggtctgatcttagttgattggaacatgacaatgatgacgcgtgcgtgcgtcatttcctcattggaggcgttgttttaaagggagtccatttgatagtctaagtgttgttttggtggagataagagatgaagattacttgtggttgtaagtcgctgcggcacggttgtagcagttgtgtcgctctttttccttttcttttataatattgataggctgtgtgcatcctagctatgcagaggccgagagtggtcttagagaaattgtatcttctcgatgtaattgtttaagatcaataaaactctctttatctaaaaaaaaaaaagggtccagttctagaacgaagtaacgggagcaccaagatgcatcgcccagtcattttgatttttgacgaccatatttttgtgttaagaaaaaaatcatttcatgactagattgaatcgaaccccgcaccaccaaaatggaggctcagtctataggcgacagagagcaaatcagccatttgtgacgcggatttcgaggaaacgacgaacagccacgacagatcgccacaatcccccgagctgttacccccattggtgggttcaaaattgggcgtgagcgattggaatgtgaaggggaggtcgaagaggggcacctggagaaggccgtagatgaggagggtgctcatgatgccgacgaccgcgaagccgcacctccccaccaatcggcgccggtcctccttgtccttccccgtcgccgccgccgccaccggcagcgtccccgccaccgccgccgacgccgacgccgaagacgacgccgcgtccgccatgccctagcctagcctagcctagcaggcgaatcggatttcgcggcgcggcgaggggagaggagaggaggcgatcgatggcggaggcggaggcggaggcggaggcggagtgaatgcgtcgaggcgcgtgggccccacgtggcagctacctccgctgggactcggcgcgtgcgctgactcctctctctctctatccggtgaaggcgtgcgaccaaagcgtacggccggtctgtaaccactaaccagtaaggcagtaaccacaaacacagggaagcgttcagattactccactctacacatgccaataagataagatagtgctcactccgttctactccaacgaatttagatataatagagatatgtccagattcatagtactgctaggttagtcttttatagtactaagggagtaaaatataacagcacttttgatttgtccccataaataacaatttttccttatcaaccaatcacaaccatccaatatttatatttcccaaataccttcgcttcttaaccaaacaccaaggttcacaattccgacaaaaaccggtcgaattccgcgaaatttcaacgctttgacacagctcataattaagtttcgattggaatttcgaaggttaaacggtagatttggtcaaaattcagtcaaaatttatcgaaaaccgatcgaaaattattcctatttaattctaccttctttaattctaaaccgatcgaaaagtaatgtaaaccctgccaatcacaacttattcctatttaattctaccttctttcttaaaaaccgtattcaactctaaaacttattatattttattatatttaattctacctacgaagatatatcctccgttcaaaaatattttaaattcatatttaggattagttttttttacagagtagtatattgatatattttatagaaaaatgctattaagaagcattatgaaaataatttctatgaccaagttttgcgacaatattgtataatttgaacaacactcgcaggatctcagttgcagtaatcttttttttttctaaaaactacttaacacaccattcacatgtaccagcatctttgagaagagtatgacgctcatcattatcactaaatcgcccgtgctagcatgtacgtggtgcctccgatacgatattattttagccaaaattttcaattttttttgaaaatttttcatgaattttggtaaaatttgttcaaattactaaattttgttctaagcttcagaaatttcatcatatcagcactgctcaatacaaaggccgaaaacgagaaagtgaaccctgggtggggatactttagaaatattttacattcgtgtacaaattttatgcgtaagaatgcttaaatatgtaaacggagggaattccattgttattgatcaaaccactaaaaaaataataaaataatttataatatgaaacggaaagggtaaaagatagcatgaagatggatatcttaaaagtgatacagaaaagttgaacacagccagcaaaatggagtacttgggcgattaggtaataaagccaatataatattagtagatagatagatcatgtccagtactaatacagagcaactaaacattgatgcgaggcagacacactgaattctgaagcagacatggagcaaaataaggcgaaatgggcagcaagcaaatcgaagaacgtccatgcggcatcgataaaaagcactggttgtttcacttcttcttggcgaggaagacgtcggagagcaccgtgtcagagcgcagcgccgccttcagaatgcccagcccctgtcaagaacaagaacagccaagacgatgggtgtgtttagttcacgttaaaattgaaagtttggttgaaattgaatcgatgtgatcaaaaagttagaagtttgtgtgtaggaaagtttccatgtgatggaaaagttgaaagtttaaaaaaaaaagtttggaactaagctcagccgatgatgaacattgaacaagaatgaatgaataattcatcagatgcacaatgctgcactatacctcgtccatggcgatgctgacgtacttctcggcaagctcgacgtctttgccgacgctgaacttgttgatgagagtgatgctggagatggccgacatgggcgtcacctccagcccgtccgtcaccatgtacgtcacgagccccttcacgtacccgctgctctccccgtcgcctcccgacgccgccgccgacgactgcgccggcgacgacgcggacggcagcacgagcgccacctcggtgtccatcgcctgcttgcactgcgggcacgccgccttggcctccatggcggccgtggtgcagtgccccgcgcaggtgtacagcttaaacctggccagcggcgatcccccggcgccgccgctctccggctgcagcagcaggagctcgcgggcgtccgggtggagcaccttgggctggagcaggtcggcgcggtccttgttggggaggaggtaggaggcgttgatgtgctcgacgctctggtacagccgcccgatgctgccctgcatcgtccccgccgagatgagcttcacgacggcgccgaccggcagcgtcaggaggctgaagacgaagtcgacgaactccttgccggcctccgcgaacagcaccttcttcgacttgctgtccaccagcagcttcaggctgatcttgctcctcgaacccatcgtttgtgggttttctcttgctgattcaggattcagtatgtattcagatgttgagaaaatgagattgctttgctgcgtctatatatagttctctcactttttacctgaccattcgattagtggagtgcttaattaatggcattgttaactgaaatctcctagtaggcttcttctcagtaattccgtggtgggaattggaagagccagagcctttttatcttctcaacactctgcttcgggaaggaggaattcaggatcagcagttaattcagcgttaaatcatcctcccaatctctccaacttcaagtttagtaagtttagtaggagtagtagtcattctgaatgatgcttcagaaacagagatccactacattcacatggctttatctgccaaaatggcacatttgagcagatgctatgctactgcttcaaggaggaaaccatatcaaaatgtaaagcaacacatttagagctaaataactgcattgcatcagatcattgttacatatcaattgattgaagctaaacctgaaggaggcgacacaaaaatacactatacctattctatcattatattcagagaaagttctatgtcaatgccctgtactgttccctgttctatgaatattgtcagtaaaactagcaaactactctgttgattttcttcaaccaaaactagcaccatcttttcgggaatacaccagaggtgcattttttcatactttactgaactgatcctcagcaatgatccaagtggtactatttctaaaagaatgaaacaaatcttaatgatgtcacttttgtaggacgtccaagctgtccatccttgctgaagtctactgctactctacgcttccacatcggggtaccgcaacgcactttccgctgaaattcgtcgatatcgagcagaacaacaattagagcaggtacaatatcaggctataagccagctacaaatatattttaagaagataaataaggagagagaaaagcagcgggctacagatttgtagccagctgtagcacggacttcaagacgcagtgtgtatatgacaggtgggaccagatattaatagtgtagtatgtaactattgtatagatgagctattagattggctatagatgaattagagctagtagttggctatactattaaacttgctcttagtgagcaattttgtaataagaacaagtgaacaatcaagtcttaaaacaagtgaactactctactaaaatgaaaattcagtaaccaatgctactgaataagtagtactcccacaacagtgaaaactggagaaaggcccgggtcttcccggctagtaacgcaagctgcgagctagccggtccgggttcgagcctcaccccctttttaattcaaaatcaatctagtccttcctagattggtcccattttatatcagtgaaaactgctactgaaatcagtaatgtcgatcagactacggtatgctcctaaactgaataatcatgcagtgaccaatgataatactctcacaacaatgaacaacgctgctgaagaaagcaagatcaaaattcagcaagcagctggtagaaagaacaaaatgcctgtagctagctactctactactgaccaacccaactatcattacagcagtgatcagtgaacaatactactgaaatcagcaacttcgagcattctacaatatacgccctccgttcctaaatatttgacgccgttgacttttttaaacatgtctgaccattcttcttatttaaaagatttaagtaattattaattctcatcctatcatttgattcattgttaaatatactttatgtatacatatagttttacatatttcataaaagtttttgaataagacgaacggtcaaacatgttttaaaaaatcaacggcgtcaaatatttagggacggagggagtataacttatgctactgaaatgaaaattcagcgaggaaagaaagaaacggcagtgagctgctcgtcagtcacctggtgtcccgtgattgagcacgacgatgtggatggggttgttgcccatgggcaggtcgacgagcagaggggagaggtgggcatagcggccggcgcggacgcagagcgtgatctggccggcgtcgcagttctggcccaagcgctcggccatcgtcagccgcaggtgcgtcaggttgttggtgttcaccctcaccggcgcccactcctgctcgccgtacctcccggcgttgtcggctcggacgtaccggatcacccgcgacaggtcggattccaccggcggattcgtgcggtgcatcagctgttcatcgatcgcacaatgcagtgacaatgaattaatctagcagagtacacattggggacaacagatatctgatagaacagtataagatcatgaaatggaattcagtttggaacaatcgatacacagtttttcaagaaaccagaaattaacaacgctcaagaattttcaagaactcgagaaagatctagctagggattggaaccgatccaagaatgtttgatagattgaatatagcacaggatcatgaaatggagttcggttggaatgatcgctacaccctgt

SEQ ID NO: 63812 - DNA, 2272 bp, Oryza sativa
ctatataatcttatcgttgattttcatttaaattagtggacccgttattttataccattagattagatctattattaaaaaaatatttttcttatgttgacatacaagcgctacacgatgtaaacgctacttcttgtctttccgtacgtacaaatgcacgtgactgaaagcaaaacgataaagctttcctattcttcgctggaaaaaacatacatccatataaaaatcaatggtctttaaaatatgatttctataatataaaaataaaatatataacttcacaaatataaatatatttacttaaatctatctattattatatactaaaagttcgttaaacttcctacaaacgcttctaaaccgccttcggtgctataaaacaaaaaaacgtgaactttcgatttgccttttaatagacgggaaacatctagccctcaattttcatttaaactggtggatccattattttgcaccattagattagattaaaacctcccttcctctcctctccttgcacgttttgtggtccaaattacagaaaaccatacacattttgacacttggtactcaagtacatatattttggtagtgtagtttaacaaaactaaactatcaatgaatggattcacctgtgagacgacgtcatcgttccacctaggatgaggacgtggtatcctgttaacttggaccataaaacgtgtagttttgtgaaatttactcttttttctattcccattcacccacttttattttttttacctagggtacccctaaatatttttatattacttttttcgctattgacttttgagcatatgtttgattattcatcttactaataaaaatacataattaccatttattttattatgattttacattgatgtcttatgttcgctatattttagcacaaaatacattgcggcaaatggcatcgacatgtattaattaactccataacaattttttcaaaaaaaaatcgcatcaaactatatactttatggtatcaaatattacttaacaaatatacaatggtaatttgaactatgtaaaaatgcaaaccatgtaatttagttgtttttttaagtagatccaatttaaattttaatttatgtgagattaacattatcaaatcattttggaatttttcgaaactgtttggttggtatttcaatagtaataaatcctacattatacatatatgtaaagaaaattcaacaaaaaaattttcaacaggtaaagtatatatcattggttttttttcatattttctaataattatttaaatgatatgaaaatagtcagaatataacccaaaaataacatatttatttaagaagttcaaatatagttaataatggtccaaagacataagtcgataaaaaatagctatttattttaaaagattataataaattagggttcctgactaatataggatgaaaacatgagagacagtacattgggagagggcatgaatgaggcgaagggggtggatgttgggcgatggtgtacgtatgtgcatacatacaatgcccctcgggctctatattggcacaatcgatgtttactttatgttttcactcccaatacatatccaaaatgacatatttggttaaggtcggcttttaactctagctaccacaccaattataattttatatccattatttgtgattgatcgaaaaatgcagttctgccagttagaggaaacaatccaatccgagagtgccaatcgatcttctacataagtgctctagaatatattctatggcaccatttaaatgactttattagacagtatttaatgatcttttagtatatagaacatagatatacttgccgatggctttgtacttttatttcataccttccgggtataaaaaagtatgttttttataaatatttatagttttatttataaataaataaataaatcaatcaatcaagatcacattaactatattttactacatagaagttaacatggcaactaaataacaacggaaaattaattgtacatatgtattatgttatactaaatcattcattgtatgtaacaaaagtcaattaaacacgctctagagcgctcataaatcaccgtataatatgtcgtaaagttgtaataaatagtaattacattgacgtatctattatttttaactattagatctattattttttaaaaaatcttaagtcgccatgtgtcacctcctatgaaaacaggaaaaaccatagaaattcttagaaaaaatgaaacaccccatcatcg

SEQ ID NO: 63813 - DNA, 6373 bp, Oryza sativa
  unsure (1)..(6373): unsure at all n locations
aacgggtacgtcgcctcccattgaaagaatttgtcaagtctaggacttgcacccgagtgggcaaatttccaccacagagaacctaaccaattgagctacattcacttcgtaataatgttggatattaaaacaaccataatatttaagctacatttctgaaatactcctatgacttttaaaccggtggaaatattatttctaaccgttagatctatcttatataagaaaaaaaaagcgtgtattcatggtacatcacatttcaaaagtattattgtgcaattatatttcgtcgttatcgtattcacgttagctggcgtggaacctctgacccactctacatgaaatgttcataagatggactggttgtcaaactacatctatcatattaggctatataaacccatacatttagtggaggttcacgtcccacccaattcatcctcgaataaaccatgataatatatatgcaattaaaaaataccttacttttactttacacttacttttcgttgacatgttttctaaaaaaaaataagtctaccttctttttaaatgatgaaaaagattataaataatttgtttatagatagtattacttaaatatgatataatataaagctaataggttaaaaattataaaagcaattaatgccgactaaaacaatttacggagaaatcgtgatagatgttcttcggttaatatttcgctcttacaagtgtctcaaacttagtgtacgacgcatgcccgcgtattcacgcgggctaccttcctagtttgttttaattcccgattaactacgcgtcgtgatcggtggtgcccaatttatttcctttttagttacctccgatttcctacagcgctaaatataaaagggaggctgacccaagactcaatctccccgacaaccaaaccctaaacccgatcaacataggtgctggaggggaaacgtgtgaaaattccgggacaatataggtggcgaccggaaggccgccgctaccccacaagtgatcgccggtgaccccttcgggatcaagccggcgttcttactgctacgactacttcccctatgccgatgatcaccggagctgttcgagggacttcgtcctctacttccactcctgttgacgacattgcagagggaagaaagagaattgcatcaatggttttaaacaacggtcagtaaccctaaaaattccgcattagggtgatcatgtttagactaagcactcatgttagtagattatagtttctacacatgaggtttacctgggccggtaggtcgacgagggaagggcgagaggccatggggggcacgacctccaccctccactgcatcatcgtgctggcgttgtcgccggcgacggagacgttcttgtgccacctgcggaaccttgccgtttgcgccgaaggtaccggccggcgcctttgcggaggacaaaggattcgcgccggcggaacgcctgccacaggtaccccggcggcgttgggcggacgccgaggtcgcgctgctcggcgacgaccccgtcggatggccccctcccggcgccgtagttggtcgccacgaggtaccggccgtacgcgccgcggaggcggacgtagggccccgcgctggctcccggtatgacgccgatcaccggctcgacggcccaaccgcgttgtgcaccccgcggcggccgcacaggaagacgctcgtcccgtcgtcggccgcggcgaggtacctgctgctgcggacggaggagcgcagacgcacgaagtgcgccacctggaacacctccattcgatggccggagatcgcggcggcggnggcngnggcggnaacngagacggagatggaggagaaggggagagnnagnnaggngagggggnnacgcgnnggcggcgccaaaggcgaggctattcgaagcgggagaaacggtctccgtgactcactgacaaggtgggccctgggatctggttggtgggccgcgttggggacaaagcccacggcccacccaaggcttcgtctccctcctcctctccccttcccatttcgccgatcccacccacggcggcgccgccaccgccaccgccaccgcccaccggactttgtgtagagagctcgatgggaatccgcggcggcggaggagaccggccggctcatggaggggaagatgcagggccacgcgtggaggaggccggctcatgcttcttcttctccgtcgatgggtatgtatcttctttttctgaagctttgctatgcaatttcgtcattcggtatgattattcagtttcaccaattttgcatgtattctgttggtataactaggactatcttggttctgattattagtgctacgtaatatacagagatgcgaaaatatagagattgctacgtaacagtgctgccgtagaggcttatggaacaggacgcactttcagattaatagaaaatacaattacattgtagaatgctaggcttggaaaacaaatcactcgtataagtattcacatgctatgttctaaagctggtattatagtactggattctcctgtgccttgttaggttacggactgaaaccaaaaagttgcctacagtttattttgcctcacaaattcaactgtccatcagggtagattcttgatgttcagttctaaactcaaaacttcagtcatttatttgctgattagcagaaatgctctagtgcggatagcatcaatttcctggttttgttttaacgcttcgtattaggattttcatgtggtttgttttgtttctttctgttatattccatttctttaatgatatttcctttatcaatttatgaataaacacaaattaagtggtagttctgccatcatgtcatgagatgctaacaatgttttgtgggacttttggcttttgtcatactgaagaagctgcacacgtttcctcatatggttacagaagtacagaaccgaaggaaatttactgggccgcagtcccacagctgtaggtgcatcaagtattcagaacatgctccccgccaaaaagaagtattcagaatatgctatcgttagagtaataaaacttgcaaacttctgtaaaagcaacttacatgaagcagaatctctttcctgcttccttaggttctgtgagtgccatttatgacgcctaaaggtcctcagagaaggtacaaaggccaaaaaaaatggcagattgacgggtgcacattttgatttatgatttagccgtggccttcaataggaatttaaacatgccttgctcctgtgtaacaggaagatgtcgaatcaatttctaatatttaacatgaagtgaggttcactttgacagctcctggaaattgattaatctagctgatttcatacttctgcttatataaacaaattattcagcagttttgtttcaccttctcactactagcacatcacggatatatgcttccatttgtgcaatgctattggagtttatgttaagctgtttaggatgtagtaccaggcatgcctatgggactagttagcataatgggccaaaaaatatctcaaagtatgaaagtatgtggtctagaaaattatgttacaaactaccttacatcgatgtcaatatgcaagaaataacatgctgcattatgctccgtttgtactcacagggacagcacgtaatggagttggcatgattgaattacaggatgttcctgctcactgaaacaagtaaatgatgacatgaaaggccgaaagcagtgtgtttctacccaggtttgatccaagcttgtgtcggctgaaaattcatcatctcttatcatgtgctagcccgccttgattgattgatgctactggacagtttgggattggtaattttctgggagtgccttatggggaccatctcccatcaattgttacttgcctcctgaattacatttaactgtgctatcttgtttgcaattcaggtaaagtctctgtttaggctgtatcaatcatgcatgtgaactagttaatgcaaaggacctaggaattgatgaaagtattaggcatcagcatcaatggattagcagcagcttctatcatcctgactcaattctgtactcccagggacagcagttgcctgctgatgttgctaggccactagtactatgtagtagtatacattacattggatatctcaatcatttgattaaactgtataatttttcggcgaaagctacctttgaatggtgatgtggttagtttgtagatcatgcactgactaaattaagttttcctctaatgaaaatggtagaaggtttactctgtatgtaatggaacacatgtaatttttgtatgctttaatatgaaaatacccatgcagtttatcagtttgtatccagtgcatttaggaatatctatctctagtctgcaagttattttttggggataaaatccttattgtactctgaactgttttacttgcatgtgattaggagtaggaagtagaaatcccctcttatctgctcatgtgagacctaacaggctaatctaccaggattaattaattaattacaaaggagcagttatggattatcttacactggaaaaagaagtggcctagtcaaggagagttttcttggagtgagctcctttgtgttgaaaaagatgatgttgggacatatgcaatggatttgggtgctcaaagcagttggtcacccatgttctgctccataaatgaaagagatgcatgggaacaagcctcatgtttccaggaagaacaatggcaaaggataacagatttgtctcttctcttttgaacacctgttaattagtttatgaaatcctttccaactgaaatttggcaccttctgtggcagtcactacccattgctgatgaacatggcctaagtttcagtaagtgcaatcccctatattaatgcttgataagtacttcctccgtttcataatgcaagactttctagcattacccacattcatttagatgttaatgaatctaaacacatatatatgtctagattcattaacatctatgggtacataggcaatgttagaaagtcttacattgtgaaacggagggagtagcaactctgaaacttgaagattaaacaaacagtaatttccaatggaagtttttgctaatgttcgtcagaacaccagatttttttttccttttgaattttgcatgattgccttaaatttgtcgtccattgttgctaatttgatcaaaacatgctacattagacatgctgaggatgtatcataaattactctgcaagttgtaacatccaaagtagatggatactagcatacatcaatgtgcagagagcatatcaagaatgaataagctctctaccaaaaggataaataaaattccgattccagccaagccaagggcatgaatgaactcgataaacctaacaatctctttatctcactgcaaagcaagaattactaccatgtcacactatgaacaccctcgatcactcactcacaagttgaaacgtcaaaacaaaaaataaaaaaagagagcaaggaacaggtttaattaaaatttgatactaacttcctatttacatcataattaagcaggatcaactctataataattctatcatgacgactcttaacactaagcagttagcatctactaatgtttttggttcatgcaaatattcgctcgccctcaatggtaatcacatgtcactgacaagtgggccctcaatggcaatcccttgtcactgacaggtgggccacacgaccaccacctaacgaaccaaccggtcgtaagctggacgcacgacagccgtccgatcccgtgcacacgacagcatcggatcggacggtcagtgcagccgatgccgcttggcgctgaacgccgccggcgagcagctggccgccaccgccgccgccgccgccgccatgggcctcttcccgcaggcattggcgccgccgccgtagccgatcaccgccgcggaggaggtgatcccgggcgagagtgacgcgccggggtagacggcgccaccggcccggacgccgacggggagcgtgtcgagcgcgaccggcggcgggttgcgccaccgcgggagaaggccggcgacgagcaggttctgcaggagcggcccggcctccatgacggactggagcagcctgcccctctgcggcagcggcttcttcatggcgagcatgtcgagcaccgcgtcggcgcccgcggcggcggcgtgctgctgcttggcggcgggaggcgggctggcgatggcgcagcagcgcttgtcggaggaggtgacggggtcgaagaaggggttgtcggcggcgggggaggagacgaggctgccgccgtcggagtcggtgacgctggaggtgacgagcggcggcggcttggcggccgcggcggcgaggagacgctgcagctgg

SEQ ID NO: 63814 - DNA, 1999 bp, Oryza sativa
tgtaggtggtgagcggcgggtgaaaaccctgcccggccttggccggaccgacaacgatgaattccccctcctgagggtgttgtcgtgctgtctcacccctcaagggtgattgccgggcgaaagcccagtcttggctcctttgagccctgatggacggcagcggcggtcttccgtcgcttctctttttgaagacgtcgttttggcacccccttgctgtagggcgatctcgtctgtgttcctttgttggtctagcggcggccggtctggtgctaaccttctcctggtcgtgtgtgttggcgctgccggtgtgtgggtggtggtatatttttttctttctcctggttatgaccctccagggttgtaatcttgtaattttttcctgctctatcaatagaatttcgcatcgtctcgtgtgagtcgttcaaaaaaaaagatagaattagttttatttttggatagagaaagtatgcaataacaggtctgccgtgggagcggagtgaggaggcctcgaggcctcactagtcactactgatgctaggactgtgaaagcttcactaacattttctgccgaacatatataaaagaagagattgaagattcgtctagtttgttaaacacaccttactatttcttttgtagatcgatccgtcctggactgcatgtgtatgaaaaatttgagattttggagagagagaaacgttcaattgtgagcatgttacagattgaacgccggatctcaaggttacaaccacatatcccttatcactgcactatcaaccacgtttcaagaaccagcatgtgtactattaattacaagtagccggctggtgtgtggatggttgacatcgttcattagctgagctagcagagagtacatgaatttatatgttgtttgtttgtttcctccatttctttgatgagagagagagagagagagatgagagcggcggaggagacaaaaaaaactttaaatttttgcgtgagaaaaggtcgcaccatccaccatgtgactacctttgaggtatggcatggtgaaccttatagctttaactgcctgcagctgctggtatatgcttcctcctactgaagaagaagacgacgacgatgctagagctggaagacgatgatcgagcattgctaattctagaagagagagatgctattagcggcgccgttaaacccaaacgactaagaacatcatgctatacactacacactaactcttagctagctaattaactcgggtccaacgcggctaagctccgaatttccattaataacttaccggccggcgagagcaattagctagatagatacctttggatcttctctgctgccttctgagcttgatcaacacgtactcctccagtccatataatgatgttaaataggaataatttttgaaagttcgattgaagattaccgcaattaattttataagtttatggtactagaaaaaaatacccgtgcgttgtaacgggtgaagtctattttaatctcattattattatatgatttagttaagataaaattaactatgagagttcacttggatatatatatttttaaaaaatcatgagctgtagttaggagtccgatcgtctcaagttagaatgcgagttttttttaaacagattaaaaagtgaacgatcttaaaaaccgactcaaatacggatatgtattttcaaaagcaaatgaacttaaaaaccgactcatacacggatgacgtaccaaaataccggcaaaaacatttttaatttttataatagtaaagatttgtgaagtatttttcacggaaaatctacgtactccacctccgttttttaatatatgacaccgttgactttttgggatacatttgaccatttgtattattcaaaaaatacatataattattatttattttattgtgacttgatttatcttcaaatattctttaagcatgacttatttttttttatatttgcataaaagaatttgaataagatgaatggacaaa

SEQ ID NO: 63815 - DNA, 985 bp, Oryza sativa
tttggcaagtgtttggacagggaagctcacatacttgagtgcctgaaacaatcaaattatatttggtaaattaataacatgaatcaataccaatgacactagacatgaataaatgggattgaatataacctcatattggcaagttgtagtcagtatgtttgatacagagaccacacagtacttctgaagtggagccacagggtccagggatttcttacttgcctgcatgaatgtacatacaggatttaggggtttagcatattctgttggaggtaatctcacagagagatctgtaccgttagcaccagcgcagacaccgtagacgtggtgatacggttacagaaaacaagaaaaagcgagtatctgaagaactccttttctgctccatatggaactctcatgattttttcctgcataacattacatcaaaatgttaattaataagtgatcatgtccatgtacacagtcgtaggtgtcttttccaagaagacatgtttatgaatacaccgtttaaaaaaaagactgtcggtaagtgcttatttgaaaggaaaaaagagtctagctcttttggataggaaagatgtattgtctttgttggatatggaagaaactagcaggggtttaaggaatgaaaggacgaatgttcagaaatccttttttttggtcctgtttacattgaactttgagccttgtgcagcatccaaacattgataactttccaaccatagattcaggacggaaaatggtgatttgtgtttaattcatgaacaatttagtataatcgagcagaattttgctagtaagttgacccaaaagaacaattaccaatctcagtaccagtgagttgatcaatatctacaaaacattaaaacaaacaaggaagcagtcgaagaaggggactcagtgcgtctcaacttaattgagcttatttgcaagacgagacaagacaatcaatccactgcacagatcaacttgtgaacacacc

SEQ ID NO: 63816 - DNA, 2490 bp, Oryza sativa
attatataacatatggattcgttaagcctttcatgcattgtggatgaaacttttaccgttatgtggttgatggcgctgtcgaccgatgttggattttccgccaactcagttgatgcgcaactgctgcgcttttggttgggacttcctaactcttcttgcgcagcagcagcggcggcctgcgggttatgttgctcttctcggatctcttgcctaatcttggccctcatcgactcgagcttctcgtcgaattcagaggtcagctccactctgatcgacgcccggatcttggcttcaaggcgtgcatctttctccgccttgttggaagtccgcttgtctagaaatccatacttccagagaacggtggacctaatgccccatgtccgtccacggtgttccttggtgcccaacgcttttgtgaggaggtcatcctcgtgtttttgagagctgacctcttgcaaggcttgttgctcggcaaccaactccttctgcattacaatttagtagggttaaatcgaaagctcaatgggaaacaatgtgtcacgtcctgataaattcatcccgaaataaaaatcattccataaaaggaataatagaattaattaaaattcgaaaagaaattggcaaacactaaaatacgtacaagaaaaattcgaatgtcgtccggagaatttttgttaaattctccttggtctaaaaggagccctcaaattttacttgaattttcagagcactggaaataattattaagcaacaaaaataattaacaaagtttactaaaaagaaaaactaaaaataatccccctcctccctttgggccaagtttggcccaaagtcctccctctctctctcggcccgcggccaaagtcctctcttcctccctctctttctctccctctccttctctccctccttctcttgggcctccccttcccctcccggcccactccctcttcttctcctccttggccgcctcggcttcgcccggcccaagccgagccgtgcctcccacccgtgccgcgcacgtgcgcgcgcgtgcgcgccgttgccgcgcgttgaccgcgcgcctcccgcgtgggtcccgcctgtcaggcgcatccccgacctctagccgccggcctccttcctctctctcccgtgaaccctagcgttgttcctcctccaaatccaccccattcaagccggctctttccaaattaaatagggggaattaatccccattgattcctctttgatttcccccgttttcccccttgaatcgtgtccccgattgccgggaacggacgcgccaacccccgccgctttccaaggccaccggccgcattcccgcctccgttccggcctctctcgttgccggctccctccccgcgcctataaaaaggaaccccctccttccgttctccagttttagccccctcccgcgctctcccgtggccgccccgcctctccccgccttctccttctctctctccggcgccggccgacctcagcagcacctcccgcctcgcccgtgcgccgtccggctgcgccgtcaccaccctcggcctcacagccgcctcctctcccccggtcagccctccgtttcgcggggaaaccaccagaggcgcgtccccgccggcaaccggtggcattgccaccactcactgcctccagccgcccctgccgcgccgctcaagtgcaggccggccgcgccgtcttctccctcggcgtcgccgcgtcgacctccaccccggcctgccctcggtttcgccggaacgccgtcgcccgcgccggtctcgccctccgcctagccggagttcattcggcaaccccttccgccgtgcccgtgcgccggcagacgtcgccatctcctcctctggcatcgcagcatcaaggttgccctcggcctcgcctcccctccatccgaaccccgccggtgttcgttatcgtcgtctccgttcgtcctcgtcgacgactcctccagtcggtcgttcgtcctcgccggctcgtcgtctcgctgcgctgccaccctcgtcgtcatcgcagcggcgtgttccgcgccgtcctagtctccgtgcagctgctgctggctgccctcatcgcctcctcgccagttccggtcgtcgtcctctcgtcgttcccggtcgtcgtggcgttcgtccctccgtcaagccattctcgtccgtcgtccgcgtccgtcaagtgtgccgctgcagccccgtcgtcgtcttcgtcctcgcctccgcgtcgttaagccttgtgccagccgcgtctcgccttcgtccaaggatcgccgccaaagtcgtcccctcgtcgttcgtctccgtcgttcccggccgcctccgccgcgcccgttcgtcgttgtcgttcccatgcctcgtcgcatggtggtaaggatctctcctctcgctgccccgtcctcgtcctttcggtgttgccccgtacccgttctgcggttgtcgaccccggtacccttgtaccggtgtcggtagtcgttcacgtgtgcgggtggtg

SEQ ID NO: 63817 - DNA, 792 bp, Oryza sativa
tttttgacaaacaggttaaacaacggaaatgaaaaaaatggtatcatgcctagaaatagggctgtcaacgagccgagctcgagcgagctcgtctgcctaggctcgagctcgatacaagctcgagccgagcctataaaatgttcaagctttctgacaggctcggctcgagcttgaccaagctcgagctcgactaccgagcttgattttttttacgtaatacagtatatatttgaaagattatcttaaaaaaataattaatttctagttcatcatattaatagaaaaggcaaaaaataataaaataaatatatgatgtcaatataaggcatacaaataacatattggatatcctaatttattaaataacaacaaaaatcatatattactaggctcgttggaagcttgacctcggcttgacaaagctcgcgagcttagggagaggctcgggctcggctcgtctggagctcgagctttttttgacagccgtacacagaaacatacatcattttccacataggcgtagccaagaaatgatcacacctaggacagaggagggcttagttgatgtgttcttagcaatattttaagggaaatgctaaacactggtataccgtctcgacgggataggatagacaccaaccaatccactcttcttctacctagctattctttctacaacatctctctcacgtgtgctgctgcaactaagtcaacgacgagctccggtgttgcatgggtgtggatgacggaggtcgcggtcgccggcgacgagctccgatgcggccacccccg

SEQ ID NO: 63818 - DNA, 850 bp, Oryza sativa
gagtggccgccggcaaagccgtgcggccgcaaggacagcggcggcggggcttctcgcttctcgctgacctcgtgctcagacagctggggagccgctcagggcggtggcgacggtgattgctagatccgcgctgctcctgcctgatctggcgaggagtcagctggcgacggggacggcgatggtggtggggatggcgacggcgacggtaagggcgagctgcgccgggctgcggaggccgatgacggcggggatggcgaccgcagagaggcggcggtggtggagaccgtggatcgggcgacggcggccggtgggaggagccgtggcgcatgggcgacgccagcagtgggaggccggtgtcacgcccagaaatttagcccaagtttccagactatttcgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggtttcagctccactccacaggcaaaactcaactggggtctgagccttggtcttctaacttcgtcttcagctcagaagcactacacttctgaaaaggggtaataatagcaagactgagtacaaccaccgtacccaacaagccacaccaacgatgcagacgtgcaaggggatacaaggaggggtttgtggctatttgcataaaggcggttgtaaaacattttattgagcaaaacagtaaaacggttgagtaattaaagtaatattaaatctccactgatcaacgctacaccacgttgaa

SEQ ID NO: 63819 - DNA, 979 bp, Oryza sativa
acagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgatcttccgactcttatccttgcgaccgcgatcttccgaaacgacggattctacacgctggcacgcaaaacgaggaaaaactctaataaaaaccaaggaaatagtatataaaaagtaaacaaacatgtagagctcaattttagatgaattttgcaagttgaatggcccaatttggagttcgtatgaattagatatgaattttagaagttttgagccatttaaatgaattcttagaattaaactcgatttattgcgcaattattatttatttttccaaaggaaaagagggttgttgacgtcatcaaaggggaggggcggcgccggcaagcgggccccaccggtcagcggcacaagggcgtcggtccaccgtggaccgggaccaccgaggcggcccaccgccggtccacgggaaccgacggccggatcggcccaaagccgatcgaacggccacgaggcggcgcggctggggcacggtgtcacaccctaaaaatcctaaatatataaattgttgtttaattggaattattagaatttattttaaaagcctagaagagaagatctaattttaattaataaattccaatataaaatggggccagataaaatttcattaaatactttgcttaattctataattcctagattttctgggatttatttgagctaaggaagtatttttaataaatggaattacatttaagaaataatttaaattgaaaaaggttttaaaagtcttcttttggctttgggccgaaagtcggcccaaaaccgctctctctctcctcggcccaagtcggcccagtccgccgcgcgcgcgcg

SEQ ID NO: 63820 - DNA, 1053 bp, Oryza sativa
gttcgagtggccgagatccaccccgtccacccctcctccgtcgaggttcgccgccggagcatcattcccgccgtgcgacggtgagagccgccatgtccgccgccttcagccatggtttccgatcgccggggtccatctccctccccctaatctctctcttttcctctcttagggcctcccggagctcgtccgcccgccgccgttgtcctccagtggctcgccgtcaccgttcgccgtcgttctcctccgcgccggccactctcggtgaggcatacctcctcctctattcccctccctctccctcctagccgcgccgggtcgagccgccgccccggtcgtgcgccgccgcttttgcgccgccgcctcccgccgctggttgccgttgccggcaacacgcgcgcgcgccgccgaccttgccatggccggccggccggctttgtgccgagccgagccgagccaggccgccgccgcaccgtccgatcggccccgggccgatccgggccgttgatcccgtggaccggcggtgaaccacccgcgtggtcccggtccacggtagaccggcccctgtgcgccactgacatgcgggccccgcctgtcggcgccgtccccccttgatgacgtctgccctgggatttatttcgcaataaatgatttaaggacttttgttatagtaataaatacagtgaatcttctaaaattcataactaattcatccgtgctccgtttaagcccattcaagtcttagtaaatcaagaaaaatgtgtagaatccattaaaaatggttttgttctctgtttcagtagtcgtatagcctgtttgtattgtttgctttgtatgtcgcttagattccggttcttccgacgctccggtgtacttcgaaatagtcgccgaggttcctccagcaacagagcaaggcatgtcatgcttgtcacttgaacatgttgatcctatatttcaaatgctctattgtttttcttcaaatactgcatcgttttataatgttactatgggatgtttacctattgtcatagccatgctattgttgtaccatgt

SEQ ID NO: 63821 - DNA, 726 bp, Oryza sativa
ctgttccagtttaacctgactgcaatctattttgttttaattgctgctccttcatgatatcaaagctcggttaaccgttacatatgaaagaaatggatgaattatttaatgtggtgcaagaattttgtgatattgaaggtgttccagttccaaacatgtacgaagaaatactggtaagtaggggtgaaaacggtacggaaatttccgagaattccggcaaccgtttccggtttgcaccgaccgtttcaatcggtatcggtaattgtcggtatcggaaatggaaacggtaatctctttcggaaatggtagcggaaatgatatggggttttttccgaccgttttgtcggtaactgttttttatcggtaatttccgtcaaatttccgacaaaattccgaagaaggaagtcggctaggcctggctagcaggaggaggagcccattaggcattaaggagcagcccattccgaataaagaagccaactaggcctgaccgcatcgtcgtcttcatcggcgctggggcaccgccgcgccatgttgggcgccgccaccaggtcgccgacgccggccgcaacctccttcgccccgacggcctccgtcgcagccggccaccttccctcccccatgctccaccgccggcttccgtgccaccgagccaagcgccgagcgccgccgcaccgccccagcctcctcctccccaccgatgccgcccctttctcctctctcctt

SEQ ID NO: 63822 - DNA, 980 bp, Oryza sativa
aggagaaaaaggatattagttattaacaactggtttgtcaaaccatatctcaagaaaaataaatttaatagatcatgtagcagattgtagatgaaatattaaattgttgcgtaagatttgcatcgtaagaagcaagaggtaggaaaattgatgaaaagtttgtgtttaattattagtactaatcacgaaacaaaataaatgatatacctcactttgatgggagatatatggatggaaatatgttaagtattataaaaataatagatatctatgttaaaatattgtggaaatgatacgagggggtgttgattggatttgcttgcatattgattcgtagaatttgatacaatatagatgatgtgcatgcttgcattagctttgatatgtaattattactaatagatgatgaggtggtatgtttgtatgttaagttttaggcttagtgggttgtaactatataaaatgtacagattagaggccgaaagtcagacaacgacaccttgctcatgtagcgcctattttatgataatgatttcattttaaatgcattgtttcacaaattatcatttctatcagacaaaataaacaacagaaatagacattaatatccattccatttatcatttctcgaaaagaaaacaaagattacaacgacacgatgcagttgctgtcttaagcctagttaaaacacccccttgtctccacctagccgatccaccgagtcctaagagagcagtgaagactgtctgctcggcgccatagaacacagtagacgaggacgcgttgcggcacgagaacagaccggcgagcgaccgaccatggcgtttgctgctctggcctcgctcgctatggttgccagctgctctgccacgggtagagctgctgcggcagttgacgtaatgcagggaatcacttctgccaagcgtgctgttcctccttccttgacccttctgtcttgctgctccgtccataatgcaggg

SEQ ID NO: 63823 - DNA, 716 bp, Oryza sativa
cctgcagccctttgtccagagtatacaaatacgtaagcagcataattgcttaaagcaacaaacctgattaattattattgattaaagactggacatatttgtgtccaatcatacatttatcatttttttgtttttgcttgtttcacgaggatttggatgtggtgagcattatatgtacgctgatatgtactttcagaacttctgcagatatgtacgcggccatttaaaaagtacatggtgtcagggtatagcacgtatatttcagttggcacaatgcatatatacgattagatcaacagctagcaacggttttgtatcactaccagaaactccattagccctgacgggccaaaatttttctgacgtgtatctattaggctgtcaggagtaaacaatttttttctgacgtgctttcggtaccgtcacgatatcatgaatttcgctggcgtggtttgcctgtcagaaaaaaattttaggttcagatggttctcctacagagaccacatacgttttcatacataaagactgaccggcctggttataagaaactatagcatatattattattattattattattattattattcaacatgcatgctatgatgcatgacctatgatgcacacatccattacatgattaaatcaccaaatgcaaagcatgcacttactacaaggaaagttctgaaaggccgaaaaaaggcatgataaagaaa

SEQ ID NO: 63824 - DNA, 1164 bp, Oryza sativa
atcaacgtaaaagtgaaactggattaagaaaatggatagtggatttaagttgatatattagagagatgatgatgctagtctagaggtttcaaaatgttacagaagactaattcaatcaaaggacacatttctacttcagaagagagcatttgcttttcattactcaatgttcaatttatattttgaactcatgaaacagtaaaagctgaagtactcctacaacatatttagcctgtcatgaccaaagtagcacactgagaaaattcagaaatcatggtttgcagagcaacagaacatcaattcaccaaatttattgaacatttcaacattggcacagtaacaactaacttcaaggcatcaaggaatattcactctaattaacatgcctgggtgctgatgtgcgaaggtgttccagatgcttggtctctgccaccctcagctgcaccacccttgtactgcatgtcaagaatggctaactcatcagatttcagatcaaaagataaaacatgtcacgatgtgatggttaatttttggcaaccaatccattccttggtgccaatcttagcattattcagtagcatcgtgtatcacgcaaaaaccaccatcaagtgcaaaagaaaatccctttttttctgaattatcggtggaaattaatcacatgtggagtgaacacgtaggggaacaatggagggagctcctacatcacggcgtccaacggcggcggcggccgtagcgcggtcctcagcaccacgccctttgctgcacggccagcggtctccatccgaggcggccggcgaatcaaaaggcggttaggtagacgggcgctggtcgatggacgtgattttttcctaccccatccccgtgcacaccaaccgagctcgtcgccctatctggcgaggatctgcgccgccgctgagcttgagaggagaggcagcgtcgtcgtcggagctcgtcgctgacgctgagctcctctccccatatagcgacgaggaagaggggaggacagcagactgaacggcgtgccagcgcgtggtaggctcggcctcgggcgccggaggaagaggcggcggcggcgacttcggcgcaggtgggacttgggaggggagatcggcggataagagggggtcgactgtcgagatggtgttgatggcggcctgacttttt

SEQ ID NO: 63825 - DNA, 1668 bp, Oryza sativa
ctctttctattatgggtatatatacagagagggcttgagaggttggttgatgtatccacatatgagaaagcaataaagctgtgatgcctctccctatatctgtgttcattgtttatctattgtgtgcatgagatcgtcgtcttctactctggatcagcgaacaggccactagttatccaacacgttatcagcacgagttctcgctcgttccgctgatccgggtaagcgtttttaatagatcaatttgtttcgttactaatcagattgatatattgtgtttatgcatgtgtctgccgttggccgagaggatcgcctccgcacgtagccgcgcaccgaggcaaaccgtcgggtgacgcgcgtgcgtgtcgcactccacacacagagcagcagcaccgccggtcgtccgcactgaggccgaccacgccgcaaaacttcctgacacgatatacgtcgatctgcatcaacctgaccggtggcacatgcatataaatgtatgactgatcttgcatgtgtatggatctacaccaggcatgtactacctccgtcccaaaataagtgtagttttacactattcatgttcaacgtttaaccgtccgtcttatttgaaaattttttatgattagtatttttattgctattagatgataaaacatgaatagtactttatgtgtgactaaatgtttttaattttttcacaaatttttcaaataagacggacggtcaaacgttgaacgtgaatagtgcaaaactgtacttattttgggacggaggtagtacgtagtaagtactgatctccatcaaacaaaacctgcacacatgtatatgtgtgcgatccgatctgcatacacgcatatggagattgtcgaaactagatttcggcaataataaaagggggtggctatcaagctagaaaagtgtatgggtttggagacaaaggatttatacaggttcaggccttcttatataagaagtaataccctactcctgtccggggatgaatccgccgagtgtattattgattgtatgattcgggaaaaatcagcatatgcccctagaggcgcccggaccccccttatatatgggaaggagtccgggttacaaaagataatctatattcctaacggaatatgaagatacaggtaaaatacagtcgtaaccgactaagtttcagggtatttccttgatacacaagttaagaaactaacccaagatacagataagatattctatctacattaggtatcctgtacccagttcgaataccatcgccgtgtagatatgggatacccataatctccacagtagcccccgagtcctttgcagtcgaccatcgtagccttctcaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcacacgcggcgcctaaataggcatgctagccgactgctttttagccacaataaaaaaaatccgagtggtttacactctaaaaggttcacgaatgaacacactcgacaggcatccgaatataaaaa

SEQ ID NO: 63826 - DNA, 1489 bp, Oryza sativa
tttctatggaatcagcttgcatcacctaaacccgaattccatagtgcatatcgccaatttcgtccatgtttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtacacttgtcttcctccagtgtaccaagatatttggaactcttttccaatcggagatgaagcagtacaagccttggagttgctggatcgtatgttaaatcttaaagaacaaggcctacagggagagcaaatcactcggcacttcatcaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcaccaactgccagttgtgccatataatgcattcaatccgcctccacaggtatgcatcggaaaccctcaaaccgtgatcagaacataattttatcttcatgctgagttgactaactatggaagcatcttgttcaggaatatgcattgatgaagtcagatccaccagtctctcagcgccggtctcctcgccaacacaccgctcagggaggcggagggccaacgatcagaccagatccgcaacctcagacctccaaattgactggtcaaacaggtcctcgcaagagaaagctggtacttgatgatgatgaaggcgacgataataaatctggggataagggctcgcctaataaacccccaaagcgtaccatgcccaggaaaaaactggctggccgtgcaatgccaaagatcagaacatcttccaggtattagacctctcggtatgattccgcttcggcatgctttgctcatgaaaatgatacggaatactgaaagaacactttgcaggaaaccatctgatatagatccaactggaaaagatcctgatccagctgcgacagaagcaaatgtatccaaggattctgagccgactgccgaaagccagccgactgccgaaagccagccgacgggcgcccatgcttcgggtgacaaggccaacccgagtgaccagccgccgactggaaaccggtcggcaacaactgaagcagcaacaacccaagagcccccgactggaaaccagtcggatgtaggtcctgatcaagagatccccgaagtagaagcgcagacgacgacttcgcaagggccagaggctggtaacgactcgataatcgggtctccaaataaagaacaaggatcacctcacgtccagctaggaacaccttcaggtaagtca

SEQ ID NO: 63827 - DNA, 7133 bp, Oryza sativa
ttagcagaacctaaccgtgaaccactatgcagagaatgcatcttcgcaatgaggccaaaaccgcaactttagaaaggctggttcctcatttgggaactcttgaagcggttagggaccagctacatgaggccaaggagcacgccaagaagacggagaaggagttaagggaccgaatcgctcagctccaggattcaaactatgagctgagtggttcatcaaaaggtaatccctagatccgtttcatcggtttaaactggcataactgtatcctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcagcttcggtttccccactttttgaaatcttggcagcgggcacttctccttcgctcaccatggttgcagccagtcagatttcctctcgggcagacgccatctcgcgggtttgggccatgtcgcaactctccttgtcgcatgtgacagcttgcttgatgtcgctccgtagggttaggactcctcggggaccaggcatcttcatcatcatgtacgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccggaagagtgatctggccgagtggagttgcggataatcctggaattactccatgaaaaggcgcattgcttgattttaactcggagcgagggatctgcatatcatccaaagtcttggcgaagaggatattgagtgcactgccgccatcaatgagggttctgcgaagcttgacgttacggaccactgggtctagtaccagggggtaccgccccgggtggaccactcggtcaggatgatccgagcggtcaaacctgattgcgatctctgaccatcgaagatattggggcgtgtcgggctgaacagcattgatctcccgttcggtcagcttttgcttccttttagactcataagccatggggccgccgaaaatatggttgagctccttgcggtggtcttgaaatccagccggggtgtcgccgtcgtccttcttccttgacgtgctttgtccctcgtcggagttcttccgagtaggcttggtgtactgctccgcgaactgcttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttacgttgttcagaaaatcgtcggatatactctcgaagggattctccggatttctggataacgttgtaaagatcatattgtgtgccaggacgctcgaaggtgccttggaagttggcgatgaagtggtcgcgtaattcggcccaagatccgatcgtaccacggggcagtccatggagccaagatcgtgcagaatccgctaaagccactggtaaatagttcgccatggccttgttgtcacctcctgctgcgcggattgcgagaccgtagacggtaagccacgattctgggttagtggtaccgtcgtacttctctattccagtcggtttgaagccggctggccaatccactcgacgcaggtcgtcggtgaaggctgctaccccatcaaggtcgtcgtcgtagcggtctggcgagtggtgacggcctcgagctgctcggcgctgtatgattgtgtcgcgaagatcgatggggtggcgacgaggcggtgaacgtggccgttctactcggcgctccccacggtagtcgggaggcgagtgcacggaccgctcgtcgcgacccctgctcctgcgattggatcctgcgccggtgatgctgaggcttggatgacggtagtcctgagatcggaagtgtggaactcggctaccagtcggcgtgtggacgctttcggagttaactggaaccgaggccgcaatcatggtcttggtctggttcaagatgttgacgacatgatcagattggttgtgctcgttttccttgaggagggtgtcgaggagggtgatcgcggcaaccgcattctgctgaggggtacggaaaaccggtatcccttcaacatcttgctggccgatgagatcacgcgctcggcgcccagcttccagggttcgctgctgtcggtgttcagcctccttcgcgttccgctcatgctcctgctgctcccgccgtagccgctcttgctcttgtgcttggcgctcctgctccagtcggcggcgctcgatctcgcaacgtgcttcggcttcccgggcttggcgctgctcctccgtttcattgtcggccataaagacgccgaagaaaagaggagtgtagttgtcttctaggcttccgtcgaagtcgtcaagatccgcgtcgtcgtggtagcgagaaccaaactcatcgtattccacgatttcggtgggacgtgagtcgacggtgggagagctgtagtagccatccagttggtccgtcgaaaccgtgccgagtggttggaggatgacgccgacttccctgaagctaggcgaaatcggtgttaagaccgacttccgcctaggcctacgggatggagacggcgtggcggtggagacggttgccgaatcgtcagggagctgtatcaagatcgatgggtaaggctcatcatcttgatctggcgttgttgaagtagatgcgatctcggccgagtggtttgaagccgactcggttgagatggtcttgaagtaactttcagccgcgtttgggagtccaaacgggaccgaaatccggttctctcccgactggtctgattccgagtcgaggagagaaatcttgccgaagttgttggtgacgaagtcgaggctgccgaaccgaaacgtctgcccgggtgggaagacgaggtcgtcgatgccggagatgggacccattgcactgatcggcgaaaagcttgacgctacccctacctggcgcgccaactgtcgaaactagatttcggcaataataaaagggggtggctatcaagctagaaaagtgtatgggtttggagacaaaggatttatacaggttcaggccttcttatataagaagtaataccctactcctgtccggggatgaatccgccgagtgtattattgattgtatgattcgggaaaaatcagcatatgcccctagaggcgcccggaccccccttatatatgggaaggagtccgggttacaaaagataatctatattcctaacagaatatgaagatacaggtaaaatacagtcgtaaccgactaagtttcagggtatttccttgatacacaagttaagaaactaacccaagatacagataagatattctatctacattaggtatcctgtacccagttcgaataccatcgccgtgtagatatgggatacccataatctccacagagatcttccacaagcccgtcaccctgccagtgctggtatacgctatgcagatgcatatgcggaccggcttactttacatgggtcaaataagataagttattgatttcatctattctaatactttgcagtagcgagagtaatatgctagatcatgcctctagtcgttttattttctcgcatgaatagatgtatttgtccggcctttgtgccgactcttctcttgttatatcaccgaccacgaagtttgacaccacgcgcctgaacgcgcttaccgtgtacacaagaaggtgcacatacataatccgttgaattgaacgacggagtgatgtcccgaacgacgacacctcacactcggtaacatacgacatcacctagaagttgtcgtctatctggctaacacagtcgttgatctatgaatatattaacacactcgtcatcgccgatcttatggatcagcacgcttgggacactgttgattgtaacttgtatgttaataatccgtcatattgctatctgtatgaagtagatggtaacaaatccgagtcatcggcacctgcatgcgccgccgccgccgcctgcacgtagcgacacccagatgccaccgcatgacgtcttcccctttgtcaatggttgccgaatcaatccagagactttcactcatcgatacgccatctgaaacgccgactcgacggcctttcgaggccatctgcaacgcaattgacggccgtcgcccgtagcgatgccgaggagcttacgcctgcctcccctcgccgccggtacgcacggcatgcctcccgcgctaccgcacgcggccgggacgagggtcgaagccgccgtgagcgcccgccgccgatagccgtccgccatgccggcctgtatgccgagccgagtttcgtcgacacgtaacatggagctatgattgtcggacgccggtcacggcctgatgccaacgaatgccggtgtcggtgctactagatgttgcaccgccgctccgcctctgaccatggcaacttgccatagtcgtccatctctaccgagggctcactagcacgtttgccattggttccatccgtcgtctccattgaaggatggcaactggatcatacctcacccacttcttgtgggagaaggtcgtaatagcccattgggcaacatatgagatgggttggccagattttcaagctagctagtataaggaggtgggccaagtagaaattggcctattaaaaggagtcgggcacgaaccgtgattttggtccgaaaacggcattttatttcaacagtccttggtttccaaggcattatgcggaactcggaaattatgcggaaaagtcctatgggacattagaaactacggggaatatacattcgccatttatactttgaacattcatgaattgggtttacgccaaatagagaagtattaaggatttataccttagtcccgtatttctaattagttgctttaactatttagttagtttcttgaataaccataatcaatcctagaaacattgtttttaggaaaaagagcttccatgaacttgtaaaacctttgttttagcacccttttggaagcatcatattttatggtttatttcctggcaattgtttgtttggggtaattgattgttctgtgggttagtagttctgtaaattacacatacctttgaatagcagaaaatcatgttaattgctaggattgtaataaaaggtgtgtatagaaaaccattatttactattttgtactcgttttgtgcactttacttactagaagtaaaccggtagaaagttgcataaaaggacatcatgtaagtagttgcatgtagcaaatacatttattgggcaaatgagtaatagaatattcatatatcttctctttgtctaattgtcgccacatttgtagaaggcacaattatatattctctgtatagaataaatgtatacactcatcatgaagagagtatattattgacttagagatatatattagtgcaggactatcatagaagataagctacagctaatttatattaattgtgtccaagtagatgcaatgtcatcgaatttgcgaatatctagacgagaagtctatatgccaatatgccctgcaccaaaattatctatcaaaaagactatatacctatgcagtgtctatagttcatttgattgataatgttatgtccatcttccacgtataaatgactttacaaatgaagtattgtttttatggatgtatgtaaattattttgagtaaattggtcatttgcatttgaagcaattttggcctagatgcaacatgtttagttgttagaattgatacacaagaagttgtattactatcaacatgtgcatttgcacgcacatatatgacttatactattaatatgttcatgaagaacatgcatactcaaaatttgtggaaggaaaggaatttggtgtatttgaatttgatgttcaactcagggggagacgaatagtcatgacagtaatcttgcattcgttcttttgagatagtattttacaatacacgagttacattatagtttagattaagttcaatataaaaaacatggttaagctcatgcagagcatctttatcttttgctttaggcatagaagcttctacataagattactaaatattttttttatataggtcatctcaccttaactatattgttttttttttacctgtagtaattctttaaccttttatggaataaaattgtgaattgtatgtctaacattgaatgtatttttattatccactaagcctcaatcaaccatgtaggttgatatttctaagtgcattgacgccatattggcatacatgtaaagttgtttacttatgcacatgaacaattagaatatttatgtttaagcattgaagcttaaatatatccacctacaaccacattatttcttttagaaaagttgtaccatgaagttataacaaatatgtgggtttcacgacaactattttgtaaattttcttatgattggcatgaaaagggggaggaatatgtgtattttgcaaattaatttcagaatatttgcaataaataagcataagaaattgtggatatgtggcaggcaaattgatgtgttataggtcaaatgctagaagcaaaatagcccaaactattatcgaatcttatttgggataattataattattgtcacacaacgaagtgtgttatttattagccattgaaaattgcatattcatcaaggaagtatgaaattgcatatagctatctaaaagctattggtttacttgtagtaaacaatatcctaaataattaatgacctttgagattcaattggggtgcaggaa

SEQ ID NO: 63828 - DNA, 6628 bp, Oryza sativa
gaggaacatattttaaagatattttttttaaaaaaaataaataattgagttaggttctatgaaaatcctgtaaaatctctatgttcaaaacaagactttagagattgatagaatgctattcatttatcaaagatgttagcctatgttttttttaaagataagttaggcatagattaaatgtctctaacatacatatttctttatctttacagtagaagttatcttctctataaaaaaaaaatctaccatagaagttcaagaaaactaaacaaacaccactgaagacaccaaataatgtctactataatattactcagctcatgacttcccacaaaagaatggaatttcagtacaaccaataatccaagccactggtacacaatggcaccaatccgtacacaaattctcctatacaaatcaaaacaacagcacatacacagatacactcaaacacgccacaaaaattatagcaaaataacacaaactaatttaatcgattggtcaatcaaccaacagccaaatgaataatctgatgatgagaagttgaggctttcagaacagcatggcagctagcagcagcagaaacgcaggaaaaccggcattggtggcgaccctccgtgcagagctgggcaccacctgcggcctcgtctgcgtctggctcgtcgccggcggcgtggccgtcgccgtcggcgatccggcaccggccgtcgactccggcggacttggcgctgtaaatttgacaaaataaagaaaatgatagatagtttagttcccatcaccagtaaaaattctgacaaattttgggctgtttggcatgtgttgcagatgaagttagagcggattcaggctaaatatttcttacgcagtggtggcatggccggagaaactgcaacgggtactcctgcagctggaatctgagctgatgtatctgaaaataaaaacaatattgataaattaaccgtatcttataaaccatttaaaagacacaaatattagagaatgacctaatatcaaataattagaaggggtgaggcttcaaacccaggtcatctagccgatcaccttgtggagctagctggaagactcctgagcgtttctctatcctataaacttttaaaatacacatctggctcgtttggaacatagggttctataagataacctttctcgcgcaaaacaacaatttgttttcttttaaatgccacattttaaatttaacctttctcgcgcatatattattacttatatactatctttgtcattaatcttttgcctaaatttttttgttctaacaacaaatatgaaaaaccggagatgaagtttattacctttgcattggaggggaacagacatggagttgcaggctttaggcaatgtaacggctagcgtccggttgatggggatgccgaggggcacgttgccggtgaggacgaggcaggcgcagctggcgctcgtgttgatcatcgccgccaccgactggcagcactccgccgtcggcgcgccgccgccggcggccgtgccgttgccgccgccgccgccgctgctgctggtgatgaagttgaagcacggcgtgaagctggtgatcagcgacgccgtgcacgacgccgccaccgcctgccccgacgccggcgccgccaccattgccaccacggcgaccatcgccgccgccgccacggccaccgccttgttgagctccatgtcactgttttgcggtgtaattgattgcaccgtaaatcgtccggtgatcttgcgttgataaaaaaaaaacgtcaacagtcacgtctcactctaactcgaaattgttactgtttgatgatgaagattgtaatgcgctatgaattcgtttatataggggggatgggagaatggttgacgtgtcgaattgaattggtagatcagaagttggtcatggcagcgtaaccaccgtaaccaattaatcctttttaagatgtttgtgtcaaagtgttaagagtgtttgaggtcaccttggttaggaagggttcgtcaccaaatgcctttgctctagccggaaaatatgctgatgtgtcattttcaccttgtaactaatttagcttccgtaatcttaatctgatcgaatagtgacattattgttgtaacaacctaatttgaccggccataatccatatgacaatgctaaattgaggaatttccgtactcacatttctattccttcaaaaattctttcccaaacgactcatttatatataaaattaattaagaatttgtttggaatgctaatggagaatttgtagtatttcttgtacaactgaaccagctctcgtggtatgcaccgtcggatgttgatctaacagtcagaaaatgctcacaaggggattcggagatttcttctccgatcccattttaccccactattaatatacaactttctctgggtcctttctgctaatttccctattgttacatcgatacatcttctcgggcctccatctgggccgcgagtgttggatcggacggcggctattgattcctactacgattttcgggtgggacccacttgtcagtgacgaggaggaggtggtcgccgtccctgacgagccgcgcgtcgtcgacgtcggcgccgccgctcgtcaccaccctcgtcggcgacaccccgaacctcgccgcgccgagctcgaggagaccacgcagcgtctccggcatgaacaccagcttgctgctgtgatccttcccgcctcgcgactccgggcaggagatggccaccctcaccagcggcggcgagctcgacgacctctccctctcggcggcggcgccgccgcctccgccgccgcccctgtatccgccttcgtgatggaacgcgtgtgacgaggagatgacgccgaagagggagttgcggaagttggccatccgctgcggcgtgctgcgcgcggaggcggcggaggtggaggacgtgcgccctcgccgagacgacgacgacggcgaggagtccacgccgtcgcggagcggcaccggcacgatcgccgacgccggcggtggcggccgagccttgcgcggctcgtggcgcgtcgccgacgcgaacgcgagctgcatgtcggcgtggccgccctgctcggcgacggcgcgaggggtgaggccgttgacgtcctcggcgtcggcgtcggcgccgtgctcgagcaggagcctcgccatctgcacgttgccgtcgaggacggcgcggtgcagcgcggtggtgccgtcgccggagcacgcgccggacacgtccccgccgtgccggacgatctccccgagcagcgcggcgtcgttctgctcgacggcgacgcgcgcgtacggcgccgcgtcgccgccggacaggtcggcgccggcgtccaccagcagctgcaccacggtctggtgcctcctgcacagcgcctcccacagtggcactctcccttctggatctgcacatcacttgatcaaattttcatcagaattttctttttcaaattacaatttgaactgagcatgaaaatagtataaacaattggagtatgcattcttgatttgaatttgaaaagcatatacctctcgaatttgaatcagctccattctccaacagaagcctgacacactgctcattcccattagaagctgctatatgctgtcaaattcagtaacaatacactctgtcaatttcagattaatttcacacacaaaacatacaagcttaaaacaaatgttgcatctaaagtttgaattaacaagaaatcattagtgtaccagagctgtgcggccataatgatcagattcattagggtctaatccacgcttcagaagctgatgcaacaagaagctatcccctttggaagctgcaaagcagagtgtgattgggaaatccatttggcccctggccaacatgtcatcgatctcctttgcgacagcaacaatggaggcaatttctttcttctctctcagatactaaacatcacaaggaagaagaagaagaagaagcatctgaatagatcagaattttcccctttctcgatgccgggagcggttttcgttgtcggaaaattttgcttacctgaataagattgttcatgacaattgtcccatctgcaatgttggactggatgatcctgaggaatgcggcccggtccaagcgaagaagctggcacagtgatcttgttcttgctgtgaagagctgaggcctgtagcacaggaccccgatctcgccgacgacatctcctgacttggccatccctgctagctgcagatcattcaaagaaaaaaaatgtgaattagcatttggtatttttgatgcatttgttcatgaactgattttgaattatggaaggtacagttaatacacttgcctgctctataccattatgaagctctatcaactcctgtaaattgcatcacttacattcatcagcaacaaccactttgccatttattttttgttacaagatcatcgcttagattttgaaaatggacaatgataaaacaagttatagggagtgattttaccatactaccagagactatgatgtagaaatccgcaggcgcttcattctgcagtatgatatcctctcgcggcgcaaagtactcagcattcatctctgaaaccttcactcagattacaatcacagaaaatatcaacaactcatgaacatccaacaagaattgaaacaataaacaaaactcacataatcacactgagatcaattaccagctgaaagatgagatcgtttgagacaccctcgaagaggtagacattctggacaaggccaaagaagagatggtgtgagatgcttgacttgatggccttgggcaacgcctcgaatgtctcctgctgatggagcccttctgaattcgtcctgaacttgaggctcagatgtgacaccatctgctcctgcagcctcgccggcagctgatgccgctgcgcgaagctcgtcgccgcttggatcatgtccctcttaattcacacaccaaaaaccacccaaaattcagacaagatcaaaaccaagaacacaccaagaaattaaccatcatgtgatgtgagtactagagtatactgaaccaagaaacaccaaagaattgctgctgatcaagaacagcaagggatcgatcaaagaaaatgagtgactactgacgaatttatgtctctcttaattcacacaccaaaaaccacccaaaattcagacaagatcaaaaccaagaacactccaagaaaccatcatgtgattcgagtactagagtatactgaaccaagaacaccaaagaatcgctactcttcaaggtcagcaatggatcgatcaaagaaagtgagtgactactgacgaatttcctggtgcggctggtgccgtgaacgacgaggttggtcatgttgccgatgatgtaggcggtgaggccgaggttgaagagcatgtaggtggtggtgaagaccatctcgccggtgttctcggcgtgcatgtcgccgtagccgacggtggagagggtggtgatggaccagtacatggaggcgacgtagcggctccagatgctggccttgtggaagttgggcatgtaggcgctgatccaggtgttcgtcgggtcagggtacctgtcggcgaggaggtagtagaagcaagccgagcagtgcaccgcgaacagcgtcacctgcgccacgacacgaggaagaagacgacgtacgagtacgacgacggtgacaatttttttctgaagattgaaatgttgaggattcttcagattctgaacctggcgtaacttacgcaaacgagcttcacgcatcgaacccagaagtagctgaacttcctgtccttctcgagactgaattcagatggaaagaaattcaagttacaataaattttgtaaaacaccgccaattataatcaaagttgcagaaaaccataggaatgtttgcacgtgacatataatgcaagtattatagttttaaagtttcataaagtcacatcgttaacgaatttgatatatacagatgtaacatttaaataatgaataaataactcataatatgattgtaaaactcaaaattataatagattaaagccaaaatgatctaacattgtgattttataaaattttacgtgtgaaaatctctatgattttgtataacttagagcataatactcgtggttagatgaaatttactcataatacttgttgttgcctcctagctggtctgccctctcccaccccgtggcagctggttccaggactggtgaccgtcctccagggcctgcttacctgagcacctccgcgacagcttcaactccctggtgctcctggtctcttagtgtctgtgggaggagcggaactctagggttttcgactccgctcactcttcggtctcagtggttctggagtccgtccatgtagaggaccatctgtagtctttagctggcgtcgccacttttagggatttgttgggagtctggcttggccccttcccactgcttggagtctgtttttagccgccatagtttctctaagctttagtttttccttcttttgctttttcttccttcccctaacataagccagtctagctgattgcgtcatgtaactaaaactctttttcttctaatatattgacgtgcaatccttttgcgcgttcgcgaaaaaaagaaatttactcataagatta

SEQ ID NO: 63829 - DNA, 5482 bp, Oryza sativa
cgcccctggagcccagcgacggcagcacgccgctcgagaagctgaaccgcgggctcgcctgcgtcgacgacagctgacgcgtcagctccgccgatcccccgccgccggcggcgccgctcaccagcgggacggcgcacttggtggtcggcattatctgatcgtcttcggtcgtcgtcgccggcgccggcgacctccgatgtctcgcgcgcgcgtcgatctctctgagcctctgatatctgcttccctctatccgaccgaacttgcaattgcatgcggcctcgcttaatttaggcgcgcgcgccgcgggagtggcgggagttgttaatttgttgtttgttttttaattaccggtaaattaattaagaggactgctacaaaacggatcccgttgtaacatgataggcatattaactattctcttacacgagtatcataggtatcagatttaggtatcacaggtgctgggtaacagatatcacagatatcgggtaccatgcagctggtactataataggtatcatgtataagatattgtcttgtctaggttttctattaatgataatagctgcaaggataattcatattttgatgatacaaatgggccgacttgggcctggtttacactgattcatcagattgggctgggcttttgacactgacacttcgctttatcttttcgtttaaacaagcattatgtgcttgctttgactaacatactcacgtaatgtattctccatagagatggattttcaggtataaaaaaaatgtacttctcccttctaaagtgtcaacaaaatatataaggaaaatttagaaaacaaataaacagccttggtacgataattaagttacagccatgcatcttgtagaaattagaaatgtagtgataatttgatgtaaagatcaatgaaagaaggagcaaatctggtagtgataatgactacaccctccgtttcaggttataatacgttttgactttgcttaaaattaaattgctttaagttcgactaagtttatagaaaaaaactagcaatattttcaacccaagataaatttattataaaaatatatttaattattgatttgatgaaactaatttagtattataaatattactatatttgcctataaatttagttaaacttaaaataaattgactttgaccaaagtctacgtctcttataacatcaaacgaagggagtaccatttttttttgcaagaatagtgacttaatttctggtgttatatgtgaatgcatttgggatatataattgagctctttcttatctccttgctaagctaattaatttgtgttatctaaaaatcattaatccaagcataaacatttctatctaaaacatgacttaaatatacattcagtagacaaactatctagaaagtacaaatatatatggtgataagagatcttgaaccaaaatttgtgccttaatatacctgaatgtataatatagtagtacctactaccttttcccctacacctgttccatcaaatgaagtccttttgcgctcatcaagaacagtggcatattcccacagcatacaccccactagtctccaacatcaatgacatgcatgattttaattggagcttttgccccacaaaacctctagtttacctaaaagtattttgatccactaaatccaatgctcatatcatagttgatcaggtttctcaagcaaactgaatgggatagtactcctttttggattcttgctctctttctttaaccaacatcagtactagctatatttatttgcctgtcaacttcatgaagagctcacgcaagaaggaaaataaatgtgaaaagtatctagaaaattctaaaaataaaagatttatagttagaaaataattgagaaatataaggatacagaattgagtcatcggtctttaagaaatgatcccacgcaggttatttgatagggtagaaaaaaaaagaaaggaagtagagaaaaggatgtggtttgttaaacgccggacaattcaatggacaacctattaaattattaatcttatgaatatattgtacgaaattaaataggtaaccgaattatttgtatatcatgtgaatatgacatggaaagttcatgcaatgatgcaagtatgtatcagtcgtttaatccattgacaaaagcaatttatatttaaaattcgagggattaattattagtttttaatcaaactgtgattttgtaacactaatagaaaaataattttttatgacgttggcctattattttcgctggcggccatacgcgaaaaccgccagaaaaaacatatcgaggggtgggaggccatggactgccagcgaaaaccgatttttgctggcggccaagctaagaggtccgccataaaaaaaactctatttttttaggcggacctcttaagtgtccgccagcgaatggcggtaggtaagaaagaccgctacaaaaaaaatttgaggcgaataaaatccactacgcgcccaccgcccagtccgtccttatcccttttccattctcccttcccaccgcccagtccgcctctctcccttctgcacctctcctccctcccttctccaccgccgccagctcgtcgcctctccaccaccgccggctgccgtcggcatagctccggccaccgccgcatacgaccgccgctccggccccattctcttcttcctcttccagctccttctctccctccacggagtgcacagcgaaggcagcggcgagctcaggcacgggcggcggttctcgggtgcgggcgcggcggcgactctcgagcgtgggcgcgcggtgctcgggagcgggcggcggctctagggcacggtcacggccgggcggagctcgggcacacggggagggcagatccgccgccgccgggcctcggggagggtggcaccgacctcgacgccgtcgaccgtgctacccggctccctcctctccgacctcgacgccgtcgaccgtgctcccacggctccctcctccgatcgtgttgctagatttgattttttttctttttttttgcgtgttgttccagatgatgcacatatttttgatctgtgtaaatgatgtttgatctgtgttgctgatgattttgtatttcgtatttgaatttggaaatgagcagcgaatctagatgtggatttgaattttgaaattaatgaatcaatgggcggttgcatgggtattttcactggcggctgcgcagctgcatgggtatttctttttgggccaaaaatagattttcactggcggccgatttaacacagccgccagcgaaaatccatttttgctggcggccgtcttaagccaacgccagcgaaaatagtttttttgctggtggtcaataaccgctagcgaagatctttgcctttgctttgtggcggctgcaaatttctccagcaaaaatccaaaatagccgccacgaaaaatggttttcgtagtagtgtaaagttcacagttgttcgatgtgtgatttttataataattggctgtagttttttaaatagtttaaaggccgtaatgaatctattattaagaaaaaaattaaagaggtaagcgatcgaatgaatatttgtaaatcattggtgctggctaagttggacgcatttcaagagtgaagatggtgtcatctgcctcagtttatctcctttttcaaaaagataggtagcattggttttatgtgcatggcttttgcataggtccgtttgaattctgtgtgcgccggccacacgaattaatcaacattgctggctcatgaatgatgatagctgcatctacaccatttgttgctactttttttttctatgactggatatcaattatctatcattgctcaatacgataatgataaatcaagagagagttgatctagtcagtcgcgacgattgatgtgaatgaatgaatacagttgatgtgctcttttttgtattattacacgaaagacagatatatatatacacaccaagataatatatatcgtagacactgacgaatatgtctcctaacacacgcttaaagagagataagaccattcacaacccaaaacaccagacatagtttccataaactctacatcatcaagaaactagtactagacaccactcttccaatgcaaacactactattccatgcttaagtttaatgctaattatctcatatgatgtcttggatgttgtgtagaaaccatgtctcatgcaagacatggtttccttttctttcattatttattcacttgccacattactttttatcctacgtggcagtttatttaatgttatggacaatattctaatattgggttgagaatggcctaagagataaatccctattccaataaaatcctattgaaagcgcacaaccaatgtcattaattaatgggattcaaaccctggtgtggataaagtcatgccctcatacctgaccgagctacatcaccggtgctttcttttaattgttgatgtactcttgatgagatgtcgatttcaatggtttctcaaggttcgactgcgaaactatatatcatgtacattagatatattacatcacatgcacatactcagtacgtgaacactatatattgatttgaatatgtacaaattgacaacgaaccttgctgtttgttcatgcatattgaaaaatgtacatatatacggtttcatctaaaaagaagaaggaattaaattatatcatacatatggctaaatttcgttccaatgttatagttaatacacatatatgtatacatcgctagttccctgcatgacagtgttagattgtgaaatgcgtaataatcagttgtccaaagatttgaacatatcttgcttcgatatatgatgatcgagaacgctgacttaactgtacatgtgcgcggtcctgcagcagtgaaagcgaacagattttataatgcgcatacttgcactgtcgcaatccaaatagatttttccttttagttttgattcgaattgcgtcccaacctggaccaattaatatttttgttaaatcctcgcgtatatttgtcgccattagactcgttcggagacttagtcaagggctagctagagggtcgttttaatttttaaacataagaaggactaacaaagatgctaattaattaaagggctagagggcaaccgattgtgccatatatggtgacaaaatttactgtattttgtagtctctcgggattttcttttattgttagatgagaatatatactgtttgtttagtgaaacactactttcataaaagaaattaaacagttttgattcaatcagtgcgcgtttgaccattatcttattcgaaaatttagtgtaaaaatgtaaaaatataagtcacgattaaaataaattcaatgacaaaataagtcatagcaaaataaatgatatttacatttttaataagttaaatagttaaacattataattaaatatcaacaatgtcgtacatttaaaaattaacatataacgaagatagg

SEQ ID NO: 63830 - DNA, 4808 bp, Oryza sativa
gattgacctctagtccagattcattgtactttgagttttttttttacagagattttggatggatgggacacttcctgctccctatccagattcgtactactagaaagtatctcctccatctaaaatcccttacattctagaacggaaggagtacaatgccacagctagctagctatagctaccactaattccttctttttgcatgtataccattgatgtaattgagcatttggaataaattgaaatactacctccgttccaatataaatgtagttgtgggtttccgtgttcaacgttttgactattcgttttatttgaaaaaaaatatgattagtatttttattgttattagatgataaaatatgaatagtattttatatatgtatgtgactaattatttttttaataaaattttcaaataagacggacggtcaaacattacacacggaaattcacaaatgcatttatattgggacagaggtagtaattgtttagaaacagcccggataaattgtacggcaaattatatatttagttaatcgcgctaactgtaattaattaataatttgagtccaaagataactaactttttcctttagcccgccatcccatcttgtagtttaggatggaggaatttgaaaacaattgtatcatcctctttccttatagtgatcataaatcttatctgatcagtttgctagatgaatggtgatacatgccgtgacgaaaaatctagacatatactgttgacggaaaaaaatatgcagatactccaaaaaaaaaaagaaagatagccttgcgtgttggtcagcatggctaacccaattattccatgaaaattgacatatagtagcatgtaacatagtccatatgaactgaacttttgagaggggaagtagctcagcactttttacattttgactctttttaaaaacttatgttataaataaatctctaaacaaatttattttaataatagaccattttcacggtgccaaggtccctaacgccgaggtacaacgtctcagtgccaatactctcgttcccacaacagccaagacatagaagacatagaggagtcggtgccaaagagactcgcattgacgacctatttataagaagtgctgagtctatttgtaagaacaaatatttatattttttacccttctcagaaaatttattttacaaataggtacctggcaccaatctctttgggaccgatcccctccacgttactaacttagctacatgaggcgaggggtgtatatgactgtgttattggcgccaagacattgatcatggtgccaacaaaaaagaatacatttgtagaataagttttttcaaaggtctatttgtaaaatttatttgtaaaataaattttagaaactaaaatgtgaaaattcaggaaagtagctagtagcatactatacaccgtaccttccatggataggtcatgtcccatcaaatacatcaaatgatcccttcgataaaaagaaagaaaatatgggcatattaccatgcaaatctgaccaaacatttctatgcgacacatataccaaataatggagccctaacatatattcctacaggaacctcgagatcgatcgatagatagatggatggatatatatatcgacgttgttgcgtcaaatcgtccatttttctccatcaaaagttgagtcctttcgatcgatccatggatggcgagaggtgtccattggacgcatttcactggtccatgtttctgcagctagctagcatatcatatgcacttttgttttggagggagatggagaagacgttggcttcatggcgaacccaggaccagccatggcctctttaatttcttgtcatccatggggcgagatggccttttttgagcctcactctttccctcctagatgctccatcaattatggaaaatgcttatcccacgcaatagtgagtaaaaattgtgcttcggagcctttcaagaggtggaaaagtcgaggggtttaaacgccatgatagtttgattcgcatggtagtcattttctcagtcgccatcggatggcacgcggaaattggcatacgtgttgattatgttgtattgatggtataatcacgttgttttcatcaaaagtatattggttttgtagaagtatttataacaaagggtttaatttaatttgtaattaattttggtgtattatttatgtggttttatgaaagcaccgatagatttgcaaagggcatgtttacatccatttggaatagcaaatgccaaatgacaaatattttggtggcaaaagttttagtattgcaaaagtactagttagctggtgattagatgcatcctaaacttttgccattctagcactttttggtggagagagagagtggtcccaaagcactttttggcacaatttgctactacggactagcaaatagcaaatgacaaatatttaacttttgctactagtgtttagatccaaaatggcaaaacttttgccattttggaggatctaaacagggccaaagataactatttttggcacttgctgctccttacatttttacctattttacaatgaaactactaacaaattatgagatgtcacgaattatgaatcatgacgcagaagatcctgtttttttgttttcatcaacagtaaaatcaagcatatgcgtgtacattaattacttaatcaggtcagataatatggctctacggtcagataatagttatgtaactcatgtatgggtatgtttcttttaatattattttagtaatacaggacagatttaggagcgattatatcaccaccatgtgtaattgttctaaaatataaaaacttaggatcggatagaacattttctattatttgtcttgctcggtggtacctatatatagcctagcaaatgttccaactgagtataagctcttatattttaggctgaaggttgtattatcttaaaagaatctgaaattaacatctgctacctcagttcaagctccacataccgtctatgcgaccagacccatgataagaagttcgcgccgccgtccctacgaactccggccaccgtggccgcggccggggagcacggccacgctgagcctcgtggccgacgcatacagatatccgacaagcaagccaaagagggtaaggctgtgtttgtaagagcaagtttccaacactttctttttaattttcgcgcgcacgcttttcaaactgttaaatgatatgttttttttaaaaaaatttatacgaaagtttttttttaaaaaaagttatattgagcaatttctaaaaaaatttaattaatacttagttaatcacacgataatatagtactccgttctatgagcgcactttccatcctgctctagcgaacagtctaaaaagggaaaagaaaagtacagcggaaattatccacaattggcacagtactttcgatgggacatctctttgtgcgaaccggaaaacgtacccccttcctcgactcgtaaagatctcacgtgcatgacaggtgggtcccaccttaatcatggcccactggtaagtctcttaacgtagaaacgtgcgagtacgtggaggttttccttaacctatctatctactcctcgtaaattgagcggtagtatcctttaccctatgctgaaaataaagtccttttttcataaaaagcctgcaaaaatatttacatttctttttttttacaaagaaaactttgccgttgtgctctctgctaaaaaaaaaagtattttcaactgtgatggctatttaaccagtacctagaaaaaaattaacaaagctcctatattttagaggcaaattttaaatactactagcagtcctttccagcaagggagtgaccatcaccaatgaactttcttgtggccttttgggcatggatgcaaataaacaaaacaagatggccaaattttgatgaactacacttttaaataagcctccccttggattctggcctccctcggggagcgagcagcataatctccttctgctagctcactgctccctctcctatcctccatagcctcatcactctccacagcagcagcagcagcagcagagagtgagcagacagcaatatcatatccgcagccttgttcttgctgttctcactaatcaatcaataatacctctcttttcttgaaattttgatttcttctttttatttcctcgagaggaagaacatcttttcttctacttgtttgatggcagagacttgatctttgtcaatcttgtttggttgctcaaatcttttggtggttcagtttggttttttttttctgaacatttgtttgatctgatctttttttttcctttttctaatcgtttctgaatctcttttgctcattggcaccatcccaagaacaacagattaatccgcagtagatttggattaataatttaagatcgcagtaaggttagattaaaacttgctggattaattatctcgagctcaaatgctgaagaagaggtgtgatctgcaagctccctcacctctgagcagcgagctcgccaatggcggcggggggctcctctcgccgaggtcgtcgtcgtcgtcgtcgtcgtcgctgcagggcttctctccgaggagcatcttctccgtcgacgaccaggccaagaaccatccctgcgcgagcccaaggaacccgctgagcggcggcggtcaggtgaccgggctcgccggagttctcgtcgacggcgagggcgagcggcggtgctacgggaggaccggcagggtgctgctcgggatgatgcggctccgggtgcagctgcctcaggagagggtgctcg

SEQ ID NO: 63831 - DNA, 5738 bp, Oryza sativa
agctcgccgatcgagttcggcgtgaagaaccgggacgcgcagctggcgctgctctcgccggtgcagcggtcgccgctgtcgtcggcggcggcgaggacggcgcagggcgaggcggagctcgccgaggactacacctgcgtcatcgcccggggacccaaccccaagatgacccacatattcgatgacctcgtcgtcgagagctccgccgccggcggcgacgcttgccgcctcttcatgcagcacaggtaaaatccaaaaagaaaaaaaaaagaaactctgaattttgatgctctgaacatcgaaatttcatcgttgtaagtaactgagtatgattgattcacttgatatttttgctgatatttgatatttgaaaagatttggagaagtagtttgatgaaattctgtcggtttggtcagcattgagtgcattgtttgttgcggtttttatgaagtttatttttgggtgccttttaaaaattacttccatatgtaactcctgttaagagataatggaaatgctttttaagtatactagataagatcatggtcatactttattgtcaacctacttagtgcaaagcgacgtctttggctgcaattgtggtggtgctcatatggtctattgtcatccactccaataagatttctttttttttcttttcatttggatgaaagctaatgtaaatatagtttagccacagcttggtaaacaatttgatgcagcattgctgtcattgtgagccaatgagtgacatcaattgatctcaggttgcagaaatttgattgaattctggctcatttttttgtggtccctaactcaaacattgataggactgtagatctggggtctccaatctttgtcagtcattagttgccggccctgaaattttttttctatgaatgtgacgtttccttctccttaagttcaggatgagagttcaggatgagaatgagatggatcattagatgttgcctccaatattctctgctaattattgagtcattggatgcattaggccaccaatcagttgttttcttctgaattttcgtaaaacaatacccgattttcgaccaactgatcaacatatagtacatatttgattgaatgataatattgtcatgtactccattacgacaaaggcatactgttactatcaaactgcacacagcttttgcactgtgtgtttatcgcgtcgtgataaatagtatagtttactgattcaccattatttgcctttcagagatgagaaagccttctgcagcagccaatgccgctaccacgaagtgcatttcgataaaaggatcgatgaagcatcggatgtgtcatttaaactgaagaattgattggatcttttcttttttttttcagcctaaattttggccactacctgcttatgagttatgagtgagattatcattcttctacctaaattcttttggtttgaatggatgcatgtgttgtatgggtgagaaaaaaaaactagcagggtttggagagccctatttttgctgtataatcagaagttcagaactggtgatcatgagcaatatttgagcagtctttcctgctgcaaaaatgttcatgtttcatcaccacacatatgcagcattaccccacggtctgcaggttgtctccatgcatctcaccaaaaattcagaacagtgagaaatggagtacttagcctacatccttgtacccatttcccaatcttgccagctaaaatggtgagcacaaatgcaatatttatatgttgtaatcttcaactagttggaaattggagcaaagctgcagcgcagggatctgcacaactaaaaacttttgtaccaccaaatttgacaccataacatgtttttttttactgccaattcaaagcagacattgaagcatgcgggcatcgagaaatctcatcagcacagcaagttaagaaaacagcaacaacaacaataatagagaggatgaagctaattatgctcttaatcatccaatacatttccagacaaaaccaagaacaaacattgatcctgcagactgcagtgcagctgagcaaccatttgttcatatgccaattgtttttactctgcttgtttgatcgaaacagctactggaaacaaccatttattcggatcgaggatagtaaaagcaaaaaagaaaaaaagaaagacacagagttgctttggctgattgggcgaaagctctaggacctgcgaggcggcggggggttggtggagcaggaggagcggaaggcgtcgatgtggtcctggcacttggagcggtcgcccttgttctcctcgaggcacttgcgcagcgccgccacgtcgcacgccgccgccttcttcttcgtcgccgtcccgtcccttccgccgcctccgcctgttcccgcctccgcctccgccgccgccgctgcttccatgggaccctggtggtgtcctctgcagagatggatgagcggaaggctcgaggtcgccgggaggaggcacgccgccgccgccgccgccgccgggacgcgagacgcgagggggagagattgcgctacagttttcttttttttcctcttttctttttcttttcctttttatttttttaacgtgtgattatggtaagctagaggatttttttagaagtagtaacactaacatgaatggaatccattcaatttcaatggatacagcccagagaccataggtggagactgaaatttacaaatttgcaaactatttgctactcttataagtggtaaataagaatttgtcactggacacacatgttatagacggtaagtcgcaaattcttaattgccgcgtcttaaaagtggcaaaaggttaaatgcccctgttttgataccaattgaattttctcaaatactacattcgtccaatataaattgtaattctaatttgtttagcatatattaaggtttgagtagaaagactataatgtctcttattaaatggtgtataggtaagagtgaaatggtagttgaggataaaataggaagaaatttaaatgaaaagtgattaatgagatctttagtactctattgtaacaattattttgggacaaattcaaatcctaaaaatacaattattttgggatagaggtagtaaaaaaaaaacagagaaacctatactaaaacttaaagaacttctttggcatgaagcaatattatgaaaattttagaggaactgagccatttcgtgtgaaaattagtcgaagttcatgcgtctcaaaaggagcccttgtcatttcgttgcatttagtttccagtattaattttgttgtaagagcatgttaatttgattgttctttcctaattcctattagaattaattagtgctaatgtatgaaacaatcttttaacaacaataatatgaattagccaattgtaaaagtttctattctatatatattgttagatcatttttatctatcgatagattgcttcctagtctctactgcgtattgtttcttagtatgggccgcaaaagaaagtgtgttagtaatatcttttagtcgtaaaatttggggtatacaagtcacacagtttgagttacatgtaaaagtttactaatttcattcaagaatgagtttattaattgttttggagtggtcttaattttatcattctgtaaagaaatggaatatgaaacttcatacaccacatgcaaaattaaatttatagtcagggtacacagataggccgggcttattgttttgggccggcctactttaaacatatatctttaaagatagatcgggaacgttaatttcataacaggtagttaatcaacggtgtcgatagtgggggcaaggataattagggtttatgataggtcatcctatatatacatgctatggacggcgccacacacgagtaaacaaaaccaaggtaaacgataaggtctatgatagatctcaccatacaaaatcgatagaagagctagtcgtgtgcaaaggtgaagaaactaagaacaggtaagatctttttcttttttatcaagatgaaagttagatattatttgttttgttgaaaagtattagaagatttaggatttttgattcagcgaatacataaaactaagaacatgtaaggtgtctttctttcttactgagatggaagtaatatatatttgttttgttgaaatgaactagaaaaaaatagatttaggattctgattcagcgcttgaaaaactaaactaaaatcaacaaaaggacttcttttcacttcttttcttttatcttgttttgttgaaatctaatagataatttaagtttaggattcgggtctggcgggtatgaaaaactaaaaacatataggatctctcttttctattgagatgaaaataaaatttcatttgttatattgaaatgtaggagaaatttagggttccaacatagcaaacacaaaaaactaactctttcattctttttaaccagatggaagtaaacattcatttggttttgttgatatgtacttacttactccatcataaaacattctagcaatttctagctatgcatttgaactttatccttaatttgttttatgaaatttttgagaaaatttagattttggattccgatctagcaaatgcgaaaacctaagaaatctctttcattttttatcgagatggaaagaaaattttatttttgttttgttgaaatgcaacactattacttcaatccacaaatataggagtaataattttcaggtatgtatctggatatattcttatctatatacatgacagtgcccagaaagttattagactgaattccttttttactgagatgaaatcaaagattccatttgccccaaaaaaattacttaaaaaaatggatttacactagcaagtattaaaaatcctccatatataggagagatggagaagaaaaccaaaaagaagaaccctagcaagagggggagaaaaagaggaggaagaggggagggaagggagaagaaagtggaggagatcagcagcagcagcagcagccgcggccgcggccgccggaggatggcgccggtgaagaagtccaagaaagggaagcgcaagtccaaggactccggcaagctcaagatcgtcaagtatggcggcggcgcccctcccctcccccccgagctccgcggcctcgacaccgagtggtggtacaccttcctccacaagcactccgagctaggtatcgcttgttccttcccaagatttggtgcggtcgacgattctttaggttgattgattgtttcggcgtgatattccaatcttgcaattccaatctaggtctgagcgcgccgtcagatgagggggaggcgttcaggtatttcttcaggacgtcgaggaggacgttcgactacatctgctcgattgtgagggaggatttgatctctaggccgccgtcagggctgatcaacatcgaggggaggctgctcagtgtggagaagcaggtggcgattgccatgaggaggctggcgtcgggcgattcgcaggtgtcggtgggggcggcttttggtgtcgggcagtccaccgtctcgcaggtgacttggaggttcatcgagtcgatggaagagcgggctcggcatcatctggtgtggcccgggcaggagaggatggagcagatcaaggcgaggttcgaggccgagtccggtctgccgaattgttgcggcgccatcgatgcgacccacattatcatgacgcttcctgctgtcgagtcgtctgaggattggtgcgacccggcgaagaatta

SEQ ID NO: 63832 - DNA, 10243 bp, Oryza sativa
ccagatcaccatgatactggttatagtgaagagaagtgcgagcaagtggatcctaatggcaagataatgagagatgtcattacaggatatcttcaaatctaagaagcttcccattgaacttagctaagctgactggcagtactctggagttgcaagaaggcatctctgttcttatgtttttctcctcagttgtccttgttgtaatcagacctgctggtctccattcggtaaagattagcaatgaaataattcagttaggaattagctagctcaggagcaaactatctcttccttgagttaaggaaaaaatgttaatgtgttcatggtgatgacaatctccatcattttgaggtacaagatatatcagtggtcaattgctttgaatgaaggaaatcgcctttaaggagagtagctattcaactttgttttataaatgtttagatttgcataatatagtaaaactcatgctcgcatgttattaaagcatatccaagaaaaatagtaacctatatatgacatgttgagttgagtgaactagtcttggatgtacatcatctcattttcattttattgcaaggctattgttttctaaaatcatacatctaagtttgacgtgcctggtagtgttttactgaattcctgatgatatttgtgactgcatgatgttcattctgttttgttgatttactatttttttgaagatgatgtggtatcttgttttgttgcaagtgctttatgtgtaattatatctgggctcgatgtaaaactggttgcataatggttataaatcttgtccatgtaaaactgtttcccctcaaaaacacaagtataatgttcttaaagaatgtgattgaatatgcttcttctagttctatgtcttctggtctgctattttagtacattttctgcagactaatattctgccctttttttagggaaaatattctgccattttgggttggcttacctacagattcccggaaaggctaattcgcgcgtacgcgttggcggcgcgcacgctggcccactaaggcccatgcacgcacgagctgcgcttctctctttttttctttcttttttagccgccgtttcttttttttcgctgtttttttttccttccgtacggataggagaaaaaatcgtaattagtttagattagtttcctatttttactagtgattagtttactagtaatttttaaatcttaactttaaaattttcaaatttggacatgaaagttttcaaatctcgagttgaaagttttcaaatctcaagttgaaagtttcaaaattttcaaatctggacttgaaagtttttgaatcgagttgaaagtttccaaatcttgagttgaaaattttcaaatctcaagttgaaagttttcaaaattttcaaatctggacctgaaagttttcgaatctcgagttgaaagtttttgaatctgagttgaaaattttcaaatctcaagttgaaagttttcaaaactttcaaatctggacttgaaagttttcgaatctgagttgaaagttttcaaatctcgaattgaaagttttcaaatctgagttgaatgtcttcaaaatttgactttaaaatttaaatcttaaatcaaaagtttctaaatctaactttaaaaaatcgaaaagaacacgtaaataaattaaaatgtgcagaggagaaggggcgtgacaataggagaaaaatcaagaaaaaaaagagagaaagaaacatataaggggaagggcgcgggccgtgcgagtcaggaagccccccagattccctttctatgtcttaattgcggcaatgtaaaagctgggaacaaaatctggttaaccaacatatatgatgatactcatcagaaggcatactattcaaaatatattaaaatgaagaaataagaggcatactaatgactgatctaatacaaggtcacataagatctagctgctgcaaggtaagcaggcgacaatagccatgaaaatgaccttgtgcaataactagaagacatagaacaaggcacaagtagggatgagcacactggccattaaactcgctgctttctttgagtttgtggcgcttgaggttttgttagatcctgcacttcctgcatcgaattggatcagcccagtcaggtacttgtaactaaatttcacaatcatctagcaattagcagagtacttgtaactaaatttcgatctattatttaccctaaaaaaaatttcgatctattcgtgactttacctgcaggtggtggacttggttcatcctcgtttgtctctgctggctcatcagctaatgtaggtgtatctggtgctggaggtggagttgggacggctgaaacaaatcatccacacattctggttaatcttctgagcttaagatcgacatgaactgatcatcatctgcatttgattgcgagatagcatttattacctgtgcattggctgattggtggtgcctggaccttgcagacaccagggagctccagcgccctcgtgtggttgatggagatgccgaaggacgccgcgctgccatccaggaccatgcagaggcaccgggggtcggactggacgacgccagcgagcgtggtgcagcaggtgaactcggggatcggcgatttgccggagatgtaatccaggcacggggagagcgtcatcatcacgctggagcagccattgttctgcgatgcggcacgggaagcaagcattgtcatcaccaccacaatcaccgccaccactggagcccgtgggacgccggtctgcgactttcttgcagccattgtcagctgccgatcgatggtccctccctccttccctccctcctcctcgacgacgaacaatacaatgccggtcaaatcaagaactgattgatgtatgtctctcagaaaaaaaaaagagtaaaaatgcttttggggcatcaggtgagaatggtttgtgaggatgttgatggaggatgagatcgttgtatgctgcagccactcgtgccggaattgaaggaatgctgtgccgggaaagtgcagggatgtgttcttcctggccacacagttgtctggccatagtgctaatgaacatgtatgccattttactgcagtcctctatttatggaaagaatttgatgcatatgcagaaatttagggggtgttttggtctggttttgctccaatttgggcacagccttacccttttctctcttgttgtttccagaatcagcattagcagactagcatgttgtgacaattatagacagtgaagaatagtgaagaaaacctgtcatcatcaagtgactattttttttttcttttttatcaattttagtgactgttttttttccatatgtatacttatcgaacaacatgtttaagtattttccttggtgaaacaaacaattgtttagtgaatcatacaattgtaaaattaagaaaattctaatctagataactacagaaacatttataggtgaataacttagaacataatttgtagtttggtgaatcatacaaatataaaattaagaaaattgtaatctagataactacagaaacatatctaggtgaatcgatacaaattaaggaagaaaccaaattaaatgttaataagtaagagtaccaaagttcatcttttttttaaaaaaaaaacactaaagttggagtaagttttggctctccagaactctagattgacactaaacaagagtattcagatgactagtaacttacaacttcaaaagttgaaggtttaacatgtatatttattcctaggacatgcctgctagctgtccctcttggaagaaggacgcatatcactgttcttgttggaatattagtgaattccgatgttgtttttgttgttaggaatgcgaattaatcggtatttggagcacctaatattccaacacgaagaggaagcatcttgcctaccgaaagtgcatgcatctcactgaaaatttcataaatatatgtccaattgccaacagttaatcaacaaactaatgccaatacacccaaacaaattcatcaaaattcgtatggtagtctctgtacatctcaccatgcaaaaacattgatcatgtagcaatgtcattagtcatcatcatcacctgtccaataattagttagagctgtcattaggaagagttggtcaccaacgacatgcctaagattccatcacttcacactatataaacaccccaacttaaacacacaatctcacacaccatcaagctataatccgatcttaattacatcattagccagctaattaagtatatatctagcttgcttagctagaacacactctacagctaagctagcaatggcgcgcaataatggcgtcgcggtgatgttcgccgccgtggtcgtcgtcgccggcgcgctggtggcgggggcggcggcgcagagcgggtgcacgtcggagatggtgagcctggcgccgtgcctggactacatgcaggggaacgcgtcgaggccgacggcgtcgtgctgcgcggcgctgtcgagcgtggtgaagtcgaggccggagtgcctgtgcgcggtgctcggcggcggcgcctcctcgctcggcgtcaccgtcaacaccacccgcgccctcgagctccccgccgcctgcggcgtcaagaccccgcctcccagcgagtgcagcagtgagtctctctctctctctctaagatggttgccggagtttggtcaaattcaaactgctttaaatttgtaaaaaaacatagtaacattttcaatctaagacaaatttattgtgaaaatatatttaattattgatttgatgaaactaatttagtactccctctatcccataatataagacgtgcacacattacaatattcaaatttaaaaacgtttgaccaataattattataataaaaattaaaatttattgtttaaattatatcattggattgacaattaaatttactttaagatggttataaatttgttgcaataaacctttataatatatgaggaattttaaatcaaagattagttttgaagactgtgtcaagtttaaccatgcgttatattataggattgagagagtattataaatgttattatatttgtctataaacttagctaaatttaaaataatttaattttgatcaaagtcaaaacgtcttttataactgaaggagtattactatcttcttccatttctctggcgagcctccgccgccgtgggccgtagagtgggtgactgaccgtcgacggacgactacgttgtgttgtgttttgcagaagtcggtgctccgattccgtctccggcgccggggggcgcggcggcgccgaatgcgccgccggctgcagggaccgggtcgaagacgacgccgaccaccggcgcgagctccgccggcgagagcgtcggcaaggcggcgtccgttgcgatggtgatcgtgtcggctgcgtttgcaatgttgtatgcttgattaattagtttaatttctgcgtggattaattgagcagtttgattattgtttataatgccattgatatatactgtgtgacatgtcatttatttcttcatgtattttaaatttcgattattattatattcattgtatgatgatatatcatttgttgaataatatattcaagtgctttgcatttgtccggtacgtttgggtaattcctgatgattactgcaaagatttcaagtttctttgtggatggatctccttgttgtatatggaatccatttccattggtctcatattgttctctcctcgttcaagcacaataattaatttatttttaaattaaatatccgaaaagaatgaacttcaaaacctggacacttttcagcgtaccctaatatatcaaagtgttcactttataataatgaaataaatttccaattgaaaccaatggtttgatggacaaattcctgatggtgacaggttaatttgctggtgtgagattgattcaaacgaatttgatcttatggatggagatgtttttgtggcagctggttcatcttgttttctttctaggaatgtagtaataagcaaattaatggcattcatagagtgcttgtaataatctgattttgaacagttaaaatagatggttaccttacaatttctacaattagttcttggttaactaactgaaatataaatatttagttcagagaaggtacaaatttcagttagcaagtgggactaaaatatgacctttgatatcccagaatcttaataacgaaaatctctgtactgactcatatatagtaatgttgcatattctttctagtcaaagcacaacatattatgccaaaaaaaaatgtgcttatagttggttaattaggttgttggtgagtagtatcttgcatatagttagattggtctggctggccaactccagccaaatgctacctcccaattcatagatttttaccggttggcatatttggttcatgcactatgttctatatgtatatacgcagaaggagaaacgtcacaagtgcaacgacatgattactattttgaattgttttgataaaaactgcagtctcagtcaacaatgtaaaagtaagtacattgtaatggatggctaattaataaatttacgattcacaagcaaaaggtatgttggataactagtggcttattctgtcacatcctgatttttgtttcagggtttataaattatttaataaattaataatagaatttatgttaaatgttctttaatttacaagtgaagtaaaatgtgggaaataaaatttcctaaatataaagcatggatggatttaatttttgttaaattctccatggttaattatactctctgaaattttctcggatttttcagagctcaattcttaaataatacaaagaacagttcagtaattatttgatcattaatgatctaattatatttgttaagtgcttttcttgtttaaaaatccttaaattataaattgttgtttaaaaggaattattagaaattattttaaaagcctagaagagaagatctaattttaatttgctaaatctcaacataaaattgggctagataaaattttgttaaatactttgcttaattctataattcctagatttttctgggatttatttgagctaaggaagtatttttaataaatggaattgcatttcataaataatttaaattgaaaaaggtttttaaaagtcttcttttggctttgggccgaaagccggcccaaaacccttctctctctctttctctcggcccagtcggcccagtccgccgagccgccgctctcctctctctctcagccgctgacaggtgggccccgcttgtcaggttcgtcgtcctccttcggccgccgccgcccgcaaaccctagcgcgccgccgccgccttctccttccaaattcggccgcgtctttccttctccggccgaatcttttgaggggaaatgatcttctcgatctcctcttccttttctcttttggattcatcgcctaattcggtttggaaactcgatggattcgagatcgaatcggattcttctctctctcccgaacccgatctttccttctcgtcgccggtcgccgtgggccttcgccgccgccttcttgcacctataaaaggatccccgagctctcctctatccgccgccacctttgccttagcctgccgtcgcgtctagcgccgcctccgcgtagcccgagtcgccgccggtgccgtccgttgcccttccgccgttgttttggtcaccggtgagttcgcggcgccgcgctctacccgttggtgccttccgttcgcgtcgccgcgccgtcgttcgccggcgagcatgcgcgtccgagctgcccaagtcgccgccggtgctgacgtcatcgctgccgtcatcgctgacgtcatcggagccgttcgccgtgagtcggtcgtggaccgatcgatctcagccgtccgttttggatagggttgatctcggccgttcgtttccgtgagccgtcgccgtgcacccggtccaccgcaaaccctagccgctgacgcaataatcctccttttccttttcaaaaataattcattattgcgtcataattcaattaaaatcaatataaaggttttaatccgatttaatctttaaaaattcataactaattcatttgaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaaatatgatctacatgtttgtttactttatatgtactgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacataatcctttgagcatgttgatcctatatttaaattctctatttatttcaactgtgcatttattttcgaatgtcactgggtggtgtgaacctattcctttgttatggcctgtttgcattgattactttattccttgataccttgggttattataacttgactagttgagctatatatattggttcagctagatattagatatgattgctttgccatgcttagaaacattagcacacaattgggataactaatgtttcattatcacttatggttatatttaatggtagctcacgatggtcatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccaacgtgggcaacggctttaccttttgtatagcatgattcattgcggagcaccagactgagaagtggcggagataagcccacgggggtcgctggggagtccatgcctctggtttttgagggggtgattatgatccaggaatggtgcactgtggtgagttgtgttatgcagagggtattgtcacagcctctattcgagtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataagtattgatgttataactggtaataatttgcttagctcctggtttggagttagatctgtacagccgggtatggttgttcaggatggttgggcctgtacagcatgggtatgctgttcagtgttgattaaaatttctgattaattactctactgttttactactctaaactctttgctaaatgctgctttcgcaaatgagcctatactacgccatcctttggtatccttgtgcacttgcatatttgctgtgtggcttgctgagtatgtcatatgctcaccttacaataatcaatcaacctcagttgaagaaaaaggatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcaatttgtgtacctcggctcattcctggacgaggatttcatgcacaaataagttcggaaattactagtgaatttccgggcgtgacatattcgctgatccagagtagaagacgacgatctcatgcacataatagataaacaatgaacacggatatagggagaggcatcacagctttattgatttctcatatgtggatacatcagccaacctctcaagccctctctctgtatatatacccataataggaagagtcccattaggatacgtttccatatatttggtatgaacccatattatttttggcaggagataatagtttcataccactcccccttgggcgaataccgcgctatacacatgtctcattaaaaactccatccaaaaacccagtgggagaaaaggataggagaaaagagtacatcgtacacgctagttatattgcacttgttgcctcgttaaaaaccttgcgtgagaa

SEQ ID NO: 63833 - DNA, 738 bp, Oryza sativa
cccctacgaccgccgctacgagctgcggaacaactacctcatgctcctcgtcgtctactccgcgtgggtgacccccttcgagttcggcttcgtcccggagcccgccggcgcgctcgccgccgccgacaacgccgtcaacgccttcttcgccgtcgacatcgtgctcaccttcttcgtcgcctacaccgaccccaagacgttcctcctccaagacgacccccgcaagatcgcgctccgctacattaccacctggttcgtcctcgacgtcgtcgccaccatccccaccgagctcgcccgccgcatcctcccaccggacctccgctcctacggcttcttcggcatcctccgcctctggcgtctccaccgcgtcggcatcctctttgctcggtaacctaccttctacgtatacggggagtttctgattctagaagaagttgcagctgttagaatcttttcaaataattcagcttttttatccatattctaataagttatagttatacaatctagatgatgaattagaggggaaactattttgatccctcgagggatgtccactcgtttgcttaaaaactatccaaatggttatgagaaattctagaaaaaattgacaacacacgtacaacatatctatacaactctacaaaattttaggtccaaactcaactcacacgttgagatataaaaatgacaaattcaatgtatgaatagtagcgcattgtttacatcagcgtcctc

SEQ ID NO: 63834 - DNA, 6573 bp, Oryza sativa
tacagctgaacttggagtgtcaatggagagatgtatccagcaaaaggttgaggttatcaaagacaaaagtgattcaccattgagaacttctataagcaaagttatgttggagaaatcggatcaaatgaagtctactgaaagtgatagtgttaaaatgaaggacatggcgattgaggtgaaagtcacagttgagaacttcagtgaagcaggtaaaccagcttcagcgcttgtcatgtcaaatgacattaatggtgaagttatggctaagcctaatctaacttgtggggatgatcaacttcatggaggggatgggacatacaaaaatagcatggaagatgacctagcttccagagaacctgttaatgcatgactttgcatttcctgctacaaaatgtttaaggtatcccatatcctagaatttgagctcatcgtttgataatcatattattcacatactaaattattccctgccctttttttgctgttctctctctcccccccccccacccctcccctccaaatggtaatgattttcttgacaataacctacttcaagctacaggcatgatagttttaagaatgctccaaatcattcaaaattagctgtagaacttgtaatataacatcaaagaattgatccatgatcatttgcaatgcttatgttccatgcgaatttactatcatttattctgatatattgatagatttctttagtggcctaataattcctaggagaaaaggactaaaaagaaatcctgctagaaaaccccatatctagttttagtttccttaacatggacaataacaaaaacttgaacataggaaatccattggtaatttctaattccatggcagttctctctttttttagttatattccccacttgttccattatcaaaaggaactttattgaatttgttttgaatccgtaatttctggactaagaactttgtcttacctttttatgcttacagtgagcagagcaatgggagggacgatctagttttctgcaagtagctgcctcagctcgttctccatggctacaacgaagtgtttagagttgcattttgcagcaatgaaatgctgatgtttcagaattttggtagtctgtcgatcatgggggctttttgttggtttagtaggcataagtagttcacaccgtaggacctcttatacaaaccccaaaaagtgggccaaatttttggtgtaaatacatgtgggaaattgctgttggcattttggtgcacctgaaatgttgtctgaagattgtcgatgaaaacagacttgcaggtagtgcctgtacagatataaaaatccatcctcatctgtttgactgttactctgaattttcattcggtttagaattctgaattctggatgggatttcagcatccagattgttcaccagctatggtcaaatttgctgtttacccataatgtgtcagtggcttgagtattcgttatccttcgtaaattctgctgtcttctactcatttctatcacctctgttcataaaagaatgaagcatatatttgaagaaactgaagggaaaaccagcaaacctccctcgttcagaaatactcgtcagtgttggtcgagcgatgaatcaaggaagaaaattctatgcggcggtgccgcaccggacagcccgtgcaacaccgtgtaccctagtgacgcgtgtccaatccctgttgcaacccgagccgatcattgcagccgagccgatgtccaatctcccagagctctacagtatcgagtcatatctaccggctgcatgtaaaatctaattcatttttttaacagtgctctatttgatgcgagatacataatgccgttacttttagacacatatttaactactcgttttatttaactttttttcatgattattatttattttgttgtgagatgttgtaatcactaaaaatattttatgcatgatttatatcttatgtatgtccacaaaatttttaaataaaataaatgatcagacgtgttttcaaaagttaatgagatcattattaaaaaacggagggagtaatatacaggggatttttctagggtaatatacattttactaaactttatcaatatgcctcaactggtcagaaattattttttcatttgaatagggttgggaaattccattttgatgacgtagaaatcacggtttgaaaagggctttgagattacatttttgttgacatataaatcacggaaagtttataaggctgcgttcgatcaactccaaaagagagaatttttagcgcacgcaaaacgagaaagcgtattagctcattattaactataaatttaaaaaatgaatttatttgaattttttaaataacttttatatagaaattattttaaaaagacgtattatttaacaatttaaaaaacgtaaactaccaagatgaagtttggagtagaagaaaataactaggcctaagtaataatcttgcttcgataatcatgttctggtaattgtttattggcacgagactgtgtaactgagggagacgtgggtgtagaagatcggcttggctccaaagaggcaaagatggtctcgggctgcaataatacatcggacacgcgtcaatagtctgcgtggtgttgcacagttgatcttgtgcggcactaccgcagagaatattcttccatgaatcatcaatttatttgatcgtacaactacatataataaatataaaaaagaagcatgcgtttaagcatgtttttttggggcgttgctaacttgcgcgcgctgcctcccccggctccagaagcccatcgggctttttttctttcttttattcgcgatttttttcctttttttcgattttttcttttagttttttctatttttctgattactttttttaaaaatctttagcacacgtagtttttttaaaaatattttgagttgaaagtttttaaatcttaacttgaaaattttcaaatctgatttgaaagttttccaatctcgagttgaaagttttcgaatctcgagttgaaaatttttaaatctgagttgaaagttttcaaatcgaaggaaagttttgaagtcagagttgaaagttttcaaaatttttctttcaaattgaaatttcgaattgaaattttcaaattcggagttgagagttgtcaaaatttaaatcgtaagtcaaaaaataaaaaatctttctttaattactctcattatccttaactatttgaattagttacgttaaccctaagtcccgcgcgccgctggcgcatacgcgccagctagtcttctcgtgttttttgtcctaaaaccgcatcattttcagtccttgaagttgataaaaggaaaaagtccactttgactcccttaaatatacgtcgaatctaattcgtatccctaaaccgtaaaaccggataagacgactccccgaaatattgaaactagtgcaatttgactccctcagcggttttggagggcggttttgctgacgtggcgctgatgtggcgatgttgacctagtcttcatcccacgtggcgcttatgtggcattgaattaaaaaaatatctgtgggacccatctgtgattcgcacattaaaaaattgtgggccccgctgacatgtggggcccacatgtcatcctctctatcttcttcttcttccttcctctctctcccttctccctttctctccccctttctcttcaccttctctcttggcgcaatcggcggcaggggcggcgattccggcggtagttggagcggacggccggtgctccacccgagcgccttgtccacacccagcgccctcgccaccacctcggcgtccgcgtcccgacgctgctcgtctcgccgtggatcgagacgatgctaacacgggcggcgccgagggaggactgcctcgccatgctgctgaacccgccgcggctgcgggacatagaagcgggttggacacgccaccgccgccgccacccacctggccacctcctcgccggcgtggtggggagctcgacggtggggaaaaaaggaggaggaggccgacggtgggaggctatgggggaagatgctgcatgggaagttggtcgccgcaggactgcggggaggctggtggaggcgctcgtccggtggcggggtaggcgagcatggcgacggtctcgtctgggatggggaggcagcggagctccgatggcctcctaaagccagcgagggcggcagctcttcggggtagcagagacggtggggagcccgaagggtggcacgctcgtcaaggggaaagaggcgactggcggtagtggggggagagtggcacaatgagccaatgaggaattgctccgggtggcgttttgcttgatgatgccgatagctttgagtataagtaaaggagagaagctcagagccgactccagtggtggcgcgacggcgtggacgtggttcacgcgtgcgacggcttcttcgaccacatctccgtcccggtcaccggcgccccttcctcagatgacatcgtcagagctgcccttgtgtatttcgccttgcaccgcctcggagtcggagtcccgactgtacgagaaagcagtatagacatgttgcagcccacctcctacggtcgctcgtcgttccccacttcagccgttgtcgactaccgctgtcccctcagcggctgctggccaaggtgaagagagagaccgggggagagagatatataagggggagagagagggagggaggaggaataagggaaggagagggtggttgacatgtggggcccacatgtcggtgggtcccacctttttgtttgaatgacatgttggtcttacaaatctttggatttggttattattgtaatgccacgtaagcgacatgtgggacgaagaccgggtaaacaccgccacgtaggcgccacgtcagcgccacgtcagccaaaaccgttttcaaaaccgttgagggagtcaaattgcactggttttaataattggaggagtcgtcctatccggttttgcggtttagggatacgaattagattcagccgacaatgaagggagtcaaagtggactttttccttgataaaacgcctaggaaacctgtagttgcgtaagctgctgcgttgggccacagtccattaacccaacaacaacatattaacaagcccaagtaaaagcccattcaatctacaccctagatctcaatccccatcactcacagccgtccgatccactccacccgcaactatataacagctccgcctcctccgcgaaccggaaaaccctaaccctcgcagccgcatcgcgccaccgcctcctcctccccctccccctccggcgagagagcccgcgccgttgccgccgccgccgccgccgccatggtaagctccgttcctctcccgcatctcccctttgcagtggtctctttgcgcaggtgctaaggggaggaatcgcgtgtgtgtttgatttttgcagtcgctgatcgcgggggaggatttccagcacatcctgcgtctgctgaacacgaacgtggatgggaagcagaagatcatgttcgcgctcacctccatcaagggtgtcggccgccgcttctccaacatcgcctgcaagaaggccgacatcgacatgaacaagcggtgagcaaaaccttctcgcctcacgcccccccttccctgatctgggtgctagtttgtgctgttgatgatgtgctggaatggtgcgtggcgttggatcgtttggtgtgtgtaggtataacgaatggttattagtgttatcgggctaatttctagataatttgagcatctttgggtttgtagctttgtaactgtgcattttgaatccgaagttttgtggtttcgttggttctactgtgatgttaggtggatggatcatgcactagagttattttgttcgatagtgactgggattcagagtagggtttactggctggtgctttaatttctttgtcgtggattgtgtgatctgttacatactcttacatggcaatttttttgtgcataaggctgccgcaaagctgattattaactgtctgccaactaagttagattgcttggaacttttagaatttattttaacagcacaaccgttgtaattgtaagttatggatttattttttgctaacttgacaggggattcaaatgcctgctaattttgatgtgtttatatatcaattggcgatgatgttgattgcatggctgatcttttggctccagttaattgcctaatactgtgtttattctgacgtgatgtcacaaggtgtcagtttgttgcaactagtttcagttaagttgaatttgtgttctatttggcttaataggtcaggagttgtctgttactacttagcagttcacaattatgttgaatggtagggcatttgattagtttatattttctgggacgtcattaattttgggctactaagatgattagtctatttttatgctcgtttggaacctgagggtttaattagataaaaacgtgttatagttatcacatctatattttatttggtattagttgtttcatgctgcttggttaatctgacatgccatactgtactttgcttatgctaagttaatctgatatgactttgtaa

SEQ ID NO: 63835 - DNA, 4875 bp, Oryza sativa
taccaaacaaccaagttacaatatcggagtataaaagttgacaaaagcatcatccaacaaaactgcctatcaagactgacatcattaaaacgctcataagataagcaaaatgcatatttgctgtgctgatgggcatggaatttatctcttcttggagacaccgacagtctttcccctcctgccagtagtcttggtgtgctgaccacggacacggagaccccagtagtgacggagaccacggtggttcctgaattacaaaaagatatggttcgattacaattaatcgtagtagttcaaatgaaatcaaagcgcaatttgttcaactgtgagaatacaaaaagtactcggtccaaggcctcaaataacgaaagaatatgatttaaaccaagttcacaccactagctggttgagaacaatgttgtcaggatcgggatactaggtagtatcgttttgctcaaagtaatatcgtatcgtagtatcgggatactatgatattttctttttttaagtttaattaatatttatattaattatatatagccattctatataaaaaaatatagtaatgatatatgtcatgcaaatagagacatttatcgagagaaaccacgttggttttgatatatttaactgatttttataaaaatttgagcatatttatttatattattttcaaaccatgttattttaaataatattttgtagtatcgtagggatcgtagaatcgagataccacctaagatttcgtaggatcgtgtagtaatgaatagtaggatggagatactatgaaaattaggatactaggtgggatcggtatcgtttcggcttggtaggatcgtagtatcgtaagatactaggatacgtatcgggatactgacaatcttggttgagaatgactgatgacatgaacagtacatacttagctaggaatttcaccataacacaaatggatatatgatttaaccagagatgattcattcccatttgcccatgattgatgcagtaaacatctcactaaaaccgcacaaatttagctttttttttttacgaatgtaacaaagcatgaaacaacttatcagtgcaacaaaagcatgaaaagataaatctaccctacacatgcaagttaccatgaacctaaaaaatgtggtacgtgagcacaaattaatcagaaatcacctgatcttcttcagcctctcaaggtcatccctgagcttcatgtccagagcgttagaaacaacctgagagaacctcccatccttgtagtccttcttcctgttcaaaaaccagctgctaggaggatgatcacacagacagagaaaggtgcgaagagtgtcctgtagaccatcggccagccgttggtcatgatcatggcgagggccgcgagtgcgaggaagatgccgattgttacggtgaacagaaacacctcccggtcccaggtaaaagatccctgaatcaatcggttaacatctccaatttgtcggtaaaatagtgtgcagtgacagaatatgtatagtcgttttattttccagaatggataatgacattttcactagtgaaaagtgaaaccaaagatgatattggaatgagccacgtcatgaaaataaaatgcaccgttggatgccaatgaggaaaaaaaaaaaggacaagcaacatagaccgtccgatcaaacaaggaaaaaagaacaatgcaacggaactgaggattcccgattcctgaaccgtaagaaggagtcactttgcattcagtgccaatcaatattggctctgtttttttaaaactatattactccattcgtcctaaaatataacaaactttggactctgacatggtctctgaaatggtactttgaccaacaatatctataaaagtaaaatatgttaaataaaaagagttgcatattatgatagtttatttaatgatgaatctagtaacatcaattttatatgattaatcttttttatttgtttgctatcaatagtcaaagttaaaataatttgacttgtcactatgctaaaaatgtttatattttaggattgagggagtagctttgatcggaagctagatactgctgctggatagcagcaacagcggtagaacggcgtttgggaagagcggtggccaccgccttcgtccttatgtgccttccgctcttcaccgccgccttccgctccttcccaacctctgatggacacgccgccctgaccacaggagagaggagggaggccgctcttcgccgctgcttccaaaggggatggattgtagcggcaagtcacggctcgatctcggcaatggcgatcgacagagaccggatttggggggtttcgactatggtggcgattgggcgccagcgaggggtggaatggcattgctgggaagagaggaactcgattgtggcggtggctgggttgactggggactgaaagagagggaatcgagcgcccgagcggcgacggccgacgcagaactcggcgatggcgaggaacggcatcgctgtggtgactcgaagttgtgggctcgcaaaggggatccggccctcgcccgcccgccctcctaccgttgttggcccccgtcccacgctcgccgaagggaagagaaagagagagagggaggaggaagaaggaagaagatagagcatgatacgtgggtcccatacatactcttttgtgaatgacaaataggtcaaacacttttttttttttagttctaatgctacctaagtttcatgtcaatgccatgtggaacgaagaccaggtcaatactgccacgtaggcgctatgtcagcgaaaccatcgaaagagtcaaattgcactgattttaatagttaaggggtcgagttatccgatagtgtggtttagggatacgaaacagatttggtcaatagttaagggagtcagagtgaacttattccggtaacataacccatgtctctacttcttgcgcatgctgctgctccatcagcctgtaatttgtatatgcgacggctacggcgagttggcgagcagccaagcacagagatgcttctgaacagtaagaaaacaaaccattagatctgaaaatctcctttagcacaaatgcagaaaaaaaaggtactgaaaatctatcgacaactaatatgttcctctcgaaacacagaaataaattcagaagttctagactttcagtgaagtcgggaatcctcaaatttttcaaagatatccttaagatgaaattcataagtactcattaactcttagactgatttagtaacttacctttcaggtaatatccatgacatatacggccccatcgtagccgctcggcatgccggcggcggcagagcactggagagagaggaaatgagagacgcaaagagacgagaagaccgaaaaaagtcctcttctcttattgcaccaatcctatcttcctataaagttatctcccactaacttcttaagcttgacatgcaaagatgccacatcatcatccactaacaagatgtcacatcatcatccactaattaacaagatgtcacatcatcatccactaacactcatcacatttaaacatcatacaaacatgctatatatttatagtttttataatttaagagcttttaaaatacaaacatgttaaattatcatccaacataattcacataatgtttcaatgtatatctttattatgttttatgatataaagtatataggtcattctcacttagtcagtgcttaaatgattaatctatggtccaaattatctttctctttttttcctctaattaagtcatatcacatcaattgtttttagtctttagatgattaatatatctccctacttttcttcttccataaagtcataccagcttactttttacgtttgaatcaccattctacatactatttaaatttaaattatcataaaccacattaatttacttaatctgatgttatctagctatcttatatgttattttttttattgttatcatactaaattcccgcagcaatgcgcggggtttcacctagtataatatatagcgatgccaacaactttaattattgagacaatttcgttattgcctctattttaatataattttaccctcggttttttaggttttcgctttttatccctggttttttaaatagacaaagcgtctaccctgtttttcaccgaagttaatggtgccgaaattgttgctgtaaagaaatagaaaagaaaagaaataatgattttgcaaattattgaattacctttatacccctagctattttgcaaagtaaggaagccaaatcgctgcccaaaaccttatctccaatcctcaatcccccatccctggcggcggcgtcccggcttgcaggttgcagcaggcggcgacgggcaggaggctccggtggcgtttaggaaacccggcggcggcggctcggccgggagggcgacgggcaggaggccgcagaggcaggcaggaagttgcggcggcgggcgcacggtgaagaggggaggccggcggctacgcgcaggaggccacggcggcggtcggcaggggctacggtgcgcggggagtaggaggctacgggccagcgacggggagaggtaggaggctgtggggctgcagtgacggctgccggagtgatcggcgctggagtggctgagcgtgacgcggtgcacgctgtgtagcctccgcactacgacggccattgctcctgtcgaccacggtgagtgcgatacgtgaccctgtatctgatactcccgtattttaatatatgacgccgttgactttttaactaacgtttgaccattcgtcttatttaaattttttatgcaaatacaaaaatacttatgtcatacttaaagaacatttggtgataaatcaagtcacagtacaataaataata

SEQ ID NO: 63836 - DNA, 1761 bp, Oryza sativa
aaaaacgaaaacctaaaaaataagggtaaaatcaatattaaatattaaagtaggggcagaacaaaattgccccttaattattcagtcttcttccacggtttaagtatagattgacaaaaagaaaatttattatggaaatggattacatcttcgacttctgtcataagacacacaaccataagtttcttaaaaacattattaaataaatcaaaatgagaaacaaagtgatgggaaaaattctcaattctcctttattattagctagcgttaaaccacatagatttttagctagcaattctaatggactacgccacctagaatggaattagagacccttggctaccgattccaagagtgtagcaccattgtgcgcagtatcatgctcctcatgtggtagcatcgtagaaaaaaaaatgaagccaatagaaagacatgaagataacctgtatacagttagataattgtttagtattaaaaactttattattacaaaaacatcaaattgcctaacgtacagcactaactccaattagaataatttttttaatagacctaggtacccctctaagccaattaacaaaaatatttttcgcgttacggggtgaagggatattaaaagcaaaaaaaaccacacatctccaaataaactaagcaacatgacactcaaagaaaacatgttagattgtctcttacgcatagcagaaagaacagtgtttgccaccccccccccaaaaaaaattactatatagaacaggttgtctatattgatcatccacttccttggctttcccaaagcaaaatctcacttttatgaaagttaatttttagccctgagaattgttcgaacacacataggattaatgtatcatcgatatattgtaaaatggacaaaccatcctacactaaatgtggaatggctcctctaatttaaccatcgaatttagctcgctcaatgagaatcgctaacatatcaatcataatattgaaaagtatatgcgacatttgatctccttgttgtaagcctttgtgcgtttgaaaattattacccaagtcatcattgacttttatacggacacttccccctttaaccattttagaaatcagtgacaccacggctgagaaaaacccttcatgtataatgtttgtcggaggaattactatttaactttatcataagctttttcaaaattaattttaaaaataaccccatcatatgtttcttgtaaaactcatggtctcatgtatagtctcatgtaaaaccaccaccccttccattatatttcgacctggtaaaaaaattgtttgggttgggcgtacaggttcagaaatgaatcacaaaattcacaatctcgatgaagttaacagaaagccaacacttacctgaagtttgatttcttcggttcttcacacattgtcggcagcgggctcaggaataacctgaacctgacggtgtcgacaaaacagtgagttcatcaacctgcacacaatttcaggctcgctccaccaccagatacatcccagtataatgagcgtaatcaccataagaatcggcgcgaacacaagggcagataatcctgcagccatctgaatgaatgggatctctagcatcatgatagctagaataagggaaagtctcgctgcaactttcgccaggaaatgcagtttaggacggtctgacatggtggtggttgcaatcgagcctgctgctagaaggatcatcacgcagacagccaggggcggatccacaatgggggcggaggg

SEQ ID NO: 63837 - DNA, 1361 bp, Oryza sativa
agttacttctattgtatagctaagttacttctacaatttaataaattacttttaaattaataaaatgtttgaatatattcaacatggatcttgttttgtcacatattttatgtagagtataatggtacaaataaatcttgaaaataatatgtgatttaaaagatataagtcattaaaggggttaaaaaagacgtgtaccataggctaaaggcatttatatatgggatgaggtggtctccggttagggctaagcctaagggtgaaaacggagcggattcagacggatagtgatcataccatatcctaaatcatatttttttaagcgaactcggagcgggtgcggtccgtgtggatagtacacggatgtggatacggagcggattgtttcggatgtcggaaatagtgcggagtcggtgcggaatcagtttggaaacggattaaatttatcggatgttacgtgtgtatgcaatcaatacaatgtcaacttaacaatgtaagaaacaataatacaatagtcaatgaacgacccattgtaataattatgtgcttaagtgctaaacaacatgaatacgtgatgttcataatataaaaatacaactacgcaagtgtgacatgaggcggtgaaagcctcagactaaaaaatctaggttaattgatgaattaggccattagatggaccaacttatgttatatgcaatagatagagtgattacatgtgttgataattttgaattatccagcaaatggcatatcagataatccgataaaaatatcggataatccacatccgccagattttagagataccatatcctcatccgcatccacatccatatcagttggatttctgaaagcccttaccatagactcgtttcgaacggattcggaacagatcggataggatattatccgatccgttttcacccctaactaaaccactactactcacgtccactactaatgctattttggtgccgccgccatggagatgggaacgacagagatgagaggcaggggaaaatctaaccctagtgaccacggccaaatgggccgagatggcccaagggaattgctccgcgtcacgtgtggcattttctacgcacgacgccgaaccactcggtttgtcaaaaaccacccggttcattggttttcccaaaaactgttcggttccccttgtttttacaggtctgattgcatggatggtctttgaagtgacccaacccgtcaaggttcctagttatggttttttccggtttaaccggtccggtccgttttttgcactatgcgccaaagcgcgtactgggacaacgagcacggcaaagccggtgatggcttcgcatccctatgctaagatgataaga

SEQ ID NO: 63838 - DNA, 2006 bp, Oryza sativa
ccgtgtgaaagttgaaatagcacaatgtcaaccgtagcagcaatgaaatatgaaaacataacttccactagaaacacatccagtaaaaaattaggcttcagaatttgcggtaccaaacaaccaagtcaacaatatataaaaagtttgagaatcctgcaacgcacgatctatcttcttagacaaaagcatcatccaacaaaactgcctatcaagaccgacatcattgaaacgctcataagataagcaaaatgcatatttgctgtgctgatgtacatggaatttatctcttcttggagacaccgacagtctttcccctcctgccagtagtcttggtgtgctgaccacggacacggagaccccagtagtgacggagaccacggtggttcctgaattacaaaaggtagttcaaatgaaatcaaagagcaatttgttcaactctgagaatgcaattaattagcccaaagaagttagcagtccaaagcctcgacacaaaaaagaatatgatttaaactgagttcactccactagattcatcataatacaaatgaattatttaaactgtgtgaataaccgaaggcatgaacagttcatatttaggtagaaatttcatcagaacacaaattaaccaacaatgaattattcccaaattcccatgaccagttgttgatgccataaacatctcattgaaacagaacaaatttagctaaaatttctatcaatccaacaaaagcatgaaaggtatatgtacagcacctcacacatgcaagttacaaagctacaaaaatgtggtaagcgagcagaaccaaacctgatcttcttcagcctctcaaggtcatccctgagcttcatgtccagggcgttagaaacaacctgggagaacctcccatccttgtagtccttcttcctgttcagaaaccagtcagggaccttgaactggcgagggtttgccaccacagtcatgaggcgctcaagctcctcaggagtgagttcaccagccctacagagaaacataattgttagctttctcactagtaaaataaaagtcctttggttttgcacaaaatcatcaccatcttatgttttggttacaaagtcatctcggattaactaagcataagcaaagtacagtatggcgtatcagattagccaaactgcatgaaacaactaataccaaataaaatatagctgtgataattataacacatttttatctaattaagcccttcaggttccaaatgagcataaaaaatagactgatcatcttggtagcccaaaattaatgacgtcccagaaaagatcaactaatcatatagactgctaagtagtgacgggcaactccagggtcctggcctagtaagccaaatagaacataaattcaactgaactgaaactagttgcaacacactgacacctcgtgacattacggcagaaataaagacagtattaggcaattaactggagccaaaagatcagccctgccatcaacatcatcgccaattgataaacacatcaaaattagcaggcgttcgaatcccgagtcaagttggaaaaaaaaatacatccataacttacaattacaaaggtcatgctattaaataaattctaaaagctccaagcaatcttaactcagtttgcagacagtcaataatcagctttgcagcatagtaacgcgcagaaaatttctcatattatcacttaatccaccacaaagaaattaaggcaccagtcagtaaaccctactcgtcctaatcactaccaaacaaaataactcagtacaagatccatccacctaacatcacagtagaactaacgaaacaaccacacaactttggattcaacgtgtacaactacaaaccgaaagatgctcaaattatctagttttccctgattgtaagaaattagcccgataacaccaataaccattcgttatacctacacatcattccagaacatcaccaacagcacaaacgaacacccagatcagaggaggggttgggggggggggg

SEQ ID NO: 63839 - DNA, 2401 bp, Oryza sativa
cgttttctcatgggggcggcagtgtcacaccggtgggtgtcaccggatgatgtatatgtggcggcaccactggtgacagaggaagcagaggacctggatgactcagcgaaggcggggtgaacgaaggcgtcttcgttgggtggaaacgtatttatgtaatcatagtgcgtgtgtgtgttcagtgcctgtcatgtgggcctggatgagagggtttaaattatgaggagtcgagttgtaaactgtcgattatctaagaacaaaaacagaggagacaaagtgacaaactatccccaattctctctcgcgttcacaccatccggcggctcgcggcggccgaatcctcgacgccggcgagcggggtgttacatactccctcccactccaacgaccaacatcagcaagcagcagcagctcgatcgatcgaccgccatgagcgtggtgatcctggacctggacgagtcgacggtgcgcggcttcgtggcggacgacgacgccttcggccgcagcgtcgacgcgcgcttcgaggcgctggacgccaacggtgacggggtgttgtccctcgcgggagagggatgggacgacgcggtcgaaccgcagtcatcgtgcgccccctcttcctccttgcacggagtataatgcaccaatatggcgatgccaaccactttaattattcagtcttctgccatgattcaagaacagattcagaaatgaattcacaatctgaattttaattaattcaatcttctgcatggtccaagactccaattacagagactctcggaagtttttttttttaagactggtcaccgggggagcttccccacctgaattttcattaaaatattggaacagtacagcagcttaagttacattagagtgaggggaggatgataaaatgagtttccaagactctacaacagccctgtcagcgtggctcaatctttctgcccacagggctgcatcttctttacattttgcgataaggttatcaattgaaggtgatgcacccctagaaactacatcataccgatggttctagagtccccaaagacaaaggaagaagaaaactttgaagtgttttgcaggcagaagacctgttgggcgcagagactctcggaagtgaatcacaatctcgatgaagataaacaaaaacccaacacttttacacctctaattacattttgatagggaacgtactaacaaacctgaagtttgatttcttcagtacttcacacattgtcctcagcgggctcaggattaacctgaacctgaccgcggctacggcagatccggcaaaaacaggcgcacacgatgtcaggctcgctccaccaccatatataccccaatataatgagcgtagctatcatgagtattggcgcgaacacaagagctgacaatcccgtagccatctgaataaatgggatctctagtatcatgatagctataattagggaaactctcgctgcaactttcgccaggaaatgcagtttaggacggtctgacatggtagtggttgcaaccgaacctgctgctaggaaaatcaccacacacacggtgaaaagggcgaagagagtcctggcgaccggtggccagccgttggtgatgactttggtgagtgccgcaagcacgaagaagatgccgcctgaagtggtgaacagaaacacttcccggctaaaagatccctgaattgatcaattgacatttccaatttgattagtgacacagtagagatgaatcatacacgtgtatgatgctatgaaaaaaaatagtaagccattttttccccaaaatcgccagcacaatgagcgaatgactgaacagagtccctttttttttcccagaatgaatcattctgttcaaaaggataagaagctggcgaacctctgttggcggctgtgttgcagcggctggagcagattgtggaagggacgctgtagcagatgaagcagatgaggcaacttccccggagggacctccatggcccaggtcgcactggaggcgtgcgatgtgcggactgcggaggtgaggaggagagcaccggaagtccggaaccgtcgggggttaaggtgcggagaacgacggtcggctcgccgacggacggagcgagtatataggaaaatgaaataggatctgggaggaacatacgggagcacggcatactcatataggctctgcatccatccccgattcgaatccattcatatagaatgcttgtacgtaagagcaggttccagggtggaactgctgcacctactgagaatctgagggagaatatagattccatacaaatggtatacattatccaaactttgcttttctgtggccatttgaacaatcaccaactcagcatgcgtggaagaagtgctaccgcttatctcttttttttctctcctatataatg

SEQ ID NO: 63840 - DNA, 1953 bp, Oryza sativa
tttgttaatgctgcatatcgaaattgcattttgatattggttctttgacaactgtggagtagaatgtcaagacaagggcagctcatctgttgaagtatcctaatgcgaagatgctatggatcggtgaccctacatagctcagcactgcgacatggcagaggtacattaatataacaaacgccagttgtgtagcttcagatcagtatatcaagaacagagctaaatttctaattgagaaaagaaattctgcattgcatggcacacaactcttatggttcaatgtaaatgattcagtcaggctttgcatcttcctatagttcatttttttaaaaaaacaatgttctttgatgggtctatttgtaaatgcacagagcagatgcgctttgttcaaataaacaagatagattaggtcattcctaattaagaagttttttgctaaaattttttgagtttagtttaaaccagatggcagtggaccggaataaaccatgtgcaaattatacataatgtgtgtggtatccatgaatcttaggaggtagagtttctcactactgtcattgggagctgaataacttattcaaaagaggaagtgacctgatgaaataattcttagtagtagcacacatggatggtaggaaccattgattttttggtcatgtcagcattagttacatagcgtactgttttatgacgtttagtttgatttcaataagcccaaaaggaaattaacataaagactttacttttcagatgacataattattgtgagaaatcattttagcatgtaagaagaataccttttagaagtgtataaatagacgaaaataatgcaaatgttgttattctggcagctatgcactttttattatcggtgcgatgttggttagagatatgcaagtagctttatgatgagcagcttttaatccatttgtcatagatgggctagcaggtagccagtctgtgcatatccacaaagtgagaacattgagattcttagctcaaatgcaaaggatctgagattgtcctcttatccacatgataaaagctagagctcaagtgtaccaattcaagtcaaaggtcacattgactgtgaagtgaaataatattcatgtttgtaactgggaaaaatagtattgactagaccaagtatagacatgaaatatttccctctgtctggaacttgtcttgctttgatccatgctctatatactttatcctgacacaccaaatataaccacgatttgtcaccttccctcctgttctcttggtcttaaaaagagcgaaagattagctttacactgcactgcagccatgtatgcatgtatgttactttagttcacagatagagtgttaccacatcaaccgaaaaagatatatttctttaactaacaacctcttataaaagaaaacactctagtatcagcaaagaacatggatcatgtgatctgatcgtctgagtaactgatacaattatcctgatgtagtatttgtcaaaaaaaaaacattaggtatgcacaatcaaaaagcataggggttgtgcatcgtctgactgttgccctccttttttaatagatttgctctttcattgtgaacgcaatggtatatcaagtcctatccttttactctctttctctcattttgttttatctgtgaacataacaatatatcaagttataactgtttactcaatttattttctaggaaaactttgtttatttactatgagcatcaagacataaagattgtgcatctacatgacgagctgtatcaggggtgctgcaaggaaatattttgaggggaatgttactacgaacgtagcatgtacactaaagtccttatcaatgcatacaattgctatattgatatgatgtgcactctattaggagtggattcattttgatcccaaaatggccaaaatggacgctaagaatgctgagatgaatccgatgaatg

SEQ ID NO: 63841 - DNA, 3887 bp, Oryza sativa
tgcattcatttttctttccctaagacgtactctcaatattcatcacgcataaaccaaaatgaaaaggggaggtgactatcagaaatatagaaagggagcgtgcaccaacaccatctctgacctgatactcagagaaagtgtcggtgtagaactgtgcaattccctcctgttcatacttcctgtaatatacagtataactttgcacaaagatgcattcagagcgcgtgaactagctagactctgatgcttctcatctgatacatcattgagtaattacaaatattgctgaccaaatgccataatgacacatagatcatgacaccttactactaaagttgaaaagatggttggccttgctctagagttccttggcagattctgcacaacttgaagaactatccccaaaaaactatgtatttgcacagtaacagtgcattattctgagacgtgctgattctaccagggaactctggaccagatgcatgtactcacttgattagaaaggaggcttgttcttcttggagccatgtttggccttgaccatctggttcagggcctgcacgcaccggcggatcactcccatcgacttctttcccccatcaggtcgctttatcaccatagccaacgtcgcgctggaggcagccggaggtggagggagtttacgatcagcaatggctttcttgccgtttccgagcttgctggtggccttggcttctccgatgaggagctgcttctcttgtatcagatcctgaagggagaaccggggcacatcgttggcacaaggcggcgtgatcagcttcgtcttcgcagttttgcattgccccggggccttccgctccgtgtcttggcattggtgttgtgccttgagtgacttgtgctcttcatcttgatacttctctaatgcattctcttcttcttcttcttcttcttctttgcattgtttagctattttctgctcctcatcttggtattgccctggagtattctcctcatctttgcattgatttggcaccttcttgtcctcatattggcattgctgcactgtcttctgatcctcatcaagatattgctttggtgttttcctctctccgtcttgatcctggaatggtttcttctcctgctcttcatctagataatggtgaggtttctcctcctgctcatcatggtatcgattcggtgtctcctgttcatcaccttcgctttgcagctcctgatcttcatatggatatggtggctgaagctccataccttggcgctggaacaatgtcttcagcttgtcatcttgacgtagctgctgcaccagggacggcgcatgttgatcttgataacaaacgatgagacttgttgatcttcgtgttcgcctcgacatgccaggatcgaagcggcgggatttgttcacaccacactctgtggccattgtcagtggtttggggagaaagatcaccggaatgagcaacttgcttcttctcaggggtggagttgttataggttgcctgatgtgatcagtagatgcatagtacatactgggaataggtgatctggtaaaatgtccttttcagaggtaaagtctggtttggtcatttggaagatcagtgcctgtcctagtagcctttaatccctacaagaagtgaaattaaagttagtattagcaaacaagtgatcaatattctgccacaagcccacagacatctataatatttgttctgaaataataaggttctagtacatcaaaattgtattttgcaagatgacagtatatatgaatcacgcagcataaggaatgctaggaagaaggggaaaagttctgaaataaagaaaattgctgtgtatttgaagctattcccaactacctaagagcggaggaccagcaatatttggtttcaagcaaaagatttgactgagtactgacacatcttcacttgctttgactggagtcgttaacctaaattatttgtttgaacaaattacactgacacctcgcgataggaggtaatgcccagttccaataaatagcatttaagaaacttactcataaattggaagaattggttctgaagaaatactgagggcagctttcataagtacaataccatcataataattgtctaatatagaatgcacaggctacatattatgtcacagctcaacctaaaaaaagtattggtcctttcccaacattttacatctcagggcacgccaaagatattcatttacagagtcagtgatcttgcttagatgcagatagaactgcctatcttgcaaaccccatcgtccactccacggctattttatcgtgcttatttctatcagtcaactataaacgtccaatgcttggcacaagaggaagttttcaagttgaaatgaagcaacaattatgtgtatattacaactagcttgaacaggactacatgttaagtaataaaagatagttcagaaacataactatcctgataatatgctgaaacttggaacatacatggatccgggtttgcgatgattgctttagtggcaagtagcacctttgaaatagtaaaagcaggactccagccttcccttaaaatgcccatactcaagttaccagtggagtcaacattgcagtagtaaatccttgtcttgaaagttacctacagtagtgatagaacagttataatcacaggttgaggtcctctaatgctaaaatatcaaataaaattacagcagggggatctcaattgttccatgcttctattatatatactgtattgaaattccaactcccttcaatattgagaagttaatacgttcaactagaagagtaaagtattttaaatattttttttaattattgaaacgtcaaatatgaagccacaattatcagcttacagtgtttttcttattataattgtgctatcaactgtctacaaaacatgagaaaattcacttgctattgccaaattatttggagggttatagtactatcagcatcaatatgtttgccatgttgaaaaaaatcagatagtttgcccccgcgtcgccccccgcgtcgggcgactcgggcggcggaaccctagccgccgccgccgcccttccccaccccttcctctgccttgccgccgcctgagcgagcggccggcaaagccggcggctcgcgaggacggcggcggcggggctcgcggcggccatctcccgagctcctggcgcgggtggacgcaaaggcggtggccgaccggagcggcgccggcgtcaaggctcatggcggcggatccggcatcgccaccaccagatctggcgcgctcgcagctggatccggtcgcggaggcgtgggcacggcgtcggcgaggcgtgggcgctggcggccgcgacaggcggtggcaggcgcaacggcggcgtcaggcgcgacggtggagcaggcgcgggcggccgcggcaggctcggaggcgcggctgctgtggccggcggctcgatgcttggcggcgacggcagcggtgcccccagatccgcgcctctcggccggatctggaggatgggagcagtcggcgacggcggcggtggcagttggtgacggcggtctcggccggatctggacgccggcggcagttggcgacgacggcgacggtgtggtgacggcggtggcggcggcactgggccagcggcagttggcgacggcggtggcggctgtggtggctgccgtgtcatctggcaacggcggcggaagacatggcgtcgggctactagctgtacggtggtggagggcgacggcgcaacagcgatttgcagaggcggtggttggcgtcggtggcagcggcgacggcggctgtgattctggaggcggtggcgacgtcggcggcggggaaggagtcgggggcgaggtggctgggtgttcgggagccaaggctgtggtggtggtg

SEQ ID NO: 63842 - DNA, 2549 bp, Oryza sativa
gtggtggagcatcggtgcgccagccatgcctttgttggtctagtggcggtcggccacgcttagcggtagccgatccggtactagtcttctcctgggcgtgtgtgttggcgatgtcgtcgtgtgggtggtggtattttttttcttttcctggttacgactctccatggttgtaatcttgtacttttttcctgctctatcaatagaacttcgcaccgtctcgtgcgagtcgttcaaaaaaaaaaaatgtttgccatgttcgcctcgcctgcattggtgtttgtatggttccatgtcctggtcaaggtaaaaggtaggccactacagggttgtgtgttcagtcaaagaagtgctagaattgctccaggcttccaggtctgatatctagagaatggggggagaatttcagatgctccatgaaatactgaagagcggagattgaggttggctgtttggatccctcctgtcctacctaccatcaagtcattataagttgatgatggtaatagctggaaaagatagtagcagtcttagtaaccaccaaaacaagctgcaggtgctcacatagggcttgtaggctatggccagcaggtggatacttattagtcaatgacaccactaaatgtactgaaaaacagcatttagaaggctttttgttattcaccagactcccttatattctaagccaagatccacaaaacgaaaacaaatatgtcagcataggatgaatgcgatgcccaagcacatattagtaaggcttccaatggacaaaaccattctttgtaaaagaacacctttttcacatcagtatcaacaaaaaacagcaggcaactaggaaaacaacattttagcaactctgcgcaattaatttcttatttcttggacactaagcataaaacaatctcctgataagttttcttcataaataatcaagaccatattggaaagaggtaaaatggctcttaccttcaaatgaacgcaagccgcttcaaaagaagcaaacatagagttaattagcagtaaaataaattggctttaacataattcttttgcaatctaggtccttcaaaccatcacactatttgctgggcttgtccttgaacagtcatttaggcccggtttaaatgccgaaaattttcgggtctgaaaacttgagagacaactaggcgcattttctatttcctaaaaggtttagcaaattaaattataccattcttatggaataaattaaaataagtttggtgacattggacttttgaaacaaaatgacatatgcatttacatactaatgctcatcgcttttccaaaaggagctatacaaaaatactatcccaaccaattattcaccctatttgaattcctgttccagttcttcaagattttagccatgccggtgtctcttaaaagcatttctttcgatgcaagtctttactaccttacctttacgccgctaccgtgtggagaatccatagcaatatatcaataattactgtattggagtgtcacatcgttctagattttattttttcccaacaacagggatcatatgatcactcattggtcatactcatcatcactcatgaatcaaggcattaggtagaatgcatacatacaaggagagaaaatgtcaacattctacacaagcattagacgtagatgggctagaaaccccatagcacatttaagcaaacataagacaaaaaaataaaaataaagtgaaaattcttagtgttcttaccatgggatgtttaaacgaataatcaatcggaaatacaatatcaaggaagaatatccctcctccatacgtagaacctacaagacgagtactaccgcattagatcaacaaagtgaaggtgcatataagactcgtttactctagaaaaaaaattaacgcaatttatgaacaggtgaaattcgcacagtgcagtagtaatattcacacacgctaggtttaccggctgctgctagctggagccccaagggcgcacgccgctccatcccccgcaggatcttcctcctccgcctccgccgcccctggcgccgccgccggcggggaaaggggagcgaccgagcgagagttgggggaaggagtaggaggagggcatgtttgcgtgggccgtgggccgggctctttgtgttggtgaggctttaagcccaatttttttaccaggccccaatcttgtcagaaataatgggccaaagttaaactggcgatgtttcagtatagggaaaagtacaccgaaggtccctcaacttatcatcgagttacaaaatcgtctccaaaccgcaaaacgggtatatgacatccctcatcttacaaaaccgttcacttcaggtcattcggcggttttgatcccggttttgtctgacatggcggctgagtcagaggtgggacccacgtgggctccacatgtcaggctgccacgtcacacccccctctctctttcccctctcctctcccttcctcttcctcctctctctctcaattttctcctcaatggaaagccagccggcgggtgaggagagggtcgtcggggcaaggcgggatagga

SEQ ID NO: 63843 - DNA, 2671 bp, Oryza sativa
ccggtggccagcaggggagaagaacggcggcggtgctcggtgttgaagacgggctgaggtcggggagaccggaggccgccgcctccgccatgctccccctgtgctcccgccgccgccaccctccccttctcccgcgtcgccggctgccggacatcctctccagccatgccccggtgaccgtctccccacccgccggccggctgcccatggaggtgaaaagtgagagagaaagggggaagggagaggaggggaaagagagagagagaggggtgtgacgtggcagcctgacatgtggagcccacgtgggtcccacgctgactcagccgccacatcagacaaaatcgggatcaaaaccaccgaaggacctaaagtgaacggttttgtaagttgaaggatgtcaaatacccggttttgcggtttggagacgatttcgtaactcaatgacaagtcgagggaccttcggtgtacttttcccttcagagtatagtactcgacatactgcggacatctgctcctgcttccaatcgttcgctctatatgaaatcagtcgtagccaaaatttaattttaaagattttttattgaagtttatttttcagtattaactgttaaatcgctaagaacatgtatataaaagttttactcaaaaatattattttaaaatatgtcgtacagtttattatcagcatatcccaaccaacgggggccagcagggttgttgatggtgatagattgatttgttcttgtgagattgatcaaacggattccatcttatggatggagatgtttttgtgattgctcaccatattattttctctgaattgtaatgaggaaattaatggcattcatagaggactagctagtctgatttgagcatgcagtcaagagatagttggtgaccaaaccatctcaataaatctatatgtaattctaggttaagtgaactgtttatatttagttgagaggaggtacaagttcagttagcaagtgtgactaaaatatgacttttcatgtcccagaatcttagtgacgaaaggctctatactgacttgagttttttttagtcgaagcacaacagattatgccatttttttgtgcttatattctggttaattaggtaggtgagtagtatcttgcatatagttagattagtctggctggccaactccagccaaatgctacctgccaattcatagatttttaccagttggcttattaggttcatgcactatgttctatatatgcagcaggagaaaatgtaccagtgcaaggaaatagttttaattacttgcaagtgtttaattttatattcatacagacgtcatcagtgcaacggaattctaatagaaaaacagagtctctgttaataatgtgaaagtgagaaaaatttatggcctgactaattgtcgacagatttttttttttttacattttacaaggcaaaggaggtactgtttgtacataggtgtacccaacctttcacccccttcattttttacttaaaaaatgtaaattcataattaaaaaataatgggtgccaaaacactttgtagagtaaattatcaatgtatgtttcatgttcttattagaactatatgtttcatgttggtatgacacccaggatgaactgtgtgcattactgcacatagttaattagctatcactactatttgtgaatctagggaaacactcgaactgcttacgcgtatcagattatcaatcggattatccgtgctacgcttttaaaactactccctccgaggttaaaagatattttgattttgataatagtaatatttttaacccaatataaatttattataaaaatatatttaattattaatttattaaaactaatttggtaatataaatattgctatatttgtctataaatttagtcaaacttaactttgaccaaagtcaaaacatcttataacctgaaacggatggagtacaatttttatgaaaaaacattcattgtcagaaatgcatagacaacctttgtcaatcaatttctttcaactatttattttattatcccataaagcaatatatcatccatcaactattatccatttctttgtctaattcaaacgggccataggataagacacccataggtgaaacaaattgaactctcctcaatatgttctcataaataatatgacataatgaatacacaatcaagaccaattaagaaaaatacatcaagaaattcatggcacactcaacacacacacaatacaattaaaatagtgtaaaaaattcgcaacacaacaatgataaagccgattaaggacacgtggacacaaccaaatcgaacggcttaaattaacccatgcagaaattaatcaaacatggatcagtgcaaacgccactgaaacgacgacggtcgccatggacgccgccttgccgacgctcccgccggaagcactctgcccggtggtggtggtcgccgtcgtcggagtcgccttcgacccgccggttcccgccggagtctcgcttggcaccgccggtgccgccggtgtcgccggcgtcgccggagatggcatcgggacgccgacagctgcaagaacgacgacgacgtacggtcagtgatgatcacggctgcgattcgccggaagaatggaaggagatcgacttactgctgcactggctcgccgaaggggtct

SEQ ID NO: 63844 - DNA, 2760 bp, Oryza sativa
attcctgcaccccttatatagtgtggtgatggaatctagcttgtataagtctttgagagattggtgacctactctttcctactaacagctctgattagacatttattagactgatatttaactaactagctactaacttagtaatataatactgacattgcacaacttgatcagagcttgcatgaatatggtcaattaagatgtacacagatgatgatttttcctggtccagctgttcaattatgggaggattggtacttggtaggttagttgattgttttggcagataggcatgtacctgggatggcagataggcatcatatgtatgcttcccccttgtatatttctatatcaaatttgcatgtttcctctctgcaaataaaaaggggaactagtgatcggcctaaaagggaatatccttagaattcatagtttgaagataaaattttcggtatgaaagttgggagtattcatatggccaaatcaaagttcactgctattaggaagtgttgactagtccataatcgaagtttgaaattaatcagagctagagatcgttttcaggtgtaataatgtgtggattggtaggttttgttgattgttggcatccaccatgagatgtactaattttggctggccttctcccgtaagatgtactcttttttttctgaatagttgaatagttttatgataactactcgaggtacgaacaattatatataactattacaaagttaaaagaatatactccttccgtttcaaaatgtttgacaccgttgactttttagtacgtgtttgaccattcgtcttattcaaaatatttaagtaattatttattattttcatatcatttgattcattgttaaatatactatcacgtacacatatagctttacatatttcacaaattttttttaataagacgaacggtcaaacatgtgctaaaaagttaatggtgtcaaatattttgaaacggagggagtatttaacttggatggcaagatgtaatatatcaccttgccgccgtctacttgacggcatgatctatttctataaatattttcgctggtaatatatttctgtaaatattaaaaaattaaaagttaaaaatgaaaaaaaaaaagtcgacatcaagtatatgcggcaaccataaaacacggccaaaaaggagggatgcaaaatagacttataaaaaacacaatgggctgccacctttgggccagcccggcctgaccgttgagcgggccgtgttggcccgaccgatctcgggccatgccgggccgggcggcccatttagccatctataccctcacaccgctcggtcaacctacgggatcccccgcgctgccggtggtccctgcgcggctgcgccaccgagcggaccaagcttatgctctgcaaggtgatgccggagccaccggagatccgtgctaccaagggaggaggaagtcccatctccgcgccgccgcggcgacctccacacccgccgacctccgtgttgttgagcctgcgctgccgtcggagaaagggcgatatcgtgctgtgaactcacggcgccgtaggtggtaggaggtccgacgacgagcgatgttggagcagacccaatggccagccgtgttgtaagcttgaggattactagtgttttgtacaccaaagattttaattcaatgatgaatgatcgtgaaccaggactgcggaatgacggttccgtaaattgggagtttgtgttcactggttgttttgtaaatgcataatgaaatgcctgactgagtgtatgagtgatattgctgaatgttcagcattcagttcaatcatatgctgcgccggtcccttcttgcggctgctgcgccggctgccgcaatccgcgttgccggagccatcccaggctcccagccaatcggacactggagtcccaattgcctattggaggagtcttgtatcttggagatgactccttcggtatcactggcaggggaaacggcaagcacatcctcatctacgacgacgttggttaacacctcccaggcctcaccaaaggtattccgtattccccatcctggtggctcctcctccctcatccgttccacaatcgacaaggtcagatttggtgcctcagtagtggagagaagacaagggtgctggccttgatgatttgatctgaatttttcattgatttgtctagttttgcagttgctaggatgtaatgcagtgttcttgtctcaaatctcaacttttcatgcttcatgctggactgtcatgaaggcgcagaggttttcttttttactgatttggtctgaatttatcctgttttctagctccaatttgtgttttcatcagactattttgatcaatttgaaattttcggaccttgccaagcaggccctgatgattatttttgaaatataacaatttcgtgtatctcttggagaattataccgctaaagcgaaattccaacctgaattcccctgttccaaaatagtctgtcccaaaagagcatcactgaactgtaaagtacatcaatggcgatgctaacagctttactggtgattcagaaatgaattacaatctcattgaaatggaaataaataaagaaacacgaatattaggtaatgacgtaaaattaaataattagaaggggtgatgcgtcgaacccagatcgtctagcgcaccaccttgtgtagttaaccggaaaagtgggaataaatcaaaacacaagtttcacatatgtaatgtaacatcgtacacctgtagtttgaaat

SEQ ID NO: 63845 - DNA, 3075 bp, Oryza sativa
  unsure (1)..(3075): unsure at all n locations
accgacgacgttatcccggacttggccgatcgggagtcccttgacgccctctgaaaaaccccacgtcgctgacgctgccgatgtcgtcgtgccgaagtcgccatcgccatcgcgtcggaatccgccgccgtcgtcgtcgcttgagcagggcggagaggcggcgggatccgcacgaggaggagaggctaccggatccgtccctcccgtcatcgccgccgacggatccgcgcgcatcggtggcggagagacggcgggatctgcgcgggagggggaaaggccgccggatccgcgcgtatggtgggcagcctgcttggagatggcgacggccttatggcgcagaagcccgacgaggttgaggcagagcagcgtggtggaggacgggatgcgctgtggcgtcgcgccgtggttgcggtggtgcagcgtggaggacgggagcacgcggcgtgatacggaggctgcggctgtggcggcggggaggcgaggagcgctgtgcaatctggactgagattagggtttcttatgcgcatacaaaatgggccaccgttggtgtttagtttcttacatgggctttgaccatgttggaatgagtccattaaggtccctcaactatagccacagtttaactagcgtccttataaaatactccctccgttttttaatagatgacgccgttgatttttttttcacatgtttgaccattcgtcttatttaaaaaatttacataattataatttattttgttatgagttattttatcactcatagtactttaagtgtgatttgtaanttatacatttgtataaaatttttgaataagacgaatgatcaaacatgtgagaaaaagtcaacgacgtcatctattaaaaaacggagggagtatatacaatgcaactagtatagcagcaagcgcgctcaacacaaacttttaaaacaaatgttcatactaaagttatctataaattatataggcttgtatatacctcatttgttgttagacttgcccagttttatgaaaatttttgaatccgccactgcttggcattcagtccgagcgtgtaaggaacctcttgtttaagggtggtgacagtgtcatccttaacaaaacgagaggtgtagttattaggattttgctgagttctggtgaagccacgtcacccttttaactccagccgttcgatcagctgctacaaacggttagatgcgttcctcctccaagcgctgcctccctcctccaccgagcgccagattctccgccgctgccgccgggcgcgcgactcctcccttccccaccagtccgcgcgacgctctcgcttcctcccaggcgcgggcccgccgtcgaccgctctcgcttccttccccagtcacgcacgcgcgaggcgcgggcccgccaccggccactctcgcatccccgcgccgcttctcctccaaccccctccccccggcgcttctcctccccccggcacttcaaaaccgctgccaccgcaggcttcatggctgtcgagccccattcccttacttcaaatcgcttcccacggcttctccctcagcggaaatcatagttcgattggctttctcaacctctccctcctctgaaatagtatatcttatgctgctccttcaccttgaaaccgtatgggtgtatattcacctcccaaaggtattcttcttcctcttcttgaatcatatatatctcatccaaatatccaatctattggcttcttcttttagtcaagctagattgatatgtttctgttatctctcagattattgaagaattaattaaaaaaaaaacagagagaatggttttgttttggctcttctttaggtttttaccatcccgattgaaatttatttatagtatataaggagatcattcattttatgaggataactggtatgcataacaattttacattactgacgcgtgcttgcagttataatttgatatttttttttttctgaatttcggttgcagatcattgccactactagattgcttgctattgctgtagcagcagccagccagtgcaggtgctgtgatggcggtttcctaggtccggcgccgtcctctgaggtcaggattgtactgcttttctgaccttgcatgtgcctgtaactgcaagctcaatttcgtgtgtttcctctgaacgcgcgtggcgtgtttgtggaaatgcctctgtgggagtagcacgcagtacgcacacacgcacgcacatgtttgcccattttgctccatgcatatcattatgcctgcatgttgtgagttgtgctgctgactaaccactgcagaattattggtttatataagttagaaccatattttgatgtgttccagcctgctgtctgttgtttgctgaccattgcatttgctgctgacccaaacaagttttagggccaagaggttgattcagtgtggacttaattatggtactgaaagtaactgtacatagtagttgcaatgcagaccagctttgcactaatttcaggaagataagaaaaagagccaaacttagataggtttaataattactcaaactatttttcctccactggaaagataaggagatcattcattctatgaggataacgggtatgtataacaattttacattactgacgcgtgcttgcagctataatttgatttttttttctgaatttcggttgcagatcattgccagtactagattgcttgctattgctgtagcagcagctatgggctaccgctaagatcagcccccatgacattttccatccaaatcagccgctgaagcaatatattgggtaatcataattgcctcgcctcatgtttgtttatggtcatcacaaattttaggtacaagcagcgactttccatatattttattatatgcccatcctaagatatatacttgctttgcaaaggtcaaacagttccttctataactatactatcagattttagatacatattagaccctaatttttcaactgtccttactaatttttcattgctacatgatgatcgtatttgcattcatgtaactaaattcttcatatttctttctggctggagtataaagaatgttctttgtaata

SEQ ID NO: 63846 - DNA, 1740 bp, Oryza sativa
aattttagagctagagaagatctacaactctgtaattaacaaccttttcatttaagatcgtttagatgtccgaatatttgttacaaaatctaaaacttatttaaaaaatctcaaaccaacatttcaaacaatattggataaagataaactttatataaaagacgtagatctagatgagttctataactttgtagtttattacttttccatttaaaatcatttggagtcaggggcaaatccagcatgggtgtggggggactcgagccccctaccccgctggatcagccttgatagaaggagagataaaaggggaagaagagggaaaaaataaagagtatggggaccgaagaagaaggaaagagataagttcctccttcaatctggtcttggattcgctccggtttagagtgtcaaataagcattattagcttttaagcaattgaaacccgtgaaaagggttcgaatacaaataaaatttttgcatttaggtcccttaacacccttaatttttaaacgtctagatttgtaaattttcaaaacaaaaatacttttctaaaatttgtaataaaaaatttaaaaaatcttaacctattataaaaattgaatatgattccttaatcacacaccttttcttccgccgtaacatcagctgcccgatgtatactttctatatagttgatacccactaacaattattagaagctaaagcttaacatgcaagcatatcacatcatcacccattagcaattattattcaaacccatttaaaatcccatgtaagcatgccacattctcactcactagcacttactattctaacttattttaaatcccatgcaaatatgacacatattcactaactagcaattactatcccatgcaagcatgatacatcatctacaaatcatcttccttattattttattaacatttcaactttcatcgtttcaacaatatttaagatatactcatccatgaaccccagcgaagcgcggggtatcactttaccgaagagttagcacgttatctgcgtgcatctggttgctgcgtcggctcgattctgatttcgtccgtagtcctgcttgcgcgcccgcccgtccgtagtccgcccaattcagggtgcttcgagcggatgacctcgagtagtagacatggttggagaaatgggggggaataattaattatttgccactcttacggatggtgataaatgatttgccgatccacatgtcatagacacataagagctcacatgttattttgagggttttcattgaagtttatttttcaacatttacttttagatagctaaaaacacgtatataaaagttttattcacaaattatttttcggttgtaaatataccatttggcttattccccaaataagagaaacaatggggtcaaatgtttcttggcttatcatctaatgtttattgtaattttattttttttttccgttgcaacacacgggtcgactggtcggcttgtgaggctttttttttctaaagaaaaatagaaaagatcgactggtcggcttgtgaggccgtgacgttacaagggttagtggcaatgccgcagtggggctctgttgatgttcgtccgtcttggttcgttcatcgtcgcgaatcccaatacccacaagccgcttatcgaaccgatactgtttctgccacaaccagtccgcaaaaagccaaaaactacgatctgcccgttttgttactgcctgtctccctccgta

SEQ ID NO: 63847 - DNA, 1468 bp, Oryza sativa
  unsure (1)..(1468): unsure at all n locations
tttttttttataatatatataaaaaataaatgcatgtntacttttattatagttctttaaaanacatatatatatatatatatatatatatatatatatatatatatatatatatatatatatatatatatatatatatatatatatatatatataatgttctatttcttttaaactaaatatttttaaagttattgatggtcaaagttataaaagtttgaccttaatcttgtctaaaacgtcaattaatatagaatcggagggagtacatctttgaagtttggagtattcagattaggtagccagttcttttttttgacgcaaaggtagccaattctggatttctggtctgtgccgtgttggaagagattagcaacggtatgcgtgtcataacatgatttcttgtccttttaatttggatggtttttacggatcagtagcagtaattactggcctggaaaaatcgtatacttttctgcctgaaaccacaaggtcaaagtttggaattactgtttcttctagacgcacttccgtgaagaaacaagagcaagtgatttgaatattattaatatacaggatttttcaggcattcaggaaaactgaaacccttcattaatttccttttctaaaaagaaacaacagctagcatacaaaataaagctcccaaatttgctagtagtacttttagttagggaggctggtcgtaaagcagacaataatttttacacaaactagaagccaatcatctttacagaaagcaggcttatcaacttatggctagtgtaatttgtcttggtttagtcataaagcaccggccattctggaagttgcacacaaaaacatatgaaatgtgcaaagtcactatataattcattcttttgttgcagtggcatcacatctcccatgttttcagttggtcggataaatcattcatgtgtgttcccttttttcttcttcttcttcatgatactacatccataagcagtagcagtagttgcaacgtggtttgcttttagagcagtagcattctcatattcttgttctttctgtaatttgttcataaggttaccattcacaacggacgcatcggatgatctctgataattcttggtgtgaaataggagtatgaaccatgttgacatcatctttttttctgtacataaaaatgcagtttatatttattagaaaatgttcaggtttctactgggtattcattcttctgcgtgtaaatttcagggtagcagatgagccgtgtgcagtcactccagtggattgttcttgctatgctgaaaagcagcatgggaatctcactgttcttttgctgttatgtttgttgcaaccactaatttgactcgaccggatggatgttgggggttgtttgtttggttccaaatctaatcttacaactcaaagctttaggcagcatcccattttcttaagcaagtactcactccgtattttaatatat

SEQ ID NO: 63848 - DNA, 733 bp, Oryza sativa
gatcgagcagcaggtcgcttcgacaactcctcgatgcggcggcggcggcggttcctcggcgcggcgaccactccggcggcggcggaagcctctcgacgcgagcagcaggcggggcggggtggctcctcgatagggcacaacagaaggtttgccaaggtggattcctccttcgcttgccctgttgactagtgcggaccagcacggcgtgagaggaagattagtgttgattgtctcttcattgctgtcatgtaatttgcattcataactgctgatcgaggcgattagagaaaaagattaatctttgactaaccaccaagtgagtgctagtgctagttgtgtcaaattctgccaaaactatattcaaattataccaaaactatcatatttgtcaaagtttgtcaaaaatatgataagatttaaattatttcaaaaaatttaagctcaaaacagtttgcagctttatgtgcaaaatatgggtgaaaacaccagtgatatctacaggtaggggtaaatatgcaataagtaaaggcatatatgtattttcgtgctcgacttaacaccatcatccatccaaaacaaagggcaaatctctgctccgtttcagaaaagcagaggccaaaatgcaaatcgaaatgctaacccctaaaagataagagcaaaattataattgaactttaaaataggagtaaaagtataatagccccgaaggagaaaggtttttttttctttccag

SEQ ID NO: 63849 - DNA, 1439 bp, Oryza sativa
  unsure (1)..(1439): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcataggatatattcccttatcccccttataatagttccaaatccccagtttaactgtatgattgttgctgggaactggcgatcctgctgtcactgggaaatgcttttttcttagagacctcccattttagatgttttcaattttttactctatttgctttgtatgtcgaaatctgttgaaattgtaactaaaaacgagaaaataaaatgaaatgtgacaaggactgagcttggtaactgcctcctaccaggccctgtcccaagaaacttgtcctgaaggggccttgctgtcttgaaaacttgttctaggtgaacatcattatatttgttgtaactgttatgtacgtgcaaaactatatatgtattctcttatgtcttttaaggtaaatgaggtgttgtagaaaggtatgaagtattacttcagttttagctgatgatgataaagtgatacttcgcacttagttgttcgctttcacttgaagctttagcttcatgtttgagttgtacaaactagattttgatattgttgagcaatatttttccttgtttgttttgatgtaccagtgttttctttgtttcattttcggacgagtttctaatattttcatgggtaatttattgttttgtaggccctttcctccctgaatgttcgaagactagaatacctgccatacctgaattgcaaaatacctggactactgtttttggttttaaacctgttgaaccttccaagagacaaaaaatcaagtctctgaatatcttgattatccatggcactggtcttctagagaagcggttgcttgcaacaggcactattaaccaagagaacactactggtacaggctaccataccaaattatcatgagaatattccttgaattctcttgttaagattattgtaacaattcaattttatatctcaaacactctttgtgtttatgcagttaatgatatgatggatgctcaaacacatgttgaagcaaccggatcccggacacctgttcatttttcctgtgaattaccagtgggtggtgatcctgatattaagcatcatgatgactctcatcctttagttgggaactccaaaggcttgacacttaatctgccttgtgttcctgaagaaaaaactgcagaattgacatctccagtattagatgttg

SEQ ID NO: 63850 - DNA, 8688 bp, Oryza sativa
atctccatcacctctgggctaaccggtaagaagacaaacaccaacaacccgacagcaaccatgattaagctggggatggcaaatgaccagccccacccaaacttcagcagaaatgcagccagcagtgaaccagatatgttgccgacagaagtgtgtgcattccaaatgcccataatcaatcccctcttgctttttccaaaccagtttccaacaatcgcgacaactgaaggccatccaattgcttggaataaaccggcaatcatctgaatgaccaggaaatagtagaaattgtggatatttagccaatatccagcaccaaaaagggcagtgaacacagcagttccaaacatgccaattgtcaggaagatccttaaatccatgcggtcaccaagatgtccagcaaagaacatcccaacagaataaaccgcaagaaacgccacatctatctcaccaagcaatgctgagccatcaatggtgttaaacggcaaccaaccgatgttaagagtgttttttgtgtgcagtcgtccccatggagaggaccccaactttgtctgtggatcaagcacgctcttaacaatactcggtatcttcctagtcatatgaaagcaagtatacgcgacaaatgtaagcaccaaaacaagtgtctggtacgtccgtagcaccgtaatgcctccgaataatcgaataccaggaggtttcctactcgtcatttcatgagaatgagccatgagaacaccaaggttgctagttactgacaaagcagagacagacttcttggtccaagaatgattaacacctgaaaccatcagaggaggatgtaagtaagacaatggactaattgagacattgagtgcattaatttgtgtttagatagacgatcttagctacacatttatgaaccactactgcatcaagaaagcgatcatgctgttcaaaagacaagaagctactaatccaaaattcagccttacacagtaccaccaatcaagttatccatcattataaatcactgtctaaaaagttatcatgtaaacatgggcaaatttgatgatctaagaacatctcaaatttagtatttcaggaaacaaccaaattggcccatctatttacttggcaatacaaccagtgggccagagtgggaaaaaaaaaggaaatattctgtactcttacttctctagagcaaaccaagatcatgcgtgctacctgagaccttgctgatgcacaaaccactacaagattgtcctcttttttttttctcaaaaagtaggtaaaagctgcctttccagcttccatcttggtgcaaatgcgtcacttagcaggcaaccgacttttccttgactctaacaccatctttttaactattaaccaggacaagtaaaaaggcgaattgacctcaatctcatgaccaattaattatttttttcacaagctccacaaacgcaaacctttaactcccaaacaattccagtttcaacccaatataatcgttactactgaatattgtcgttgaatccacctaataaacttcccaaatcaacgaacaaaacgcataataagaacatctcgtctctgaactctgaactctggactctcctgtctcaaaacattgaccaaatccataaactccccctaaagctaaacccatttagcacgacatacaaaaatccacccaaaaataaccaaactttccctaacaacgaacaccacaaagcaccagattacccccaaaatccgctccacacagtacaaagaacaattttcctttttttaaaaaaaaaatcaagaacagggattggcacctcctccgcgaaggggacgacgatccgcgccgggcgggagagggatcggcgaggcgactagccggaatgcgcaatgggaaggaggaggatgcgtgggttttcaatcaaggagtaggggagaagagaagagaggagaggagttcttgtgctgctcgtggtgagattttttctttttttgccttcttttttttgggtgtttgggtggttcgaaggcttcgagaggggggaaggagggcaatttatttagacgccatgttggcctttttcgtaggtatttacgaccctgcccttggaccatattgccccttctttgcttctctctctttgcaaaggtaaactacgaaattgaccttgacatcaacaaaggctttggatttttgtttactttggagtattcaggtatctgacaccacaaattagcatgtggataatggtatatttgtccctttgtaaaaaaaatgagaaatatattttttggtgaaataagtgggaaattgttttgaaaccaaagtttaacaaggattaacttatcatatatggtattattttctgatggaaaagtttgctttgtcgcatttttttttagaaaaatgccgccataattttttataaagtgatagtttttataagatagtagtataatattttttccgtcccataatataagaaatttcaggtggatgtgacacattctagaaaagtaaatctggacaatggtatatcaccataattactacacatgctttacattaattagttaaactaagacatagagacgctgagagataaatagggagagaacaacatgcattggcatattattgcataagttggtatttcaatttttcatgcgtcttttatttgcttccatggtatctttgaccttaaataaagtactactagtccatatacatagtacttatatttacattaaaaatgaattgactagtattaaagatacggaccatgtgatgcacacgctgaaaattacactgccaacttgtgtagcaggtgcaccgttggccgttgctttctagttgtactagagtttgttccctttcataccaaaattagcccacccaaattttagcaacaataaaatttagcaaagttcaataatgccaaaacttttttttaagaaacatgttagagacacagatgcgctgcactcgcctaagcacattcgaattgaaacattgatccggtatattttgagattgacgaagtcaccgtacgagcgtctcgctatcgatggttatatcatctatcactgagaaaataattagtcataaatgcaagcacccatttttaagtctacaacttgaatctggataggatggttccaaagaaaaaaaatctaaccaattaaactacattcacctagtagtgtagaagtaaatgggtgctgtttgttttgctaccatgccaaatattcttgtatagtgttgtgtagcaaattgttactcccttcataaaaaagcaacctaggttactttttggataaccctatgtccagaaaagagatcacatccccttgtagattattattattttttttttgagcgagggagtaagtcttaaggtatactgggtggagacagacaagtggcagggccgtaaatacgccagtcaagtcaggggcagaatcgggaagcgagagagtagcgtcctgtttgcggccaaaaatcaaatgaaaaccagtcggccaagaaggaaggaggagggtatcccaaggaatattcggttcccgccatgggaattatacctcgcgtgccgtgtgcacgttccttccttccttccttcccgccgcgtcacacgtgtccggctcccagtgggcccccggccccggccacaggagtggccacacggatatggatgcgctatctttaaaacgacgaggtggaatgacttggactttcctcttgatctgatttggatggaatggttttatctgtttatctgttttaaaatgttgctaggaagaatgggatttagattcattgttctaaaataaaaaaaaaatatttatattctagatagcaatattttgcgcataatgaataagattgtcatgcacatgacagagagagaaaaaatggttttgggattgttccgtctgttttcgtgtacaaggaaatttcttgaatataaagagaacaggcagtggtcttttaggattggttgagaactcctccctcctcacgtaaaacggagcaacagattaacatatggtaaattaagtattcactccgtcctaaaataagcgtaaccataagtttccacgtacaacgttgatcgtccgtcttatttaaatttttttatgattatgcgtgacttatgttttttatttttttttaaaaaaaaagttaaataagacggataattaaagttggacacggaaactcatgactacgcttattttgggacggagggagtattaagtttaaatcttgaaaaatagattgatatgattttttacaacaacttttccatagatttttttttctaaaatacaccgtttattagtttgggaaacgtgcgcatggtaaataagtgagtgaggttgggaatctaaagtaaggtcggataaaatacaatgttttaaactgtttgaaaaacatgctaatggaaatagaggaaaaatctttataaagtaagaatggccatagtatttcagaccaaacaacaattcaacccaacccaatttagcacaatcaaacccatgctgaagttaccgggtcgcaggagggaagaaaagcggttgtgaagacacggaagctagccattgtttacaaatgtcacgtctccggtttccttctggacttgtgtatggacacatatgcagcagccacatagtggagtatgtcggaaattgttgaacatgagcgatccaaccaaatactagtattatactatactctctccatattttaatgtgtgacactgttaatttttgaacaatatttgactattcgttatattcaattcattttacaaatataaaaatttatgtcatgcttagaaaatatttgatgataaatcaaatcaaaataaaataaataataattatataattctttttaataagataaatgatgaagcattgataaaaagtcaacgacctcgtacgttacaataagtagattgttcagctagtattttgttgcgtcaagacgtgtgtttcgttctcttggagtcaaattttctggtacgtcctgacatcctgtaaatctcgatcaagactttctttgttcagattgatacgatacattcggatttatttatttattttgttcttctagagctcacatgaagcccactatggttggccacagcgttcacaatctcaataccagatcaaattccgcttaccagtagtaccgaaacccaataaaaccctgttaattatttttttgtcgaaagtttaaaaagttttagtttcattttatttgacataagaaaagcgagtgacttgtgttttcgacttggctgtcgacgtcgttaacaaacgtcatcgacatgacatgatatgtcatggcatggaatccgtttttctattctactaactccgtttctaaataagtgcagttttacactgtttatgtccagcgtttgatcgctcgtcttatttgaattttttctatgattaatatttttgttgttagtagatgataaaatataaatagtattttatgtgtgactaacttttttaaatattttcataaaattttcaaataagtcggatggtcaaaccttcgacacggattctcacagctgcacttattttataagggagatagtattaaaaaaagaaaaaaattggaagcagcgaagaaagcagaagtgggcggcggcggcggcgaggatcagcggcgcgccgctctacggcccgcgttatctggtggggcccacttccagctccacggcggatattctgggaatcatcccctcggaagatgctgatgctcccgtctctccgacgtggacagtaatcacgaaaacaaatgtaccagttttcctccgtctttatttttcatctcctcctatctatttcaaaataaatttactttttttcaaataaacattgcattgaagttacttatttcgtcccaaaatataagtacatactccctccttaaaaaaaaatcaagctaggtggacatgaacttcgttgtcctctgtgtttatcgtcctacgtagtctcatcctcacttacattttctttactagtgaatctaggctatcataataatctaaatacttatattttaggactgatgagtagtaaatagatgattttcttttaataatcactacatgcattggagtttatcctaattaaccgttgcttagtttcccggtctacgtagtagaaattataaggcacaggtcgctcgacttattatcactcttcaggctttaagaattgatttattgaatttttcatcatgcatgtatgccttggatttgactagcaatggatatgtcttaccttaaaagtattgttattgcatcagtcatatatgcttcaacatataaatactctctctaccccaaagtatcatgaactccgtcataaaggccctgtttagttcacacgtaaaattttttcaccctatcacatcgaatgtttaacacatgtatagagtattaaatatagataaaaaaactaattacacaaattacgtgtaaattgcgagacgaatcttttaagcctaattgctacatgatttgataatgtggtgctgcagtaaaaatttactaatgatggattaattaggcttaataaattcgttttgcagtttataggagaaatctgtaatttgttttgttaatagtctacgtttaatacttcaaatgtgtatctgatgtgacacgccaaaaaatttcacccctggatctaaacacagccaaaatctttagccaatactgtgaataactataatgtcatcatcataaagcactttcaaatcgaaaataatctaataatatcatacatatgataattaaactttcatattattagtttattagtaaaagtttataaaaaagtattttaaaattaaaaatatattatattttaggatagatgggtacttttcaagccagcgctattgctagagataacactttgttgtcattgtgttgacagcagctgatgaatattaacatggcgtgtgtagtacgggtgctacaaaagaatcgatcaatcggtcgagtgaattctctggatggatggatacaacacattgcatgcatggtagttgcttcaaagaaatggactcgtcacattcgtcagatagctgccagtgtacagtgtgcatgaaggagatgtgaagatcgatggtggagtgcaagagtgtacactactgtatttttcagaagaacataaaataaagagtgcactccactggaatcgcgagcctgcaatgtagagtatgcgtgttacacattagagatgcttttccttgatggtctccgttttgtacattattagtctttttaatttttaaaagtcaaatttatgtaagtacatgtaatcgagtttatagaaaaacaaagtgccaatatttttaacacccttttaatctaattaaactcagacactcgcatctggctatcagtttaaacttaatctaaagtaaagcaaagcgagagagcagcatttttctccatttaatttagttctagctccatccagggtttaccttatcgtttgggtcggggttatcgccaccccgcggtagcgcgataaccgcgataatcgcacgataattgtctaaaatcgcacaaaaatcacacccaaaaatttgaattcaaaactcgacggtttcgcggtttcaccgcgataatcgcacggtttaccgtgataaccgcgatattcgcacggttatcgcgggctgtgtagctgaaataatgtaaatgtaaaataaatagggtaaaaaaatcaaaaatacggttgaatatgtgtagaaaactataaactgagaataattggaagaatatgcaggatacttaaggcccaatatcctcttcctttttcaatttgtaaactatttttggttttgccctcaaatttgaatttagcttactctatttaaaaaaattcttcaccattagcaattacaaatcaagaactacatccatgaattttttcagtttttttcgatttttttctggaattttgaatttggtcaaaattcatccaaatcatatcgccggtttccctaccgtatccccgtgataatcgcgcgattatcgtgcgataagtaaaaccctggctccatcctgatcatgatagtacaccacttgagtgttaccactagatcgctccttggaagctgaaaccaggatggttggaccacaagctagttgagttggatgaagaaaacagaggccgcatcctgaactcgccctgatctgctctgcttttgttactggattattgtcgcggccatcatatatagcacttggcaattagcaaagcggacacaaaagacaagctcacaacgtgaggccaccacccaaaaccgggggcacgcgagtaccattaagtagttgattagtaaatttcataaaaccacacttattatatggtctaagttacacagaaaaaaaacttatatagatgtaaagtatcatggttttaaagttttgtaaaatcacaccattaactattcggatatatacatatattgagattcaaaatagttgtgctttcatagatgtaacatttatatgattgataaaaacctataaattgaaactgtgatgatagaagttaaaaatacaatagatcaaagtcaaaatgataaataatattatggttacgagtcacgtgtcaaaacccgagtgattttgtgcaacttaggccccgtttggcacagct

SEQ ID NO: 63851 - DNA, 3296 bp, Oryza sativa
aacctcctcctcccgttctctctccttctccgtcttcctcccgagccctaacaaatgcaggcgggggcattggcatcggcgtcgggcagcggcgggcggcggcgacggcaggcgccacggcggcggtgcgcggcaagcacgcgggaggaagatgggcggcgcgcggcgacgacgcgcaaccgatgggggacggcgcgtgcggccgccgggaggtgcactaccgaggcgacgaagctcggcgggcggagggcggcgtgcggccggcggacggctggcggagggcggcgcgcggccggcggagggcagggggtggcgggcggccggcgaagagcggtgggaggtgggcggcgcgcggccggtggagggcagcgcgcgcaggggatgggggtggccggcggagagcggtgggaggtgggcggcgcgcgcaggggatgggggcggccggctgctgggatttttgtttttattttattttcttttttttttgcagatctagagctgaaatgtagccaaacacttttgatgagtgtccaactctaactggagctagctcccactagagtaggagtttggagttaggagttggagtttggagccctaccaaacgagaccttacataataagcttgcataactctttaccctaaactaaaaaacgagctattaaatatacactccgttatagggaacatgtttgacggaattactagaaagtatacaacactctatcctcaaaatttttgaatttgtcacttaaaaatttatgtaaagcataaaactaaaaatacgtttaatttgtgacccacgatgtgttgagatatcaactcctaatgataaccttctgaccaagcaaatgttttccaaaaaaaatacaaatagttactgtcgacgtttgatgtcgtgattccggtatttgcatggtatggggatcgttggtactagggtatacgcgagactgaggtaaaagaaatggagacagggatttttttatgcatgttcgggcccctgaattgtcaggtaataaccctacatcctgttggccgaagccggtattgctcttattcaccataatcacaccagtacaatatttgggatagcctatctaactgttgtcgacatggtggtctgaaggtctgactcgtagttgacaacagggtagtcttcctcctcgaatccgtgcccggcgagatcagagatagcgcaatgtctctcttgtcaatatccggagataccgtaggggactagccgtgcctatctctgaagtcaatatccggcgtcttgtcttggcgtatgttggcttgtgtgttgatcttgtgtgttgatctatggtgggtgtgtggattgtctgttgattgtcccccctctcctcctagggggtcttgtatttatacccataggtgtccccttgtcgaagtagaactagggaaaccaatatggatacaatccgagtagtccttgtcgtttccatatagaactctggttgtctttccttatccggaactcttcctatatccgcaggttgtttccgtataggacatggtatgtggtgggtcctgccgagatttagtcaactactattaggtatgtggtatccataaccctgacagtagcccccgacttcgatgcaaatgaatgaattcgtattctcaaccacgcgcagatcttggagtaactgttatcgagctcatgtgaccgttctcggtgagttcagagataacgttagacttcctttatcagcctcgtgcgggcacctaaagggtttgtctgagtcaatctccgacgtcaaccaagaaagttcagagcatacgactaagtctcccgtcttgctgtaatcgagaatttggattgaagtcaagaaattttatctcgccaggtacaccatctcttcattccgtattccttgacgatatccaccaactgttctcgagtaatcgagaaggcgcagagtctgcgacggagccttgtcaacatttgtcgcactcgccttagtcgatcttggtgtagaaccatagagacatggagtcttcgataatgtcgaatagaattttcctgaaatcaatactcagaaaagaatattagatagaaatagcccccgagtgaacgctcaaagggtgacatgttataatatgtatggaaaattgaaaatcaaatttacagaccaatgttttatatatgagcgtatactcttttaccgacttcgatcagtcagtttgttgagttatacactctccctagcccccagccttgtcgtcggagaatcgttctaggaggataaggctcttggacctttgacctgcctcggttgaacaagcactgatcctagcccccagccgtgaagttggaaaacccaatttccgattacacggcttggttaatacgcacggcaagaactcttacacgaccagatattacatggtcttttgtctctacaggatccgacaaggtcttatccgctctggacgtccccagccgaagttcccttaggttcctcagaggtcttgtcaagacggcataaaaggacattaggataggtttcaacgctaggtgtcttttgtggtaagggatctctgggtaaaacacttggcgatattgtgcacctgatatcacctttgttgaagtagaggtaatgggagaatcgctacacctctggtcaagaaccaggtagtagtcataactcaaccactagaagtaaatgtataagaaatcgctacaatttactggttgaggaccagtgagtaggtgtctctcgatcatttgaagtcgtggtgcgaggactgctgcgttattgctgtagtcgtacctcgaccaatggaagttgcagtgcgggagattgctacgtactggttcgagaaccagcgagcgagtagaatcatctctcgaacaccaatggaagttgcggtgcgggagattgctacgtactggttcgagaaccagcgagcgagtagaatcatctctcgaacaccaatggaagttgcggtgcgggagattgctacgcactggttcgaggaccagcgggcgtgtagaattatctctcggacaccaatggaggttgcggtgggagagattgctacacactggttcgaggaccagcgaacgtgtagaattatctctcggacaccaatggaggttgcggtgcgagagattgctacacactggttcaaggaccagcgaacgtgtagaattatctcccgaacaccaatggaggtgctagagttggtttatatgtgcgtctcatgtggccagcatgactcacacacccaacttgtagcatatccggatgtccattcgcgatcatgt

SEQ ID NO: 63852 - DNA, 1592 bp, Oryza sativa
cacattatctacgaaaaagaagtctagaacaacaagaaagttgcgactagtttaggacttcgttagacaaattgtgatagttgacatattggtggtaaagctaggagagttctatagacgcatgtataggtaatgaaccatgtcgaatccatattgtatatctgatcgaacctatatcatttttttaataatagaaaataacttttgacctccgcaatggttatatttcaagtaaatcatattattctcaatgaaccataattaccacatatatgtagtacgagaaaacaagtttcatgagaaagtgttgttctgctcttggttataatcagcacacctaagggctaaggcctttggagatggatgtgtaaaccaatataaatttgttaaagtgaacccactagaatatggcataaatactcccacaaaaatatagtactcctacatagtattagagatgattgacatgagtgaacattttcatttgcaaaatgagtcttttcagattgtggtttgttcccttgaagagcaagttctgtggcagagagaaatgtagcccccaaatcaacaaccaatcaggagtgagcatcaaggccgacatatcacagcagaggcaaggccatggagcatcaatccatgcatgctacaccaactaattataaactcccaagatcccagacaaaatgaggattgatccactaaaccctcatgacaaagataatgattaatcccctctttccttctctctctccctcttttgagtggacattagcacctgaacctgcaactaaacaccatttgtcgtgtgctgatgtgtcaatgtggcactggcttgttgcacttcatgtccgacgtgtcatgccacgtttgcagagggtggcacacggtccagtaggctacgcctagagaatgataggatcaaactctattatcagaaaaaaggtgtacagtaagaaaaaggatcgaactccattattgaaaaaaaaaaggcatagagccgtagaaaaccaaaaggcagttggaaaatttttaaggtaggaatgagctgcagctaactgcttatctgtggggtgactatttttttttgaaagagcacttagggcatagagtcccccctattccgctggattactattgatagaaggggagatgaaaggggaagaatagagagaaaacgaagagtaggggggactgaagaaggaagaaggaaatgagtccccccttaaatcttattctggatctgcccatgtgtacaaccgtgtgtaatagtggtctctctttgttgccatgtaagtaaatttgatgatgtggaagaaagaggagaggaaagataaagcatggttgctatgtatgacaacagctcagagtcgactcttaacatttattaaaggaaattttgttgcatgagggtggagaaaaggaaagaacagtagtaaaaaaaatattttggtgcattaataattaagagttcttgttgtctcaactattgtagcagtatagtctctaaataatatgtactaactaagagaccatatcggaccctacctttgtacatgcccttatacacgtactaaaattttcttacaaaactc

SEQ ID NO: 63853 - DNA, 3615 bp, Oryza sativa
cattggtacatatatttctctccatacacttgggaatgtctcttgggtgatatgtgggcctcactctcatcttggttcatgtagtagggctccttcactttgcaattactttcctgtataattattggtgtaatcagtgtttgactttttgtgagaaaggcaactaaggaagaaggtcaaaacaatgggcttagtggtaaaaataatgcaggtgggggcccagcacacgttgcacgggcacttgcaatgtggggccgggcttgggccggcagttgatgacggcaggtgctcaagtgtatgggctgggactctttcggttggcaattgccaaaatgaaattttcagcatatgcatggacaataacaatccagggcctaccaacttagtagtatataggagtacttactagccatgggatgcaccaaccatcaaccacggtggtatatgaaaaaaagaaagaagaagaaaagaaagaaagaaaggaggaggttgatgaagttggatcatactacgtgcattatattagaaatatgcccttttcgttttttaaagatgacgccgttaactttttgacacacttttgaccattcatcttattaaaaaaaattatgcaaatgtgtaacatattaaatcatgcttaaaatatttttagtgataaaacaactcacaataaaataaattataattatataatttttttaaataaaatgaatggccaaacatgtgttcataagttaagtcttctattaaaaacgaagatagtacgatagtttggaaggtatcgatatactccgtacacccaagattttatttttatttgagagataatctattctatgctcataagtttactcttgctcaacgatttgacaccaaatttatttctttttataatgtctttcaagtctttcaaaaacaatatctaaaatacacttcaaagcgtaccaggattgcaaacaataaaaatatagagcctaccaacacagtattaatagtactagctatgtggtgacatatgacacaactagtagaatatagtatcatcaaccagggtgtagtgtaacggtatctggaaagaaaggggggaaaaaatagaaaaaggttgatggcgttggatcatcatacgtgcactattgcgtgcgtatggttatcaagtcaaaacgttggtttatactcgtgactacgcttttatcctctcggtatctttataaaaattatgtgtatctcgtggcactgatttgggtgtgttcgcaccttctggttgggaactctccctctctggtacgaaaaacgaagcagtcgtgattaattaagtattagctatttttttaaaaaaaaataaatcaatatgatttttttaaaacaacttttgtatagaaaatttttctaaaaaatacaccatttagtagtttgaaaagcgtgcgcgtggataacgagagagaggagttgggaaaactgtgataagaacacagacacgtttggaatgctgacagcggctggctgatcagccatatcatttggtttataagtaacttaaaaatatatataaaaggtttacctatcatattcacattgcttataagtaacttaaaaaaataatttagagcctcatcggttgctcatattacctaataagtcaaaacggtttatttaggaataaaagaataaaatttaatttataggtaaaacttttatatatttgttcatagtggcttaaaagccaatgctaaaaataaattacttttaaaatcaactttagaatcaaatccagaaatataaattttggcttttattttagcttattaggtcaatcgatgggactcttaataattcaaaactaaatatttcaaaataaactacgaattaaaaagcgtaaataaatattacaaaattaactagcaatttaaaagcgagtataagcaagatgatggaatatttttttcttagtggtgccgaccgtctcatgtttgtggccatacacttgtcgatcgcattgttccccaggcagcgtctcacgtgtcatgtcctacctttttaatttcaccctcactttttttgacatataattgacatataagttaattatcacgaataggtcgacgaggctattccacaacaataaagtacatggaaaaaaaatcgccacgaaattacacggaagcaaccaaaaaaacacaggcagctgaccaccccacaagaactgtatgcaaaacatgttcatcaacatttgcgagcacaggcgaaattccacaagtataacatgccaaaagtccaagacagcaattcagagaagatttagctctaatggcagacaagagtcttacaactttagcataattccatcgagccatggcactcgatggatattggcattgagtcctatgataaaaagagcagcttcaaagcatgcgtaaaagttaaggtcctttctttggtggacaagtcatacatgagtacatgagaccctcgctgctattagcagcacaaggaaacttactattgagataattcatcaaccaaacaaaaactggaaaagtcggtgcagcgcgcagcggattcatccccagcaaatcaccacccatccttcttcagcggcttcattttgccttctccttgtccttgtcggcagcttggggagagaactgctggccggtggaggatggtgagtagcccggtgcagtgggggagtagcttccgctagggctgtacatagggtagataattgagatggtgagaactctaatgaagccttgggttcacaggaaggatagattatgctgaaaaataattttggcccctttgaatcgtaggattgaaaaaacagaggaataggaaaaacacaggattttggtaagaatgcaagtgtaaaacagaggattgcaaaacacataaaaaatataggaatagccgtttgattagaccgcaggaaaaatgcaggaatcagatgagagagatagacttaaggaaagttttccaagagattagagtgaatgttaactttcctacgtttttgctctagaattgtaggaataggaaagtttactacgtttttgctctagaattgtaggaataggaaagtttactcctacgaatcaaaggcatgaatagtgtaggatttcaattcctttgtttttcctccatttttcctccaattcaaagggggcctttacctgtaattcggagatgttgggctataatctgggctgggccctccagatgtggtgtatgggctgaaaacagaaaagagcagcacattagaagtcatctcatcgtctcatatgacaaggaacattaaaggattactgcaatagacttatatggaacttatctggagaataccatatgcctctgccatggcttacagtcataggttattatttatattagttaatcttggcttcatttgaaacaattaactgagaaaattgttgttatttagcatcagtgttttgtatctagaactaactctacatgcataactcgtttcagttttcactcatcagttaacagaagtcgaattgcaactttggtcttttggtctacatgtcaaattgtcaataatggaaaatctttctaacgacatttctaggacggattttggattttgaaccaagg

SEQ ID NO: 63854 - DNA, 713 bp, Oryza sativa
tatatgatggagaagtgggactgtagctgggtgaagcaggactatatgatggagaagttgggctgtatcctggccctggactgtataccggagaagatggactgtaaccaccccctgacgatggagtgtagcctggtgaaggtactggtgagaaagccattcctccaacatatggcgagaactgagcatctgtaatggggaagccctgatgtttggacttagcaggtagctcggtgacatcattccttcatgatatggtgtcccagagatgggcgagcgtgctggtgtcatgccaaagtccaggccttcaacatagcttgggagttgaagttcgatggcctgctgcagcatctgatcattgagatacaatgcacagcctcctgtaccgataggtgcaagctggccaagcataatgttctcagtgacacctctcaggtagtcagattcagcatatacagcagcatcaagcaagatatccaccgtctcttcaaaggaacatctcataagaggccctgtgtcattacggttgataccatgccttgtaatagccatcagatgccctctgtatgtcattgtatcacaaagaatggccagatgtctgtaattgacataagaaccatcgaaagatatgaccacccgcagctcatccaagagagctcgacgaacagcctcgattccaagaacctcaattacttcgatcaaatggttacttg

SEQ ID NO: 63855 - DNA, 1292 bp, Oryza sativa
gaattcctgcagccccaacaaatcaggattcaatctttcgttttcggtgtttgtattgggatttggtcaaatttgaacaaaatattgccaaataaaaaaaatcgaaaaactttaaaaaattcagcccaaataatatcgagtccaatacaacaaaaaaaattccaaaatttcggtccggaattttgaaccatggcacaaattaaacagatagagggagagagattgtttacggcaactcttgcaaaatatttcatgaagaacgtacgaaagaacaaagagaaatctaactagaaagaaagaaaaaacagattaggacataatgctagctaattaactgagacaaagatcgaataatatatactttacgacatgcattattgctgcttgcatgggggaacttatcgtcgtcatgcatcgatcttcgaattcgtcgtatgaagagacgatcgactagatttcagttgtgagacggaggatgcgtcttgggcggcgcgtagtcgacgccggcgtcgtccgctgcgccatcgctgccgccgccgtcgccggaatcaccatcatctttcccgccgacgtccgcggccgccgggaacggcgccatcgcggctccggctccggcggcctcttcctccgtcgtcctcgccgccgccgccgcaccctcgacgccgccgggctgcagccccagggcgccgtccggcagcggcgccggcgccggcgatccccgctgctcctccgccgccgcccgcatgtacctccggggagacctccacacgtgctgcatgcacacgcacacgaagataatcaaaatcaagaatccaactaattaatttattaaccaagaacacttctccactcatgcttaccatggcggcggtaatgtcgtcgtcgccgtacagcgccgccgtcgacggcgaagcggccggagcggcggcgaagaggcggcggtggttgcggctggtggcgtggcagacggagaggtggaggaggaagaagaggaggagacagaccatgcaagagcagcgcatgatctctcggcttcttcttctctactctctttttgagtcatcgactcttttttctacagggatttttgagggtttttttttttctggtcttattttgatccgaggcgtggttggggttggaatgtgacgcggtttggagatttcgcataggtatttgtagtcgttcagggactcgtattgtcatacataaccaatcaatttatgccacgtgtctaattaactaggctttgtgtattcaaagacaaccaagattatatattcatatatact

SEQ ID NO: 63856 - DNA, 13323 bp, Oryza sativa
ataattaattttttttatctatatttaatgcttcatacatgtgtttaaatattcgatgtgatgtttttataaaaagttttgggaactaaacatgtcctaggtggctaggtagatgggccctcgattgtaattaaggtggcgtgcagagttgaggccgcaaacacaaagttaaataattgtctcctgctgtggaaaccggataacgcgtaaacgggttgctgacgccgcttaattccaacataattttaagtctcacactccacgtagtcatgaagacatgatgataggctgccttaattagctggagaagaaggaactaggcttccacgcaatcactcctatacctgtacatatatgcatgtcaacaatttgcaaatttaataacttaattcattttgtgcaaatataaaaagtttaccacctgtttcaaattgattattatcatttcaaccttgctctaagttaaaacatttttatatttgatcactaatatttagaaattcgtgtatcctaacaacatgtgaattatatatatattatgaaaatgttcttatagtgaatccaaaaacataaaaaataaattttaatatgctaaacgatataatatttttagaaattaatgatcaaatctataaatgtttgacgaattagaacaaagctagaatcataagtaatttagaatggaggtagtgtggagtgcaactatggagtatctaactaagctagtcagggtcaattagacggacatcagcggtgatcgatgcacggttgaaagtgaaagtgtgaccatatatatgatagatatcgtgtggcccatccagaagctacgcccacgcaagtatatataatacctccgatctttaatagacgacaccgttaaattttttgccacatgtttaaccatttatcatatttagaaaaatacgtaattataatttatttttgtcgttgcgagttgttttatcacttcaagtattttaagcatgaattacatattatatatttatataaaattttgaaataagataaatgattaaatatgtgttcaaaaggcgatgacgtacataatttattaagaaaacgtataatcctcatcatcatgtcgtgtataattactttccaagcaggcctaactagctacatgtagacttagtagctgattaaaatgaagcaagctggagctaaaatagtcgtgtgacgttgttgtcaccagcgatattatatcccatcgtaactttcacattggagttttctaaccatataatcgtgtactgtggtttgttaagaaggtataggtgactaatggtctgtttggtaggttaaaattctgagaagtagttggttggtagacattttctaagaatctagaaaagttaggtttctcagcttctgacttctagtgtattttttgaaatctacaattgcagtttcttaaactctgaaccaaaaactggattatttggaaaagcttctgattctgagagaatctgcagcagttagaatctcctctaaacaggccatactaattgcccactggactggacacacaatcatgacagtaatttgattaagggtgataagacacgcactcatgcattactggccagagatgatcgagtactcgaaaatgaggtgtgatgcaaactgcaaactggaaaattaaaaagaaagaaaagctgaatgaacgaactgggttggattggaaaaaaataaaatgaataaaatcggtagtgcgtgtaacaagctaggccactaaataaaccattcgtacgtgcatggtactctattaattaaagaaggaacattttatagagcgaaaagaaaggagtggtgaatcattcaggcatagtgctcgatcgctgcttgatagtgagaagcttacgggcggctgtgttcggtggtgggtatttacacggaaaacagagtaatccattagcgcatgattaattaatattagttaattttgttttaaaaatagatcaatatgattttttaagcaactttcgtatagaaatattttgtaaaaaatacaccgtttagcagtttggaaaacgtgagtactgaacacagccgtattaatgtatcaaaatatagaaaaatatcgctgtaacctcaaaacttagttgtctgtttagattcgtacttcatgatatgtccaattcaatcctaacttatttatatcttgaaacaaatgagcatatttttttttctaaaatctccagctgtaactgtctaaattgttaaaatttgtaaatataaaattaaaaaataaagtaaacattagacgctgagaaacttagatttcctatattcttgctagctatagctggtaaatttagtggcctagcttctcaaactgggccactaaattaccagagattcgtggtcgatcgatcgatatcgtgacttccatgacagcaaaaagcaagcagaatcacaaaaaggagctaaaattcgagtttgttggcctgcagctgccggatcgtcgcatccaagttatctaggaatcaaatcaaaagcaggcaggcagcagagagattccagctgccaggagaccatgaacccatgacattgatcacatatcgccgccggcgaccattgccgtcgcggtctgttgagctgtgatctaaattcatttgcatttaataaaggctagcttctgtcgtagtggagtggaggcccgtcgccggaggctttggccggagcgtagcggggatgcaggggcggagcctccgcgaaacggatcgtcatcccttttagggttccaccatatatatatctcttgtaagccgccgtgcggcgatgtaacctcaccccagatatagtgaagatattttgctggctggcgctcgtggttttttctctcccgttttaggagggttttccacattaaaatcttgtgtcttctatgattgatctattgttttttatcgtttgttcgcctgtcatttcctaacaccgtcgacgacgacgatcggccggcggtcactgttggatcgatcggtgcaaattaaattaaagcagaggctgagcatgtacgcagcctactcaccacaagccatgcaaagcaacctcactcgcgatcatgcttgcacacacctgtaatccaagctactactactgtcgacacaaatgcttggccaattcttcttctgtttctctttttccccatcgttttctgcttcgcttttttgcagcatctagttcatctttctttctttccttttctttcggagcatggatacagagaagcagaacacctaccataatgtattcgattgttatgccgtgatgggggaagagccatgagaattgtggaaaggagatagctaagtaggcaaccactccctttgtttctgtttttttttctaaagtagatgacgatgttgattactggacacatgacgttaaaccagtcgtcttgttgaaagtttttatatcaatacataagatataaattatgattaaagtatttttttaataataaaacgacttacaataaaataaataataattacataattttttaattacatgaatgatcaaatacgtatttaaaagttaacgacatcatgtattaaaaaataaaggtaatacataatactctcttttttttcaaaatataaaagattctaggccacataaaatatcttatattttgtaacggagaaaacaacaagctatagctcgccgccgatgaacgaaccatctgcaacggccggccggtaacggatcgccagcatatgcaagtatggcacacaacgaaattaccaaactgatcaaccgaaagaaaaaaagctaggaaaagcagatatgattatgaatatatgatatgatgatgccaatatcgatctaagctgcaaattgtttcgtttctgatatatgcatgcgtccctgcttacgttgtggcccatattcagagtatccaacgtcgacttcttgttgggtttcatgacgaaattaacccatcaaatatataaaatcttcttctcatcttccaatgtatgtatctctacctcactacctgcaattgttgtctgtacatgccgcccagatacatgccacaaacagcaaccatatctgactttttctaacgatctccggcttttttttttcctttttttgttgaaaatgacatgtccaaaatctctgtacagattgccgaacttattatatattagctgtgaaattcagaaaggaattaaccgccgtatataagttgggagctcgggagcttgggcttctccggagcctcacctgctacaattttacgagccgctcctcaaaatttcaaactctcctacatattatatatatattttttaattttagagaagagtgtttttcactttttcttaacatgtctctatatccaacccgacatatatgcaactttttaaattgagaacttagcccccaaacaactcaatccgaaaatcgttcatttggagatttgaattcagaatcttgaggtgctacttaagtcactgcaaccatgtcctttcacaaactctcctacatatagttcattccccttttgtttgtgcatttatttttctcttctgttttctatatgctttgcaagcctagccagataggtcctctgcatattactgcgttgtttgggtttgtgtcatggatccaacataatgggccacatgctagcttctgataatggactgggtccactaaacggggacaactgttaattgaaggccctttgaaaggaataagttcactttagactctcgaatatagatccaatataatacgtatccctcaactaaaactaggcaattccccgcgctttgctgccgaaattattgagtaattttaatatatatatatatatacacgttacaatcaagctatgggtaaaaagaaaacaaataaaatatcaggacttatcactatttattatgaaacaaacaaatgaaacccgcgctataatattgaacatattgatatgtttatgttaaatattataaaaatgctagatatgtttgtaaaaatattgtagaaatgatgtgagggtgatgattgaatagattgtagatgatgttacatgcttgcatgaggttgaatatgtaattattgctagtgaataatgatatggcatggttgcatgttacgcttcagagttagtaggttgtaactttatagaaagtatagataccagatatctttaaacccataactattaaaactgatgtaaaatgacccctcattggttttaaaggtggtttttgttgacgtatagtagctcgtcgacctggtccaaccgagtaaatcaacatgtggggctcatatgtcagggactccttccttccccaaatttcctctcggcggtagcgtgtgatagcgtaaagactacaatgaccgctgccatgaggctgaggctgtgtttagttggatccaaagtttggattttggttgaaattaaagatgatgtgactgaaaagttgtgtgtgtatgacaggttgatgtgatggaaaaggactgaagtttggatctaaacacagcctgaagaagacgagcttctctgacctgcccatcgcgccgtcggtctttgcagcagctgcggtgatggtcgtggagctggatgttgggcgtcagcttcaggccaagaatgtgcctatggtctagagcttattgagggcgtgccttacgcaccactgggtacgatgatcactgggagttccgataaaatcttgttttaatctgaaaacataatagtgttgtatgcgcatggtaaacttaatgttttagcagagaaagggaatttgagttcaatacattgttcgatccctttcgctctcattctcaggccttataaagagttcggcctactacacggcccattcaccgcctacgtatcgtggattgggccgtatgcctctcgtgggccgatttggaggaaccggcccactatcctttgaagttgcaaggcggcgtcgcgccttagtgtgacaaaaactgaatgaattaattaacttaaattggttggaaagaggataaaatgaaatagaatgagtgtttgatattaagtgcgtgtagcaagcttggccactaaataaataaataaaccattcgtatgtataatactactagtaaaagaaggaacactaatttttcagggcgaaaaaaaaaaatgagtggtgaatcacgcaatcacttccctgcaatataatgcatggtgctcgccgtcgctgcttgatagcgagtgcttctcgattcgatttgcatgtgtacgcactcagctgtagttctatgttagactgtgataaatatatatattcgatcataccactggtggagaaaaccatctttgatcggtcggccgaaatatataatagtcccggttccactaaaaaccaggttcaaaaggttatagctaccttttgatctttagtcccggttgataacacatcaatcggaactaaagatcatttttagtcccggtttaaaagatggtaggtggtgtcagacccctcctttatctttagtcacggttggtgactaaagatctatttttagtcccggttagtgttaccaaccgagaaaaaaagatcgacatgcacggtgcgagatcgagaggaccgaggcgcacaggaggatcagttaataagttctgaccttttatctcctcctctcctcactcaccccatctcttcctcttcctcctcccatctcttcctcttcctcctctggatccacctcctcccctctcctcctcacttctcaacctcctctagatcggcccctcccgtctcctccccacttctcaggcggcggcggccgggtggctgcggaggcggtctcgcgcggccgggaagcgcggaggcgccctcacgcggcgactgggtggcgacggaggtggcctcgcgcaccattgcgcggcggccgggcggcgaggcacagcgtgcggcgggcggtggggcagcgcgcgacgcgggcggcggggccgcacacggagcggcagcgcgccggctcttcttttttttatatataatttgtgattgagagatgtataatttctttttaaaatttgtgatttattgcatggatctgagatgtataatcgatctgtgatgcaattgatttgtgtgtaatttttttaagatttgtgatgtatttgatttgtgtgtaagtaacttaggatttgtatttgtgatgttactttgaatttggggatttgaggtttgatttaggtatatacatgacactcgatttggggatttgttgtttgatctggtatatacatcccacttgatttaggagaaaataaaaagaaaatggaccaaccgggactacccctatcctttctttagtcccggttgatccctctctttagtcaaagatcgatctttacacccgttatttcacccgggactaaagatagcgatctttagtcccggattcgtagtcccggttggaaaaccgggactacagggggttataaaccgggagtaaagatggtttctcctccagcgtactctccctccatcacacaaaaccaatcttaatacaagatatgatacatcataatactacgaatctgaatagagtttgcttagattcgtagtcctagctaaactgtgacacatcccgtactagattagttttttttttttatatctatcgaatccatcacaaaaggagtttgggtttgttggtagctgcagctggagtactgtctccgtcgcatccaagctactctagccatgaatcagaaagcagacagattcctgccaggagaccacgaaccatgacattcatatcgccgcgcgcctccggccggccatcgccgtcgtcgtcgtcgaccatcgatcggccggccggccggtcgccgtcggtctgtccggcggccgtcactgttcgatcggtcgatcagagcaaaggagaggctgagtgtcgaaacatgaattcggcaataataaaacggggtagcgcacgagacctaaaagtggatggatgtggagacaaaggatttagacaggttcatgccctctcaatgagaggtaataccctactcctgtttggggaattgaatccgccgggtgtattatagatctgacgatctagttgtctcatgccccctagagggcctcctgcccaccttatataggatggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatatatataagttatcccctataactagtcggataaccatgccgtgtgggtatggggtacccataatctccacagtagcccctgagaccttcacagtcgaaaagataatcttctctcgaaccagattactccaaagccgagtacttcaatcatctttgccatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataattcaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagaaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacatggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattaggcacttgatcacgcgcactttggcctaagcaaaaagtgcctaagtccctaaaagaacgtgacaggccacacctgaaaatatgggttgcagacatattaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggcggcgacaaacgcatccaacggtaatgatgattaacggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgatcgctccaccatgatgacaaatttgtattgccgtaatgaagtgaacacaagtcggcggcaacagaagcaaaccggtagtgaagacgcgtagttgtgaagataaaagcaccaatcggcggcagcataatcagtcggcgacggaagatgatgatgtccatcagtagtggtagctgtataaaccagacgtagaggtaagggcactagtcagcagcagacgagacgaccgacgatgaagatgtagatgcccaacaacagcggcataataggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgctagcggtgacatcagtcagtggcggatgcggcggccggccggtgaagacgtagacgcccaacaacggcagcataataggccagccgtgcaggcggaaacaccagtcggcggcggtcgaggtggccggtcggtgacgacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaagcaccagtcggcggcggacgaggcggcccgtcggtgaagacgtagacgcccaacaacggcggcataaaggccagccgtgcaggcggaaacaccagtcggcggcggcgaaggcaagccggtcggtgaagacgtagacgcccaacaatggcggcataaaggccagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagtagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgaggatgtagacatccaacaacggcggcataataggccagccgtgtaggcggaggcaccactcggcggcgacggaggcaagccggcggtgaagtcgtagacgcccaacagcggcggcataataggccagccgtgtaggcggaggcaccaatcggcgacgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagctgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggcgatgtagatgacgatgcccatcaacggtggtgtgaccaaccgaccgtataggcgaggacaccagtcggcggcgacggaggcaggccggtggtgaagtcgtagacgcccaacagcgacggcataataggccagccgtgcaggcggaaacaccagtcggcggcggcgaagtccagccggt

SEQ ID NO: 63857 - DNA, 2936 bp, Oryza sativa
ccctactcctgtttggggaattgaatccgccgggtgtattatagatctgacgatctagttgtctcatgccccctagagggcctcctgcccaccttatataggatggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatatatataagttatcccctataactagtcggataaccatgccgtgtgggtatggggtacccataatctccacactgagcatgttggtagtgtagccaccacaagccatgcaatacagcacactcgcgatcaaacatgcatgtccaaccgtgtagccactccactacatgtccacaaatgcatggccaattcttcttctgcttttctctctctctctctctctctctctctctctcttctccttcttcctcccatcgttttctacagcatttcttcagttgttatttttgggcagcatgcgtgatgcatgggagccatgagagcataagttgagaagctaactagctaggcatctaatatattgatgtgtaatctttttacgcgtccgcgaaaaaaactcgctaggcatcaactacctatccaaggctctgttcgaacttgagtaagatatgcacgcaacacgtacaagaaaagcagaaaagcagtagtatattaattgagttttttttataaaataggctaaaattcggcctttatatccataatggatatacacagcctatgattaattgaattttaattattacaaacattaataaaaaaattgtcatattatataatattttaatcagtgttcacctagtcgctaaacgctagtcggacggccaccgattgactagcgactaggctgattaggcggcgactagacggattaggcgaattagacattttttctatttctttcacacaaaaatactgattctatacattcggtactcggtaaatattggcatttaggcaaatagcataaatcatagttaaattcagaaatcatcaagtccatacaacgcgctaacactgcacacgaagcattgggtttagtacaaatctatagggatagcgaacacatcagtatagccactgtacatgcacatcataattcataaatcataactttataaatctgaggggctggagctaggagagaggaagaaaaatttatctagaactggaagaacagaggaggtgaggtggtggaggggagcctgatcccctgatggcctgatctagggttggcgtaagctgcttgagtggttccgtacttgactgcttcaatcggtgtgtttgccaccttccattgacggcaaggatgaaggatgagatggagagcaggagaagcagaggagggagaagaacgtggagaagcagaggaggagagggaaggacgtggagaagcggtggaagatcgatgggcgcggcgacggagccgtcgctcgtggcggtgtgaaaaaaggggtaggcagggattacgctctctctccaggctctcaaataagggaacctaaatccccttctataccgagtcggtcccgcgtggcgcttctaaattttatcacgcctaaattttgatttctatcgcctagtcgacgcctaaacgcactgtcccgttgtctaattgcgcccaggcaccatcctgtccaggccgtccaggccgcctaggaccgactaggaccgtctaggcggtaaatcgactaattcactgcctagggtgtaaactggacaaattgtcgccgactagcgattaatcaccgtctagacgggctaggcggccgtttaggcgaacattgattttaatgcaacttttacataaatttttttaatgaaacataccgtttagccatttaaaaaacatgctaacggaaaggaaaaacctatatccaccaactcactcgccgccgatgaccgaccgtagatcggaattcaccggccgaaactggtaccggctcgccgccgccgccgccgcctctgcaacggccggacggcaacgaattgccagcatatgcatggatggctagctggcacacaacgaaattacgaacaaactgaactgaaagagaaaggaaaaggtgatacatgataatgatatgatgatgcaaattgcaagcgatgcctagctttaatttgatttaatttaattctggataacgtatgtgatgtctgcttgcaaatattgttcgtttctgatgcatgagtccgtgcttacgttttggcccatatccaaagtatgtatgctatccaacgtcgacttcttgttgggttttcatgacgaaacccatcaaattcatcttcttctcatcctgtatatcaagggcgggcccagtatgtattcaagggtattcagatgtatacctaagttttttggacaaaaaataggtatatataccctacagtgtgtatatgtattaaaaaaaattaaaaaagaaaccttatactgcttatattgggccttattttaccatttcttctctattggtcctaaattttccgctttcctccccctttcctctcagcccgcaccctaattgggccgcatctcagcccatttcgacattttccccaattcccctccccatctaaccctaaccaccacgggagccgagcaagaggactgaggaggcgtgcgggtgcaggtccgccgtcccgcgtcgaggcagccggcggctgcggcgccctgctcgccgagcttatggtgcgggcgcgtttcttagtttgttcgtgccggcctctccgcgccggcgtcgagctacacgtatgcacgccgtgtggttttgggcttttggctgtctggcagacagtgtggagcttggctttggttgcagcaactgtggggagagatcgggaaga

SEQ ID NO: 63858 - DNA, 4437 bp, Oryza sativa
atgaaacctcttcatcatcgattttgctatatatttgtcgacaaatttttccctaaaaatttgacagatgtaattacagtacaatcgtagtgtaattacactgtaacttgcatgtaattacactgtaactatagtgtaacttgtatgtaactttcaaaaatctctccgtaacatgttatttcggtaaaatgaaggtcgtgggacaaattctttcacatgtgtttgctatgatttgctttcttcctcacgaaaacaaatcttgtaatagatctaacaatttaaaattatgtgaaacttacatataagttacactgtagttacatgcaagttacagtgtaattacatataagttacagtgtaattacactacgattgtactataattacatctgtcgaatttttggggaaaaatttgtcgacaaatgtataggtagtcccattgcgaaatagcccctctgcatactagagcacttatagatggccatatggcccaaggcccacggcccgattagggtcgtgcccgtgtcgggccatgcttgggctgcaccctcggcatggcccgatcaaataaaaaaaatacagggatgcaaaatatacttaataaccgtataaggcaaggcccaaatagaagaggaatacaaaatagacttattttccagccatttgaacacaacccacagagttgagggacgaaaaataaacttttctgtgaggaagcacgatagactcgagtagtattaggccgtgcctgggccgtgtatgccgcccgtgggttggcacggtccggtgaacacgctgggccgtgccggcctaactaacctcggcccaggcacggccgggcttaggccgtgccgtgccgggcggccgagttggccatctataagagcactgtttggtgagcttctgatattggcttggcccagtaaaagaaaggcaaactgtccaattaggcccatttacaaattcacaaatattgtaaaaaatcttcacggcccaactagtcactcgggccgattcaactacgagatcggtgcattgcaattgttaaggccctctagttcagatgctcgccactttgccatttgagcatttttcttcctttattttgttaataatataatacatttgttctttattattattcggtaaattaaaacttaatcccccgtctcatcaaaatatagcaacctagaaatagatgggatatattttagtaccacgaatttggacagtctcacgttgttatattttgagacgaatatagcagttagtttgtacatacatacgctaaacaatttaacttatacactagttgctcgtttttgtagagcatatatactccttgcagcttggatggggtaggagccagcatcagtaggaatgcaagtggaccaacccacgaacctgtttataagcaaaactatgcggattatccactaattcacttgcatctatagatgtgacaagccgagccacgacccgaaaatccacgggttatttatttgacctataagtgggttcggttcatcgtaggtcgacctgcttgcatctctagctatcagtaacttagttactcttcatcgtcgtcgatctccacggccttgttcatcctcttcttgctcccgccgccggcgccggcgccggaggagggcttcttgcggtaggcctcctcgtattgcttggcggcgtcgacgccgcggtcggcgagtccccggaggttggggaccttgtaattctgcgccgcgtacacgccgacggccgtgccaaccaggaacgggaacagccgatgcagcaagcaaaacatcgtcgccttcgctcgatcgccggcgatgatgaagaacacactaattaatgtgtgtatgttaataattagtgtctgaactagagatgagtaatggtgtttgatgataacaacatgcctgtctatgctgctatttatacttgtgtcatagttagcattagtgtttcagctgaaattctgaatattgttgtttcttggacaagggttcaagaatggatgttggaggaagatgattaaggagaaaagcaaagaggaaccaaagatgcagatataaagatcgatttatatgcttggtgatagtgatgtatatgatggccatgttctgtgtaggagttgaataattgatactccagctactgctgccactgtagttgagagatgagttgacgcttcagtaagtcatggttggccactccactagatcaggtgctcgatcacacggttttggtttggataaaggactctgattgacgatcaacttcttctccaaggctgagacttgagaaagactagtactagctactccatctgtttctcttcatattataaagtaatatgacgtttccaattaaacttttaaatctgattaagtttgtaaaaaaaaattagcatctacaaaaacaaattagatttattgaatgtagcattgaatatattttaataatatatttgtcttatactgaaaatgttgctatatttttctataaacttgacctcaaacttaaaaaagtttgcttagaaaaataatcatagcgtcttatgatatgaatttgaaggagtgaaaggttgcaaatgcccaacggcaagcgattgtttcttcatcatcttcttcaaacttgtagcaacatataggcggttggttgattaattgtttcaccttgtgttggggaagatgtaatggatgattttaattttttttcttttacttttagtaaataaaatgattcatgtaggaagttctcaccccgaatatgaccagtctagaaagatatatacggtttgttgattattccctggctgataggtttcatgttgcttggggaaggatgagtcaaagagagattaagcaagaggtgactaatatatcattcgttaatacggatataaaacgagaagggggagaaaacaagaaggaaggagtatactagtccgaaccaccgcccttcctacatttgactaacttgacacacccgacaccaggagagaggagtgagggagagaagaggatagaagccgccaacgccttctctacctctggttgtatttaccttgccactgcagccatcccgcatctctactagcgctggaaagcgagggggaggaggggagagaagggggagaagtgaggaagaagataggatggggaatttacatgtggatcccacttttatctttttttccgctagctatagtgccgcatcagatgaagactaagtcaaccgtgctacgtagacaacacattagttaaaaccatccttaaaacagccaagaaagtaatttttgcacgtgtgtacttaaagaagacgatatgcacatttttgtggttaagatcactaccggagaaaccgtttgtactcccggttggtaacccctgtagtcccggtttttcaaccggggtacgaatctttccttttttttcttttctcacgtccaatatctccaaatcattagaaaataacaaataacaaatcacacagatagttcacatatcacatatctcccaatattattcacatatcacaaatcacagatcgcatcacaaatcacaatcatacacatcacattaagaaggaaaaaagaaaaaaaatttccatgctgccgcgctcgccgggccaccggtcaccgcttgccgccgctgggaagacagtggagaggagaaggggaggagaaggagtgaagagagaagaggagaatgagtggaggggaagaaggataagaccgagggagaagggacagacagaagcgcgaagagataaagatcgaccgagatatgtgtgcggcttggggtgaattttggacacggttgttagttctatttgtagtcccggttgtttataccaaccgggactaaaagataattggggcctgactcgatctaacaacttcttcaaccgggactaaaaatgatctttagtcccggttggtaacaccgtctggaactaaagatcaaaaagtacccttgagcttttaaaccgggactaaagatacttttcagtcccggtttttattggaaccgggactattgtggaaattggcttatcgaccaaaaatggtttctgtcagggttatggataccacatacctaatagtagttgactaaatcttggcaggacccaccacataccatgtcttatacggaaacaaccttcggatataggaggagttccgcataaggaaggatgattagagttctacatggaaacgacaaggactactcggattgtatccatattggtttccctagttctacttggacaatgggacacctatgggtataaatatagggaaatttggaaccatgccattataattttgcaaaatttgagatatgccatcctgacccacatgtcattgactcatgtgggtcctgcatgtcattgagataccgatggcatatctcaagggctgcaggaatt

SEQ ID NO: 63859 - DNA, 4684 bp, Oryza sativa
cacggaacaatagatcaagacataagatcaacatacaagccaacatacgccaagacaagacgccggatatcgatttcagagataggcatggctagtcccctacggtgcctacggatactgtcaggagagatatagcgttgtctctgatctcgccggatgcggattcgaggaggaaggctaccctgttgtcgactacgagtcagtactacagaccgccaagtcgacaacagttagataggctaacctaaatattgtactggtgtgattatggtgaataaagagcaacgaccgaccggccaacaggagtagggttattacctgacgattcaggggcccgaacctgtataaaaatccttgtctccgtctcttttacctaagtctcacatatatcctagtaccaacgattcccatactatacaaataccggaatcgcgacatcaaacatcgacagtttctccagtagtagattacgaatctgattctatgggagtcaaaatggtcgattcacctacacgttcggctgattgcaatagtgaaagtggccacaacttcgccatttgatcaatttttcgtcctttatttttattaatatatccgttctttttaattttttaatttagaaacagtacaaataaggtttacgtataagttttacgtgtacacataagaacattccaataatttacatatcatacacactagctgctcgttttcatagaaaatgtaataactagtgagctagcactagcagtatcaactaatttactcctcgtcgtcgtcgatctcgacggtcttgttcatcttcttcctgctcccgccgccgccgccgccggcggagggcttcttgcggtaggcctcctcgtagtgcttggcggcgtcgacgccgcggtcggcgaggccccggaggttggggaccttgtaattctgcgccgcgtacacgcccaccgccgtgccgaccaggaacgggaacagccgccgcagcaggcaacccatcgtggatcgatctctccctgtcgtcgccggcgatcgatgatcaacaacaacacatacgctagctaatgtataaactatacaggtagctaaccacctatatatatctgtatttatatgtaagtatatatgtttgtgtcagtgtgtgtgtgtctgaacttcagatgagaagtggtgttaatggatgagaataatctgtgtatctgtgctgctatttatatgtgtcaggtgtgtgtaattaattagctggattgaagaagctagcatcagtgtgtccatcaatcggatgaatatgtgtttcttggacaagggttcaagaaaggaattgaagggagcaaagctaaggaaatgtaaagatctaggaatgatagtgcagaatatacaacagattaataaataattgatggtcatgttctatgtaatcaagttgaataattgatagtactagctactagtagtataatagttgaaatgatctgacgttgcaaggggtggccactatcacacggttttggtggataaaagattcatgatcaacttcttctccaagagtcagactacaacagctgaacttcaggaatttttatatactttttgcaatatccccaaccacccaccgagcaaggcttgtccttgtccggtcgattaaattgtgcccttctatttttcttgtgcctttcttgctagcaatagagtgattaatctgttaatctaggagactttctcagttaattaattgtgttgaaatatagtgaggtgggcttattgctcagttaattagtttggtttttttaacctgtctactaccattcgatgagtttgatcacaattggctgccaattcatacacccaacaatccaacacacaattagccaattgtgtcatttttttcaatattatctctatcttttgtactgtttgttcatctttatcggtttgcattataagcagtctatcctgaccgtaaaagtgtaattcgtttgtagatttatctagaaattttccattccgatcacaaaacaggagtttaccctgaattggtctaaatttgttccgctagctagttttaatctcaattattatatatcttagttataagtttctcaagatcgagatggctgacgactctagctcacaacgcaaagctctaggtaaaaaataaaaaaaccgtcaaacaaaggtacttattttttaacaacagagatgtatatatattatcttattttgtcaatacacacaacaggataacgagtacagagctaaacaaacacaattaaccggcacagcaacggaatcaagcagctaattacaataatagctgaactcaaactgaacttaattaataatcaactcaaattaatcctattcatcatcgtcatcctcctcctccctagcaacactagcagctgccttctccttggtgctgcccttcttggccttgggattcgtcgtcgtcgtcgccctcttgctctccttgtatcgctcttcccctgcagcctcgccgtcgccgtcgaccagctggtcgtcgtcgtcgtggcggcggcgacagcggcggtggcggcggcgcatggggcagcagctgtcgccgtcgcggcggaggctggtgagcgcggcgccgaagccggtgccggccaagaaggcgaagccgtacttgtagaacgccatggatgatctgatcttgatcgcacacggctagctctacggcagctagctagttgttaattagtgaaatttgtctgatgaaatcagcttgatgatttgcactgtaagtgatggagttcttgtgaattgttgatgatgaatcgatcggttagatcgagctggatcaggatgggtgtgtgtgtgtatatatagccatgttattggtttggtctcctcctagtaccatttgatttgttgttttgtgtgtgtgattaatgcagtgagctagctagcgtgtcaatggcgtcgtctctttcttggtcccttgtccaaggcaaagcttaattaattactcgctccgttttctaatagttacggttgttacttttgaacgatcattcgtcttatttaaattttttatataaatatataaggtataaatcatgctcaaaatacttttagacataaaataatttaaaagataaattataattagataactttttaataaaataaatcgttaaacgtgtgataaaagttaacggtgttaccttttataaaacggacgagggagtaacacatttttgcacaaccaaagccggacgagaacgagtgttgttgctaccagctgacgtcatgagaacgacaaattaaaattcgattaccgtgtgctagggccctgtgtgctagcacacatgttcaatcctaagggccggatacaacgactgttttggatatgctcgtacgcattcatgaaatatgctgctccctctttacatttagggctttttttcatgggactaatccactagtccttccatatattctagtttttttagtctctaagaatctaatctaaatataggtgactaaaagggactaaaagtgtatattgggactaaaatccattaatccctctttacttataagatctaaagcggcagcctttctcttctctctccctcagtccacatgactttagtctttttagtccctggattcaaatggggactacagtttttagtccaaggactaaagtatacagggactaaataatccaaacgggaccttaatttatgtatgatgatgtttagttcatttaaagagagtatatatgctctttggtcatagatatttaatgttaggataaagttttattaaacttgtgaaagattgatctctaattttatattagaataaattttgaaattccaataaatttatgatataacttcccgagccaaatctcaacatgtccataaaaagaatttaagcatctaatgcatcaaagtttaaaaggttgacagaatctttctctatgcgtcaaatatttataactaaaaagagtattagcgctttctaaccagactttgcttaatggttaaaccttttccagttggttaatttgaatttatatatacggatctatatttcaaagtgatttcaaataaaggattggctactattaaaaaaaagaggagactttggagggataagacatccctccaaagtccaaacattttttaagaagaaattgtgagcgtccacccttgaccctaccttgaaccctaaaccttaaattgttgagtcgctgtcggttgccttagttcattagaggcactgaagctagaggagaacgagctctcgcacgaattgtgaagcattccctaatgtaagaaaactacaagattatagctagcctccacctttttttttttgttaaatgtgatgtagcaattccgtctaaatgatgttggtggctgttaagttgcaactaagaatacaaatcacaagaaatcaacggtcaggattaatagtgatttttttaaaagaaaaaaaaacgtcctacagaagaatttaaggacggtcaacctaaagctttgacctttcttgttttgagaggagggttaaatttgggcttgtaacaggcctttcctaactagtcaggttaccaaattgggcttgggcctggccacgcactggtgatttacattagggcccgttcaataggtctttacctggcccattaaaggcccatgacagacgtgtcttc

SEQ ID NO: 63860 - DNA, 11838 bp, Oryza sativa
ggtcacgaagatgatggccttcactgtgaagtattcccttaagtactcgtcccacactttcaatccctctttccataaatcagccatatcttccaacaatggttcaagaaatacgtctatatcaataccaggttgatggggtccctgtatgacgatacagagtagtacgtattttcgtttttgacaaagctaggtaggaagattatacatggtgagaagcactggccaagtactatgtgaactgctcatgtctccaaaaggattaactccatcagtactcagggcaaatctaatgttccgtgggtttttagcaaactctctatactgagcattaaagtttatctactgatgagcatctgccggatgtcgaatcatcccatccttcttgcgcccttcttcatgttagcgcattagttccacatctcgcgggtttgagtatatccgtttaatgcggtctttgacaggaaggtaccacatcacaagctgcgggatttttctctgtcgtcccttagttgcttctgagggttctaggccagtattgctattcgacttgtaccggcttgcaccgcatgttggatattcatctaaagaagcgtactctttcctgtatagtatgcagtgatttacgcacgcatgaatcttttccacaccaagtgaaagggggcatatgagtttctttgcttgatatgtgctggatggtagtgagttaggcctcggtagcattttctgcagaagttctaacagactgtcgaaactggtatcagaccatccatgtctcgcctttaacctcataagttcaagaactgactggagtgttgtgaactcactgtcacagcccttcgactcatcgtacaaaacttcctttgctgccttctgtaaagcttcaaagtaatttaaccctctagctgaccccatcagcacctcaggttctgcatgacgtaacatttcctctaggtcgattttgtcctcaacagaaccatcgtcatgcaccatgtcttcaacttgtgtcggaactacattttcatgcccgtccacttgttcttcaccatgacgtgtccatatttcgtgcttgtccataaatccacgagttactaagtgctccttcactttaaaagcatcgtcaaagtcccaggatatttcattcttacagtcagcacatgaacaaattatcttcctcatattgttcttctcagcgtgtgccttggcaataccaataaatttagccacttcgtttctatatggagacaaaaacctcggccaatgatacatccattcccgactttccatatctctaaaaaaaatatacgtcaaatatttgcacaattaataccaaatttgtagggtttattgaaaaaacttatcgctattcaaaactaattaactaaaggttaagtgtaaagtaataaaaaatcaaagtttatttcaattttttttacacagacatgccaaattagtacattaggaaaatctaaaaaaatcatatcatcggcatattcaaaatactataactattttttgattgcaccgaataaatagacatttaaaattttattctctctctatatatgacaagatctagatctagatctagaactaggtggtggatgtgatatcaaaaataaaaaaaagagaatttatgttaccatattaaaccactacaacaagaggcatcaagtattacacatacatctaacatcaacatatgaaaagaaataaaattaaaaaacatggagctcttccttcacaattttggatgcataaatccatcacaaattaaggtctaaaagcttaaaaaattgcatacctagtgtggaaatgagtagatctaagtaccgtagaaaattcccccgaagatttgaagttcaaaacctcccccctatatttaagtcactttaggagagagaaacgtcggggagaatgaacagggctcggggaggaaaaagactatataggggtatctttgcaggcgggccatataagcgtcgcctgcgaagatcgatcttcgcaggcgcctgcaaagatcaatcttcacaggcggaccgccccctccaccccaggtactttttttgccggcggggttttggctccaaattacatgcccgcctgcgaaaatcaatcccctacgatgccgaaaatgagttttctagtagtgttctctagccaaattataatacttggtcaaaactaatgaacatctttttttcatctaggccataacagttgtactagtttgtgtacttgtgagattgcaaatataggagtatatatgaatatatagtcttggttgtctttgaataaacaaagctttcgcgtaaaaaaaaaacacaaagcttgattaactagacacctggcataaattgattggttatgtatgacaatacgagtccctgagcgactacaaatacctatgcgaaatctccaaaccgcgtcacattccaaccccaaccacgcctcggatcaaaataagaccagaacaaaaaaaaaccctcaaaaatccttgtagaaaaaagagtcgaggactcagaaagggagtagagaaaaagaagccgagagatcatgcgctgctcttgcatggtctgtctcctcctcttcttcctcctccacctctccgtctgccacgccaccagccgcaaccaccgccgcctcttcgccgccgctccggccgcttcgccgtcgacggcggcgctgtacggcgacgacgacattaccgccgccatggtaagcatgagtggagaagtgttcttggttaataaattaattagttggattcttgattttgattatcttcgtgtgcgtgtgcatgcagcacgtgtggaggtctccccggaggtacatgcgggcggcggcggaggagcagcggggatcgccggcgccggcgccgctgccggacggcgccctggggctgcagcccggcggcgtcgagggcgcggcggcggaggcgaggacgacggaggaagaggccgccggagccggagccgcgatggcgccgttcccggcggcggcggacgtcggcgggaaagatgatgacgattccggcggcggcgatggcgcggcggacgacgccggcgtcgactacgcgccgcccaagacgcatcctccgtctcacaattaaaacttagtcgatcgatcgtctcttgatacgaagaagaagctagacgtacgacgacgaattcgaagatcgatgcatgaggacgataagttccatgcatgtcgtaaagtatatattcgatcgtgtctcaattaattagctagctttatattttgcaagagttgtcgtaaacaatctctctctctctctctctctctgtgtgtgtgtgtgtttaatttgttgatcgtacgtgttgtgttcttcattgtgtggagtcctatactccatgagaaataatgaattttggcaaaccttaggaagaatgaaagcaaaaaggaaaaaaaatatatagatttttctcctacataatcattctatcccaaaacaaattaacttatgactgtttgtgtgccgataggttaacttattttgggacggagaagtaactaaggccgtgtttagttccaaagttttttttcaaacttccaacttttctacacacgcaaacttccaatttttccgtcacatcgttccaatttcaaccaaacttccaattttggtgtgaactaaacacagtcgaagtagtaattgggaaattggaaaaagtgtttttctaaatacaactaggatggggatgatactaatcttgcaggtctcatggatggatatgaagttgatgaattgactgaagttgatgatgattggccatgaaaggggctagctagctggagtagtaggatccaggagctaagccaagctaagctagggttttgaaaactagaagccttgggaatgttggagaagacaagcatagctaacctaagctagttttacccccttcgttgcgacatgcgtgtttgaatgagctatataaccctctggttagagcaggtacaatagcaggctataagccagttgcaaatatattttaaggagataaatcaggagagagaagaacagcgggctacagatttgtagccagctgtagcacggactccaagacgcagtgtgtctatgacaggtgggactagatattaatagtgtaggttgtaactattgtatgaatgagctattagattggctatatataaattggagccagtagttggctatactattaaacttgctcttagtggttacaatgcattcagagatgcatggcaagttaaagaagttgcagacttccatggactagctagctatagctagtatagtagcttcattccaattttccaattcaccattaagtatattcgtagttatctccactggtaatttttttcactaattactgtgaaatagagaggtgtaagctaatgtgaaagaaaacaagcaatgttgtggctttatataacactggtggagagatggtttgtagtcccggttggcaacccctttgtagtcccggatttccaaccgggactacgaatcccggttggtgttaccaaccgggactaaagatagcagcacagtcccggttggtcaccattttttttcttttttttattttcattgtttctttccaaatagttgctgcttcccaaatctccccaaatatcccaaaatcaaagtatcatccccaaatcaatgaatcattcacatcacaaattctcaaaaaactacaactcaaattcttaaagaaatacatcacagatccaaacatcaaatacatcacacatcatatacatcacagatccaaacatcacagatccaatgaatcacaagtttttagatccaaatgtatcaaaaatttgggaaaaaaaaaagaaaattgtgcttccgcagaggagagggcgccgccggccgccagctcccgccatcgccgcgctacctgccgctgcggcccgcggccgcgctccctgccgcccacggcccgccgccagcgccgccgccgcccgggcacgctctggtagaggaggaggaggagaggggaaggagaaaggggagaagagaagactctgtggcataatgccagatctgatctgaggttgttgtttatgagagctagggagtagagagagagaggggaaggggatggaacgataagatcgagactctgtgccgcgcacgggtggttttattttttgtcccggttggtataaacaaccgggactaaagataattagggcctgaattcgacccggtgactttttgaaccgggactaaagataccaaccgggactaaagatcaacatttttttaaccaggacttaaaaatcgtttttagtcccggtttttaatggaaccgggactattgtggaatttggtggaccgaccaaagatggtttctccaccagtgtaagcaattccaattaaaactcttgtttgtgaaggcatttttctgaagaatgtggtgtttactttattttttttccctaaactaacttacatactatcaatatatatattcagctttctttaatttccttggaaacgaaaagaaaaattaaggtgagttgcagagttagcaatgcatgctctgatgagaaaatctcaggcgctttgatgtgcagcaaacctgagaggtttagccaagctgataactttcctttagtcatgactcatgactgaggtagctaggagtgcttgtaatcttcaacggttttcttgcacatgtaagagcttcgatcagcttcagactgcagttcccccccctgtccctgcacttttacttgtacttgatcatagaagaaaaaaagcagagtggttattttgtactatgtcgttatatcaggacatagtaattagctctcggtgagagtaattatttcgagttcttttttggttaactgtgtttaggcgttgatagtacgtaggaaataaattgcaatgtggtttctcaattagaaggttctattagccagaagggttaagaagctttcctctccagctttccttgtcgtgtttaaggaaaacaaggaaaactcaggaaacttacatttgcggatacacggcaaactgattttatcacagttatatagattttatcacagttatatactatctccgtcgaaaaaaaaaagaacaatttcagctatcatctaaacatgataattcttgctatgcacatagacatgcataccactttcttttacaaaggtaatatatataacacatcctatctagaagactaaaacaatatataaggcatgctgtgaaccatgcaaaaacctctcacgggctgcatattagtaaaacggttataatcatacagttgagacgattttagacatgtagtttgcattacatgtttagtagtttatctccttcttcctcacatctcatgtgcacggtgacctctcgcatctctctcaatcacaacccattgccacccctcaaccatggcatcatcctttccctattagcattggcttcatctctttcacgccgatcttaccacccaccttcccttgtcatctattgcctcaatgaccttagtctcttgtctatagatgaccctctcttagggatatggtgccatggtggataggtttctgatggccttaaccagctcaatcttattgtcactacatctccatcaattttatccctcttaatccatccaatccacgatcctgctagacccaacgtttctataaactttggcccactagatccatacgagttgcagttaacgacacaatgatgaggtttacgtaaaacttgaactcatcaaccttgcacatatacaacctatacatagtcaccacaaacaactctagccaccggaactagatgagtcatggttgaggacgtgagcaccatggtaatattgtattggtgttatctctacagccatagatcgaactaatgttcagtccgtgtcatgctgcctcacctttgttagtaaggttaacaaatatgtttgtcttggactttcttatccctcaatttcgtttgaatcgataaaataaaaactgtattgctgtccaatatttgtatagggtaacattaattataccctcatgggtaatgccactatataaagtatatgctgtagagcacctattttttaagataataaaatcggattatatctctggcctctgcctcattgccaacaagtttcagaataaaaaaagggaaaaaaatgcaaatgtacaacatctctcttttttttaaacacctctttgtttccttcgttgaaagaaaaaaaaagatgtgtcctgttggaagaaaaatgcaaatgttaagacacagcactgcacaaaaagacaaaacggtccttccgcattgaccgtaccagacccacacaagctcctcgtgatctctgatctccaccgtccactccccatccaacggccgaaacccaaactcaccccaccgtagtcggtttccccaccttccgtgcaccgagttcaccaacaccctactccccaactccccgtacaccgcgcccacgggtccacgcgccccgcgcaccggctcacgatagcgcacccggcgcacgatacgtctataaatacgcccctaccccccttccccttccggaaccggatcctctaacgtaattcattctacgtcagagggacgttcaaccacggatcgtcgttccttgcgcatccgacggcaaccaccgtttcagtccgtccccgcctcagaccccacaagcgcgatgtctctgcttgctctccggcccattcgttgatagcggcagcggcgccgcgccggccagccacccggaagctcaggcagccgtgcgctgccgccggcggggaggtcggactggaacgcagtgctaccgccgtccgccggcgaggtcgagggcgaggactccgcaccgcctcggtgtctgctgttggtcccatcgcccagcaactgctgtttctcggaaccatcgccggcgaggttggattggaatcgatctgtagtctatcgaacttgcatcatcaggttgccttttctcatggaagaggcagctggttgaaattcttgctaaggcattcgtgctgtcattagcttgtcccagaaactaccaagtaacctgaagaaataaaatcagagctgaaaccagaactttgccaacagattcatatagaatgcggcatagcaagtctgcaattgcaataaaaaattaccaaaaaagatggtttttctccttgaagaagagatcaatcgagtgcagatgttaaccaaggaaagaaatctcatggctcgaactgaagagaagatgagtaatttttctgttcttttgttccccgtgtagctcaccgaggacggttccgagaaacaccgacagcaaacaccgaggcgggcggagtcctcgccctcgacctcgccggcggacggcggtagcactgcgttccagtccgtcctccccgccggcggcagcacacggctgcctgagctttcgggtggccgaccggcgcggcgccgctgcccctatcagcgaatgggccggagagcaagcagagacatcgcgcttgtggggtctaaaggcggggacggcctgaaacggtggttgccgtcagatgcgcaaggaacgacgatccgtggttgaacgttcctctgacgtagaatgaattacgtcagaggatccggttcctccccttcccctttcctcagacgaacccttcttcctctccgcgatttcccctcacctcgcggaggcggcgaggcgatctgcgcgcgatcccattcgattcgccccgaattagccgccaaaaacactcgctgctgctctgctcactgggggggtggagcccacgcgggtgggcgaggcccggtggtgctcgcggcgggtggggggagggggcggcggcggcgccgcgatctgaaaccctaggtggtgggctgcggcggcgggagagatggatgcgaggttcccgtactcgccggccgaggtggccaaggtgcagctggtgcagttcggcatcctcagccccgacgagatcgtaataccccccgctccctcctcctccccctccccctcccccgccgccgccgccactgtttggtttctctctctgtgtgttcgcggagtctggaattcgagcgggttgggtcaggtcggggggggggggggggggggggctgagtttgggtggatgggtgaacttgctagcttaagattgctgttgggcgagtttggcatcacaagttccaattgaacgtttaccaggagctcgaaatgtttcaaattgggaccattgtttggtttgagtcgctacttcgatgtttcagggggaatgaatttatcatttgtagcgtatgaacaaccatgtgtaacttcaaattttgtgcactacaattacaaggaaacggtgttctgtttttgttgtaacttgtaatataaggtgtgtagtgaagcaattaggattgaacctgctagcagtgtacttataatgcaagcaatcggtggaacatgtactgttgtcataagttgtgaggcatcgaatcgaatttgtactttgcagagtcattgttgtgcggttccgtgtacctgttgagttgggaagctctgatctttacaatgaagtttaaatttttcagtacgcccgaggtttagttattgtgttgataataacatggactagatggatttgatagtattgagtcatcaggtttaatggttctgcttcagcaatgtgataagtgctcaattacaagattaccgttgcatgtggagtgtgtaaaaaaacataatttttaggatggtatttgatgtggtttctgtgttgctttgcatctttgtagaggcaaatgtcagtggtgcagatagagcatgcagaaaccatggaaagggggaagcccaagcctggtggcttgagtgaccctcggttggggactattgaccagaagatcaaatgtgagacatgcatggctgggatggcggagtgcccaggccactttggccaccttgagcttgctaagccaatgttccatatcggcttcatcaagactgtactctccataatgcgttgcgtctgcttcaattgttccaagatccttgcggatgaggtacatggaccccacttctcgggtttggctgttttgcaggactttgttatatgaaaaatatcttaacaaaggaggcaccattgattttatgctacacatgctaaactggaactgaaccctatttattctgattcctgactattcatggaaacacagctatacttgtaatttgccatttttaactctgttatgttttgcatgttttgtgtttgcaaactaaatctggtaatatccttttatgttacactcgtttaacatgtgaaaatacaatttttttttgcgacttacttttccccttctgttgtcctcttttttactgttaaggcaaaaaccggaagatgcctttgttttcaatgctggacatgctaaactggaatcatattgatataaaatgtttattcggactatacatgcaaacgtaaatcttattttatctttgtaccggatctagctcttacgttttccatcttttctcaactctgagtttatttatcaatgggtgaatgcttttgttgcaggatgataccaagttcaagcaggctcttaaaataaggaacccaaaaaatagactgaaaagaatatatgatgcttgcaagagcaaaaaagtttgcgcggggggtgatgacctcgatgttcaggagcagcaagatactgatgagccagtaaagaaaaggggtggctgtggtgctcagcagccaaatatcactgttgatggtatgaagatggttgcagagtttaaagcaccaaagaagaaaaacgatgatcaagagcaactccctgaaccagtggagcgaaagcaaatcctctcagctgagagggtatgcacacaatctttactcaggttcaatacattatttttaagaatatccatttaactatgtggttcctgtttattttgtacttaggtgctcaatgttcttaaacgtataagtgatgaggactgtcttctattgggtctgaaccctaaatttgcccgccctgactggatgattttgcaagtccttccaattcccccaccccctgtgaggccatctgtcatgatggatacctcttccagaagtgaggtgagttatatgccacacttttttttaaccttcctactggatgattttaagaatgatgcaccttcatgaactctctgctattctttacaggatgatttgactcatcaattagctatgataattcgacataatgagaacttgaggaggcaagagagaaatggggccccagctcacataataacagagtttgctcaattgttgcaatttcacattgcaacatactttgacaatgaacttcctggccagccaagggtgagcagattacagtcgttttgccattttacttgatgcaaataagttatcctgattatctttttgttggaattttcaggccacacagcgttctggaaggcctattaaatcaatttgcagcaggctgaaagcaaaggaaggccgcattagaggaaacttgatgggaaagcgtgttgatttctcagctcgtactgtcatcacaccagatccgaatattaacattgatgaattgggagtgccatggagtattgctttgaacttgacatacccagaaactgtcattccatataacatcgagaggtaaaaaaaaaaacatctttactgttattgaggcatgatcacagttctttaatgatcacttacacctaaattcaatgatctcagattgaaagcgcttcttgaatatgggcctcaccctccccctggcaagacaggtgcaaagtatattatcagggaagacggtcgggctgcagg

SEQ ID NO: 63861 - DNA, 919 bp, Oryza sativa
tgagtttgggtggatgggtgaacttgctagcttaagattgctgttgggcgagtttggtatcacaagttccaattgaacattacaaggagctcgaaatgtttgaaattcggatcagtctttggttgagtcggtacttggatgtttcaaggggaatgaggttatcacttgtagcgtatgaacaaccacgtgtaacttaaaattttgtgcactacaattacaaggaaacggtgttctgtttttgttgtaacttgtaatataaggtgtatagtgacgcaattaggatggaacttgctagcagtgtacttataatgcaagcaatcggtggaacatgtactgttgtcataagttgtgaggcatcgaattgaatttgtactttgcagagtcattgttgtgcggtgccgtgtacctgttgagttgggaagctctgatctttacaatgaagtttaaatttttcagtacgcctgaggtttagttattgtgttgatagtaacatggactagatggatttgatagtattgagtcatcaggtttaatggttctgcttcggcaatgtgataagtgctcaattacaagattaccgttgcatgtggagtgtgtaaaaaaacataatttttaggatggtatttgatgtggtttctgtgttgctttgcatctttgtagaggcaaatgtcagtggtgcagatagagcatgcagaaaccatggaaagggggaagcccaagcctggtggcttgagtgaccctcggttggggactattgaccagaagatcaaatgtgagacatgcatggctgggatggcggagtgcccaggccactttggccgccttgagcttgctaagccaatgttccatatcggcttcatcaagactgtactctccataatgcgttgcgtctgcttcaattgttccaagatccttgcgg

SEQ ID NO: 63862 - DNA, 983 bp, Oryza sativa
gaattcctgcagcccatcaaaggggacaaatcggaagaagcccgagaagaatacgaagggaggggatagtaagaagcaagatgacagttcgaagccagatgataaactccctcccccattcaagaagcattccatattttttaagtacctcccgtactggaaagatctggaggttcggcataccatagacgtcatgcatctagagaagaatgtgtttgacaacatagttggaacattgttggacatgccgaagaagactaaagatggtctgcaatcaaggatggacctagtcgagatgggaatcaaggaagagttacaccctcaagaaggagaaaagaatggcaaagtatatcttccaccagcctgtttcacactgacagcctgtttcaattttgcaggatatgtgaatttgtcaaggattttaaataacatgttggagggtatgttaacattttttttaaaaaaagtggaggatatgtttgccttttccattttttttagtcaacatgtcgatgaaataaggaagtcaattagtgcactacttgataataacaaatcaaattttgtacaaatttgtttgtagtaattaatttagcataatagtaagtagctattagtttcgctatttaaatttgtttgtactaattaatttagcataacagtaagtactagttaaatttggaaatctcagagaatttaaatttgttcatacgacatattgttaatatacaatttatttttgtactaattagtttgtactaatttgagtaatttaaaatgtggacgataacacttttttttacattagaggtttgaaacgatggccaatagtactcctaagaggatatgtgaatttgtcaaggattttaaataacatgttggagggtatgttaacatttttttttaaaaaaaagtggaggatatgtttgccttctccattttttttagtcaacatgttgatgaaataggaagtcaattagtgc

SEQ ID NO: 63863 - DNA, 15303 bp, Oryza sativa
agtttcgctatttaaatttgtttgtactaattaatttagcataacagtaagtactagttaaatttggaaatctcagagaatttaaatttgttcatacgacatattgttaatatacaatttatttttgtactaattagtttgtactaatttgagtaatttaaaatgtggacgataacacttttttttacattagaggtttgaaacgatggccaatagtactcctaagaggaaggtgactgataaggcggatgatccagagatgcaaaaggaaaatccagtgccggaagtgccaccggagattgcattgccggaggcagccatggagatttcaccgccggagacagccatggagattccagtgccggatgtgcccatggagattacagtggcagaaccagaggtgcaatttgtagcatcagtcgggtcagacaaagaagaagtaccaggattggaatgggatggtacaaagccagaaatatttgaagacccttctcctatgaaagaccccgatgtgccacgagtgcttaggagccatgactccaagtccaaagatgagaacaaggagaagttcatagtaaccgtcttcagagggggtaaggaacgtgccaagctcagagatgacaacccccagaaggctgctgaactagccgggccaacatacttcgcaaccgatgattgcccggaaaagtacgaacatgggaaagcactcttgccggaatgggcactgaaagaagcactatgggagatgagaaggttacataacttctacatggaggccagcaagaaaggcttgggcaatataacagcttgatcacctgcagattgtttcggcgaagaaggttacgtatggctagatttctcagatctccacgccatatatcgtcgggataagatggacgtcaattacgtcggtgtttggtgcatgtgagtatgagttttaattaattagatgaaaaaaaatgtacaatacaaatccatgtgattgttactaacaaacttcttctataggatgcaatacatggatgctaagaagaaaaaagaacccatcagcttcttgtatccaactcggatctgccaaacacagcataccgtgatgctagcaccagggtcaaaccagctgaagggcaagaatccaaaagagatagcagaatacaagaagggcttgcacaaggagaaattgattactgtcgcatagtacattagatgagccttcttgcactttcaaaataagagagtcgttatagccgcttataattttaagtaagtccggtacatttatcttgtacacatatgtcttattttagctggtactaaataactataatgttgttaatatgtagcgatcattatatctgtttactcatccaccctaaagacggaaccatggtagtcttggatcctctcgattacagtcacaagcaatacaaagaatttctaacaatcttacagtagtaagttattatgactcttgcatttgtatatgaatgtattacaaataaatatcctccttactctgaaacggtacgacatccatatacatccatatagtgcataccaatactataagttcaagggtggagaacagacccgaacacgggagaagctgctagtacgtacctattggccggtaatactccactcactttatgtattccaattgtttcactaattgcaaattttaactacttttttctatgatatgtcctgaagtgtcacaagcaaccgcgaggaacggtcctttgcaggtattatgcgtgcgaattccttagggttaatggacggtacaggactaacgcggaggatgtaagtctctatactatgtactagacagcacttgatatttatgatactaatatattgattaatttcaatgcatgcagttgccaagattagaatgtcgaacaagctttgacgatacaggtatcacaaatgtccagcgtgatctgtgccacttcatccaccatgagtgctgtcatgtcaaaggagatttctttgacccagagggtgccctagcggcaagtgacgaattcaaggatcttcgggagtggaacactgctatgccataatgtaactagatgacgttatttgaagtgacaatgtaaaaaaatattgtaatatatatattttgtcaacatttttgagttatgcaatatatgtaaatttctcagtaccaaatgcttgataatcttccaatatatgtacataaaaatctacatgcaagaatttctattaaataatttaaaagtaatttacggccaaattataattaaatttcaatattttctacctatcttcgcaggcggaagtttttttttttttgcaagcggacgattcctattttcgcaggcggaccggactagccaacgtccgtctgcgaaaataatcttcgcaggcggacggccgccccgcctgcgaagacccttttcgaccgcttgcgataatgcttttcctagtagtggaacacattattcggatacaccaaaaaataatttgagtatatatatatatatatatatatacgggtttatgattattgaggcataggtggaattgtatgttgtgttttctttctgaaactttaattttatacattatgatggagagcgagaatggctatagattctgttgaagcaaatgtcggggtttatccattatctaaagagaaaatgaagagatcgaggggatgccatgttaatattcacatggatattttcattattgacatggatatcttaaatatattttttatctaagtattagaacgttgagtgataagcaataacttttggactaagcgacaatcttcttcagactgtctatccatttgtcaggtgatttctaaccaaaaatcacccaaattttttctactcctagatttacatccaacggactacaaaagaatataacaaatacatatttacttaacatttttttatcaaaattacggtgcacttacatgtcttatcaactgaatttacaaatgtaattttagttatataggactgtaattttatattttaaagaaaattacaaatatatatttacttacacattattttttttcaaaattacagggcacttacatgtcatatcaactgatttacaaatataattttaattttagttatataggactgtaattttatattttaaagaaaataacaatatatatttacttacacattatttttatcaaaattacagtgcacttacatgccatatcaactgaatttacaaatgtaattttagttatatatgactgtaattttatattttaaagaaaacaacaaatatatatttacttacacattatttttatcaaaattacaaggcatttacatgatatatcaactgaatttacaaatgtaattttagttatataggattgtaactttgtatttcacggtgacgacgacgacgagagtggccgtactgccggcggccagctcaatcagaggccaccttggcaccgtgcttctccatcatcacgcgcgcacgcggtagctaggtaacacaggccgacgtgcctgccggccggcgagctgcatggaacgtcgaccttgcaaattgccgctcgcatcgcaagctgcatggaggccaaaaaaaagtgtcaaatgccagcaaaaaaatcacacgggagatggatagcaaaatcaaaaaaacaatcttcttttcagataggaagacacgtctgtcatgggcatttaatgggccaggtaaagacctattgaacgggccctgatgtaaatcaccactgcgtggccaggcccaaccccaatttggaaacctgactagttatgggataagttcatctgaggtcccttaactttacaccgaatccgattttcgtccctcgatcagaaaaccagacacagcgggtccctcaattattaaaaccggtgcagattaggtccctcggctgttttgagagcggttttggctgacgtgacacctatgtggctaatttgactcggtctttgtccgacgtggcgcttacgtggcaattcgacccgtgggacccacatgtcagtctcacatagaaaataataaaaaatcgtgggacccacgtgggtcccacatgtcagtccaactcacccctcttcttcctcctctctccccatctccctctcttcatctccctatctctgctctctccaggcgccacggaagacaacggcgcgtggcggcgcgcggccggcggcaggagaggagggagcaacgcgcaaagaccggcgaggtgggcagggagggaggacgcaaggaggccggcgatggccaagcgccgtgggcgggggcttgatggcgacggacagagggagaggtgcgcagccgacggcggccagcgggagagggagcggcgaccgccctccgccgcaacctacctccaccaccaagctcgtcagcgactgcccaccggagtgagcaggacgacagccggcgacgggtgaagaggatgaaggcggcggtatggagcagaggtcggaggagggcccccagccgctaggatggcgctcgatccgtcgcgtttcaccaccaccgagctcgtcagctgcagcccaccggagcgaggagcgaggagcttccgcttccccttcctcccattgacgccgcagccgcagcaactgaggcgccgctccccatgccgccgcttctgtggctgttaacagtaaaatttggtaagcccggagtagtcattggcttagagtcaatatcggtttggaagtcctgagattagccgatgagagttgtcaagtcgtcagttgtcggattcttgctatattcggttaaggaaattgatctactaaaggaagcttattcagaagagaccaagttcaaagagaatgcggcatagcaagttatctattaattaggaatagtttgttagtttccttttatctctaggaaagtgtgtttagtgtcctataaggactttatcattttcttttatctttaggaaagtttctttcttgtccgacaaggacttgtatcaacccatgggtataaatatgtacacccggggtctatgtaatctatctccacgatcaatacaattcggtgcatcgccaccttttaccttttctactttattttatcatccggcgggacttggcacttgacgcggggctgcatcggtgttcgatctccggctaaggggtaagtccaatgttccgccggcccagggaattgtatcgtttacgtcggcgtcgttcaaggctgcatcagtacattcgacctcttggattgctctggtttggatgatatatttgcctacctatttatcatatgtatctgttaatctagtcttagcatatcaatttagctctatcggctacttctcgttttagggtttctgccggtatcggctaaatcgtgttgctagattagattagcttagacatctaccaccctgaaaactcagtcaatggcttgattgtctagatattatgtttcttttcatacttagtgctgcatcagttaagtttgtctactaagtcgtgcttagaaccataatctctagcctgcttcttgattgccaataagggtatcatcggggtttcagccagtgagttatctggacgttgcatcggctcataaggattgcatatacatataagttggatttagccgatgacaataaaggtttcactatttaatctaatcttgtggatttcatgacatcggacctccagccaatgtgtgctttaaacctcggatcgatgcttatttatcatatcattgctagccgattggtttctaccggattatattgcaatattatactatcatcagccgattgcttttatatcatcatctacattggacatatagccgatttatcaaaatcctatcgctatcggctggtattggcatcggctattatcgatatcggctgagattgctccatcggcttgtcagccaatcgactgttttgatctactatttgcatatcttgtcagtttcaggatcaaactgactggcacgcccgcatctcatcaatctttggacctgcacaggagctaagcagatctcccaggccagtatgttcgattttttcgtcaacagtggcgcacgccggatgcggacggggacgccatggccgtggccgcggacgacgtcgacgtcgacctcggcatcctcggcaactcccaggggccccgcgccgccaccactaccgggaggaatagcgcacggcggacgtcctcctcctccggctgccaccgccacgcctccccgcatggctgcatctcctcctcctccttcggcggccatcgctgcacgccgccccttctccccgccggccaccgcccttctcccggccgccactgccggatctcgattgccggcgctgctctggggggagctgtgttaacaaccaaatttggtaatatcagcatcggaaaggaagatcagatcgaagcggaatcgaagatgaggattatcgctgaaacagagtaagaattggctggagtccagatcggctatgattggatcggctgagcccgagtcagacttggttaagtgatgtagccgattccgacaatatgacctaatgtacaacgtcgggttgaattgatatgcttcaagatgattgccacgcatggatagagtcctgataaggcaattgtatctattaattaggatattttgtgtaatttccatagagatatgtttggacaaaagtctgccgcaaagatttatggtatcttagagtttgttagagataagagtcgtgtctgatatggacatagtttgtaattttcgggtataaatagaccccgaaccccatgtaatcaattaacacacacgttcaatacactttcggtgcatcgccaccctttttgctttagtttatttcgacgagttcttactttcgggttgagctgcatcggtttcgatcttcaacaagaggtaaaacttgttatgacggcttgcgttctcgggattggtgcttccatctttatgatactctaatattgtttatgtaattcgtcgagttatcatatattttacataatctctggcaatatcgcaatttaacctattatcggctaaacatctgtcggtagaaggcagccgattaggttaaatatcgatgttgactttgattatataggatatctaccactctatgaaacctccagtgacttgattgtctagatattgttcttcttttcatacttaatgctgcatcagttgagtttgatctattaagtcgtgcttagaatatcaatctctagcctgccttctggttgccgattagggtagtatcggggttgcagtcgatcttatcttatttaactatatttactctatatgcttcattgatatgttaaatctgccctttatattaagatcttgttgcatttaagtatattagacttttgtttgatatatcctacttgtcttaatatcttagtataaaatggtatcggagtattagccgatacatgctaaatctgtttgatcggctatgctatgaacatatataatcctattattaatatatatttcgatctaagtgatttatactgtctcggcatagcgaccgatctatctcaatcacttgatttaagtatatatcgatataaggattatatattgttaatatctacaaccgatcgaatagatttagttccttcatatttaataatgactgccgatcgatgtatatatgacatcggctcaaagataaatgatatgtcatcggcacttagccgatcggctatcgtttatggatttaaccacggtttctttgtttttgtttcttgttgattgcaggatcaaatcaactggcacgctagcataacccgcagcgagttttggacctgcactggagttaagcagatctcccaggcctcgtgttttacatcaacaacctgccgccgcccgggtcgatctgttccgcccaccgccatcgccgattcccttttatcgccccagcttcctcctccagctcggtgctctcgctggtgggcgtcggtctcgccgccccctctagctcgccgctctcgccggaagaggagaggagaggggagagtgatgaagagagggagatggggagagaggatgaagaagaggaagggtgagtttgactgacatgtggggcccacgatttttttattattttctatgtgagactaacatgtgggtcccatggattttattatttttccggatcgaattgccacataagcgccacgtcaatgccacgtcggacgaagaccgagtcaaattagccatgtaggcgtcatgtcagccaaaaccgccatcaaaaccgccgagagacctaatctgcactggttttgatagttgagggacccgttgtgtcttattttccgattgagggatgaaaatcggatttggtgtaaagttaagggacctcagatgaacttattccactagttattagtgtactttttcctattaggaaaggcctgttacaagcctaaatttaaccctcctctcaaaacaagaaaggtcaaagctttaggttgatcgtccttaaattcttctgtaggacgtttttttttctttttaaaaaaatcagtattaattctgaccgttgatttcttgtgagttgtattcttagtttcaacttaacagccaccaacatcatttagacggaattgctacatcacatttaacaaaaaaaagtggaggccggctagctataatcttgtagttttcttacattagggaatgcttcacgattcgtgcgagagctcattctcctctagcttcagtgcatccaatgaactacagcaaccgacagcgactcaacaattaaggttcagtgttcaaggtagggtcaagggtggacgctcacaatttcttctttaaaaaaatatttggactttggagggatgtcttttcctccaaatctctttttttttaatattagtcaatcccttatttgaaatcactttgaaatatagatccgtatatataaattcaaattaaccaactggaaaaggttcaaccattaagcaaagtctggttagaacgcgctaatactctctttagttataaatatttgacgcatagggaaagattttgtcaaccttttaaactttgatgcgagcatctccaacagattatccaaatcggactctccaaacacccatatagccaactctccatctaatttggctagtcaaactagttacttactccaacagactctccattatgtatctatgacagcgggacccatatgtcagcctcaaataccccttcttcttcctcctcttttctccccttttccccgagccctccctcaccgacccctctaccacgtcgtctccaatctcactagtgtcgccgctccattcatgctgccgccgctcatcccttcttctctctctccggtgctcgagagcagacggcgagtgggaggccttcgcggcggtcgaaatcggcactaggcgctggcggcagcgagcgggaggctgcagcgatgctcgccgtcatgctacctgctgccgcggccgcgggcggatcttgtgctaattgtctcgccaccgcccaagtctccaccactgcgcagccgactaggcgggaaggcgagaagcgaggcgagatgggtggagcagatgacggggaggaggaaagggtggggcgacggaggcctggggcggagatgttgacggcaatggcgaggctgggtgacgactgtgctgccgcgtcggatggggagatggcggcggtggctgctcgaggcgaggggatttgcgcgacgcttgacgcttctactcgcgggcgatgtgatggtggcgacgccgtgacgatggggagaggtggatgggaggtggtggtggcggcgaggtagctgctcggaactcaggaggcgttgtcactggcatttctcagggcagtgttgcttgatgatgtctttggccagccaaaccagctggctagatttggctagcccacctgatcatttggccagcgagatggcttagccatccaaatggagagtttgttgcacctcattttcttgctatgtttgctattttttaacttggagagtgggatggctgaccggttggagatgctcttagatgcctaaaatctttttaaagaaatgttgagatttggcttggaaagttatataataaatttattggaatttacaaatttattctaatataaaattaaagatcaatgtttcacaagtttaataaaactttatcctaaacattaaatatctatgaccaaagagcatatatactccctttaaatgaactaaacaacatcatacacaaattaaatgtaaagagggagcagtatttttcatggatgcatatgagcatatccaaaacggtcgttgtatatatccggcccttatttaggatagaacatgtgtgctaggtagcacacggtaatcgaattttaatttgtcgttctcataacgtcagctggtagcagcaatactcgttcgtccgttcttggttgtacaaaactaattgcgctactccctccgttttgtaataggtaacaacgttaatgttttatcatatatttaacgatcgtcttattaaaaacattatctaattataatttattttttaagttattttgtccttaaaagtattatgagcatgattgatatcttatacattcacataaaaattttaaataagacgaatgataaaatatatgtttaaaagtcaacaacgttatctattaaaaaatgaagggagtaaactttgccttgtacaagggaccaagaaagagacgacgccgttgacacgctagctagctcactgcattaatcacacacacaaaacaacaaatcaaatgggactaggaggagaccaaaccaatcagtaacatggctatatatatagagagagagagagacacacacacacccatcctgatccagctcgatctaaccgatcgattcatcatcaacaattcacaagaactccatcacttacagtgcaaatcaagctgatttcatcagacaaatttcactaataactagcttagctgccgtagagccgtgtgcgatcaagatcgtatcatccatggcgttctacaagtacggcttcgccttcttggccggcaccggcttcggcgccgcgctcaccagcctccgccgcgacggcgacagctgctgccccatgcgccgccgccgccgccgctgtcgccgccaccaccacgacgacgacgaccagctggtcgacggcgacggcgacggcgaggctgcaggggaagagcgagacatgaaggagagcaagagggcgacgacgacgacgaatccgaaggccaagaaaggcagcaacaaggagaagaaggcagctgctagtgttgctagggaggaggaggatgacgatgatgaataggattaatttgagttgattattaattaagttcagtttgagttcagctattatatatttttaggtgcttgattccgttgctgtgccagtttaattgtgcttgtttagctctgtactcgttatcctgttgtgtgtattgacaaaaataagagaatatacatatatacctctctgttgttaaaaaataagtacctttgtttgacggtttttattttttgcgttgtgaacgggagtcgtcagccatctcgatcttgaggaactcacaactaagataataataaaactagctagtagaataaatttaggctaactcgggataaactcccattttgtgaccggaatggaaaattttctggataaatctacaaacgaattacgcttagcaaaacgataaagattgaacaaactaaggcaagatagagatatataatatgaaaagatgacacaattagctaattgtgtgttggattgttggttgttgtcaataaaacctaccatatttgttataaagatatcggtcttataatatgagagtttctccatgtctgttatagagatcaattaatacttgataaatctcaacacaagcaacaaaatatgagaaatatctcaactaggctcggaatcagagtttactggtcaaactggccatcatggcctggttggactgctagatttcagttagaccggcccatataatggttagatcggcctcttctatataggtattgggctttttaaatataatttggtcttgctataactgcccaactacaaaatttggttgtcaacatacaattccttttcttctttttttttttacaaatcaggaattaaaaagcacctacacatcggtattaagggcaataaaccattatcaaccataaaaaaacccttgtgagcatctcaaaaaaccggatatcttactgtagaaaaataattaaccgtaaataagaagactcggatcgtactaaacaggtaaaaaaactaattaactgagctaagcccacctcactatatttcaacacaattaattaactgcgcaagtctcctagattgctagcgagagaggcacaagaaaaataaaaaggccacaatttaatcgaccagacaaggacaagccttgctcggtgggtggttgggggtattacaaaaggtataaattcctgaagttcagctgttgtagtctgacccttggagaagaagttgatcatgaatcttttatccaccaaaaccgtgtgatagtggccaccccttgcaacgtcagatcatttcaactattatactactagtagttagcaatatcaattactacctccgtttcaacgttggacctattcgtgttatttgaaaaattagtgtaaatatgaaaaagaataagtcatgcttaaagcacttttgataataaagcaattcacaaacaaaataaataataattttatattttttaaaaaataagacgaatgattaaaagttaccaatctatacctaattaaaaaataagtaaggcttccggttaatctttttgtccgtcattaagagtgggcccacacgataattcgtcgctaatccacgatccgaaagcgtggccacgatctcttacgcctgcaaataaaggagaaaagaaaaataaaaagagaaaaccttgtttgtggagcagcccatccaaagcagcctggattggattagtgacgaggcagcccatccaaagcagctgcagaccggcccagatagcagccgcagcccaccagcgagcccacagagcggaggagaagcagcccaccagcccagcacagtactgcgcaacactgtagcaaccgaacacgaataaagtttggactcacgccaagcaggaaaaagaagagatcttattacttaaaacatgtagtcaccaataaaatgaattatttaccgacaaaataaattcttttttaaaaataaaaataatcacatgtgtctttctttttttttagaaagagtaatcaccaacaaattgaatcatgtttacatttggatttttttcgctcatcaattgcttattcgccacaggacacctaatcacatcactttttttttcattcattgtataatttcttctattatttagagtgaaagttattctgcgatataccacatttttttctttccttctgattatttaagtgagtggttatgcaattggagtgcagtgaggttgatctgatagctagcaaaaaatatttcttatattatggctactctttacaatatgaaaaaaaagtgcttatcaatatcgagtaccaaaaaaaaaacaaagtactgcaattgactcataataatacatgacaaaaaagtaaatattttttgtggtttcaaagtttagtatccatgtcagtggatttagagcaacaaataattatatcatgttagcgtcttatttgcactacaaagattcgattcgactataaagacctcaatgaacctggtggttttatgctcccacacactaattactattttttcttcccccaatgcaacgcatgggcattttgctagtaaagactcaaagcgataagtattttaagatggaggtagtattcaactcttgcatagaacatggccatcaataggttattaatctgttgtatactctgcactattattcctagatctttacatttccttagctttgctcccttcaattcctttcttgaacccttgtccaagaaacacatattcatccgattgatggacacactgatgctagcttcttcaatccagctaattaattacacacacataacacatataaatagcagcacagatacacgaattgttctcatccattaacaccacttctcatctgcagttcagacacacacacacacactgacacaaacatatatacttacatataaatacagatatatatatataggtggttagctacctgtatagtttatacattagctagtgtatgtgttgttgttgatcatcgatcgccggcgacgacagggagagatcgatccacgatgggttgcctgctgcggcggctgttcccgttcctggtcggcacggcggtgggcgtgtacgcggcgcagaattacaaggtccccaacctccggggcctcgccgaccgcggcgtcgacgccgccaagcactacgaggaggcctaccgcaagaagccctccgccggcggcggcggcggcgggagcaggaagaagatgaacaagaccgtcgagatcgacgacgacgaggagtaaattagttgatactgctagtgctagctcactagttattacattttctatgaaaacgagcagctagtgtgtatgatatgtaaattattggaatgttcttatgtgtacacgtaaaacttatacgtaaaccttatttgtactgtttctaaattaaaaaattaaaaagaccggatatattaataaaaataaaggacgaaaaattgatcaaatggcgaagtagtggccactttcactattgcaatcagccgaacgtgtaggtgaatcgaccattttgactcccatagaatcagattcgtaatctactactggagaaactatcgacgtttgatgtcgcgattccggtatttgtatagtatggggatcgttggtactaggatatatgtgagacttaggtaaaagagacggagaacacaccagcctatctaactgttgtcgacttggcggtctgtagtactgactcgtagtcgacaacagggtagccttcctcctcgaatccgcatccggcgagatcagagacagcgctatatctctcctgacagtatccgtaggcaccgtaggggactagccatgcctatctctgaaatcgatatccgacgtcttgtcttggcgtatgttggcttgtatgttgatcttgtgtcttgatctattgttccgtgtatgttgattgtgtcctctctcctcctaaggggcctaatatttatgggtaatttggaacc

SEQ ID NO: 63864 - DNA, 1245 bp, Oryza sativa
ggttccaaatttccctatatttatacccataggtgttcccttgtccaagtagaactagggaaaccaatatggatacaatccgagtagtccttgtcgtttccatgtagaactctaatcatccttccttatgcggaactcctcctatatccgaaggttgtttcggatacaatgcacagcctcctgtaccgataggagcaagccggccaagcataatgttctcagtgacacctctcaggtagtcagattcagcatatacagcagcatcaagcaagatatccaccgtctcttcaaaggaacatctcataagaggccctgtgtcattacggttgataccatgccttgtaatagccatcagatgccctctgtatgtcattgtatcacaaagaatggccagatgtctgtaattgacataagaaccatcgaaagatatgaccacccgcagctcatccaagagagctcgacgaacagcctcgattccaagaacctcaattacttcgatcaaatggttacttgttgtcctagtagcatcaacatcttcatggcacatgacagccaagagattaacaccttctgtatcaagcatccactcattatctgctttgaagccaacattgtcctcaaatttattgaccttcccatatttgataaaaactttgttaatatctggaattccacgaagtgccatctctgtctctgtcaacatgttactttcaatcttcttgaggaagacatcatcctcagcagactcatcctgtatttctccctttggagcttcatcatttgtgatgcggacacgaaggatcagtttatccgcattatcatcattaaatatgcatgacaagtcatcatcaaattcatgattgatcttctctgcaatatcagccatgctcaacttcttatcaaccatcatctcacgattcagctcgatacgcagcagccacggtgaaattttatctgggtcaatatcctcatcaggcatttcataataggaccggacaaattcaacatcttcttcaataatggttcccagtggatcaggatcataccatatctctgtagcatgtgtcacactgcgcagagtagtgtactctaaggcacattggacattcttagccagttctttcttcttgttcacctcaggctttaggtaaactgacaatgatggagtttttatcttcttagcaacattaatgatctctctcagcctgggaactccaagagtgacattcttggcactgacaccag

SEQ ID NO: 63865 - DNA, 10277 bp, Oryza sativa
tgtgttaggtccgatcgtacgtgacttgtcgtatctgaacgtgtcgagtcacacctgtgtgttaggtccgatcgtacgtgacttgtcgcatctgaacgtgtcgagtcacacctgtctgttaggtccgatcgtatgtgacttgtagcatctaaacgtgtcgagtcacacctgtctgttaggtccgatcgtacgtgacttgtcgcatctgaacgtgtcgagtcacacctgtgtgttaggtccgatcgtacgtgacttgtcgcatctgaacgtgtcgagtcacacctgtgtgttaggtccgatcgtatgtgacttgtagcatctgaacgtgtcgagtcacacctgtctgttaggtccgatcgtacgtgacttgtcgcatctgaacgtgtcgagtcacaattgtctgttaggtccgatcgtacgtgacttgtcgtatctgaacgtgtcgagtcacacctgtgtgttaggtccgatcgtacgcgacttgtcgcatttgaacgtgtcgagtcacaattgtgtgttaggtccgatcgtacgtgacttgtcgcatctgaacgtgtcgagtcacacctgtctgttaggtccgatcgtacgtgacttgtcgcatctgaacgtgtcgagtcacacctgtctgttaggtccgatcgtacgtgacttgtcgcatctgaacttgtcgctcattggaatattaatcatgttttatcatctaacaacaatgaaaatacgaattataaaaaaaattcacataagacgaacacacaggtatgacttggaaaatgtctggttagtctttttttttttacggagggagtagtcgtgtgcacttgtgtacatgtatatgactgatttatgacagccgtgcatgtgtatttgtgtacgcctaatttaatgtgcaactactactaaatgccaagcaatgaaagcaacagtcccaatgcgtccttatatactacttccattcttctctgatgcatcctgttctccaccattccatctcttctctttctgcctgagctgcatccccagttggcgaacatgaaagacaaggcatgtccgatcgtgtaaatcgttcgtagcgttagtattattagtttaagcgtcgccgttacttcgagttgactcgttctgttcatttgattttttgctagtatcaccgttctggactttgcttggaagttcccatgtatattgacgacggcgagtattttggggatgaaaccggtacccagctgaaatgtcgtcatggcctccgcccgaagagaagaactgcatgggaatggaaggacaccggaagaaggtttcttggttgcccactggaggaagaggaccagtgcgacgctttgttttgggttgacgaagaatggcaaccaagaatacaaaaggcatttgagatgctctggcttgcattggaccatgcaagtacacgcaaccctaccaaggcgcagtaccaatggtcaaattttgtagacagaacaatagtcgaagaagacaaaatgaagttagaatttcagatggcttcacagatctcggcaatcgaagcaaaacataagaagagagtttccaggataaaaaaggaaacagaagacctcaaggcttggcttatgggttccctagtcgttattgcatttcttttatttaaaattatcgaaaatatgtatcagggatgttgatgcttcaaatatgtatgacgtgtgttgatgcggctttaaatttgtgtcaatctatttcattgctaattatcacgtcacaaaagcccattgagtggcccgtttattgaagcccataaggtggcccattttatagacaataaaaggcacactctctagggtttcccccatccacaaccttcatcccatctgaccgaccatgtgaggagccagccgaccccgccgccgacacctccgatcccgccgtcgacgccgacccctccgaccccgccgtcgacccctccgaccccgccgtcgaccccgacgacgactcccccgccgacgaccacgccgacggtcctgaccccgccgtcgacccctcagaccccgccgtcgacgccgacccctccgaccccgccgaccccgccgacgacgccgacgactccgatccctcagatcccgccgtcgacgccgacccctccgaccccgccgacgacgccgatgactccgaccccgccgactgcgccgccgactccgacgtggcttcaacccctccgactgcccgacctcgcctacgcagccgactatggtgaacaacaggaaggttgttatccaagtcgacagtgacacgggtaatgttttgcatccatcgatttgtgttaacatttttttgatgaccgtgaattgagcaattgatttgtgttaacatagatgaagaggtaaaatccgacagtgacactgagacagaatccgagagtcatatggaagaggaagtagacccttcatcgttttttgctagtgtgcggcgcgaaactaccaagtgtggttagtatgcttgttttaccgagactatcaattgaggtgattgagtttttttttttttggtattatctattgtggttactatgtcggttcatttgtgcagggccaaacggcctgcagtacgctggaggctttcatagtagatgctggtatgaaaacgatgtgtacttgacaagggcataccaaatgaatgttttttttgttttttttgtatccttccattgctcactgcacaataaatgtacaattcgaactgcacagcaatggcagccgcaataaacagcaattcgtgattcgctgtaacttaagcaaaacagacttaaatcacataacagacacaagagcagcatttcaatcccaaaatacaagtcaaacacaagagcatatcattctacaacgcacagcaatgccaatacagactgaacatcaataataaaagcaagttgcatactgccagtacgtctcacattaagttcttaatacatatattcatcaatgccatacaccacaaatattcatcaagttccaccccatgttgcttcatctcagaacataaacaaactaacaaaaaatacatgttcctttcctgtcttattcaacgatgcaatttgacggccaactccatcgttctcacacatcaacacgtactttcctgaaaaaaattgtgaaccaattaaatacgcaggtattttttccaattgaactagcttgacttgtcacatataaattacctctcgtaaattggacacgaacgaatggtatggccaccgttacggcaatagccacaacgcctaacacgcttctccaaaaaacctctcaatctttttcgcggtgctcccttcggaactacctccatgggatcatgtaccaaaacatggccactaatgtctgtacgtaaactttgacctaccacgtgaccacacagtgtcctctctatttcgttaccatcacaatcttcagtttctaaatccaacttttctagcatctccatcaccttcaatgtacattcctcagatatggagcacttcattagtacttcgctaccgaagctacgcaacatgcgatacctttccatttggtccgaccatgaaaatgtctcaccatatctatccgacggaaagacacttttggctttcacagtccacctgcgaactatgcaactttcaggaatggcatccatcttcaaataaaacagaactgcaaacatgtgctgacatggaaggctttcacaatcaagtttcatgcaagggcaactcattgtcttcaaaaatgattcctcataagtacagttcaaaatcttcagcttctcattgttctctttcaagcacatgacatacttcactactgtatcctcatcaataaaatctattacttcccaatccatggatttaataatctcaaacttaaccttcttgaaaattgcaggtgtatatatgcgcgctacttctttctcaattaaacttgcatctgtacacgtgaaggggactgattgtgaagcttttgaatctagctcagcctccctatgtcttatacgcgacacgcaatgttcgtaatgctcaaccaatacaactaaactcattgtacgatccaaatgcttatgaagttttgaattcaaactttcactatgctggttgcttttcattcctagaaagtacttaccttttaaataagcagcagcccatttcttccttaagttgtacattctaaccaaccattgattatcttcacccactttatgtttgtccttgaactcaacccacttattctcaaactcttccggaccataagtagaatggataagtgccctgaaatcagccaacatttcaggccggagatgtcttgccatattctattctatatgccaagtgcacaacctatgctcagaatgtggcatcacagatgaaattgccctacgcatagaattgtctccatccgttatcaaacctctgggatgtttctgacccatgcaatccaaaaactgcttcagaatccactcataagatgcaaccttctcatcagccacaatagcacacgcaaaaatgacagtcgaaccatggtgattcacaccaacgaatgggatgaaaggcaagttatatttgtttacccgatatgtgctatcaaaaacaactacatcaccaaacgcatcataatctatacgagattgagggtctgcccagaataaccttttcaatcgaccagcctcatcggtctcatactcaaaaaagtactccatgtcatctttttgcctagcttgcatgtattttataacatgatctgcatctccacctaatatctgtttcttcttctgtcttacaaaaaaattataaaggtccctactcacaaaaccagtagactcaaaaccaccatgacgcctctccatgacatccatcacttggtgctgacgcaaaccaacttctctcaactccacaacatttgccttctgagcaatgctaatatttcggtgagaacgaaggaaaggaacttcatcagatttagccaaactatgactgtgctttgccacaaacttcatacaaaccaatcaccctgtttcttgtcaagtctaatctcaaatatagctttgcatccacaacgagttagtgctctaggttctctgcttttgttaccaatatccatataaacatctctcctatacccttctcttgagcaagtgtactgcctaaatataacatcagcagtcacaggatcacgcctagcaaaatttttccttatactaaatcctttccctttcgcatacctgttatagaacgtgaacccgtcgttctcgctcttaaacctcattgccatgaacgtagcatactcctcttcctcctctaagctactgaaattgtctgccatctcatcaaccatcatgattctgccaaaaaaataacaataatctcaatatataaaacaaattacacagtatcacttcaaacaatttacgacacatcgatttacctgtaacaggaaacacacggccgttgcagaatactgaaacggcggcagtaccttctggcgatgaacaagattgctccagcgactcagacaacggcgactgctacggcggagatgtgatttggcgcggcggctccttccggcggcgatgtgatttggcgcggcggctccttccggcggcgatgtgatttggggcggcgatgtgattaggggcggcaagtgcttccggcgatgtgaattgggccggatgttgcttccgccgtcgggcgccgatgtgagtgaggcgcgattcagagcgatgaaatttgggcgggcggtgggtcggggcgatactgaaggcggctagggtttgcgtctcgcgtctgatttggggagtagataccgattgcggtgcgccggcgccaattccaatcctacccgccacaaaatcaacggctggatgggttttggtaccacgcggtacaagtaccacgcggtacaaaacgcaggacgggagcattgctcttccatattagttttctttgcagcccggctaaatataggtctcaataaaccggaaagagcatatcaaatacaatttagaattaactaattaattaatacatcataagatcaattgcattttggattgaaaaatataataatttagaagttttttccataagaacttcaaattgaaaatcctttagtaacttctatttgaataaaaccgtggttgtgttcggcaatagtgatttgggagaaaatcccccttgttattcatgtgcacgttttctaaattgctaaatgatgtgctttttcaaaagaagttttatagaaaagttactttaaaaaatgtattaattcatttttaaaatttaaaaataattaatactcaattaatcatgcgttaatggttcaactcgttttgcatattttttcgatcttctcttttctcctcctcttaaacacaacccttagatcaaaaattgttgtctaaatgggacatcattcttgattttttttatctattgtaggatgaaaaatagatgtttgagatttgtttacgtcatcctaactaaaagttttacttatggtttaatttgggagtaaaagttttacttgatatgacgtgtacaaaatttatacgtctatttttacatcctacaatattttttaggtttccattacatattagccacacaaagtcgtgcatttgcgcgaccaagagatgcatctttgttaaatatcttaagatttttctcttacaattatagtggctttgctttcttgcccctaaatattactactgcgaagtagcccataaattacataccactacaacaatatctttatgtttttttacacaacaccaattcatgtatgtttgttttacttatttcacttctcaaatttaatcagcacgagatcaaatagtgtaatcatttcccatgcaaatcaatatcccatagtgtattttccatgcggtggactcttgttgcttgcgatgtgtcaaaggggagacgctagaagacacaggagggaagtgcctagtgcatgtattttcttttactgcatggatgttctatgatcggatggccatcttttatccaaacattcatccgatggggcgatggccattgtttttcggattacgtggtccaatatgctgtcaagaatgattctttctttcattactttagatatctaggaagcatattctaggatataatcattagttgcacaccgaactggtattatgtgccatggcatatcaaataataattcaaatttgttaatttgttcgtgtgatacaataattttatgtcctgaaacatttatgaggagcaacggaaaattgtagtaaagtgtatttgtggagtttttctttcaaggatatttgtgcagttttttttttgaatggctaaatagttgttgataggaaatcagggccaaaatcttgcaaatttctaatcataaaatttgcttcgtgattcacactctggcgaccttatttctatctgccctatctccagcgatgccatttcctccagctctgctgaccgacgatggcccgatgagttagggtttagggtcccgggtaggataggggtagggcagagggaagaggaaggagatcgtcgggcttggagggatggccgtggaaggcgaacatggataggactccagtgttggagccaaggtgttggaggagatggcagcgggccgacgttggttgcgagggccaaacagagcttgtggttaggcggtggcgaccggtggtggtggaggggagtcacaggacacgaagaagatggtggggggcacttgctaccgtcgtcgccttagggaagagaggggggggggggaggtggcttgatggcgccgtggaccccgttcggctagacggcgatgtggggcagtagtggtgcaggaggcgacgggcgggaccgaggaaggaaaggagaaaacaatagggtttgaatacgttacatgaatcttaaagcgatccaatggtctagaattttgtaagatttaaaagttttttttcctaccaaaagccatgtaggcaaactttcttttttaagataatccaagaaatgccattgacaagcgtccaagtcccagaaatgctatcaacaagtgtgagttccaagaaatgtcatcatagaaacgattttatcctaaaaataccatcaccgttagggttccgtccattttgtgacattaaaaacactgttcatcctatagaacttaacggcgcaaaatggacagaaccctaacggcgatagcatttttgggacaaagtcgtttgtacgatcgtatttcttggaactcacacttgtcgatggcatttctaggatttggatgcttgtcaatagcatttcttggattttctcttctttctttcttttttcttttttggcaaggatacctgtggtgggttttatgggcatggaacgtaaggacaccacgttgtcctcatgacaaatgggctaacttgtttgatcttagatactactccctccttttctaaatgtttaacgccgttgatttttttaaacatgtttgaccgttcgtcttattcaaaaacttttgtgagctgtgtaaaactatatctatccataaaagtatatttaacaataaatcaaacgataggaaaagaattaataattacttaaattttttgaataagacaaacggtcaaacatttttaaaaaaatcaacggcgtcaaacattttgggatggagggagtatatctctctcctttaatatttgacgttggttagtatcatatttagctagccaacgtcatatataatagtggaagggagtaaattttaaattcctacttgttcttaatacttattgttctattgttctagtagtccaccgtttttcttggattttcttcaaaaagtgaagaaatttacgtgattatgagtgaggtaaggaaaaaaatgaagaaatacgatttgtccatcagtccattggaaacgttttcggcaaattcaaatattccacgttgtaggtgagctctgcttttgggaaagtcagttgttgacgccgccaaaaattccagtcctctccatggtagtcaacgtcaatttctcacttgtactatatcctaacgagtttttggttcacacctgtttaatctctgttcgaaatcaagaaaagctggatggagtagaggatctatgtcgagtttagctccaaactttttctttaaacttttaacttttccatcacatcaaaactttcctacacacaaacttttaatttttctatcacatcgtttcaattttaaccaaacttttaattttagtgtgaacgaaacacaccctagcatgtatggcattgtgccaagcgtcgtgtcctgaactccagaactccagaattccatatccatatcgtacctacagcgaagggaaggttcagatttcagactcgctgtggtaggtcagctcggacagtttgaccacgccttggccacttccgctactccactccactcgcacggtcgcctacccagttttctggccttagcggcacatagatttccgcccaaaaccatccaccttttgccgcctccgctcgtgcgcagcagcgcagctgccttgccgtttcccaattcccacacgccatgacgccaaccaacccaagcacagcagtacaccacacgatgtcacgactcacggacacacgggctatatatatcgacgtgccacaccacaccgtacccaagcaaacagatttccaactaaacttgtaccaaaacacaaacgacatcggtcccagtcaagcggagcgcacgaacacaacgcagagcatggcagcctccgtggtgagggtggccatcgccaccggggcgtcgttggcggtgcatttgttcgtcaagtcgttcttgcaggcgcagcatcctgctctcaccttgctgctgccggtggctgtgtttgccggcattgcggtgggcgcgaagggcgggaacgggggcgacgggaaggcgccgccggggccggcggccgtgccggtgttcggcaactggctgcacgtcgggaacgacctgaaccacaggttcctcgcggcgatgtcggcgcggtacgggcccgtgttccgtctgcggctgggcgtgcgcaacctggtggtggtgtcggacccgaagctggcgacggaggtgctgcacacgcagggcgtggagttcggctcccgcccgcgcaacgtcgtctttgacatcttcaccgccaacggcgccgacatggtgttcaccgagtacggcgaccactggcgacgcatgcgccgcgtcatgacgctgccgttcttcacggcgcgcgtcgtgcagcagtacaaggccatgtgggaggccgagatggacg

SEQ ID NO: 63866 - DNA, 3061 bp, Oryza sativa
ctgtgggagaaccccgaggagttccggcctgagcggttcttggagaaggagagcggcgtggacgccaccgtcgccgggaaggtggacttcaggttcctgcccttcggcgtgggccgccgcagctgcccggggatcatcctggcgctgcccatcctggcgctcatcgtcgggaagctggtgaggagcttcgagatggtgccgccgccgggcgtggagaagctggacgtgagcgagaaaggcgggcagttcagcctccacatcgccaagcactccgtcgtcgccttccaccccatctctgcctgaactcatcgaatccctttaaattatgattgtgtcaggagcagattaaggatattatacagcattaatttcgatttgtcgaacaaaattagacaatagtaataatgcaagggattttacatgttctgttagaaaatatattttgtgaactgatcttatcattgtcagtaaacaagtgtggatagtactgttttccataaaaatcaaatttagtcatttttatttttatctggtgttggtagattgctctggtcgctgactgaatttttttattaattttctttttttatatattttttagaggagggtaaaaactgttttccatgaaaatcaaatttagtcatttttatctggtgttggtagattgctctggtcgctgactgaatattaattttattaattttctattttttattaattttatttatttttttagaggagggtatttttactcgtcctctacatctaaccggatatatggagcctttttaaaattattaggaacttagcccatcggacagagaacttaacttagccctcaaataacccaattcgaaattcgatactcaggtcagtgcaatcactaggctacatgccctttcacactgcaaccattattaatttatttttgcggggaacaagggatttactcgaataaacgagtcctcgcacacaaggtgcgagatcatattacaattatcgtctggccagaattccatcatggattcacaacggcctttatttgctaaaaagtgactaactctattttggttcctatgcactttggcaaaagacacttcctttgttccagtcatgagaaagcgaatctccctgactataaatccttcggctgacagcagcttctcctttgaattcaacagctgaataatttccagacaatcagattcaacggcaatcggaagcagggtccactgcaacgccaggttgaggccatctctgcaagcaatcagctctgattccagggccccattgcatctgccaatgaaaccacacgtggagaagattactcttccgaaactctctctcaagacagcaccagtacctcctctcccatcttgagggccatacgacccatcaatattaagcttcatccatcccggttttggccttgaccatctgggtgggttagttgaacatttaggggctgtttggttcaatgcttcaacttgccacaccacacttcacactttaggctgccacacctccttagccttgtgtttggttcattaccttagttatggcaagccacactttcttactatcttaccctatatgtcatagactcaatcttttgcctaactttactacaagtgtggcttacaatttgtaggccacaaaaagtgtggcaagccacacttgcctaacattgactaaagtgagttatggcaatgttagttaagaaccaaacatgctgttagccttaactctgctccccattccttcaggtttacaacatgcttccctttcataagatttgcaaaaggatgctgcttgatttccactagggaatgaacataactcaggataaaatgagtcgaggcctctagaggaggggccggctttccgtgagttaattcgttgcggatgtaccagatgcgctaaagcatcatcagcacaagggcctgttcatcgtccggtaccaactgaagcatgtttaaaatccagtctggccctgcccagccagctgaaaataggcttgagatatgcttttccttcaccatcgactgccacatactcctagcatgagggcatctgtataacgcatgacccacatcttcctgttcatggccacaaatactgcacacgtccaacaattccaaaattcctcttcttcttgttttccatagttggtaagctatttgtggctgctctccaaccaaagattttcactttttggggcacattacaggaccagatcaggttccaccctttcttgatggcgtagtccgaggagcacgagcattcatcctgtcgagcaatttgcattgccaactgataagcacttcttaccgaaaaacgaccaagccgatcaggaaaccaaacaacaaaatcctcctcttggcgggaggatatcttgatctttacaatttcttcaacatccaccgggaggaagattgcagaaaccaagttctcgtcccaagaaccatccggtttcaggatgtcagaaacccactttaatctattgttccttttcattgtgattggccggcgagacatgttcctgggaatccagggatcccgccacaaccggatagaacccccatttcccactctccagataatccccttctttaggagttccaggccgtactcgattgctttctagcctggcgaagcattgcccgtaaagctagtgtcagtgagactaccacatggataatacttcgctttgagaattcttccacacagtgaatctggattatcgatgagcctccaagcctgacgtgcaaggagtgcctgattgaacaatctgaagtccctaaaacccaagccaccgctatgttttggtttagttatgattatataaaaaaatatacacatacacaccacaacacacgtacatcacactcactagccacatgcgcgttgcgcgactctgattacttgcaccgtcacatgtgccaaagaggtaaaaggaatatccacataacagtgtgagatagtataggataaatattgatctcaaaatacagcttacagagcttttgatttttttttattaatgctgacaacaaattaa

SEQ ID NO: 63867 - DNA, 2006 bp, Oryza sativa
atttggcaaatgttgcccactctggatagataccatcagctagatagtatcccatgttgtaatctgactcattgagagtatattgaacaggaggtgctcttccttgtaggacatcagtaaataatggggattggtctaacacattaatatcattatttgaaccagcggcaccaaaaaagcatgccaaatccataagtcttttgaggcaaccgcttcaagcatgatagtgggtaccccataatcaccacgtgtgaattgtcccttccatgcaaccggacaattttgccattcccaatgcatgcaatcaacactacccaacatgccaggaaatccatgtgcctctccaaactgaagtaagcgttgaatatcctcttcggtaggcctacgtaaatattgtttaccaaatatgtgcctcacaccttgaacaaaattgatcatacactccattgctgtgctttcagctaccccaaaagtctcatccataagatcagctggagtaccatatgccaacattcgcatggcagcagtgcatttttgaaatggtgaaagacccacctttccaaatgcatctgtcctaagacaaaaatatggagaccactcgccaagagcttgtacaatgtgcaaaaaaagatgcctcctcatgcgaaatctcctacggaattgatcatcggtgtacaaaggattgtctgaaaaatatttagcaaataacctgttgtgatcgtcttcatgatctctactgatgtacctgcgtgtgtagcctccacgctgattagagttcccagctaggcgtgccatcaatttcatctcaagttgagcttcaagccgggcttctagctgagcttcagtaggatcattaatttcttcccacatcatatcttccaaattctcactagtgatggactcatcagaatgactagaatggacttgtgaatcactagacatctttgtgggaactaggtggctttgttgagaatgaactgaattaaaggcaatggtatatatcttgctgaactgcataccctgtttcatagaagatacaactgaatggatatgtgctaacatctcagtgttgcttttgttccaacagctagtttccaacagctatattccatacaactatgtcatgacttgttgtttggatgtattccaacagctagattcacagcaggcatgccttgctgtttggatgtattccaacagctagattcttagtagccatgtcttgctttttatatatttaaacaatagttttataaacatccatgtcttgctttttatatattgaaacaacagttttataaacatcaatgtcttgctttacaactattttaaactatcacaacagcaagattataaataattgtgctaattattgctgctacatatgtattttgtaggctgctgttaaatcaagtgctaagaaattatgggccaacaacttcaaataagttcaattaagactgtgggctacatattatcagtacataacatcttctacaggtacaaagatacaaccatcattcactaagtttacaatccaacatttacttagcctacaaacttaacactgagttcacaagtctaataattgctaagtctaaatcctagcagcaaattgatcatagaccacatagtggcacactaagtaacagggatacaacatcacttggtgatcatttattcttcagcaagttctgtagctagcttttcgaggacagcttcatgcctcttcagttttgcatcactaaaatttgaagtgtctttgtccaacaattttaagtatgtctgatacttctccattcttgtgtattccttctttgcttcagctgatttcgatgttgcttctgcagatttcagcatcgcttctgctttcacttttatagcttcattgtaaagaacaaagtcttgacatggctggtctcccaaaggagaaggtgcgacatttttacctctcccttttaacttggctttggcttttttctgtccctcagggcgcttctttttgc

SEQ ID NO: 63868 - DNA, 15990 bp, Oryza sativa
  unsure (1)..(15990): unsure at all n locations
taaactctacagctacagccttccaatagtattctgccttcttatcattaccatttataggatccactgaattattcagccaagagctaaggagtcttatgttttcctcttcagtccagttgactcgtgttcctctcctccctgcctcttgactgttgtcacttgactcttcgatatcaaccacattgttctcttcatatcttgcagggcactgagaggctgattctgatccgtgggaagaagcagacccagtaatttgattaggtgagtacacccaattttccggaggacgaaaaccttgaaaactcactggtgtagagtgtaaccaatgtgcttgctgctgaaaaccgtggaagcttggagtagaattgccatatggttgatagttgtttggagccccaaaaggatggaagttctgaaaagtgggtgttgaggattgagaaaactgggattgggagaatattgaggggaactgtggagaagtggagttttggctaccatttccagaagtttggctttgggagccctagctaagcatgtgcataaaacctctgttgggaggatccatcttatttgatgaaatacagaaaatgactgagttgtgtttgtatttgtagagggatgaggttgtagcgttgttgcaacaagttacaattgctacaaatgtaacggctaactgctactctattattttagtgcaactctctaaaatcactgtacacatgctatattttatttgtctcttgccggcagtaacactactgcctgattcttgctgttatctgcccccacaatggctattacctggttggacgagtgcatttattgtttattacctgctttttaagcacattgtggttgcccttatcgagcggcgcctcccccactcctttttctccgcgtctgccgcccactccgcccacactccgtcgcgcatcgccctgccgccgacgaccgtcgccatcgcgccctgccaccggcgaccgccctgccccgcctgcagcggaatccatgcctcctccgtccgtcgccccacaccccccaacccacggcgccactttcctcgacgccaccgcctccgtccaacactccaactgccacgcgacgccgccgccttctccctctccttcgtggtccatcccatcacggcgattccccgcctcctcgccgccgtcgccgctcccactccccatacccccaccccagtttcctcgacgccaccgcagcgcatagccaacggggccgttctgtccctgctccccagggacgacggtggcgccgccgccgaccgcaaggcgccggatgtcaaggacgcagcctcaaggtcagcctgctcggcgattgctagatcggcaagacctgtttcatggtaaattctcccatctcctcctcctcctcttcttcttcttccaatccattccaatctcttgccatgtcgctttactgcctcgttaactccatcttgataagctttcccactgttatgttggtttcttgtacatgctatttcaagttttcaaccaagaagcaatccgaccctgaaacatgagtcagcaatccaacaaaaaaaaatcattttgaggttcagatttcggaaaactgctacttaatcatttttcattaaagattttgagcttctttccataggccatgcacacgaattttttttagcttgatgacatctacaactaattaagaatacctatgtgaaaacgacaagagagcccaaatcaaacctgaatcgagcacagcatgctaccgataagtttgtgcagaccgtgctgacctgatatcacccctacatcacagctaacagaaaaacaactcctcatgctattgggagagcctcatgcttgaaaatgtagttgcgtttcttttcagccacaatgaatagcaggttactgaaaagttcagatgagttcttcagtactcgaaatttaatgggaagtcaagtttaacccggtttaattctgacgaagaacttgacaacaaaaaaaaaacagatgcctgcatttggtgattcatacagataggctgtcatattgctgatttcacctggaaggagatctccttgccacctcaattaattgcacgttcatttggaggcttaattgtgcagcgatatatatcttgtttgcaaggtgtgtcttctcaatggtcaaacaaattcctgtcacttgttggttaaatatggttattctttatgttcttaacatttttcagtttctccataactgaatttgcatcatcaagaacaagtttcaatcattatatatgtgctgaaattccaaaggtttcttgtttacttaaattagacagaaaaagttgtgaattattcttcgaattcctgacaatgattccaaaggttgggattttttttcttttgttttgttttatgtaagcttagtagaaattgttcgatctgatcggggtatttcggtgctcttaagtttgtttgaatttaccctgtattactgtactgtgcttacattttagatcttatcaatcctgtatttctcctgttggatattctgaattacctaacctgagctcttattaaagccaagccaagtttctggaatgactgccagtctgtcagtcaccaagatatatcttcagatttaccaatacccaaatagaggaaaagttcttttgccactgaaaacagggaaaagtatttcaagtagtatggattaagcctcttgcagggcatttgttcggcagaactcactgcaatatataaagctgtaatcttgaggtgttatagccctaacgaaatattcagggcactgctattatttcaccaagtagaataaagtaaaaaaatattttattatgctattgtgctgcaaattgcaggaagataagctcttttggtgcaaccaattatttttcagcaaacaatgatccttctctaaagttttggttataagctagaactgaatgagttgagaggttcttgtctgttcttgctttcaattgcatctttcggtagataggaatgcatgatttgtaaccctttcagcatatgcttttcgccatgtgtttctcttgacttctgtactccaacatatattgaaaaaacaatatattttgatgactagagtctgtcatctgtatgaaattggaatgcactagaagtgtggtcctcgatttcgccttatggtttgtactggactgcactgaaaattttgaacttgtgcattacagggttccaatggatagcaattttggggcctctagaccaacatcgctgacaagatcaggttagttattcatataatataatataatataggtttatatcttaagctgtaccatatttggtttatttgatctgataaaggatgaaatagagatgggtgcctcaaaaataactttaatggcctcaatagttcaagacatttagacatgtttttcttaattatgattaattatttcacatgcagagcaaccgatgttgttgatagtaatcttaaatgagatggagtagggtgcaatcctaccagctgcacttagactgccctggtgaatgcattttgcaagggaaagtcagtatgagaagactgaagaagtgtttgaagaatgcaacaggctagccacgagaccgaagtgtatgcttatgatgtcctcatggaagataaatggtggtcatcataaatccatggctacacgagcctacgttcctaccgacatctggatggaattttttacttttctttaagtttggagtaatatacattgtatatatcaatgcaccacagccatacaggattgctgcaaggcgcttgagggatctctccttgatgcagcatttggtgaggggtgattgtgacagagcttcatataacatcttggtggatgcatatgaaggtacagatggtggtagataatttgccaattttgtgataaaggaaccaagaacttgagtgccatggtgccactttctaaaactgaaagcttttgaatttgctgctaattttcagattcagaagcaacattcaagcaactgaagcagcaggtgatgacattctcgatgaagacattcttacttctgttgttggcgcgtgcaggtctggcaacgtggtgaggatcaagtggaggtgatggcatggctgcacaaatccggcatgtcataactattgataatgctatgcatatggccacctttatgaaagcttttgattatcttgattatggattatatgcagttgtccaaatatgtacctgctatatttgaatatacggcatgagtgcataatgactagacccccccccccccaaaaaaaaaaaaagtgatgacttgtttggttggccagatatttatgaataattttgttgtttggggataatcagatattagagtaatcataagctgtccgttgctataattggtcccaaagaggacctatgagtctacatccatggcatatttgttcttttggaatttatatcttgtaattgttgatcgacatcctgggagacgtcggagtaacttttttctattcaaatataatattgccttctagcttacttacagtaatgcagacacgtttatatattttcaagttacaccatatcatattacttattcaagatccgtagcaacgcacgggcacccgactagttaaacacaaatttccgtagattgtttacttgaggcaatagtatgacaaggaagaacacttagtgactaatggttgataaggaattccagtgcagatgaatgtactcaaggagccaaattcgacaatattggtatggttcaacaccaataccaagaaaaaagaatgtgtaaatttctgacttatctacatcatgtaatacaatgacttctgaagcagccaacttgcatataattctagatttttcttatcacaacttgtcacagctataactttttagcagctaacttgtcacaactaattttttttggcaactatcgaattaatcaaatactcatggaatttatttggaaacttaatttttgaattttatatgtttgtgtgcaaaagtaatgaaatactatctcaatccacttataaaccattttgctgctagtttgaaacccatttgttgtcatatgcattttgaaatgagtataacatgatatatgaaattcaattgtgcatgtacttcctccgtttcacaattttacaatgtaagtcattctaacatttttcacattcgtattgacggaggggtaattgtttatcattaatgaatttgagccatcaacacatttttctgttgtacaactataatatttattgcttaaaatctttctatgtttgtaggacatgttctttttacagtgaccttaaatgaaatctgcatactaaaaaaattgcaaatacataagtggctttaaacaccccgttttagaacttgttgatcttttttagtccaaacttactatttcagatttagatcttcaagttttttagacataattacatcattaaaaaaataataaataggcgtgtactgattccactttagcagctaggacatgcatgtgctcaacttctcagagttagctgaagacctggtatctgcacatcatacaatgaacactgtcaggagcgagaagttatactcaccattgtagtcaatgttgacttccccaatcgtgcagtttttgggacctttaatctttcccctggcaatcttcaccacagggggacaagaagaactggatcgagccatgctaccgaattagatccctgctattgatggagcgagcccagatcaatgggaagaggcggtgctgttggggatgaggggaaagaagagggggcgtggctagggccgaattttttttatctgaacacatgcaaaccactaattgtaggatcgaatcataagaactaagccaaccagagagggggtgaatggttgatatacctcaaaaccaaaacttttagcggaaataaaagttaccctcaaatcgatggatcgcggtctgaccgaagtagatgcaccggtctgaccgcctgaagaacgtcggtctgaccgatgtagatcgatcggtcgaaccgccgaagtcgctcgtcgcgcctgtcgccgccgtcggtcggaccgcccttacgccgccggtctgaccgccgccttgccgcggtctgaccgccggtgagtcatcggttagaccgttgaaacctggtgaaacacaaatcgaagaactctcaaagttgatgacaactttattgcttctctttgtgtttacaaagtgcaacaatagcactccttacaaaaatctcgactaaactcaaaaccctagctaaactagcaactcaatcgctctccaaagcgatacaaaagcgataccggtaaccctcacgctccccctctatttatacatgaggtaggcagcctaaagccacgaaccaaactcatactaagagttctaaacaccttagaaaaccctctagtacaagacacaaacttaacataaccaatcgtaccaaatttggactccttccaaatttgactccgcatcccatatacacacaatacctccatcgtatgccatatggaatctccatcaaccacgtgcatcaactctagccttagtatcccgcatgatatctgaccaccacggacatcgtcttaccaccaaaccgactcccagtccatcaccgcaaatactctcccgaggcattgagtcacctacacatgaagcaaataaagaaaccatattccgagaccaagctatccccaacttgactcattgttagcaaacaacggtattacatacgtatagtatccatctagaagccataaccatgaaacaagcacggatatccaaagaaacaacccgaaaccgaaaccgacacagcgtcggccggtcagaccgcgggccgggccggtctgaccgcacacatagcgccggtctgaccggcaacctccgcccagtctgaccggtcccgacaaaacaacaaaccttgttcatcacctgtccaaaaccacttcgacgataatctccaaatatcaaaaccaataatcacatatgccaattgttcatcacataataagaatcaaaacacacgttgatcttacactaattacaaatgtgagcacgtaaaagttggaattctaggtctaaacaacctgcccacgtcaccaccgtaaatccagttgacctagtgctgtactgtccatgatatgggctcctcatttcttatcctgttagctttggctcagtgccatgacggtagcctcgacacgatgatggtgtgtgtatgtataaaccatctaatataacctttgacagtgacagtgttagcgtggccatagtgcaactaaaattcttctattctgagcacattgtgatcgactaatcaaacttgctagcatggagcaaacaattgatccactaatatgaatcgctagtattgaaaatttagtagtataataccctaattaaaccctatgattttcatactaccggatgaattagatttgaacaatggagaaaactccccgtaatgatgcaactaaccaattttagaggtgggttgttaggctaacatgattagttcaacggccagtttgttgggctactgattagagggaaacatatcgctgtatatgagcatcttgcctaaataattaaatgtaattgttgtgtgctcacatttgtaattagtggtttgcatgtgtttagataaaaaaaattcggtggctagggggaggcagaggtggaagcggagaagggatggtgagaaggagcgacgggaatgggaggaggcgtcgccgcgacggttgcggcgaggaggagaggaggggaggcggtaaatgcggcaccacaacgcacgggagggaggggaaaaataaaaatgtgcataggcgggaggaccggaagttgagagaagtatctggaagagcattttttttgaaagatttcctgatctgatctaacgctccttgtttaccccatggttgtatcggacggtcgtatgttttcggatgacatggcccaatcacagttcgagaccagcgacaactttataatctccctaacatctcatattacaatcgtacccttatttgtaatattttgttcatacatccacgattccatcatcgtgccacatgctactccgattcaattttattatgacaaactattaaaacattttttttaagacaaggaatggaaatgtgcacactattgctgcaacaaagcaaaaatttgcttccacccttgtggataaagtctcttaccgactcctgccttggaagggacgacttaccactctagctggctattctatgttagtccagtcggttctctcttccatcccggtccatgtatctatgacgattagccttccagtctgggttattaaggccgttgacaagaaacatgacgtcttcttgtggatgggtatggactcggctcattgggggagggggggcagtgtcgggtgtcctggacgaacgtctgtcgtcccgaaacctacgatgggttggggattcctgacctcaggttggcaggatttgccatgcgtgttcgctggctctggcttcagtgctcagggcacccctactggcagggacgaagctagcatcaaaacaaggggggtgcactaccattgagaatctagaaaatttcactacaacactgtacattctagtgttttttagtgagaaattaggaatttggggggagggggggtccctgngcnccccccaacataatatagcttcgccacttcctactaggatggcctgaaggccccagttgagcaatccgtctctgacatgttcgcggcatctactttcatcatgctgggaaatggtgagtttatgctcttctgatctaaccaatggatcgacgaccgctcgatggcatccttggttccagatctcttcttcgccgttccctagcatctccgaggtttgagcacggttgcttctggcctggtgaacaacttgtgggtctctgacatccacggtgacctcactgtcctggtcatctcctagtttctccttatttgggatgcggtgcttcacgtacagcactcgccgggtgtcgaggattgtctcgtttggcgttggatgtctgaccagcggtaagcgcgttgggtgtactaggctttcttctatggccagcattactttgcctgtgctaatcatttttggtacgcaaagggtcttgctaaatgtaggttcttcctttggtttacattccagcaatgccgctggacggctgatctcctccagaagcatggcatcgtagtcactcggcctaccccttttgtgctcaggatcttgagacgacaaaccacatcctcctcgactgcgtgtttgctcggcaggtctagctccgtgtgcagctggttctaggaccggtggctgtcctccagggcctgcttacgtgagcatctccgcgccggctttgactctctggtgctcctggtttcttggcagctgtggaaggaatggaattatagggttttcgactctgctttctctacagtctcagtggttctggagtccatccactcggaatgccatctgtggtctttagctggcgttgttgccgcttttgggatctgttgggagtgtagcatggctcggccccttctcgctgcttggagtttgtgtttagccaccgtagttttctaagcttcagctttttattttgccttttctcccttcgcttggcataagccggtctagctgattgcgttatgtaactataactcttttcttctaatatattgacgtgcaatccttctacgcgttaaaaaaaaaagtttgcttccaacactcttagcaacggggaacatcttaatatgggcactagatttgatttcactcgtgttctggatatctcaaactaattgtacttaaattattgctaattaagtaattgactggtataaagctcacataatctcgatatgaaccgaatccagagccagaagttatgatcgtttcagcagcagatgagggctactctacacccttaatttcgtttggtcagacaaaattaagtactctatgttactagtaatatttgcaaaattctgttccgaaatgatttcttagcttaagagatggtgtttttcttttctctgagataatactgttctctccagatatgaatgaattctggacttcagtttatccaatgtctgaaatagcgctgctctgttctgttgcgtgttcaatgtgattccattattgcagcaagatttgaagaaccatgaaagccaagtatgctggatgtttacagtagccactccactacccaagggacagaaatatgaaaaccgttgcataaaaaaaaaaggtttgcattcatcacaaaattatataaactcacaggtttgcaacggggaaacaattacaatactcacgagcaaatgagtatcacagattaatgatactttgagtggtgttagttaaagctcacctgacagcacatagcaaagtcgagtaacaacaagttgatgttaaaaaactactagctggatatgaaatttcgcacatgtatatcgactggcacattgatatagacgcactttgcactagagaatcgagctgtgctagtgcataaaagcatgcaaaaagaatgataagttcaattaaaaaaaaagcaaaagaggatgataggttacttctcagttgtatcccttcaaagttcttttttacagagaatatttaagttaaaagtttgatgcacgcgttgatgactcggatcttcacatgaacatttaacgaatacaatctgttaaatttctcaccatttaaggtaaagggctggatgttgccactaaccttgattacttggatcactagattagactgaacatgtactaataatcttctaaacacacaccgtcctttgaggtttagcttgcacttgtagcatttgcttggcttcattgattattgtttacaaagtataaaatgcacacatgttcaaacgctgggtcgggccgggccgagctgacgggccaacaccgagcctcggagtgctagctaggcctgagctcggccagactccaattctcttagaccgatacccagcccaggctcgagcttgcgggcctccatgtccaggcccgagcccgggcccagctgctcaggaacaggtcttgtgccacggagcatctcaaggaagaaatccgtgagggccgcctcgtagcccggcatcttggcgtagcccgggaagtagttgatgtcgatgatgaagtacctgtcgccgtgctcctcgctcctctcccggatcatgtcgaagttgaacaggtgcaggcccagccctcgccggagcccgcgcgccacctcgtccacgaagccggcggccggcgtgtcgtcgtcggcggcgccgccgtcgtcatcaggtggggggagcggctggttggagatgttggcgaaggggacggagggctcggcgtccaggtcgaggaggcggcgggccggcacgtcggggaggctgctccggcgcacgcaggtggcgcggtcgccgacgacgtagaccttgaagagcaccccgccgtggttgacgaactcctggaggacgagcggcgcgcggaggagggggaggacgccgtcgcggcggtagacgaggcgcatgtcgtgcgactcggcgctgccgtcgacggcgagcggcttggcgatgagcgggaagcggagcgcggcgcgggcgaggagctcgtccgcgtcggcggcggcgtcgctgacgacgacctggggcgggacggagacgggggtgcggaggccggagacgacgtcgagcatggtggcgcggtcgaggaggcggtcgatggcgccgggggagtcgacgacgacggtcaccccggggtggcgcgcggcgagctcctccagctgggcgcgccaccgcggtcgtacatcttgtgcacgaggaggtcgaacgggccctgctcggcgagcggccgcgacacgtcgacggcgacgaggcgcaccccgcggtcggcggccagcgccaccagcgacggccgcacgacgctgctcaccttctccggcagcagcgcgtagccaacggtgtagcgaggtgacgacgacggggaggacagctcgggcgccatggccgcgcgaatcgatggaatcgatgcgatgcgaggtatatatatgtgatgacttgtgtgttgtacttgttggtagtgaccagctgtaacggctgtgatgtgcacctggtggatggatgcgtgcgaggccttatataggcggcgcgaggaggagaacggtgtgtggttgatagtggtggcagtggtgcatgcatggcgcgtggcgaaagcggcacgtacgtacgtatacaggaggagaaagggagaaacgtgcgagtttgggacgtggtggtggtggttgcagggaggaaaagggtcaatattttggtcgtcgtttgccttttcgttggctttcttttcttcgttttctctctcgtgtgtgtgtgtcaagctaggtctcatcgatctcctctcccgtccgggctctactttcctactactatcagacaattggtgtgttttggcagttggtaaccttacatgcaccttgcgtgtcgactttgtggagatcaagtggtgtgttcaggactgaggataagataacccaatcaggccggccgggattttgatctctccgctatggccttccacgaaattaagacagatatgcgacacggaatcaattgtaccttggtcggttgtgggaggagaaaaactatcgggatttcggcacaaaattcgatttttcttttaaaatatattttttagaaggtatgacataaatatactcattttaaactattagcaacattataccgttgtcacatccgcgagatatagaactggtgacacagtgatgatgtgtgcgagttcacactgccaacgcgtgaactcgttaagtcatcggcatggagtcgtgcaagttcgcgagttcaccatgtgaacttgtgcgagtttgccatttcaccgcacaaactaatgacgtcactcgtgcgagttgatagcgcgaactcaggacgtcatcaacacaaactcatgcaagtttacgcatgggtggagatacactggatagtgcagcggtgagtcatgtgtgttcggttttcaacatgctcatattttttttccaattatccgataacaggttatcctcatttttatctttagtttgcaaatggttggtatgaactcgcgcatcccaccgtcatatccagcgtttttgcgtcccccagatacgatgacagtataatgttactaattattttgaaaagagtatatctatgtcatatcgataaaaaatattttctttttattttttaaaattgaccttcttggtcacatggaaaatggaaaatccagctaattatccttgtacgtacgtgcgagggaatgtcccgttacaaccatcacaggtacttgtaaccatggttgggtcgtaataccttggatcgaaatttctaaaattcaggtaaattgtttggccaaagaaattattatttggctaaccaaattaattcaaatttcaatagtggatcgccgggacctttttagccaaggacttactgggcctgttcggctgcgctacagctgcacatataaagtactgtccgtataagctgcaacacagtgcaaataagggcagccgaataggtccactaatgatccttactctagttagcaatattgctaactaataggtgtgtgtgcatgtagtggcatcactactagaattaggatacatgatatatcctatgtcctgtctgggtgaacccacaagaaaatacgacttcacatcagaagttatttttcttgatggttgaccattaatttagcacatggaaaaatatcagaaaaacaatactacgacaatatatcgacataattataatttatagtgctaattcaccctaagtaagaatcttgagaatgttaggttgtacggttagttttccgtgtcgaatgtcttctacataatagtaaaagaaattgaaaaaaaaagacgtcatggaatatgtttgcaccgcgggcttcctttactttttgtcgacatatttaactagtggatacctcgcacggtgcggtaggaagtttagaaatactgggtgaaactccgcgcgttgctgcaggagttcaatacgatatcaataagtaaaaataatgtgtaaaatagctagacaacatgagctcacataagttgatatggtttatgataatttaaatagtatgtagaatgatgatccaaatgtaagagtaaagcgatgtagctttatgagagaaaaaaaggagggaggtaatttggaccatagattaatcatctaaggactaaaaagaattaaggtgatatgacttaatgagagaagaaaataaggtatttgagcaattgtgctcattttgagagaagaaaatgtgctcttttcactttgataggtgttggagtatttgtgctcttttagttttatgtagggtatttgagcatttgtgctcattttggttgtaaacttatgtgtaatgactaagctattacacttggaatttctgtagttgtatgcaccacgttggtgtagaagccgggttttataaactcctattacttaaaaaaaaatctatatctccgacagaagcagcgcgaggctctccaacaacatatcaatcaatgtacgttgtctcccttagtttcatgggcagatggttaggggggttgagctcccttaccccactagatgatcattgagaaaagaagagaggagagggaaaatagggagaggaggaagaaggagatcaacctctccaatctattattggatccgcccctgcttagtttggacttggacttatatgtaggtttacatatgatgtaggagcggccgtgcggcagatgtatcagtggttcgccgtgcttatgtgtaggggtgttttaatgttttctcgatcctcagcaaccacgattcacacacggatgaatgtattggggtaagtacatgttgtgagatcttttaatgtgcttgagaggtacctcaagtacctccacctccaataaaacacacaccgttgatttattaaggataactgggcataaaaatattttaaaaatctctttcttttttcttttctctgggaacactatatgaatctgagcatatagattaactaaaggaaaatatatagttattgattacttacttagttttatcattaattatacattcagtgtattaaatattgctacgttgttgcgaaagggcctgtagcctagtagttacaagagcctcagtagcacctgaggtcctaggttcgactctccatgggagcgaattttccaggatttaacggcgttgtgctttcagtggtaggcgacgtacccgtcgacagcgaggcgcctgtggtgactttgtcaatctctccagaatttgccggcccagtcttcgaagatgctcataggggtagggtttgcgtgcgtgtgtccatagggtattgctacgttgttttgtgcgttacaataataaactacacatcaatcaacttgtccttcccataaaaagttaattaatattatttaaatattgtacattatcaacaggtatttatcgcctgttatataatctatatgttcagctatatatggtttatttgcatagcataagttgtgatcgccctctctttaccatatctaatctgataaaagggacacacactacggagaatcgctttttaatcctggttgagaacccctatagtcctggttttccaaccgagactatgtatccgggactaagatatttttagtcccggttgaaataaccaagactaaaaatagattttctatttaccatatctaatctgataaaagggactcacactactggagaatcgctttttaatcacggttgagaacccctatagtcccagttttacaaccgggactatgtatccgggacttaaaaatatctatttttagtcccgattgaaataaccaagactaagttcgtaacaccagccgggactaaatcggggt

SEQ ID NO: 63869 - DNA, 4758 bp, Oryza sativa
agaaggaaaaagagaaaaaaaagaaaaaaatccatggagcctgccgcggccgccaccttccgcggcgggccgccgtcgctccgccaccgcctggtcgctgtcactccgccaccgcctccctagcccggcacggcccaaccgccgccttcctcgcccggcacggcccggcgcggctgctgccatccccgcccagcacgggcccggccgccgccgcccccgccctacacgggcctgaccgccgccgccactccctggcacgggcccgaccgctgccggccgcttgtcccgcagatctgaggaagagaagagaggaaaacttaacagaaggtgagatgagaggaaaactcagatgtggaagaagaagggggagaggaagagatgagagtgaaaaaggaaggtgaggaaaagaacggagagataaagagtggaggggaggaagagataagggtgatgaggactcagatcgatgcgcgcggagagaatgatggaagagagagagcgagacgtgggaaactgatttgtagtcccggttggtataaacaaccgggactaaaaatctgatctttagtcccagttattcataccaaccgggattaaaaatattaggagacctgtcacgtcgtgccaataaataaactgggacaaaagatgatctttagtcccggttggtaacactaactgggactaaagattattgcacttttaaacccccggttttttaagcaaccgggagtattgttgtttttggtaaccgaccaaagatgatttctcaagtagtgacaattacatatttaacctttcacctaatctacaaattaactgcctggcccatttttttactaccttttgtaagacatctttgttttattgtttgaaccgttagatttttattgatagacggaccagatatataacatccaagcacgatagaacgcctcacatgttggagctatgaagtgcatggggctctgggaatggaatgtcgtcccttccttctgtttatttgcctgcttttggtgagttcctacaaggaagctaccgacgaaccgttacaatcgcacatgcataacggggtgaattaagttaattaaacccgtttatgctcggcgcacgaacaaaaaagttgcagcaatttcataagaccagaatatatgctgctagctactgcacatatgacattgcttttctgtttattattttgtgcgtacaaagtgctcaatcatatatgcttgggaaatttttttttgtcaaagcatatgtaaccttgtaactttcctattgggaatgaggatgtgctttagttggtagctttgggtgctctttactttttgcatacgtatgggcatatcgtttaatttgtacatgtatatgcatgcgccatgaacattttattttaccgaaagcaagatagcaccggatccgcccgcggcaaaggccctctctgagtttcctcctcgtgttctttcgtttcacaccgaccgagcgggtgagcttagggacgggcaaaataaaacgaaatcaaatgattcggtcactagttcagacaacagtttcaacgactgaatttattccgattaatttggtcatcttcattaataaaccgatataacgaagtgcaggctgggataatggtcgcatgtaaaaattgtatatttttggaggccttaaagtgcggacggggttaatgaccgcctgtaattttttttcccgtttgaaagaatcagttttctagttgtgtaggtgggtgtgccttttaatggatgcttacccgcaaaggagcgggcgacgtgtagtagggaacatttgaaaaacgactccgcttttaaagtagtagagaaatcaaccaacttttatgttgcaaatctcaacgaatgaaaagtgaaacctaagatataaatgtgccacattatccgatgaacattggccatcagattcacaaaatgacaaaagagttggaatcgattttaacaataggatcaaacttaagtagcaataaaaaacatggcaaattttgctacaggacactatgattttgtggttttagtcgtgggacactgcccaaactcacttttgggggaaaacacttcataaacgtggtaatttgccaatagacaccgcttcgattaaaataatgatttctggttggggaggagagagaaatcacgtgaaatatcaaaaatacccttggacccacgtgtcagctctccatctctcttcctctctttctccctccttttctctcttctccccgtcacggcttgctcggtggcggcggcgacgctcggagcgccgacgcctcaacgcatctgagaaactgttccaatctcgccgccgacgacccgcccggcccctcccacgccgctgccattgcgtctgcgatctcctccgccttcctcctcatcgcctcgcccttctccttctcccgcattaccgtctcctcctccccactctccaccaccgagctctccaggctcccacgcgccacctccacgcagacccccccccccccactccaccaccaccatcgcgttgaagaactgctcggcccccaccggccacccgagcagcggcacgccatggcggatgctctcaagaacgcgcccgtggacgagtgcgccaggatccgcgcccacccacccaccactagtcccctgcttgcctacgccatctagtcctcaaatccgacggggagccagccgggatcgaatccgtccttgtggtcgaaccccaccagcggctggacggcccagaggaacggccgtccgctcgtctccagccccagcgccagctccgccatctgatggatgctgatgctgttctgcgacccaaatgagatgtacagcaccgagcgccgcggatgtgcgtctagccactggatgatgctggtgtcgtcatcctgcgattttaacggagccggcgccgcgaggattggcccaatcgcccatgcttggacgtcgattcgtgcttgggtgcttcgtgatcgggcagtgcgaatggtcgccggagtcccgccgcatctcccttgaccaccgccgagccgcccttgcttcgccccggcatgcccagccgtcatgctccaggcgtcgccgccgctgccgagcaagccgtgacggggagaagagagaaaggagggagaaagaaaggaagagagagggagagttgacatgtggcccaaggacatttttgatatttcacgcgatttctctctcctccttaaccaaaaatcattattttaattggcgcggtatccattggcaaattaccatgtttatggagtgttttctctaaaagtgagttgggcagtgtcccatggctaaaaccacgaaatcatagtgtcctgtagcaaaatttgcctaaaaaatatatagagttctagatccttctagcatgctacacaagaacctttacttgagatggtagaaagatattgcataaccatagtacctagacttcattcaagtatgcaaaagaaaaaaaaagtaaatttgctaaaagcaacaatgaaaatggtgtttatgtaaaaagcattaaacaaaaaatggttcgtacatttcaaattaagcttatttaattgagaggaaagtatagttacgtaaacaccatcgtaaaattatttcatagaataattatatgttttatatgttttggacaacaaactatgtaatttcatattatcattaatatatttttcttacatgtacaccattcataaaattatcaagtttagcataattattgtaaattatttattgtcatggtaatatttatttattacagatcaagataaaacaattcgtgttatacatagacttactgctaaatacgttatcttaacatatattcatgtatgcaaaagaatttaaatttgctaaaagcatcaacgaaaatggtgtttatggttggactcactattttgttcagactaaagatgggacacacaattcaaattacaagtctatttacactattactagaaatgaaacatttaaaagttcaacaagagggaggcaatggacacaataatgtatgttaaattatttgttgttatgataatattcttataaagtatgtttgaaaaaaaatgtattgttaattataaaaaattaagctaatcactgtaaataatgtgtaaaatatatttaataaagagggaggttatagtcacgtaaacaccataataaaattatcataaaataactatatgttttatacttttgaacaacaaattataatttttgattaacgttaatatgttttcttacacaccattcataacgtgatggctgtagtcgcgcgaatgcacgacttaatacactagtacatatatattatacaactcacactataaattttaaaacttacattaatttttttaagtacaaaccatattaggataaaataagttattacaacaagggaaaaacaagaaaaacgtatgaataaccaagagcaaggaacatgtgtgcgcgatggaaccggatcctctgatgtgaactgtccctgacgtggtcactgacaggtggccccgcgagcggtgaggcccacatgtcagtcactatgttcctctgacttcacgtcagaggatcccaatccgtgcacaccatgtgaggatgccccaaaatttggctgaaatcaatcgagaaattaatataacgatagttttctagcaaaaccgttaggccattcgttagctgactcaaaaatcctgggccatacatagtttagctagggagcaattcttgcctgggacaagcttaa

SEQ ID NO: 63870 - DNA, 13823 bp, Oryza sativa
  unsure (1)..(13823): unsure at all n locations
aattgatggtttcatggaagataacactgtggatgtcatacacatcgtacctgagcctgaagagatcaaaggggacaatgtgtcagaagactgtcaaggcgccactgccgaaaacaataatggtgatttcatcaaagacgacactcccaccaatgaagaaccggattatatgttcaaagcaactaaagaaagaacggctgcaaacggattcaactcacatggaagaggcgatgatgatgagagtccacaccatgtttacatagaagacgatgttaatgttccatcaagtcctgaaaatttcaaatatccagaggtaatagccaatgtatgaagtttaaacagttcaactcaaacctttattaaatctctctgttgaaggcatcaagtcctgaaaattacaaagatcctgaggtaatacccactgtatgaagtttaaactactcacctcaaacatttattaaatctctctgttgtaggcacatcaatcagccaatttcgatgcaattatgacacaactcatgcagattcaacaaggttgtcagtttctggacaacaagatatccacaaaactaatctcaatagagaatacttgcattcaaaatagaagagatattcaggtacagaaccaattttaacagttattgtactcataacaaattcaggtactaagttaatgatattgtacttgtactatttatgatttcgaacatgcataggcaataaagtacaggttgggtacaacttcaaggtcacgaactttccgtaaatttaaaccagcagccaaacaagaagagacagtaattgattccagggcagattgccgacaagacctagttgatgattcaaaggtaaggttgcaagcaaaatagtatattccaatgagcattacaaatgactaactaatcttgttgcatcttaacagaactacgatagtcaaccaaatggaacagctacttctccacacataatcgaaagcgatgacaatagccagcaaaatccaacactggtttttcaaataatagacctacatctacattacaaatgctacactgaccattatgctaattgcttgtacattgcagcagttatcaacaattggcggaaggcttagacgaccggagggaaggattatcaagccaacacacaagtcacaaactgatttcatctactacaaaaaaacatttccaaagccagttaaatctagtagggaaccgaaaccacatgatctaagcctgctggatgaagtaaccttgagttacatctctaagagtgaagacaaaaaattgctatcaacaattgcaggaatcaagatttttcgacagcatctgaaaccacttatcctaccaaaacaggctccatccaaagcaaagtggttgaacggcactgtaagcactgctatctcctgcttctaatttaaccaacaacagaataattaaacactcacaatatgcactgctattggacaggtcatagatgcatacatacaaatcatcatagacaagcaatccgacactccacgaggacagggaattgcactccttgaaactgcaacacaatgccagctgtggaaaattaatggtacagacaaaggtacatgcaacaagagatatcgtgatcaaagatctaaagttgctgccagctatttagagcatgaaatggtaatacatacatcgtatacattatatccataagtgaaaatgcatttcttactcatgattccgcatgtagattttcctacccttaaatagaaactcggcccactggtatgtagctgtcctggatggtgtcaatgaaaaaatccaaatactggactcactgcatatggataggacaagctatgatgcagaaaaaacccttaccactacggtataatgaaaacacatttcatacacttcccttctgaaagcactacaactaattatatttctttgcaatataacagatcaaaggaatagagaagtatcttcgttatgccaaacaagatgaacacaagacttataaatggaattctacgaacatcacgaaatggccaatatgcccgatgcaagtgcctcaacagaaggacgggtaaccatttctactatctgtaaataaaaattactatgatgtctaaatgtaacactataaacataattgaaaatttcagatggtcatgtggattgtttacgctcaagtgcattgaacactggaatggaaaagacctatcccccgagtacgatgcaatggcaagtattctctgctaagatctgctatgcgatctacgtgctgaagaagtatatcatgtctaatttttcctcgttttattatttcagcacacgacaactacttttagagctaaagtggccaccaccttgatcaattcaaccatgaatgaggtgattcaagtccaagaagacataatgcatctacacaaggaagaatctgaagaaatttgccacaaacaggagcaaaacatgtcaagtacttataattgatgataacaaattctctatttttatcttggtcaactcagtgatgtaaacgttctttcaaacagtttcagatatatgcagtactcaaacatattgacccttcattcaatcatgcatttttcattgcaaaccataaaccatcattttccattcaaacaacataccagtgtgatacaacttttttcttccaaacatcccaccacggtctgagacggcgaggacacacgatttggcaaaaccgatagcccaccacgagcgcactaccaacggccgatagatccgctagcagtgatgcaccgctccttgccgcgcggggccggcgacggcgtcgacggcggcgatttggcagcaccgatagcccaccaccagcgctctaccaaccgccgataggcccggcagcagcgatgcaccgctccttgccgcgcgcggggccggccacggcgtcgacggcggcgacgcgagtatccacggcctgtttgccctcgcatcgcgctcctccacgactaagtgaccgcgagcagaccaggcgcgcggggggctgtcgctcggggcgacggcggcgccgcgagcaccgcaagcctcggcgctcggggaggttactgctgggggaggcggcagccggaagccacggggctcgcggcgacggcagccggaagccgcggggctcgcgacgacggcggggaggtcagtgcagcaggcggcggcgcagtacaagggttagcggcggacaagtctctgcgatgcggatggagaccaattcgttagggcaacgatacaccactcatcgatccggatattgtgaaaagacaacgctacccttccaccctacgatttcaggcggtaccgcgcaaaggagaaatttggtaccgcgcggtaccgtgcattcctgaccgttagatctgtttacatccaacggctgcgatttggtaccaccttggtaccacgcggtacctcgcgacggtgctggacggtaaaaaccgtaaatatggaattatgaatatgcctttttacgctatttcaataatatgatttagtagaacgatgttaaaagaaaactacttagtttgttttgagatcaacaaatttcaacatcatttcagaggggaagaagtcaagcttacacattctacgtataataagcgtacaaatcacattatagctgtacgtatataggaatagcttgaaccttgaaatctagccggccgcctgggttggaaatggatccaaagtgcccgattaggcatgcagtgcattaggactaatctaaagtgccccatttgcatcaagtaaagtactatattaactacagtaaaatcgcacaccgttgtatgcatttgatcactgtagcacagacatcgccgcgaggaaccctttcacagaaactgttcgaatttaaatgttacaatgatgtacttatgcgtcaggttattcaaatgactttgaactaatcacgtggtaaagcagtatctcatctccaagacagtggtcaacaatcccaacaaacgctctctctcagaaaacaaaaaagacccaaccaacggttgaacgcacaatgagaatgtgagggaattgtaatccaacaccgaagctcacacaggtcgctggcctcccaccaccaccaaacccaaccccggaactaagcctccatcctggccgtccatcggccatccagacgctcctatcgcgccacaccaaccccaccaccgctttgcccccgtgaccaggtcagagcggcggactagcccaacgagacgatacgacttgtcaatttgcccatgcggccgtgcccaccaaccagccagcacaacagagagcacgagcgcgcggcgcatccacgtctctcctccattccgccgaggccgagcagccgatggatcgcggcccgccaaccctgtttccttccgtggcacacgggtttccgcgcgaaaccggcgaaattcgccgcatctcttcgtgctgagccgtttcccacgtactgactcactactacttgctactgccacccacaccaaccaatccattgacgctatataagcacgccacggccaacggcacccgacccagcagccacagctcgctttgcaattccaccaactaaaatcaaaccaccaaaacacaacacagggacgtatcgcacagccagtgagcgggtctagttcgagcagcatggcggcctccgcgatgagggtggccatcgccaccggggcgtcgttggcggtgcatttgttcgtcaagtcgttcgtgcaggcgcagcatcctgctctcaccttgctgctgccagtggctgtgtttgtcggcattgcggtgggcgcgaagggcgggagcggtggtgacgggaaggcgccgccggggccggcggccgtgccggtgttcggcaactggctgcaggtgggcaacgacctgaaccaccggttcctcgcggcgatgtcggcacggtacggtcccgtgttccgtctgcggctgggcgtgcgcaacctggtggtggtgtcggacccgaagctggcgacggaggtgctgcacacgcagggcgtggagttcggctcccgcccgcgcaacgtcgtcttcgacatcttcaccgccaacggcgccgacatggtgttcaccgagtacggcgaccactggcgacgcatgcgccgcgtcatgacgctgccgttcttcacggcgcgcgtcgtgcagcagtacaaggccatgtgggaggccgagatggacgccgtcgtggacgacgtgcgcggcgacgcggtggcgcagggcaccggcttcgtggtgcgacgcaggctgcagctcatgctgtacaacatcatgtaccggatgatgttcgacgcgcggttcgagtcggtggacgaccccatgttcatcgaggccaccaggttcaactccgagcgcagccgcctcgcgcagagcttcgagtacaactacggcgacttcatccccatcctccgtcccttcttgcggggctacctcaacaagtgccgtgacctccagagcaggaggctcgccttcttcaacaacaactacgtcgagaagagaaggtacattccatttttcttactttactgcattccctatccattcttgtcatggaaaaaatgaggattgcaaggtaaatttgttcgtgtctaatcaacaaaaatcttgatatgaaatgcaggaaggtgatggacactccgggagacaggaacaagctccggtgcgcgatcgaccatatccttgaggcggagaagaacggcgagctgacggcggagaacgtgatctacatcgtggagaacatcaacgtggccgccatcgagacgacgctctggtccatcgagtgggcgctggccgaggtcgtcaaccacccggcggtgcagagcaaggtccgcgccgagatcaacgacgtgctcggcgacgacgagcccatcaccgagtccagcatccacaagctgacttacctgcaggccgtgatcaaggagacgctgcggctgcactccccgatcccgctgctggtgccgcacatgaacctggaggaggccaagctcggcgggtacaccatccccaagggatccaaggtggtggtgaacgcgtggtggctggccaacaacccggcgctgtgggagaaccccgaggagttccggcctgagcggttcttggagaaggagagcggcgtggacgccaccgtcgccgggaaggtggacttcaggttcctgcccttcggcgtgggccgccgcagctgcccggggatcatcctggcgctgcccatcctggcgctcatcgtcgggaagctggtgaggagcttcgagatggtgccgccgccgggcgtggagaagctggacgtgagcgagaaaggcgggcagttcagcctccacatcgccaagcactccgtcgtcgccttccaccccatctctgcctgaactcatcgaatccctttgaatcaagttcgtgccatcagtcgataaatccaattaaaatttttgtttgtttataaaattgcagaagaataggttataaatgacagcttacagcatgttttcagttttgtttcctaaagagtgtaatttgaaaagtgaaatggaattgtcatccaactagtgtgagaaagtgctctgctttgcgtaaaaagaaatgtgctctgctctgctctgttctgttatctcttcctttgtagtctgactgtatgttcagaacattatccattttcctgtgttgcggtcttgcggatgcccgtgcgaagaagagcaaaggtcatcttcttcaatcttcatcaccggcatatcgctggcacagccgacgctgattagttcggcatgtattccttttgcgaccttggaggcttggatggattactgggcgccagaatggccatccaatcgatggaaaggtcattatgagacggcctataatataagctcactacttactaatataaatcaatgttagagataatatgattggctataatgttagttttatttttgtcatcctctctttctctcaccataaatttatactagctcttgtattagagccaatactttctgcttttctttacctctctctcttccattattatcctttctctaagatcggagaatacagatgactgacggtgatggtcctgagtcagtttttgttagagattacctattgatctttcgagtttttttataggcagtgtcgcagtgattaccaacggtagcaatgtttcatatgccccttcatattctcagcgtaactatgcccataagaaaatgaaaggactgttttttttttctttgttgccctaccaatattttgattgcttaaagtggtaggcatgatggttttggttttaagccaaatgattgatattaccaatatccaatttggtactttctagattttaattaatttctttctaaataggaaggtaacccgcgcattcgtgtaggtatgcgtattagtttgtttcgagaataggtttaagaatggaagctcaaattaaaagtgaggtgattttcttttctaaatgaatattcgttgtctctgttttttctaaatgaatattcgtttagaaaagaaagaaactttcgttgataaagccttcacctctttgatatgtaaaagcaaagtactgtagaggcactagtaatagtgaaaagtacggacaatttttttttgaaattttattagattttctctaattggttaactttacttcctattaatattttctattttatgtgtatacactcttattctaagttcaattttcgcgtgatgataaataggatagagtataacaccttatgtataaacctttttcaggaaaaaaaaatcaatcacccttatgtataagagcaggtacaatagcaggctataagccggctataaccatatatcgagaagaaaagaaaagagagagaagaaagcgggctacaaatttgtagctggttgcaacacggactccaagatgttatatgtgtatgagaggtgggaccgggtattaatggtgtagtatatttttatagttaactattgtatgaatgagctattagattggctatagatgttttggagccagtagttggctatactattgaccttgctctaagctgctaagactggttcggtatatgttctcattgtttactcatcaacgtattgggtggtacttgaggctgccttaaatgcatggggttatagagtcttaagagcaaggctaataatacaaccaacttgttggctgtaaggtttttttagccttctctcagtccattcatataatagttagctttttacaattaatacagggctcacttgtctatcttacagagtttcttggctcttgtgtccaagccgtctgtaagtttataagtttatagcccgcttctcccctctctctcctctcttctatcctccgcatcagtatttagtcggcttacagcctcctattgtacttgctctaaggttccgttcttttctccaacaacagttggatgaagataaatattttttggcacgcttttcaaactgctaaacggtgtgtttcgtgcaaaaattttttatatgaaagttgctctaaaatatcatattaatctatttttcaagtttgtaataattaaaactcaatcaatcatacgttaatactacctcgttttgcgtaaaaaaaaacttaattttcatcttcaggagaatttgcgggaaccgtgttggcgtaaaaaacgttgtgtgggagataacccattagagtatcaccaacacagttcccacaaattctaattcaaaattttcttttaggaatctctaatatggatttaggatttttttttaaaaaaaacatacctccaacagattgcccagaactaactcccgaaaacaaaaaaaaagtgagctcacctcgaactcttcttcatatgattggccccccttcccgtgcatgatcggcgctccccctcctatccacgatccatcgattgggagtggttgcgtgttctcgacttgtggatagccaaaaaaaaacagatatgagattttcaaattttaggcaattgatcagatggattgttggagcatgattttcatctgaaatcctataattgttaggatatgtttatgagaactattggtgatgctcttagggaatgtttcgtgtggtgtcaggctccatacaaaccagcgacaacaacttcgcatgcatttgatatttcttctgtaatatttttctataaaaattatagttttaatattagaaatttctagatataactgcacacatttatattatataatctttgatgtatattctgctatgcctatctgggtgaatactgctagttttctatggggaggtggggaggtaggtgagtgaagtgcggcaagatcatcggcacggcaccttcctaggccagcgacaggattcatgtagtggcaactgcggaggaggagacggggagatttaggaagaggagaggggacccacccatctgcgctcctcagcaaatggcgctgtgcttgaaccgcaagggagagaagagggtaaagagaggggtgatggcgtgggtcccactgtatcttttttatttttaactggacaatcactgacatgtgggtcctatgtttatgttttttttttactttaagcgctatgtgaacaccacgtagacaccatgtcagtcgaaaccatagtccaaacttccttgggaccttgtttgcactggttttgtgagttgagggacgtgttatatctggtattgtggtttagagacgaattttagactcggtgacaactagaggaccttcagtgaacttattccaattttgggactgctatgtgtccaaagtgttcgtgaggcccatgtagtattctatctaaaaaggtgcggcccatgtatcccccccagctcggcatagacttccgtcgtctcctcctcgtgagctcgcccctgcgccgcctgcgccgatctccatcccgcgagcgagcaggggcgcccggcgctggcgccgtcgttcgtcctgttgcttccgcccgcatcctggtgagcatccatccgttaccctacgcgcaccctcttcctcatctctctctggtctcttcccacgcacttcttctcgaatttgcgttgaaccctatagattctgttctagaaatttgccttaatctgaataactagtaacagtttgtttgttcccccaagtagtttggggcttcaattgaacccccttgtcggtcccacgctagatccgctcctgctagtgtctgaattgttcatcttgtttttagtacagaattaccagttcttaccccattttttgtgctaattttcgcatcggaacagaaaccctttcgtttgtcaaactctctattgttgttttaatagatgcccctaactatcaaggataatagtatctgtggaataatgggattaattatttctggcacaccatttactctctctctgtctctctctaaatttcacctggcatagcagcatgccagcataatgcattttttcacctttctcttgaatactgttttctctttacggattaaggaaaacattattgtacagacagtgctcgtttcagaataaatgggagatagggaaagacgaactgtgtttgtcacagtagggaccacgtgttttgatgctcttgtcaaggcagtagattccccgcaagtcaaagaagctctactggaaaaaggttatactgatctaataattcaaatgggccgaggtacatatgttccatctaaggtcaatgaatttctctttcattccttttaaattgccactttaccagcacggaattccagcttgttctgcatgttaattcttcttttggtgctttttttttgtctgtgtgcgtgttctgttcttggggttaattcttgatgagttgtcagatgaacagaagttgcgcggtttgatttcttgtgaagagttctgtttggattgcacatttcttattttcagttttatataaccagtttcgagtgaatgtttctaagttgaatgggtagggactatatccaatcattgaatgattaggggatgttcctaacatgtggcatgaatttatgttatattagcagataataattgctttactctgctagtgattcctctgttctacctgaaacatttgtaagcaccatgttgatggttgtgaaagtgaagtgaaaccagccagaaactttgatatatttgaatacaggtctcaggagatggaactcttcaagttgattatttcactttttcgccaagcattgctgattatataagggatgcttccctggtcatcagtcatgcaggtaattgtacatgtttataggacataccaggtgaaatgtatttcattcaaataacatttttacccaatataatggttttctcaattgaaggattactccactgcaccatgaatatgctctcattgtttataggtcataccttgtgtaaagtctgtcttcatggccaattctattctgttggacatgaggagtgtacacccttaccgtataagcttatatacaaaactgggtttaaagatcttcatgccaatagtttgaacttgattaaggcatatgctatctcatttttttcttaagtgctgcagtggagtattatatcgtgtggaacgctttggtgcattacatgaaatcctttctaaacttggtagtttgtgccaacaaattgagcataattggtgtctttaaatggctgacgcctgaagagaatagctacacttgtactgttttaacgccatattggctgctcgatttttatttacaaaacatcttctgatattataagcacttttttgttaaccaatttatgttttttcacctctagatcatactgctatttgagttcatttgaactaataaacatgccatttttacttcgcttcacaatatttatctgacgcgtacaaagaagcataatatttaagtaagctgaccatacttgctattgttaggtagagttgtaatatttctacctgccgttatggtcaaatttcattaaatgttacataaattctgtgctgccttgatatgtgctctggataaatactgtgaattttagcaagtatatcatcaattttgcatctttgttacttcctccatttcataatgtaagactttctagcattgcccacattcatatgtttatagattcattaacatccataanaatgtggcaatgctagaaagtcttacattatgaaactgagggagtagttgtcaatgctgattgcaattaaccagattgagctctagcaggttcaggaagcatattcgagacgttgcgacatggcaaacctctaattgttgttgtaaatgaggatttgatggacaatcatcagagtgagttagcagaggaactggctacaaggaaacacctcttctgtgcaagcccacaaacactaggagagacgatccaggaaatggacatagagactctcaacccttatgtgccaggggatgccaaaccagttgtatcgctgattaacaagttttttggcttcccagatgactgattttttttttcttattcccgccttttctgttgtaagaaaatgaagtcacatatggaagaggtagctgacaaaagtgaagtttcatagtggcatgtcacatgcaagcctatacccaaccattttggtatgattccaactcaccaagtgtaatccgagagaactctttgaattgtttgaaaacggaggaaatgcatcttaaactccattgttaagccattgggtgcgaagtagtatgatttttttttatttgaaactaagtagtatgatgtttattccgggacaatctcttttgctttctcctttatggtatagtttagaagcaattagaatcagacggctggtgacacatggaagctgtatcgaaaggctaaaatcttcaggtattttttattttattttaggctttgattttagtatgatgccaacagggactctcctagaggtagttttgattttctttttaagcttttgttttagaattagttccattgtctttctccttttgtcttggtgtctggctctttttcatgatcactaggagaacaattcaaagactagctaatattattcttaaaaatcaaactttaaaaattcaaaatcgctttgaattatgggtttgtttggttttttttttaaaaaaagagaaaacttagcaaactttggttccgtagaagatgtttgggtagtgttcggtttaagacctttatagcttttgttgagttttgagagtggaaagttttggaattaccatttttttcgaagagttgtgatgggtgtgtttgccaagggtacaaaggtatgccatatagagtcgaagttacccattgaggaaggccttgattctgctagggatgcaccacagcacgaacttttgcaatctaacctatcaaatactcacactagctgtgcttatatgaaaaatagaccgaaagcagggagatgtgaaattttgcacgatacaaagctattcatacgtgtgtgtgtgtgttttgggtctgaatgcattcatactactacctccgtcccaaaataagtgcagccgtgaaaatccgtgtccaacgtttgaccgttcgttttatttaaaaaatttataaaatatttttaaaaattagtcatacataaagtataattcatgttttatcatctaatagtaataaaaatagtaattattttgagatggacgaacggtcgaacgttgaagatgaatagtacaaaactacacttattttggaacgggggagtagataataaggcgtgcttcgcgcgccctaccatcaggcaaacaacaaaaagaaaaaaaaaagtcatgatgacagtaaacgcacgggcaaaaaaaagaagtcatgatgacagtaa

SEQ ID NO: 63871 - DNA, 4561 bp, Oryza sativa
  unsure (1)..(4561): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatttgctcccgagtcccaactaggaaggcaggcatgggaatgggaggcgttgggaacgatcttggcacagccatcgactcgtcgtgaacggcttttctatgtgacggaggccagcggcccgtcacagttgttagcgtgctgttaaatcgctgaagaaaaaccctcgttgatgatcggttgtttagcgtgtagttaaatcactgaggggtaacatacagagtgacccacatttttattggacttaatctacagattttattcttaggtaaaggctgacaagttcatttttcaagcagcaacttacgaagaaaattgtgctcagataatttgcaaaaggtcgacaataccatttaaaatgacttttctaggcactttaatataagtaggacgagagccccgcacatatacgtggacatcttatttaaagttttgtggtaattttatttttctaaacatgtgcttgttgtttattcagaagattttttcaaaagatttgctggcaggaaacaacagtggcattgactattcaggaaacaaagctgttcacacaaaaggaaagggaagaacttattcccaacgaaaaaagtgctctctgaatcaaacatgaaagttgttttccattatatggctgttcacttaacactgctctcagcttggattatacttatatccatttggtctgctcccgtccattatacacatagtctacttggtgatgtatatccgtggtcattttcttgatctgcattgaaccaagtagatgtatatcctcgataactttcttgagcttcaaaaagagccaaactagcagaggttttttatggctgtccatgccattttttattgtgctttcatgatgatgaggtcttgtctctgcagatctctaaccacttcagttgtttgtgaagatatctattttttagtggacgtgaattatctgcttggctatgaattcactatcaagttgctatgaacaactctaactctaaacaaagttgaccaataaagtagaattctgaactctgaactgtgcactgtcttggtttttagtttcctgtacaggacttttggtcagtgcatgtgacctgtagagtttttactgaactaagatgattagagataataatcgtacataacagaaatctgggatatataatctttcctgttctgtttctccttcaatctgtagcatgaccttatccttttcaggatgagagggacaccgtgtttgcaatcagcatgactatgcattatactgacaagtggacaaagtgggtttttatttgctgttgctttctaatcatgtcattgcatactggtttcagttggttttcttactgattatgcctttgcatactgatttcagttggtgtttcttactgatcatgtggttgcgtgctaatttcagttggtgttgtttactgatcgccattgcatactgattttagttggtgtttcttactgattatgtcgattgctatggtcagtgtgtgtgtgatattttgatttttctgaacagatcatgtcaacaggaatgccacctcgtggagatattcctacttgtgaagaagcaaactaaggctgagttcggcaaggagggttggaattgggaaccttcccctccgacacgtaaaacggatacgcggattagcgcatgattatgtaaaatcaaaggtgtttttgattattattctgtgatgaacaattggcattagagattattggttttgttatttggaatttatttacgaagtggttttggagatgattggatttacaggtgaatcacaggtgttattattttatgtgaccggtcagaccaggcaagggttgccggtcagactggcggtatgcgcgcggtcagaccggccagcccgcggtctggccggccgactctgtgttggtttcggtttcgggttgtttgtttggatatctgtgattatttcatgactatggtttctagatggatactatgcgtatgtaatactgttgtttgctaacgatgagtcaagttggagatagctttggtctcggaatatggtttctttgtttatttcatgtgtaggtgactcgatgcctcgggagagtatttgcggtgatggaccgggagtcggcttggggataagacgacgtccgtggtgggcagagatcatgcgggatacttaggctagagttgatgcatgtggttggtgaagattccatatggcatacgatggaggtattgtgtgcgtatgggatgcggagtcgaatttggaaggagtccaaatttgatatgattggttatgtaaagtttgtttcttgtacttgagggtttcctaaggtgtttaggacttctagtatgagtttggttcgtggctttaggctgcctacctcgggtataaatagagggggagcgtgaggcttcctggtatcgcttttgagagcaattgagttgagttttgagttagagttttgagttttgtcgaaatttttgtaaggagtgttgttggtgcactttgtaaatacggagagaaccaataaagttgtcatctactttaagagttcttcgatttgtgtttcaccaggtttcggtggtctaaccggtggcgcaccggcggtcagaccggaggcatcgcggcggtcagaccggcggggacacggcggtcagaccggcttcggcgacaggtgacaggagctgatctcggcggtcagaccggagattcaacctcggtcagaccgatggcaaccaggcggtcagaccaacatgacaatttcggtcagactgcgatccgttgaatttgagggtaacttttatttccgctaaaagttttcggtttttgggtataccaaccattcacccccctctggttagcttagttattgtgattcgatcatacagattaattaagtattagctaaacattcttagaaaatgtattaatatgatttttttcaagcaacttatatatatatatatatatatatatatatatatatatatatatatatataaaagcacactgtttagaagtttgggaaccatgcgtgtgaaaaagaacacagcataaagctgagttgggcactcacctttcccaacttatactccatcgtttgccatgtgtactcttttcaaactgttaaatgatatctgtttttttttgcaaaaaaaataaatttgcttgaaaatcataataatctatttttaagttttaagctaatatttagttagtcatatgctaatgagcaacatcgttttccatgcggatggaataagttatgaacctttattatcaaactcgacgtaaagcaagttacgaccaaatcagagaatgggagggaaggagatcgcaatgtatggtggaaatcgtagttgaaattcagatttgtggagatctcataggaatttatctaggtctactaagtatgtgcaatgcaaattagatatatacagaattgagtggatttgttgtctgaattatggggtagtatttgcgtacttgcctcatcctacagttagtaatgcttttcaatttcatcgttgacatttgagctgttatcgccctgctgctattgacctatggtgatcttaacttttggatggatggatggatagcctatgtgttgagcaggtggctgaagccataaagattgtgttcaaatcaagtcaacctaacatggttgttaaactcgatatgcaacgtatagaagccctgcacataggcatctctgccgactctgcagctgtctgtattgaataatccaaaaattaaagttaaaatctgaggttcttgcgtaatataccatttgtgaacttcgtgattttgtatcgattggtcatatggagttaataaattgcttctagtttactcagatatgttagttgatttagttatccaaacttagttaatcttgaaaatgtttcactttactttattaggaaagggtaatccaaattaagacatgggcatctctgccgactctgcagctgtaagtattgaatcatccaaaaataaagttaaaatatgaggttcttgctttacataccatttgttgaactttgtgattttgtatcatgtcgtgaccaagtttggggataggcggaaaaaggaactctcctgcctattcttagagagctcaaacagtacacacaaccttttggtgattactttgtgttataaaatgtctcttgtcccgctacaggattttgaccggcttaaatagcccatggtcgtacatgcaagattacatctttgcccccgcgggtcaaccctaggtgcattttggtacatctgtaggtcattatagtcttttggcgccagctggcaagagtggttgagaatggtcctcacagaatcttcttttagcatcttcccttactcaagtagtgttcttcctcgagcccttgtgttgagtgccttttctatcttgaaagttcaaacacttcttaccacttgctttgctct

SEQ ID NO: 63872 - DNA, 7001 bp, Oryza sativa
ttattgttatctttcccttattattcacaaatgattatattctacgtgcagacttttcgaatttttgaaatgatttcggatgcatgagattggtgaaggagcttttacatcatttggagtgtgcacagagctgattcactattgcttgagttgccgaggtacctggtgttcactggatattttagggcgtccaaaacaattacagcataaaggcttaaacacaagttcaaataaatatgtttgggtacatttaggcaatgatgttaaaaccttgctttttatcttgctacgtaccattgcttctattatcagttgtctgatgggggtttggtattctcttttcctcaagtttctaggaaatttatttcctttttgcaggtgttcatcctcctttacagctagcaaaatgtgtgtggttagataacatgggaggttgatatatattgtgtatactttgctatgtccagatttactgtagaggggtcacatccccttctaggttagctttttttttttttgacggagggagtactacgttttgatattatgttaaatggagaacgcttatcaatgatagctaatttgtgtttaataaaatttttgcttaagtgatgtttgtgtgcatggctgcgcgcggcgtgatgccgtgcattcccttagtgttgtcactttactttatattgacctttaaaataattccaagtttccaaacgtaccggcctcacagcgcaccttcaaccaaagtgctactcttgctccaaacttatcatcttttccacattagtgttgtcatgtaccagatttgtacacaagccaatatagtacaccagattccttcagcattaagaggcaaaccaagactatttcaaacctattatttacgtaatacatatttctaaaagagggcagctagcgcacgggatgccgttcaagactaaagtcacgagataattaaacaacttgataaattaatagatatttccaaccgcgtcacctggtgtccacgcgattcctcgttgctttccccagccggattgtcacgcccagaaatttagcccaaatttccagactattttgtgtattaaatccctgtccaggactagccagggtacacaaaacgacaagtaataaacagttccaaacgtaaataaagcataaaatacttacagaagaggcacttatttctcacaccgaaacaaaagcagcatcagcgaaaaaggcgatcctagcagggcttcagctccactccacaggcaaaactcaactggggtctgagccttggtcttctaactttgcctctagctcagaagcactacacttctgaaaaaggggaataatagcaaggctgagtacaaccaccgtactcagcaagccacaccaatgatgcagacatgtaaggggaacacaaggacggtttgtggctatttgtataaaggcggttgtaaaatattttattgagtaaaatagtaaaactgttgagtaattaaaataacattaaatttccactgatcaacgctgcaccacgttgaacaggcccaaccaacccacctgaactacagtgcattgagtcgatttattaaggtgagactaatcacggtgaatctggtcgactgcccataactgcgggcacgcgggcacggctattcgaatagttttactctggccagaggtgtacaactgtacccacaagacaaatccccacgatatgtttccgtgcgccgacatgccaccacgacataccggaaagaggccgtgacaggacccttctcataaccccctctaaccgatcgcaccacacctcagggttcgcccccgttcccagcaggcaacgggcagccccctctcgtgccgcggtgaatccggaagccgatcaaccggacaccccggccgacccaactctatcacgcccaccctcgcctgggtacgtcggctagaggaaagctacactacaagcccagccgttgcccacgttggcttgtggtaagcacgataaattcttccaaggtttcccgcgaaccggtccttaattgccatgggtgcgactagcaaaaccatgcacctacagcccaccatttagtcgcattttagttggataattacgaccatgaagcatggccagatgtctcgagcacgcagctcattctgttactgaaatggtctaatactgtaattatcccatcaactgagctagtggtaattaagcatggctaagcatatagttccagctaggtcacataagtaacatgagctagttgatttattacccaaggttgacaaaggacagatatcaagtaaacatagcacaagcaagcagataggtaatacccagatcccatgtaattagcaaaatatgcatgtttatttgcaaatagtaaaacaattgtaaagtaggctcaatatgctcaaggggaatgtgtgacttgccttgcttcttcacttcaaccttctgaactctgatccttgcgaccgcgaacttccgaacaacggattctacacgctagcatgcacaacgaggaaaaactctaataaaaaccagggaaacagtacataaaaagtaaacaaacatgtagatctcaattttagatgaatttagcaagttgaatggcccaatttggagttcgaatgaattagatatgaattttagaagttttgagccatttaaatgaatttctagaattattaacgaattattgtgcaattattaattattttctcaaaggaaaagggacgcgctgacgtcatcaagggggaggggcggcgcaagcaagcgggccccaccggtcagcgacacaagggcgccggtccaccgtggtctgggaccaccgaggcggtccaccgccggtccacgggaaccgacggcccggatcgacccaagccgatcgggcggccacggggtggcgcgctggggcacgggcgcggctcaggccagccggccgagcgacggcgagcggcggcgcggccaccggcgcgggaagctgtggcacacgcgggctgcggcggcgagcggtgcctaggcatggcggcgacgtgcaagcggcggccagtgcggcaaagagaggaaaagaaaggaaggggaggaggagggagatgctcaccgagatgacgatgaccggcgcggggaaggacgacgacgaccacggtgatggcggcgccggcccggcaagcgagggggcggtcggggagcgtcttggcccgaggaaggagagagagagggattaggccgcgcgcggcgaccggagacagcgaggagaggccgccggaggcggtagaggtggtggtggctcgggttggcggctgaaccggggctccggtgatcgtttggggatttggagtggcggccggtgtgcggggcagcgcggcgaagccgagggtggcggcggatttgcgtggcgatggctgaggcggtgaggagtggtggcttgaggcgacacaggcggtggtggagctcgggtcgatggtggaagcagtcctcgggcgatggaatggacgggtggagtggcggccggggcgtggcacgatgcggcgaacccgaaggcggcatcggcgcggtgcggcagcggctagagtggcggtggcgggcagctggaggcggtggaaggggcggcggctcggtttcatggtggagatggaattccgacaatggaatggggaaacagagtggatgccgaggtagggcttggctcggtgatgccgaaggtggcggcggccctagcgacaggaaacggcggccggagctcgcctgaggtgggtggcgatggggagcagcgtggggagagcggggaaaagcgcagggagctcggggtggaggggggaaacggaagaggggagcacgagggtgctttatatagggctcggggaggcgggatcgggcccgagaggggtggaaaccagccggcgacgtgggggagagagagagagatgtgggaggcggcgacgtggccggattttgcggggagagtgggggaaaacggcgcggacgtgggcgacgaccgcgtccacgcacgcgcgggagaggcggcgacgtgggatgccgacgtgggcgaagtggagctcaatttggcgccaaaaattggggaaaagtgggggaaaatgtggaggagttggaggggaaccggtttcacttggtttgggtgcgagggcgcgagcgggagggcgccggatttggcgggacgtgggcggcaaccgccgaccatggcggcttcggcctgggaagccgaaggtaggaggagggcctgacaggtggggtcgccgggcccacctgtcggggagggagagagggaggagaacccagggggttatttagactttgcgcgaggggaaggaagataggtcgatggcccaaggaggaaggaaggaagaggggaggggacgggccgcagggagggaaggagggctttgggccggaagtggcccaaattgaaggaggggagatttgattgtttttctttttattaaactagcaaaaatgcccgtgtgttgcaatgggtgaaaaaattttaatgataatatacgtttttcatgcataatcatgtgaagacaatgtttgtattttaatgagcagcttgctttttttataaacggtgttttttttttcttccacgattttctcaaaccatttttcagaaatagcgcatttctttctaatagttttttcctagcatgtttttttttccattttttagtgatgacaaaaaccatatttttctcctcttttttgttttgcttttctcgcgtgtttttttgtcaattttttctgacaattactttctcgcgtggttttttttgcctgtttttttaaatgttattttttgcttttttccaatacatgagaatatatgacgaaataaaagccgtgtagtagatggtaaaaaattgatggatcctacccgactcaagcgtccatcaatttagcttttttctgacagatttttcagagcggtttttttaatagatagtgttttttcttgcgtggtttttttaaaccatttttttttagaaatgacgcattttttctgacagtcttttcctcgtatgtttttttaaaaagtttttgctggcaatggaaataatttttcacacgtgtttttttattttgtaagaagatggaaaaaaaaccttttcagcgtgttttttgcgcttttttctgacttttttctcacacgtctttttgatcgtttttattttctcatgcattttttatttttaaatagttagattagattagagatagagaagagatttatactgattagaaattggactttgtttcgccctttccatattttcttgcgtgcattttttattttatacgaaccagctttttttttttacgaaccatttttttgccactttattagagaatcggacaaacttttttagatgttttttcggatttttttcgcctttacaggaatcagacttttttccatttttaaaggaatcggatctagcgttttttttcaccagttttttttttttgccttttataggaattggattttttttcccgtttgcatctacagttttttttcgccacttaggggaaatagacttctgttgttgttttttttgtttattttcttttttgtgtggcttttctttttctttttatgcacctttctacctttgttatatcccttttatttattgttttttttaaaaaagaccaaaagcaccttattgcaagattatagggactcaaatgcaaatataaaaattacagggactcaaatacaaatgtacaaacccaaaaattaaaatcatataaaaatggaatgctctcgatatgtaggttccgtttttgcaaacagatcttcaatccagcacatcaattttttttcaccaagatgtatggaataatggtatagattgaaaccgagagaagtggtgcctagtatctcggacttaatctgagagaagtgggattcggatctagagtcggactttttgaatcgcaacaagaggagtcaaacttttttttatttttatcgctatttttttagggaccgactcggactttttttgtcgctattttgttttttcttttctttttttcgcacgtttttgttcgccggttttttttatcggacaaattttggtttttttttcgcccatttttttttgccttttttctggatcggacatatttggtttttttttcgcacttttttttccctggttttttttggatcggacaaacttggtttttttcgcccggtttttttgacggacgatggaagcacctcttattttttaagtagtagagattggttaaatgaactttgtgctattcaaattatttctcgagctccgaaaattcgtgaaatttcagagagtattttagggcacaaagaatattacaaaatattctcggccaatgatttttaaaggaaattttaattctcccattatttcactttattaaattgctttaacttttatttaatttctagaaaatgcattatttaatgatttttaatcctgaacgaaaatcggggcgttacacggatcctcctcggtctcacgcgcctccacacgcgataccttgtcggtggagcacactcgcagctagccgaagcagcagacagtgccctcttcctccaagctcctccttggtattgctccctccacgtcttgaaccaacgcttggcgatgcaaggagtgacatcggttgcagcagtagtaggaaacaaggatggagccgaggggaagggataaaaggagagaaggcatgtggtgcttgattcctcgtagctagccatacctcgcagccagccatgatacttgatacctcacaggtaccaggtatcaggtttaatacctgtgggtatcagccatgataccatagatattaagcatggtacctacaggtactgggtctgatacctgggtatcagcggtaataccacatgtatcaaacttggtacctatggggtaccgactgtggatgatacatcgcacaacatacttgcacacactccggcaatgagcatggtggctcg

SEQ ID NO: 63873 - DNA, 1466 bp, Oryza sativa
cagtgggtgtccatgcctcaaaagattgagacggaggaggaggcaatatgaccttgtaaccaacatgcactcagggtagaaccagcaatgaggaggagggggaggggatccgttttcggggggcctgcttcgccattgccatgccttcatagaggagctctctgcaacagagaggaggggaaggggaaaaggagggcaaaataggagaggcggaggaggaagacgaagactcggagagagaaggcaaatagataagaacaaagcgttacctacttattccatttccacgggatatggttgagtagtttttctgtttacatagtacatcatgccgaaactcctcatccattactatagttgaagatgcatgcttaattatttctatgtatgtatatatatatcctcttcacatatgtacatatcggtcatcagttccttgctccagcctttaatttggtcgctaatagtaaccgaaacacacgctatttaccaacttgagcaacactagaaatgggaggcatgtggaatcccatcagctgtggcaccaatcgacgaagttttagtatagcatcagctactgaagctctgggagccgacaccgtgggattgtaactcttttccacctcgtactcgcagcaggaatcgatcaaacaggaaaaaactggaattcctattagtacttgaaccatggatagctgcagtagcagttgtactatatactaatgtgctaacatgtgtcttggccggtatctcagtatatatggggttgaatttcactcgaggcgttgctgctagttgaatgtgaactgcattcttctaaagtgacagctgctggtaattgagctaatggatcgacactagggttttcaattttgatttcatccgaaattttggtactttttggaccttttttttttctcaaaattttagcataatttaactgaatttaactaaattttggccaaatttgcaaaaatttgagaaaaccgaaaatttcgactaaaataatcgcttgccagcaagggggcctgaaattttgaactgaaattgcaatccctgatcgacatgccaaatactttctggaggtaggagatgaaccgtattgtttagaaagttcacatcagtttcagagaacattgatgtgtgtgtgtgcgtttgtatgtgtgggttggggtaggggtgagcgttcggtttactcggttaattcagctcggtttcaacggtttaataaattttggttttctattgcaaccgaagaatctatataaaaaagaaaaccgagccgattaaacggagtaacttcggttcactgaacaaaccgttggaacacgttgccatgaggccacagccgtggcttcgcacgataacgtgatgataataaacagggcttgagacatgggtagcttaggagatgttgggccccattaaagagatgttgggccttaaagcttgcacgttgcctaatt

SEQ ID NO: 63874 - DNA, 1889 bp, Oryza sativa
taagttttagtagcctcgtctaccacagattttggagcgagaccgtggtgggtagactgctggagcccttgtttgtgttgcattggcagtaatcttcatagaggaagaagttatgtaaatgtattgcaatgacagtaatctttatagaggaagaagttatgtaaatgtacaagaaccgtaaaatttctggtaaacaatggccgctggtcacaactgatcgttggccaccttctcgcaaccgcaactattgctcactgcgtcacatatgattaagtgtgcagaagatatttgatctggcacacaggatcagcacacgtcttcgcatcatcatataccttttgttcttctggacgaggaggccatgctagtcgttaaatattttctttttatttggataaattttctttttatttggataacttagtgtaacatagtggtagaaatataatatctctatttataaacaatccattatatagatcacacccatgacccatccaaacatgtgcgtaaaatacaatgtagaattctagttataaaacagtcaagtagttctaaagaaaatttctccgagtatccaagttttagcctaagcacaacaaatttccacaacaatacaaaataaatttacaagtacaaatcttcaacaaattccttgtgtaccaccgttattttgccgcatactttgtcactcattgtctttctaccagttgtgacatcatgaggtctttcagtactagtactacacatggaattgtctatagaacagattggtgaagatacgagctattcctctcgttaaaatatatgatatttgatttttgaccataaattttttattaggatacgcttatagataagttaagtttatgactttatggaagtgcttgacaaagcaaaactgaggttgtgctcacatatcatggactcatgggtcatcttaggctgaggcatcaagaatggagtaaagctcaaagcaagcagacactgtaatacgaaagcttatgcatccatgaaaatgctcatcataattttgacccttaaatgttccattatagtaattaagcgataatagacatggaatataagaaatagaataatctaaggtgtgcttctgcagtgaaagatgaagttataacaaggacaataacaagtgagaatgtataaaagaataatccttacatgcaactgattgcgaagaagctctgactttgtttcctgttatataaaaggaaaaaaacataaatatttatgaatgtaataatatgcttatatcattatatgccacaccatggtagaatattttttaagaaacatataaaaggtgctcaaagcctgttcattgagggcttctcttagtttattgattaggtttattccagccatgttgacactttcaagttgctcagcctcaatgcactgctttaggactgcttcctgccattgaaggtcagaaaacaactatgatctttgctgaatacctatgaaatagaaaaggagtaaggtgttataagtgcatagattattttgatcaagaatttaagtaaaaggctgaaagtattatagcatcaaagtatcatatctcttcatatccagtctccaactttgtaaataaagaaaaaaaagtaaattcaggtttcagattatcagagctaaggagcattgttaataggaaactttgcagtgcaatattgttctacactgtaactcatcaaaaaaacttagtcagatttgaaaatagcaacaatccataattatggcatacatgcatggtagcactatattcaagtagataatccacagcaataatccggtaaataatctgttccaaacaggaactcatgcaaggacaatgcattaatttggtattgagttgttttagctgagta

SEQ ID NO: 63875 - DNA, 15019 bp, Oryza sativa
acacctgtccacaaaatggtcgttcagacttcagcttcctttgtcagttattaatcatgtacagagtactatttttggcataatcatgaaacatcaaagtaaccatgtgtcatggcaccttccgaagattccccaacctcggaatgatcgcagattccatcatgaattgggtcaggctggtcattgcttggtgcttgctaaccttagtgaagattgattgcacacacagtcctgctgcaaatcactcatcccttcagtcatctcctgcacagtcatcagcccatgtctatcaaacctatgtggcttcagtaggtcatcactccttattggaacatctcaatacctggtttttcacctcccttcaggtgatgaaatcagtcaaaaactcaaaacaatccatgctggagcaagttgacttggtcacccttcagcaatcagcacatccaacagctcaatagatctcctaagctttctctcccggaacacagactcaatcagccttgcccagcatctagcctctggcatgaacccagtgtccaccagtccatacaatgtgactgttgcatctgataccctcccaacatcacacagaccaatcaacagcatgtttgatgctgcatagtgaggtacaaatcctcgtccgagcatcatgcccagcaagccagccgctttctccatctctccacatgagcacaggcaattcatcacaatccggtagcttgcgacattcagctgtactccttcggacggtaacttctcaagcaaggtcactgcttccgctatccgtctatctttgcacaacccctcaagcagcagattgtatgtgacaacatcagccttacaccctttctgccacatctcctgcacaagattgatcccctcatccacattcccatgccgacaaaggcatccaacaagtgaggtatagctgacagcatccggctgaaccccagatctaatcatctcctcaaatacccccctcgctgcctccacttcccctttcttacagtgcccattgatcaaagtggcatagttgaaggcatttggctcgcactcattcttcctcataaatccaaagatcgattgtgctttctccacctgtcctagcctgcagaatccaccgatgagcaaattgtatgttagctggtctggcacaatgcggtccttctcgatcatgtcctcaaatagttcaaacgcttccttcatctgagccccacgacagagcccacctatcaatgttgaataggtgactaagcttggtctaacatcagcgcagttcatcttacgcatttcatcaaacacctggaaggctgtccccaaatcgcctttcttgacgtaatgcttgatgaggatgttgtagatgcacgtgttgggctgcggaaggtacttgctccgggggtcgcgcaggtcggccaggagctcggtgagaacatcggggcagcggcgggaggagacgaggcggtcgaggcagacggcgagggccttgcgggagacgcggccccggcggaggagcgcggggaggaggcggaggagcgcgagggagtggtcgggcgggaggaggcggaggagcgggaggaactgcggctcgaggaagcggcagggcgcggaggcggcgcggcggaggacggcggcggcggcggaggggaggcgagagcgggcgaggcggacgaggagcgcggcgaaggtggccggggtgtgcgagaagccgcgctgcgcggcggcggcgttgaagaggtcgagcgcgcgctgcgcggagggggaggaggcgatgaggcgggctaggtcggggtggtggacgtaccgcagctgcgtgaggggcgcttcgggcagcggaagcggcggcggcggcggggagggcggcgcggcgcgtgtggggcttcggtagtggagcggggagatccacgggagcggggctttggtggaagcgggtgagggtttcatgctcccctgcggcggcggatgctggggaggaaacaggctagggcggcgggcggcaggacgccgtggaatcgcggcgccgccctcgtgtggtgtctcgcgagcgcagcgcaggcagggcgccggagcggagcggagcaggagcaaggcgagtgtcctctgccttggctgggccgtttgtcaaatcttggacgctctttttgtatgtttggatggccaggatttctctaggcttcacgggagtggctgtgttcttgctgtgttcttcccccgttttccgcgcgtacgcttttcaaactactaaacggtgtgatttatataaaaactttctatataaaagttgtttaaaaaaatcatgttaatctatttttttaaaaaaaatagttaatacttaattaatcatgcaataaaatgaacttcgttttacgtgccggggaagaggggtttcttgttgtaaatttagtcataattcggcatattttaatccaaaatattaagacaataaacatgacatttgcaatatgagtagatctagtgacagtgcaagatgtatacaacttgagtatgcttgatatgaaataagtatcaacatttacatagtaacgcaatactgccattgcgaagagtattaacaaagaaacatctaatagaatcgggagaatgaaagtataccccgagaacgtcccaccgctggattttgaggcagtactacctccgttgatgtcgttcattatcttgtctccaatctccgtcgacatcttggtgaaggcgtcgatgcagcagcagtagccgtgaagaacaagagcagttcgtccgcctacccgtgcaggttctcaagcggatggagtttcggaggcacctgctcgtcccgtacacctgtgcacgcaggtgaacagaatcggggaaggattttgcagctcaggaacagaggaggaggaactcgaagtgcaagagaggccgggaagaacttctcccgtccttctagtcactgcggagtatataatatgcgagtgcgagagtaacgttcggagtcatcaaccacggtgtttaatttcgtaaccgatgcgctcgttaatacggaatcaattcacggcatttaattccataaccgacggaatcaattcacggtgtttaattctgtaaccgacggaatcaattcacgacgtttacttccgtaaccgacgcgttcattgatacgaaatcaattctccgtatttattaccgtccgttacaaaacgagagagtgtagcaaatgtctgcctcgcctcgcctcgcctcgcctcgcccgcctggctgtccgcgcaccatctcaaccggtcaacagagactaactccgtatttaagttgagacctcttcacccgatttccaaggtggtattattacccatagcacttaatgtgggccaatggaatttattaggatttaattgggcttagcccattaatctaacaatccccaccaaatttcatggctcacaggaaatgctctcgattctgatcttgtttgttataccagtgtttcggtggagactgttaagttgaacttcctcctaggaaaaaagctacaccagattacaactgaaaaatggactataccttgaattgtcagtcttgtgcgattcaggtttcactcaaacccttaactggtactaggctgccgtttgcatcccctctgtttggagcgtataagtcatactcccggccttttcatgagtatctagagatcaaccagatctcatagactgtgactagcagtcggactcatataggtgtgttccttctaagatgttctgtaggccaacatatctgctttatgaaaagctactcggattacattaaggtgtataccatcctaccatacagattagaagagaagtgcatcatgaagataagcccattttagggtctcttctctcagttacacaatagtttgtttcgccatccaaattcacgggatctctgatcacaatagacaggtttccattattgtgcaactctaagtgggtctcaagcccatctccctcgatgcacagtctatcacattacgtggtagccccttggtaaactgatctgccagatttttagccgtctggacatagtccaatgctatcactccggagtttttctgctttctgacagacttcagtcttcttttaacatgcctggatgacttcatgttgtccttcgaactgttcactttaataatcattgtttgattatcacagttcatcaggattgctggtactggtttttcaaccatcggcaagtccatcaggagctcacgaagccattcggcctcaactgtggcagtatctaaaactgtgagttatgcttccattgtagaccttgttaagatggtctgcttgcaagacttacaggaaacagcgtcccctccaagtgtgaacacatacccacttgtggcctttatctcatcagcatcagatatccagtttgaatcactatagccctctagtacttttgggtacccagagtagtaaatttcatagctcattgtcccttttagatagcgcattactctttcaagagcatgccaatgatcatctcccggatttgaaacaaaccggctcaacttgctcacagcaaatgagatgtcaggccttgttgcactagctaagtacatcaatgaaccaataatctaggagtatctccattgatcccttgctattcttcggtttttccttaatagcacactaggatcataaggagtaggagctgccttgcagtcactataaccaaagcgactcaggaccttgtccacatagtgagattgcacaagtataatcccaccctcatctcctctcggtagtttaatgttaagaattacatcagctactcccaaatccttcatttcaaagcttttggacagaaagtccttgacctcctcaatcacattgagtctggtcccaaagatcaatatgtcatcgacatataaacacaagatcactccctctcccccaccatagcgatagtacacacatttgtcagcttcattcacaacaaagccagcagatgtaagtgtattgtcaaacttctcatgccattgcttaggcgcttgtttgagaccatacaaggacttcaacagcttgcacaccattccctcttgaccttctagtacatacccatctggttgatccatatagatctcctcctccaaccctccattgaggaaagctgtcttaacatccatctgatggacgagtagaccatgagaggctgccagagtgagtagtactcgaatcgtagtcaagcgaacaaccggtgaataagtgtcaaaaaagtcctcgccttctttttgggtataacccttggccacaagccttgctttatacttttcgattgtaccatcagccctaagctttttcttgaaagcccatttgcatcttacaggcttgcacccatatggacgctcaatgacttcccaagtaccattagacataattgagtccatctcattgcataccgcttccttccaatagtcagcgtcaggagatgaatatacctcttcaatggttcttggagtatcatccacaagatatacaatgtagtcatctccaaaaaactttgcagtcctttgtctcttactctttcgagttgctacaatgttatcctcctcaggatttcctcaagcatttgatcaatgtgttctatcggtgcaaactgctcaggggataaaataggttcttgactagaagtgcttggtgcatttttcataggaaattcattctcaaaaaatgtagcatctctggactcagtaattgtaccaacacgcatgtcaggtactccagaatttactattaagaacctatatcccacaccgtggatagcataaccaaagaacacacaatctacggtctttggtccaagtttacgctttttggctataggtacatttaccttggccaaacagccccatgtgcgctggtgtgagagatttaatttcttcctttcccttcctcgaatggtgttacttccttaagcttagtaggaattctattcaggacatgacacacaatcaatattgcctcacccaccattccttggacagtcctgcagtgtctaacatggcattcaccatctcagttagagtacggttctttctttcggctaccccgtttgactggggtgaataggggggcatcctctcatgaataattccatactctttgcagaaagaaataaactcattggaaaaatactctccacccctatcagacctcaaccttttgattttcctttccagttggttttctacctcagcgttatagatcttaaagtaatgtaatgcttcatcctttgttttcaataggtacacatagcagaatctagtgcaatcatctatcagtgtcatgaaatatttctttccccctttacttaacacgttattaatttcgcatagatcggaatgaacaagttctagtggtgccaaattcctcgcctcgatgccttatgaggcttgcgaggttgtttcaattgaacacaagtatggcacttagagcgtttgactaaactgaattttggaattaaactcatgttggctaagcgtgtcatacaaccaaaattcacaaaattcacatgacaaagtcgcgaatgccacacattggactcatcatcatcatcgcctacatggttcacaactttattacatatatcatccaaggaaagcggaacaagcctccgctgtcataaccttttccaataaacattccatatttagatacgacacatttattggattcaaacacaagtctaaaaccatctctacacagtacagagccgctaactagattcttctttattgaagggacatgctgcatgttcttcagctgcacgatctttcccgaagtaaacttcagatcgaccataccaacaccatgaatagccgcaagcgatccatttcccatcaacaaggaggaacctctcccgacctgataagaagaaacagagaaatgccagcacacacatgaatattagcaccagtatcaacccaccaatcaggtgagtgacagacagagagaactataggtaaaaatttaccatacctcgatgttcctccgccctcactaataaccatgtttgtagacttcttgttcttgcgcttaggacaatccttggaccaatgcccaggcttgccacacacaaagcaatctccttttacctttcccttgcctttcttcttaaaattggttgtagccttgggtttgacgtcaggtttgactttcttgttgttgttgtgggatgcgtgagggttcttcttctgcaccaaattggcactagaacctccctcgatctttttgccccggttgccctttgcccttgacttctcctcaacacccaaagagccaataagatcagtaacactgaactcttgcctcttgtgttttagagaagtagcaaagtccgtccaagaaggtggcaatttggcaataatgccacctgccacaaacttgtccggcaactcacagttgttgttctcaagttcctttgccaacatctgaatctcatgagtctgttccactatagaacggtcatcgaccatcttgtagtcatagaactgctccatgacatacagctcgctgccggcgtcagaaaccctgaacttggcctcaagagcatcccacatgtccttccctgaaggcatgtgcatatacacgtccacaatactatcggcgagcacactgatcaatgctccacggaacaagcaatccgtagcctcaaacttagcctcctcctcaggggagatagacggttcactcggtttgccccgtgaaacaaagaaacattgcatcgccgtcaaccacaaaagtgcatgtgctttccatcttttataatttgaaccatcgaaagcatgtggttttagtgatgcagcaaagccaactaccgaaaaagacctattaagtttttggattgttggaaatttggtcataattcagcatattttaatccaaaatagtaagacaataaacatgacatttgcaatatgagtagatctagtgacagtgctagatgtatacaacttgagtatgcttaatataaaataagcatcaacatttacatattaacacaatgatgccattgcgaagagtattaacaaagaaacatctaatagaatcgggagaatgaaagtataccccgagaacgtcccaccgctggattttgaggcagcactgcctccgttgatgtcgttcatcatcttgtctccaatctccgtcgacatcttggtgaaggtgacgatgcagctgcagtagccgtgaagagcaagagcagtcgcgcttgaagcgctacccaaaatcttgatcgtccgtctacccgtgcaggttctcaagcggacggagtttcagaggcacctgctcatcccgtacacctgtgcgcgcaggtgaacagaaccggggaaggattttgcagctcaggaacagaggaggaggaactcgaagtgcaagagagatcgggaagaacttctccagtccttctggtcgctgcggagtatataatatgcgagcgcgagagtaacgctcggagtcatcaaccgcggtgtttaatttcgaaaccgacgcgctcgttaatacggaatcaattcatggcatttaattccgtaaccgacggaatcaattcatggtgtttaattccgtaacgacgcgttcattgatacgaaatcaattctctgtgtttattactgtccattacaaaacgagagagcgcagcagcagcagctgtctgtctcgcctcgtctcgccccgcctggctgtccgcgcaccatctcaactggtcaacagagactctccactaactccgtatttaagttgagacctcttcacccgatttccaaggtggtattattacccatagcacttaatgtgggctaatggaatttattaggatttaattgggcctagcccattaatctaacatttccaaccccctcctctgaacaaaaggctacttttccaacttcacctattttatttttgacgtgcacgtttttaacttaataaacggtgtgactttttacaataactattatatagcattcaagcgtcctagcgatcgtgtcgaccacatgacctgaaatgggacaggctggcttattagttcttttttaatggctttatcctgcgggcttaaggactttcgcgaatcctgtgagcatgggctaacgatgagggttgtcgttgttgcgaaatctgattaaatgacgtggatcgccgttgttgcaggatccgatgatttgccaattgttgcgagaatcaccgcagcagagataattggcagatgtgattgatgaaaagcttgtgaccttaaccttgccggcatacaccatgaagtatgcttcaagcactgacgggcgtgggcattaaaagatttatggcgtttatgggtacagcaacacacctctgcagagtgtatgaattgtgatatgtcactccctgtttcgggtagaaactgtaaacgtggcaggaaagaaatatatcggaagttctaatacctgtggtaccttatatgcagtagatttttataattactttatatgagcttttacaatactgttttataaacatgcacaggcccggccctggaggggggcaagcggtgcggccgctctggcccccgactcgtaggtgtccctctccacccgcttcacccccctctggcccaacagaaactgatgcatgcgggaggtaagagcatgcccagcagctcttctatccggtcatccatcctttgtttagcatatggaggggaaaaatcatgctccagcaaacactccatcacacacgccatttttagacatcctccaaaccgagccctctccatgccaaatttggcgtttctctctcctcacgtcatccccccaactgcctagctccgatgactcgcgccaccatccggactgtaccatggggaaacagagaggatggacataccaggtctgccatttggagatcgccggagtggaagccccgccatccgcgccgccccaccgctcgcaccgctgctccttcatcgtgttgcccccgtcgggactcctctgcgcgcagcctccgcggccaccgcgtgcctcctccctgtccagatgcaccctcgtcggtcgtcctccaccgcccctcgctcgcccgactgccgccgcccctgggctcgccagcttgatgtagagaagtagtactagtaggaacaaagaagaacgatgcagagaactagtactagtaggaaaaagaagaaatagttgagcagtagtactagcatatagtagtatatgttacttgcattgcttttatactcattttaaatatatgagttaaaaattatccattaaaaatatatctgttaaaatttactcatttcgaaatattatagcgataaataacaccgttaaattaagttattcaaaatatatcccttcaaatacaaatgtaaagttagttggaagatattataaaatatagaagaatgtgatatggaggatgcaatttggatgatctgctggagtgagaagagatatggaagatgaatctttttggatgaccatccatataggaatatgcaggatcgaatttggatgagttgctggagacgctccgagttcctgagaatcccgacggcatcgacgcgcgcgatcacgccgaaccgccgctcacgtcctgacgcgaagtcgcgaacgcaagatcgcggccgctggcagtagcaccgtcgcaacacctcagccatctcgtccaaggccgccgtccgctggccgtttccgcgcacttccgcttccgccgcgcgacgcccatgcgaggcgccagagacgcagccgccgagccgcgcaggtttcttgccgttgccgtgttctacacttcttctcatgcctcattgatgtcttgctgttgctaatttgctgaggttgtgtttagtttgtgtgccaaaattttttttaagtatacggatacatatttgaagtatcaaacgtaaactaataacaaaacaaattacagattccacctgaaaattgtgagacgaatctattaagcctaattaatctatcattagcaaatgtctactgtagcaccacattgttaaatcatagcgtaattaggctcaaaagattcgtctcgcaatttacatacaaactgtgcaattgatttttttcgtccatatttagtgtttcatgtatgtgtccaaatatttaatgtgatgaaaaagttaaaagtttaaagaaaaaagtttaaatctaagcacggcctaaatcactgcgacgatcactgattcactttactggtctagtgagcagcaacaacaccattgccatatgaaaaattgtaactatgattccatgtgtaaattgtaatctgttatttgttgcctgttgctaattcaattggacgagtgttggatgaaccaacaatggcagtgtgtgtcccgacgcacttgcggactggtcgtgcgctgcgcactcggatacttgcaatcaactacttggtaagatatactaaatctagatttgtaattttctagcatactttatacgagttaaaacactgtagttatgttaattttttcaatcattaggccatattgtcgataaagtatgcatcggatagcgagaaaaggggaaaaacgaaaaagagtggatggtttaataaaagcctagaaaggagcattggacaaatttttaagaggtaacacgtgaacgtcaagcaaatataattttaaggtaatatgtacaatgttttctataaaaattctatttctgaatgcaatttaaacgtttatggcaataactcatatatatacgttaacaacctctacatttagtttcgcatcgggaccttaaaaactcaggaccggccctgcttgctagctccaatttcttgcatgctcattgggaagaaatcacttgtgctctccaactatactgacaacgcctaattaaaagattgatcctactaacactatgggtttgttcggcggttcagtacagttgcagacacaatacactatttgtgttggccgcacaacagtgaaattaagtacaattgagccgggcctatatctctcattgttttctggttagcttatcaaccacatgaaaaattaaattttagaacttgaatttaattttaagttaaatttgtggttttaaattaaagttaatttataggttctctcatcgtattgtatctttcggcgtttacttttaaagctctaaacatagatataaaaacttgcccataaattatctttggttgattcattcgccagctcagaaatcttgtagaaacatagggattgttcattttatagtcaaaatcaactttaccaaattttgatgatgccaaattttgacacgttttgacgttaccggatttttatactatcggttgtgtttatttgaaaccttatcaaattttggttgagtttttgtgagagaacttccggaattgccaatctttgttagggtgacaatgataacattatatttagtttgtttccctaccaaaacctagtcatatcaaaacttgataaagttgaaagtagcaataaagtgtatatatccatgaatcaaaggtataaaacttaatatattttaattgatatatacggatggtttatattttagaaacacacatggaagccatatttacttgatttcaacatctactgacgaattgagatccggtgctgtagtagtaacaactgcaaccttggcagtcggagcacattataaccgttggatcgatggacccaacagctcggattcgctctaccatcccgttgcaccatcgatgctacagtaaccgctacagtgtaagtttgccacagtattttatgaacaatactttcttaccatctgagccgtcagttttttatccatcggctgcactgcaactgctaaacatgcagtcgtagatctcgatcctcaccaaggcacatgctagcacagcacaaagaaacgtaggagtactctgctgccataaaggcaaaaccatgtggcttcaccttctctgctgcaagagttccaattcctatgcatgccaatgtttctccattgtaaattacctgggtgatgaggagagcagcaacctctagttataagccaagaataatgtggagccgtggaggtgctggagagtcaaaagaactcaagttttagtagagtgaaggagaacagcattgtgacattctctaatgtgaggtacatgcctttctcggtttgatagataatgatgtagggctatcaagtatttacccaatgcttacatttgtttgttggtgtgtatttccacataagataggtgtggcactggatgcccgtaggtcgtatgtgcaatgcataggagtgggattgtgaggcagctttgggaatgatcggcatctaccacgtttacatgacagtctctctttcagatcacgaggatactttaaaaaaaaggagatttggaggcagcggcgaagccaggatttaggtattaggggggccaaccataaggtcaatgtatccaaaagaaagcttattggctgcttggtgaacaacgtgttgtatgcatgatcagttttcacccccctacagaatggtgtccttgcaatcaatcttgtgtggacgtctaggcggtttatctccatccatccacttctttagtaaggctgagttgttttggacaacttctcggtttttcatgaggtactacctaaacggttaaataaattgtttgtaggaaagttttttatataagtttcttaatatattttataagtttctaataattaatacctaattaatcatatgctgccgttagaaatatacttccaatcgctgaatcgaatgcaacctaagaattacataattgaatcatgcaagagagagttaaacacaatttatgtactccctccgtttcacaatgtaagtcattctagcattcccacattcatattgatgttaatgaatctagacatatatatctatctagattcattaccataaatatgaatatgggaaatgatagaatgacttacattgtgaaacggagaaagtagttctatactagcagtctagcactgagatttgatgcactacaaaacatctcaattacttctttaatttgaagactccatcctgttaatttgtcgcatcacatcaaaagcttcacccagctgcttgcgggagttttagtgagttgctgatcgatgctcccagctagagctatgcatacgcattcagctacacatatccatactcgcagttagtgagttgctagctaccgatatatactcttgcatctattaattatttatctagggaagggaggggggaggaggggggaggatcagaggatgaggggtgccaggccctccccggcaccccctgtggtgaacccatgtggcctcgccactgtttggagggagatacgtgtcttcaaacattcttttaagaaaaaattaaaaaaattgtgagcgtgttaggattaaacacgggacctcagggttaaaactacacatagcttgttactgcactacattagaacacgaggatactacaacaagcaagaggtggcagacttgagagataattaatgctagaccacataatcatggatagctaccaatggacacacagtggaaccgaggatgagtttgaagatccaccgaagctcacatgagtgtaattgatcaatcacagaagttgttgattgtgtgtgtcccgtagttcgtagatagttgccccttcattgcagatcatccttactcaaattgataaacaatgctaccaaagtcgacacatacaagtacagaagtgcagcgagcaggcggttttgctttcctaatcagatcgaaaagtggtttcaaaattaatactatatttgattcaaacctcttgcatgactaattcattttttcctcatagatccggcagataaaatacattaatatactaccttatgcttgacattgaaaaaaaatatatttttttataatttcagttttcaattttcaattattccaatgggcaccagtacccgccactctgcctgcagcacgagagcggcacctggtttgttcatgtttccgacggccgtccaaaaccgccaaa

SEQ ID NO: 63876 - DNA, 27868 bp, Oryza sativa
cctgaggaaactgatgtgcaaaaacaagcgtcatcagagcatgaaccataaaatggccataattcgaagtaataggacagtaaaccgttcacaggtttgtggggggtacatactacataattcaaactttaaaaaacagattctatctccagaaagattatcattgcctatttcagtagctgtatttgtgaacaaaagtaaaggacagacaatctacaagacatggtaggcttcagcaggctagcatacaacataagcacataaattattgtatgaatttatgatctcgactggctataacatatattctaattcaaaaaatataatcattatcctcaaacctaaaagattgtatacataaaacaaataaaataaactggacacacactgtacatatgatttttaacaaaaacagattcatgcttataggaacataaatagaccaattcctaaagaaatatcaaccacagattggtcaataggtcaagactattaaccttcttggtaagtctttgcttggtcagaatggatatggatgaatggttacgttgaggatagcgacgtagtgcactgttcattttacaaatgtaattccaaatgcccttggcaaatgccagttttgccatctctatgttcatgccgttgtcttcatgatgcagcactgtaattcggcatgcatcccttccagggactgtaaagtaacataaagcatataagcaacatcaaatttaaaagtagttgaacatatatgagatacatccccagaaaataacaatttatagatgccttttgatcataattataacaaagaaaattgagagtcgagataagctagcaaaaatggcatgtcataatggctcaactttcagttgcatattcaaggtcataaagaaaattgatggcaaggagaagaaatgtgtgacaatggtatttattcttcaaaaataaacacttaaaagaatatttgttttattttcagttgatacacagcctgcttatagcttcagtagaactcttcccattctgtttggttaacaagtacaacagaactattagtgtattaactcatggatgcagaaacaaaaattacaagcctttcattcttatcagctaacaaattcatccaactgcatttcaatctaaatattaaagtataaaatatatactgtagatactagaggctggtaaagcattaccaaacaattagatcatttgaagttattctatgcgtattttttagaaattacatcgacgcaatacataccactgaaacaagataggtcattctaaactcaataaggaccgcaaaaagaaggccttctatgaatattagagttgacttacttttcctaatgcaccatcctgatctcaaaagttgcactcgaacaaatttccgctgtcttggtgcaacaggatgctcacattcctgtccaggttaacaaattggcaacaacagaacaaattgtaaaaaatgactgagtggtcaaagaaaataagataatggggataaggttaatgtcatcaaaattgcatatgaaatactcgtgtgaaattggtgagttcattctaaggttgtatattcaattagatttcaactgattttgtattttctcaaattgggcgtgtacagtgcattatccctagaatttgtgtattctcggctatatcagtggtgttttaggctgtttgtttacaatgcagaatgcaggaattctacagggagcagtttacttcccacaataggtgaaattcccacatcctaaacaggtccttagttcatttaaaaatgtcaagcataggatcaaaaccaattcaacttgaatttcatattagaattgaagatgtagttaggacacaatcaacaattgtggcatcattggtttcttctgcaactgactccatgagcattaccgaaagcttagaccttatataagtacattactgaacgaataatctacaatgtttacattactgcataagtacaaaagccaaaacaatgacaccaaagtatatcacacttttacctcgcaaaaaaaatatcgcttttaaacagttgagaatttaatgacgagaaaggatggagagagagatgtgactaaccttcaccaaacagtagaaagacttgtcatttccttcccaaactcgccatgccaatatgtactcccttggtgttaagagcggaaacttcttgattgtacgccctatctctattccactattttcatcaaactgtagctgctcatgctttatcacagtgttatcccactccattctatactcattatccatgtaaaagtccctcaatagctctgttgagcatctctcatatgttgtcacactaagatatctaggagggccttcctgcataggggaatataactgttacataaagaaactgaattgttaaacttgagcaagcaaatagaatcttgggaattgtgatgttcccaaaaatgtaatgggtcaaaggacatcatggaaatagcatcacaaaatgaaaccaggcatcaaaatccaatcatggcagaacccagcgaaaattcctaaaccctaggtaacttcacgtagactgcatcagctgatcagtaattaatcccccaactattttgaattctaaagtattaaggctttgtttgcaaaagctggttcccaactccatacttacgttttccacgcgcacgcttttcaaactgataaacagtgtgttttttacaaaaaaattctatacgaaagttgcttcaaaaatcatattgatccatttttgaacaaaaaaattaacaaatacttaattaatcacgtgctaatggaccgctccgtgttccgtttttactgtttgggttgggaacatgttcttgcaaacagagcctaaatagctttagtttcttttgtcaattcttaaccaaaaaaatcatgatcaagtacctagagcacacataaaccaatatcaataattctagtgtggttctaagatctcacccacagagttggcatgctcccaccgtcccataaaaatttaagcccattaggggaatagaccaagggatattgagaaggtgataccaaaattagctccaaacagtgatatcaaatgacaccctacaactacgcatccacttttaaagcattaaggcagggtggatggggttgaattattctaatacctacaatcttaattttctcgatcgacttgtactcttgcactatgaagtatgaactacccatacagtaagcattagttgtggcctttcgcagctagtaaatcgcatggacacaagtaggcagagtaaattcacaatccgccttacgataagaagcagatcattagaacatttccattggccagcaacaatataaaacaataaaacatttccagtgacccgcaacaatataaaacaagatcaatggattcaacaagaacaggaggagatagagctaccatgggcttgtcgcaccacaccctgtaggagacgtcatcgttccctttggcgaccacctgctgccacccctccctctccggctcacgcgcggccaccccgaggttgcccaccagctcccgcagatcgccctccgtcacaaggccatccatcctgcgaaatccacacccccacggagcaaaccctgatcaaatcacattctcgctcaaaaaaaaaaaaccccgcgcgagagggccaaggagcggaggggaccaaaccctgcggcggagcctggggcggagtccgcggtgacgacggcggcggcggcggcggaggaggaggagacggcgtcagcaggtcggaggcggcggcggaggcggaggcggcggaggaggaggacggagaggtgggaggcgaggagcaggaggagcgccgcggcggtggcccacccgccgccgcgggcgacgggccgccagagctcggcgccgccgccgaggaggaggagccgcggggcggcggcctccggcggcggcggcacggcgcgccccgcggccatcggcgtggaatccgtctcccccgccatgttagccctgcgtgcgtgtgaaccgcgttgatccgcgagcgaccgccgcgggcgctttgttgggctgcggaggagggttggttcctttcgtggcgggggagaaagcgaggaaaaaggagacgatggatgggcgagagaaaaaaaaaagaaaaagaaaaagaggaggaggcgaagcgatggaaccgaagaaaatgggggcatttggaatttctgggagtgtgggcagcgacgtaattataggataatgctcactatttctgtgagcagtgtttttctcgcgtctgggatgtttctctaaaaagaggtaatggtgtagattgatttagtggaagttttcaaaagatatacatgggccgggaatttttagttgtcaattatacgtatattcattcgtgatcattatcctttgcttatgaaattatggcgtgctacaagctcttgggatcatccatcgtagtcaagcttttaaaatagtttctgaatttctggatttttcactttttggtcctttgaaaaaacttatttcgcaaatagatccctggaaaaacttatcccagaaatgatcctttttggggcgccagagtggctggcgccgtcgtccaattagaaggcgccagccgtccccctgccgacgtggcggggcgatgctgaggtggctagggggagcacgccatagtggctggcgcccctcccccccgaattttttttatttttcttttatttttttttcacgcttagggacacataagaaccaaccatagaaaaaatgaactcaaatggacataatatgtgacttgtagaattttttttctcctctcatctctctccgaactagtacagaggagagagatgtgcaaatttttttattattatttttttgatatttttttcacacttagaaactcacaagaaccaaccatataaaaaataaacttaaacggacgaaatatgtggcctgtggaattttcgaaagctttaccgaaaaacttctctcctcaaaaacacaatcttgcaagcggaattcagaggttttaatatcgccaaacccggcgaagccatggagaatcggatgtaactttttctgtagatgtccgtgaatatattatttgcctgattccgagtccatatgagaaagttacgcctattttaataaatgacatattttgtctgttccggtagagttttggaaaattctacaagtcacatattttgtccatttgagtttattttttatatggttggttcctatgttctcctaagtgtgaaaaaatatcaaataaatgaaataaaaataaaaaaaattgtatctttttgtactgtttaacttatggctatcatttcatttggctatattttgaattagattaagtaatttcatatagtgatagagtgcattatgtgtaacatgctgatcaaaggatattactaaaggagttatgcaaagggttttactaaaggagttatagtctaattttagtgaaggtgcaaagtagactaagtggtatgctagctattttcagacttagctaagtggtagttcgagtttatattttttttatggttggttgtatcatgatcctaagtgtgaaaaaatatccgaaaaaataaaacaaaaatgacactgttgcaactacatacagagaaacagggatggaggcgaggggttggggggggggcggcgccagcatggctggcgccctcttcctgccacgtcggttcgcgagtgccacggtggcaggaggacggcgccagccactctggcgtcccaaaaaggaccatttgtggaataagttttttcagaggtctatttgtgaaataagtttttcaaaagggggacggcgccaaccactctggcgtcccaaaaaggaccatttctagaataagttttttcagaggtctatttgtgaaataagtttttcaaaagagggacggcgccaaccactctggcgtcccaaaaaggaccatttctggaataagttttttcagaggtctatttgcgaaataagtttttcaaaaggaccaaaatgtgaaaaatccagttctaaagttacttgctggtgatattttgttatgtacttaaaaaatggttttatttgttagatgtgatgggactaactatttatggaagagttatgataacgcttgtatgtaagaggacgttagagttatgataacgcttgtatgtaagaggatgttttctaaatggttggatcaactttatgcttacatgtgttgaggagccatatcattgtagaatgtaatagcatgatttttcatgcaccttgtttcaagtaaacaaaccaatcaatgaaatctaaaccccaaatccttaatagcgggagaataatgtcgttctctgtagtaccgtgtctataatagctattgctgatatttaagacctacccgcaggtgtagttgatgtttgatttactgttatcgagatttggcattagaaattttgataagtttttatagtcacccctaaaatattatatctattttttctatgaaaaacgtacaagcgctaggaacccataacatagtagtaaaggcatgtcacaaagttgtaaaaacctattcgtactaatgaagataaagattaaataaggccatacatgataagaaagttattagtgtatgattaattaagttttaattattataaacttaaaaattaaatttatttaatattttagagtaacttcaatatagaaaatttttgcacggaacatatcgctcagcaattagaaaagcttggtaatagaaagcatgcatctctgttagaaaagaacacggcctaaatccagtccaatttttcatcccactatcataggatagtggcccaataggtccactttggcagtaaaaacgtcccaggctcccagcccatcacggcctagtatcatgcccgaagggagaaggaaaaaagttcacctcaggttcctcagtttactgccgagttacaaaatcatccctaaaagaaaaaaaaaagaaagatataacgccttccttgccttacaaaatcagatcattttgagttctaagacagtattgcttccatttttaggtgacatggtggctgaatcagtatggtacccatatgtcatactcacaaaaaaaaatcctcttcatgagtccccaatctctcccgctccacccaccatccacagcatgagtccgcacaagcgggcatgctcggcactggccctgtcggtgttgcgggagacgaggcgccatggagaagataacgccaacagcgggtggaggcggcgaagcccgtcttctgagaagctatgtcgagctccattagtatatgttgtgtctagctcatggtgtcgttctattgcgcactcagcctggtgccgcccgacagcgatgccggcaccaggtgacagctcgccgatgcgtcaacctcacagccagcgatcttgaggtctctatagcacgagacgaacatatggtagcagtagtcggacttgaagcgctcgccgtcagtggcccaatcagaggcatctcacatctagcggtcggggaagatctggccaccttgggtgacgagtgggtagtgatggacggcaatacaaattgacttatgaaatgaatacgaagacgacgagtacttacgtagaaggtggtgttgacgccggtggtgtagctggaggggaccttgattggagaagctcccttcttgttcgccttgccgatgccgttgttgggttcgtgggggcaaggaggggccctcgctgctcctcctcaagatgggtgccactctgcactggagctcgacagagcttctccgaagacgggcttcgccgcctccgtggctccgcctgcccctggccttctcctctcgatggcgccttgtatctcatgacaccaatggggctggcgccaagcacacccgtcctctcgcttcaccttgccaccctgagcctcgcctaccatcttgtctgccttgttgacgttgtcgttagggtccgtgggggtagggagggcactcgtcgacggttgtggcccgctcgtccaagtctagtgccccaacaacaagcacgattgcgactgctatgtcacctactgtgacatcactacccaacagagcgccctatttgtgcctggagcctggtacagcttcctcaccgcgccgccagcgctcctcggccacctcattggcaaccactcccggccctctcaggagattacctactgcgccatccactcgctcatcatgtttgcgtcggagccgacgtggcgacacctgttgctggttgtgcgtggggacggcgatggctacgacaagcgccatgtgttcctcctcgccatggcacctaatctcccgcaacatcgactgggccggcgccaaggacacccgttgagtgagggagagagtgaggagaaaaggcaatgattttttgtgagtatgataggtgggtttcacattgactcagccaccacgtcacctaaaatcgggaacagtactaatttaggacccaaagtgatccggttttataagataagggatatgttatagagtattttttgggttcaaggatgattttgtagctcgtccacagaatgaggggccttaagtgcaccttttccaagggaaaaccccttccagcgcgaagaaaccaaccaattcaatccaggcccatcaaagcccaaatccatcaaccctaactccttcaagcacaacctccaccgtcacagaccgccggcgccgttcgactcttcgacctccacgccgacgtcgcgctgcgcctgccacctttatcttgaaccgcgacgtcgttgtccgcccctcccgcgccggcgaggcgaccgagccccctcccctccttccctgcctcgtgccactagcgccgcccttcgccgccgccgccgccgccgcccgcgagggagacgcgagaaggatgagggtgaagaggcggtccaagaaccgcaaggtggtcaggttctacgccacctgcttcggcttccgcgagccctacagggtgctcgtcgacggcaccttcgtccaccacctcctcagtcacagcctcctccccgccgacgacgccctccagtccctcctctccgcctccaggccccctcccctcttcacctccaagtgcgtcctcgccgagctcaggcgcctcggcaagtcccacgccgacgccttcgacgccgccgccctgctcgccacggccaagtaagtagtagcacacttctacttctaacgatggtttttttttttctcttatgaggcaatgagggttttgttccattggaaatttttgtttgtgggttcaggtgtgagcatgacaaagtagtcagtgcagtggattgtgttctgtcactgataggtgaaaagaatcccgaacacttctttgttgccacccaggattctgatctccgtgcaaagctacgggaggtatggaaattcactaccctttcgtgctcgtgccaacacgctgtttcagagtaatttaagaattatcaccttaattatgttatgcaaaagcatctggacagggagtcagtggcgggcccaggatttagaacttgtgtattcgaaataggagtagggtaaaaaaatttcctacacccaagagcctaataaatgatgtatataatataacacaccagtaattatataatatatagcatatataacacaaaatacacataagttcgtatattgatataattttataatatatagcacatatgtaagtactaattggatgaagtacacacaaaagaatagaaaatggtaaaatgataagaaatctttcaatttagagatgaacttttcaattcttgatattttgaaaatggtaaaatgatatgtaatcttacaaatcctacttactattcccctacatgcgcctaactagttacttaaatcaagtctgcaagttagcaattatgatgaatcaacttccaagtactcagtgaacaattagtagaatactagaaaagtagaagtgcagaacaaaaaatgaaatcagtgaagtactaacatcccaggctcccaaatcccagcgtccctgcctcttggtccatgcgagctgcgatgctgcctgcctggtgcctacgtcgtcagctcgccaatgcggcaccgacaccacgagcctgttcggttgccccgcgctgccgtcgccgtcttgccgccacgccatgcctacgcttgcgcccgagcatcgccgctgcgtgtttggccacttgcgcgcccgcgccaccgccgtccagccaccggccacccaacgtccgcgaggctgtgcgcctgcgccgaccgcccgtcggctagggttaggggagactgagggaatgggatgtgtgagattgatgggtgaggctggaagtgggtaggggagaggagagctggagagagggagggaagtggggaatttgggcccatacatttgggctaatgggtgaatgaggagggaggatgaagcaagcccaagaaaactagtttgcttgcttattgggtatttgaggctcttttttatttgtttgaattcatatacgaaatatatagtatatatacctattttttgtgtaaaattcttgggcatacatctgaatacccttgaatcatagctgcgcccgcccctgacagggacagtcagtggcccggtttagttggcaaaaatttttgttttggggtgtcacatcggatatacggacacacatttgaagtattaaacattgtctaatgacaaaacaaattacagattctgccaggaaactgcgagacgaatttattaagcctaattaatctgtcattagcaaatgtttactgtagcaccacattgtcaaatcatggcgcaattaggcttaaaagattcgtctcgcaatttacacgcaaactgtgtaattggttttttttcccacatttaatactccatgcatgtgtccaaacattcgatgtgataggtgaaaattttttgttttgggaactaaacagggccaaacttcatcacgtttgaccaagtttttaaaaaatacatagcaatgtcttcaataccaaattagtttcattaaatccacatttgaatatatattttttgtagtatatctgttttatgttggaagtactgcaacttttttctataaagttgatcaaacataaagaagtttgacttaggacaaacccaaaacgccttacactatggaacggagggtgcacaataatgtacatgttgccattacatattctcttgaatcagtttatgtgttcatgtgtgttttgactggatgcaggttcctggtgttcctgtgatatatggtctgaagagctccttgttcattgaacaaccctctgtgcagcaacgtaaatttgctcagttggacgaggagaagcgtctgcatatgggtaaatcagaatatcagaagctactgaaggttccatcggatggaaaggcggctgccagtgaaaacgcaagtgatgatgaaaagaacagaaggcctatcagttctcttgtagaaaatgcacttggggtggccgacaaaagcaaatttaagaagaaaagaccaaaggttaatattttctgttattttcttctggcttctgatgtattagatgtatacgcaagcgcaacaatacgtatgatctagttggcatcatcagccttactccatagtcaatcctattttcgataggaccgcttgacaattgaatccaatttttcccattatttaactatccataatagtgtggaaagaaagtttgctacaacagttccgcttccgtaagtaatttttattgcttgtcatttctgcagggaccaaacccactctcctgtaagaaaaagaaaccaaagccccaattgtcagctgctcaaaatcaggtaattttcattttatatcactgttgtttttctctcagtagttgtacgtaataatacctaaaactgttactttcagattaacatgcccattattagtatctattatgttgttggaaaagcatgtctagaagagctgtttgctgtcgatgcaacacgaggactgatgagaacatgtgtcctacaggggcccaaagctgatggggaggcaaagcgaaagagagttaggaagcggaagagaagccacaaagatagcaagcaaacggaaacaatgagctaagaaagatgagctgcaaagttaagaaactctcgctgcatatccagaggcagagctaggtggcacaatgttttgaagatagaaatcatactgatctcatggtgtgccactcattgagtcggctgcgttctttgaattgtaatgcttgattgttcacagatatttatgatagatccgtataggatgtatctggatgtcttcttgtagcagttgatgcaacactgtctatcaaatggaattcatggtgctactgctaatctgatagaatttcctattgggttcaaatcctgtgaacttcctccatttttcctttaaaaaattttccaaatgttttcccctgtcacaattctcggctatgcatattacaggcccacaggatgagctggcgggctgctctgctcccaggaatagtctaccaaggatgctgctccagcgagtgccatcagttcatcaactcgtcaaattgatgctgatgtctgaacagttgcgaactcctcaagatctgattcgtcagagcgcccttgtccatcggccatcgctcacttcattaagttaattgtcctttctgtggtacagttttgcttgtgaatcgtttaccttgattctttcctctcattttctgtaccgcttgaagagttctttgagctagtagaaaagttgctttggtttgacatccgataatctagatgttccaaaagattagatttctgaatctgatggatgttttgctttcttttctttttttacatctccactgctattttatcaccagaagtcaatctgactctgctgcatcctagccacttcatggaagaactacccacggtccacaagctcaagattcatccaatccaaatgtacatttgagcatagagctgggaagaaaaggtcgtactccctccgtcctaaatataaggaattttgggtggatatgacacatcgaaaatcccttgtattttaggacggagggagtatagcataagctcattagaacgtcttgccagcgatgtattaaccatatcatgatatgaacattggaaaaaaaaaatctttctgtttcaagtcttttctccgcctctgcaatacagttggatggaacttgtttgatcctcaagaagttgaggccaacacaggattcgttgaacttcaaaatgatggcatgtcacatgtgtacttcacctcacattcgtctctgttaaggttaacattgaactccaaacatctgtcttgtgtgatcttggatctataatgcagacattcttctacagaagttaacaactcctcttcgagctatctttttattattatggaattattataccagtagattgggtagaacattagcggtaaattttactccctccgtcccctaatataagggattttgacattctgtttgcactatttaactactcgtcttattttaaaaaattgtgtaaatataaaaaaagaaaagttgtgctgaaagtactttgaataataaagtaagtcacaattaaaataaataataattctaaatttttttaataagacgaatggttaaacaatgcaaaataaaatatcaaaatcctttatattaggggacggagggagtatctttagttagttgccctctaaaattctatggacttctcattggtatgtgttgcttgaaactctattctaaaatataacaacttctgactaatttattcagatagatagctagaaattactatattttgaaaccgatgtatatactactaatgcatacttgcatatagtatccgcgtcccattttacaattagttgcattgaatttgaagaaaaaaatgtacacgatgggacatattagaattagttttcccctgtccagcttccgccaaggccgaggccttttgcaaaccctgcaatctccgcgaggtacaggtcgtccatcccgccgccgtagatcgccgggaagaacagccagaacgccgtgccggcgacgaaacccagtacgagcggcgcggccaccgcgcgaggcagctgcggcctcgcctcgcgcttgtgctggcgcgcgcaccaccaccgctcggcgcagacgcacacgccgtggagcgcgaagaacgccgtgacgcgccccgtgggagcccgggaggtcaggtagagtatcaccacctcgtgcatcagccccgacacgaggaacgcggcgagcacgccggccgccgggtcgccggagcgcgccctgacggggtcgtagacggcggcgcggagcaccgccgacgccacgaggttccaccgccggccccagaagtcccgcagcgaggccgacaggtacggccggtcgaactgcggctccatctccatgcccagcgccacgcccgccgcgccgagggccggcaggacgacgtcgaggaagcagtacatgaagacggcgttgagggagaacgccgcgtagcggtgcatctcctccttggcgtggaggacgcggacgatggccgccatggcgccgaccttgatggcggacgagacgacgaacttgaacgtagctgcaggtgcagctggcggtggcctcgacgccgacgcgcctgctgctgccgcggcggcgtcgacgagcttgacggggagcgcggcagtgaagacgaacgggagagggcggagcgccgggtggagcgggccgtggccgaaggcgaggaggaggagcttgaactcgccgagccagacgaagacgaaggcggagaagccgcggtagctgtagtacgggagggcgagagggaggacggggaggagtgccatcgccgggaggagcgcggcgaggcggcgggggccagggccggtcagggaggcggcgaggcgggcgtacagcatggcgacggtggtcgccagcggcacggcggcggcggcggcgtggcgcatgacggcgtgtcgtgtactcgtgtcgggggcctctgtgcttggatagtcgggtgcgaggttttctgcaggacaaactcgaaataagaacagagcatgcacgcacatgtgtactgttcctagtgcactggagtagtgccattaatttgtcagtacgagggtagagttttcacaattgaagtcttctccaaaatactccatccgcaccgataatacttgtcgttttaaacaaggtgagatcaaactttagaatttttattataaatcatttttaaaatatttatctttcaaatatgataactacatgtatagattagtcttaaaaaatattttaataaaattatatagctgttaacacttttatatatattataataaaaaataatggtcaatgttagttttcaagaccgtctctagtccaaaacgataagtattatcaacccggaagaagtagttttgaagaaattactggcactaattcttccgaacagtgctagtgctacaacatctgtcgttatgtgcatattcattagttcgatccatgccattgcaaatgtggttattaaaaaaaaagtcattacaattcttcaatttctaagcgtgcaacttaaattttacgaaattggaaccatgccatcaccgtcatattttctatcttcttcccgtttacatgtggggtgctgatatttcttaacgacattactataaatatgaatttccagcaatagcgctagaaatggtcctgctatatatacagttacagaaggaatccgcaagcgcacagatatatcattgtagtattttatccgggagtattccaaggtatcgtatttattaggcaaaatttgctacgtgatatccaaattttgtataattggctgagggacaccgtaagatcgtgccattgccaaaagacaccataaaaatgatgtaattgtctgtagaacactagatacattattttataatttttaagaaaaagcggagagagaaatttaaaaaagacaagtttgctcctggcttggcctgagcttaagttgggactttctgcttctgctcaaagaaacaaagctttggtttagtgactcgcatgtattcgatcaacaaaagatgaacaaatacaaatcaatagagtctaacaagaacgtgtcgacatatgtgatgtaccaggaagaccgtgctttgcggatgaacaaatacaaatcaataccggagcttcttgcggatgttgccctacgtagttgttgttgtcttgctcgtccgaccacccgccgacgacaacaactccagcaacatccgctcaccgtagatctcctccacacactccctctttagcaccacgcccacggacaacaatgtgtacacgctatgcgtagggccacggtcgccgtcgcagctgcgtccctcgttttgtcgagcgtgcaacgatggctgcagcgacagcaatacggccaccggtagccaccatggtgtgccgtcgcgttggtcgttcctcctccttggccgctgccaagggacaggcccagcgccaggctagcattgctcaggtggccgacgtccccaaagcgggccgcccatagcagcgggccgctgcctgcttgcacagctactcgccgccgccacctcctcttagctaggggagaaagagcttgtcattttaaaattctctctccactttgtcatggaaattattaaataatgtgtttggtgtcctacagacaattacactattttttatgtcctttagcagtgacacaattttgtggtgtcccacagccaattacacaaattttcaatgtcctgaaacaatttagccttatttatttaatcccaagggaagattgtaaaaaagaactatgctaataatgtatatatgccacttgtatgatcagagtctaaacaggggttaatataatcataagggtagagtggcacaaagcaaagaactcatatctctcattaatcaatcctacgctatgtggaagaagaaataaaaaagcaattaattcctatgcttctagtatacgttccatcaattagtttatatccgctagtatacagttgtatggccaataccctctaacaatgccctcctggtgttttgagagaccatcctgggttgccgagttccttacgacaacttatcatggctgtccaaccgggactaaatacggaggagtaccctccccaggaatttatcttaggaatatatactaacatggaggaatacccgtactaaactttcaccatcagcggcccacctctactgtcccgcagcatatatgcctagataatgatacttaataatctaaacaccacgtctacattattaaatactactctatatcccctaggatgacatagagcaaccgaataatggaacattaaacccacaccattgcacctctctggtaggctagctacacaactataccgatacagatataaagtaaagtcgatacttacataaactaaagcaccaagaatatataaatatatatagaataatattccattaattccaaaagtcttacaaaagaataaagaaaagctactaccgccatactcgaattcccccctaaagactccgaggacttcaagagctattccactctactccacttagcactagaatactaaactaaagtatagatagaaatgttgagctttcttaagtgtgttttgaagtgtgaatgagctcctccttaaataggcaggtatgatggttgtagcctatgcgaaatgtccaatatgccctgaaaccgtcaatccgtcattggggagcgatcaggagcgtccatgtgtaaggccagtcgaagctagcgtcaccagggttcggccatacttgggccggcccaacaggcctccaaactactctagggcactgacaagtgggtccctatgatggttgtggcagttatgacggtttcgaggacagttacacctgacatgtggccccatcttatccttaagcttgcttaaggatgagttctcctccattttatttgcttaatcactgcaaacaaataattattctaaaataaatatgcattgcaagtatagctagctcccctttattttagttatattgatggtcaaaatttatctataacgaccatcaacatgaggcccaccagtcatattcatcttcttcctccattcttccctcctcttttttcccatctctctccagtacttcttcacctcctccccaccaatccatcctctccccgccaccaccggtgccggcaccgcgccagagcgcgcggcccacgttggccgcgcagctgctgcagcagcacagcagtgcagtagcggcagtagcaactacagcagcatagaggagtagcggcagcggagcagcagtgccagcaacagcggagtagcagcagcagccgcgcgcgcggagcgggagcggcgacagcagcggaaccctgcggcagcatccgacgggggcgacggcacgagaacacatttggccaccgacctcgccacctcctagccaccggagcactggcgccccgctcctctcttccctctgctctacctagcaagaaagaaggaaaaaagagaataggggaggatggaggaaaatgaatctgaccggtgggcccacgtatagatggggaggaagatgaaaaatgtgacggcgatggtatggttctaattttgtaaaatttaagtgacacgtttacgaatagacgaattataatggcttttttttaatagccacatttacaatggtatgaatcgaattaactctagatttaaatgggatgtttcacggtgttgctagtccgtacggagtattgtttctcttaaaggatggggatgtttcacggtgttgctagtctgtacggagtattgtttctcttaaaggatgaatggataaatgtttacgttattttatatttctactattataaaaattaaagatttttttgccggtatttcggtacatcatccgtgttttagtcagtttttaagttcgttcgcttttgaaaatgcatatccatgtttgagttggatttaaaactcgtttgcctttgaaaatacaaaagaagtcgtataagaaatctctttaaaaaaatcattctagcttgagatgaaatacggactcctaattgcagtttatgattttctaaaagaaatattcaagcacagtgaattttaccctagctaaaccgtataaaaataataaaattaaaataacatttatcgttgcaacgcacgggcattttcttatatataaatttaatagactattcttttattttttttgaactttataataattaattaattcatttatacccttgattacttgtatcacctcattcaattaaatatttagtcattcagaaaaaaaacacatgcactgggcgaggtagaaagaaatagagggtgccacttacttaatttattctacactttagatcaagtttaaactgatgcgggtatctaagtttgtattagagagtgcacacatggtgaaaatgtatgagatatagctcaattttattttgatcgggttcctgggcactcccctcccatactctacctccgctagtgcatatgaatgcattaaaaccaccctggagttgccgcgctgaaagtgttttggaccgacgtgttcgcacgcggtgctatccacgtcactccagcgcgctgggaggcgggcggatttcgcgtccgcacgcgccgtccgattagcttgagtggacgggcaggatgatgagggtggaagttttgcaaaaaaaaaaaaaaaaaaaacccttcacttctttgtaacttttgttaggttaaatacatacggtcttacgttttaatttttaacgtttagaccctctataaccaggaaaactttatgcaaagaaaagaaaaacatgaaaataggtccgcactctgaaaaacaaaaggaggctcttttgaaaaatataacatccccgatcggccaatcccctccccaccgaaaccctagccagccactgctcccaccaggggcggattcaccattggggcttgttggggcgcaagcccgagcttcagcttccagcctcaagtgttctcccaacaagctcaaagctagtataaatcactgggacagtcagagtatatatattggagcctgcagcgactagagaagaagaaaactcgcctgtagctatgtggtgtgattagtgctttgtctgtcatctagtgtttaataattgctaaatgctataccaagcccaatacaattaccgaaccggtgaggaaaagacaagacagatattaccatctaccaggagctcttggtttgcattgttcagggcacatggatggtctaattcaactgggcatacatgttttttccaaattaatgaaacatggatttctaagttcataattttgaaatatgatttccattactgagctatatatttttagccctatgcattagcaccatcttctatttcaatcttggggcactgctcccacgctgtccccccctctccctgccgccacctcctccacctccttcccccgctgtgatggctcgcggctcgcgcctcgccccgccgcaactccccgccaagcgacgcctctcactgatccgtcccctgccaccttcctcctcgatcccctccctaccacatgcttggtagcttcctcatcagccgccgccatccatctgttgccgctggtggactggcgctcaattcggcgggatttggtggtggctgcctgcattgagtggatttggggaacgacggctcctgtggcggcataagcggcggaaagcaggtgcggtggcatgagctagggctggagtcgatgggccactaatctggtggcagcttaacaccaccccattcacgagatcaaagcggtggttggtctgagggaaatgggcggtccgggcagatgtgcagacatgctctgtgtcgaaacatgaattcggcaataataaaagggggtagcgcacgagacctaaaagtggatggatgtagagacaaggatttagacaggttcaggccctctcaatgagaggtaataccctactcctgtttggggatttgaatccgccgggtgtagtatagatctgacgatctagttgtgtctcatgcccctagagggcctcctgcccaccttatatagggtggggggcaggattacaagatagaaaccttaaccaatacggtatcggtttcctaaatctactttacaatattatcaaaccaggactttaggccgttccataatatacaaggaaacgtaatacctaagtcatgattcgttacatattccatagatataaattatcccttataacccgtcggacaaccatgccgtgtgggtatggggtacccataatctccacagtagcccctgagaccttcacagtcgaaaagataatcttctctcgaaccagattactccaaagccaagtgcttcaatcatctttgccatggtcacccgagtactttaacaaatatgaagactgtggagggctgaaaaataaagtcagatgcattgactagatgcacctaatagatgtagcccccgactacgtggttagctgaacaaactaagcatatagtcaaggaataaataatccaaccaaccgagtggttttgataattgtaatcaaccaagtgacttgatatcaatatatagcatatgcggtgtgaatcccccaaataacatgatccaagtgatataccgactgctttgtaaaaattgatgcgagcaacctaaagttgactacatcattgaaaattcacatagcaaaacagctataaacaagcttgaatgatgtgaataaagaaattttcaaagtattaggcatacgccatgcacacactgctttaataaatgtgcttaagtccctaaaagacacatggtttcaccacacccggaaatatacggcatatgtggtgtaaaatccgagtaaataaactcataaaggatttaccaaccgcctgaaaaatgactaagatatataatcagcctaagccataatattggtcaataaaaatgcacacttacgtggcaaaaagcagtggtattgtatccaatcaattgctttataaacccaaatagcacattgactatataaaaaagtcagtaggacagctatgaaaaacttcactgctgggcaccttttaaaatgcattgtaccaactcctaaaaagttgagtaactgcggtataaaaggattttaaggtattgggcacttgatcacacgcactttggcctaagcaaaaaatgcctaagtccttaaaagaacgtgataggctacacctgaaaatatgggctgcagacatattaggcctaggccaaaaaatatgccttcgacaccctttaaaggatgacgcatgtaacatgctcccgagtaataaatcttccgggtgatatagaccaagtgtagctcatacgaatagcttctgatctgagtgattatcccttatgggatactcccaaatagatataataattgaatcccgactggcgcaagtattcggttgataacccttacggggaatataaatagtccagtctttgagcatagaaaatagacccatgatcatgaattcatgttgcatgtattcggaacaagtccaaattgaaggtatgatacttgtgtttgagctagtaagtccctaagcatatagcttgtccttctgtcgtagtcacaattgtccattgatggtagctgacgtagtgggcatagagacaagatgaccaatatagagataatattgcccaccagaggtggcaaaaatattggtagtagtgaagatagtgataccaatcaaaagtgatgaagttgcacagccgtagaggcgaagaaaccagtcggcagcagtcaggtcagccagcattgaagatgaaagcgcccaacgacagagttgtgcagccatggcagtgaaataatcagtcgataacaaacgaggtgcccggtgaagaagacaaagacgcccattagtagaggcataataagccatccgtgaaagcgaagacatcatgggcggaggcaagccggtggtgaagacgtagacgctcatcaatggcaatggcgaaatccatcaatcatgaagatgaagaaaatagtcagcgacagaaaacgcaaccgatgataatgatgattagcagcaacagagatgatcgaatatgatgacgaagttgcccatcaatagcagtagaataagctatgttgaagaggcttgacatgatgttgatgaagatgacgatgtcggtgatccagtcaatagctgtgtagcagccgatgataatgacgaaagacactcatcaacgtttacgtagtaggtcagccgtgaaggtgaaataataagtcggcaaagacataatcatccattagcaacaatggagatgacagagccgatgaagcagaggtgctggtgatgatgtcagtgacaataatccatcaaactgttgagaagatatcaaaactcgagtagtttccttgatgcgagcgtgtgcataacaaagatgatgcaatgccccttgatttacgaagatgactacagaacttagtgttatatctgttgcagatgcttcacttggaagagagtagatgttgttgtccaacttgttgaatatgagttaattggttgataactccaacctcccgaatatgtagattaaatctcaaacttgatacttgagaaatttgaagtagattgtggcagtatggagcatccaaaattgtcagtgaaataattgaagtagaacgtctgctccgaagcaaaaacgaagataatgactcctggagttgtaaatcctttatgagtttatttactcggattttacaccacatatgccatataatgacccggcaattttgagagtcttgtgtagcccccaactctttgattagttgggaaacaactgaacatagagtcgagaactatagcttcttgtcatcgagtagtcattgcttgagtgaagatatgtgttgaggatgtccgagtagaaatcttgaatattgaaacaccagttgttgtagtaaaataacacggcatcaaatctagtggtgcatgccgagatgtcgaggctcttgtagtcgtcgtggtttgtgaagtagcaaagcttgcgaagtagaggcaatagagtttgctggtgccgaagataataaaaatgaagtcgctccaccatgacgacaaagttgcatagccgtgatgaagtgaacacgagtcggcggcaacagaagcaaaccggtagcgaagatgcgtaattgtgaagataaaaacattagtcggcggcggcataaccagtcggcgatggaagaagtagaatgatgacgaaaacgaagacgtccttgaatggcagcaaaataggccaaccatgaaagtgaagacaccatgggcggtggcaaaggcaaaccggcgatgacgatgacaccagtcaatgttgatgaagacacgcagccgtggaggcgaacaagccagtcagcgtcagacaaggtggccagcaatgaagacgatgacgtccatcagtagtggtagcagcataaaccagtcgtagaggcgaggacaccagtcaacagcagacgacatgaccggcggtgaagatgataaggccaatcaacagtatcagaatcatgcagccatggaagtgaagaatccagtcggtagcagatgtagacagcttgtgttgaagatgatgacgcctattagcggtggcggcgacgcggccagccgtgaaggcgatagcaccagttggcgtcatacaaggcggccggtcagtgatgatgtggacgtccaacaacggcggcataatagaccagccttgcaggcggagacaccagtcggcggcggtgaaggcgagccggtcagtgaagacgtagacgcccaacaacggtggcataataggccagccgtgcaggcgaagacagcagtcggcagcggtaaaggcaagccggtcggtgaaggcatagatgcccaacaacggcggcataataggccagccgtgcaggcggtgacaccagtcggcggcggcgaagacaagccggtcggtgaagacgtagatgcccaacaacggcggcataataggccaaccgtgcaggcgaagacaccagtcggcggcggtgaaggcaagccggtcggtgaagacgtagatgcccaatacggcggcataataggctagtcgtgtaggcgaagacactagtcggtggcggcgaaggcaagccggcggtgaagatgtagatgcccaacaacggcggcataataggcagccgtgtaggcggtgacaacagtcgacggcggtgaagacaagccggcggtgaagatgtagacgcctaacaacggtggtgtgaccaaccaaccatataggcgaagacaccagtcggcggcgacgacggcaagccggtggtgatgttctgactgatccattcctagagcgtaagagataagcttaaagccatgaatcccttttatgcatatttggatctggatcctgcagaacaaacatataggatgagtagtatctgatataaatataatactcgaggaaaattcaagtattttaaaatgtttataaatatgtatttctcctcttgttaattttgatttccccgagcgaatgactccttacgtttaaacactctgcccgactagtcatagcccccaagcaccgggagtcggcctaagcacttccaaaacatgcatatgagtgacatgagttcgtcattaatggaacaaagtttcacgaatcagaatttactactcgggtacttttgcaattgttaagagcagaaaataaatttatcttatctctatgcttttgatttattccgaataatacttagcaccttgcgttactcggtccatccaacgagcccccgggtgataggaatcggcccaaaggcaactatccatcggcaaaccaaatggaaagcataggaagatagaactccataactcgataggcacttttgtactcagattatattgcaagcaatcaagataaatattataaaaattgtttaaaaaatatggtataacatatgtagccccgactcactagtcaacggcgaaccagttgacatagtgaggcagaggaaaaggaaaatatcatgtaaagaatgaaataaatgatgacttatctttgtaatattcccgttggtgatggcagaggtgaccaatgtgggaacaaagtcgtccatcaataacaatgaagacaccagtcggcggcgacgaaggcaagccggtgtagatgacgaggcccatcaacggcggcggagtccaccaaccgtataggcgaaaacactagtcagcgacggaagcaagccggcggtgaagacatagacgcccatcaatagcggcataacaggccaactatgaaggcgaaagcaccagttagcggcagacgtggcggtcgatcggtgaagatgacgatgacgcccatcaacggaggcggagtccaccatccgtatacgtgagaacaccagtcggtggtggcgaaagtgggccaatggtgaagttgtagacgcccaacgacggtggtgtgaccaaccaaccgtgtaggcgagaacaccagtcggcggcgaacgaggcggccggtcggtgaagacatagacgccaatcaacggcggcataataggccagccttgcaggcggaaacaccagtcggtggcggcgaaggcagccgcggccatcggtgaagactgatcccggcgaggtgccctagctgacagccaacatgaataggcagccatgccgaatatatagatgaacatactgtacatggcttgatgtattgcattgttcctaaaaaaattgcatggcatcgggtttggcccaattgatctgacaaagatgaaaccaccaaagagagcaaaaactccgcctgtgtgtgcgcgtcgtcgaggccatggtaggtgcagatcattatggcaaacaaaaacggcaaaagtccggcggccgtgaccgacgctcggagagttatgcatgtgtgattgttgatgcatgcacgtgagatggaggcgactggcggcgatctgatgcggtggaggtcccctggtcgactcaatgcatgtatgcatcttagatagataaatcatttgactaatcaaattcctttcctggttgctgatgacgtggcagctcctgattgattgaccaaattgccatgcacgtttgcttgcacatgtatcagatggaaacatacacttgcatgattaatgtcttcgagtattgctgatcaaggaaataactcggcgacgaccgctctgatcgattggctccaagttcaggctgactccgatttggattagtaattgagtatcgctaggaaatttcacatcttcttaaaaaaaagctggcggatgagaattgatctgttgcattgatatcgccgaacagattgaaccagatgatgaacacaacatgccaactttcttcaataaaaccggtaaacatggcggcgatccaacgagatgaaagaagtcttaagccttcccgactgattttgcatctgaattacagaagcataaaattccaaactcgtggacgaggaaattgaaactcccgaagtgagaggcttggggtgaataccagggggtcaatctgtaattgaaagttaatctaacaataacattggttagattgaaacggcaaacccgatatcgatttgatcagaagattgcatcaatgacggcataatccatgaaactcgagggaggatgatgccagcgactcaggttgattccatcacacttcttgacagataactcggcgtagccctacctggcgcgccaactgtcgaaacatgaattcggcaataataaaagggggtagcgcacgagacctaaaagtggatggatgcagagacaaggatttagacaggttcaggccctctcaatgagaggtaataacctactcct

SEQ ID NO: 63877 - DNA, 1535 bp, Oryza sativa
gggtgtagtatagatctgacgatctagttgtgtctcatgccccctagagggcctcctgcccaccttatatatggtggggggcaggattacaagatagaaaccttaaccaatacggtatcggtttcctaatctactttacaatattatcaaaccaggactttaggccgttccataatatacaaggaaacgtaatacccaagtcatgattcgttacatattccatagatataagttatcccctataacctgtcggataaccatgccgtgtgggtatggggtacccataatctccacactctgcaatgcttcacccgtgttctagctgttgctgttgcttttcatgttgacatcgttcttgccatcgaagacaacggatctggccaccggttgctgtcccggggagcttgtaatggaattaatgtcaatcagggcaatctaccgttctggcttggccttgtgctgctgtagaagacatggccatatgactggagcaactagagattggctgcctaccactgctgtgctgtttgctgtaacatttaaacaccaaacaagtaataatctactgattttgatttatctctgcatacgatattatttagtagttattgtttcttggatatcaaataggtacattattagcagcgaatagattgttgtgaggtcaaacatattagcaggtgcttggcttactatgcagtgtggcagggggtaatattgcagaggtaatgcacagaagagtaaacaatatttctatttcttttcatgaaagccacctttggatgagcatagtatagagtatagttgtgtgttggttaccttgcctttaaggtgtttgttattcttcctatgagcacagagtatgaaactatcttgaagttatcaactagatatgcatggcctactgatatgcattggttgggtatgagatatgtggtccctggctttgaactattttactttaataattgtgttctttggctccccatcctgatctattttgctctatgcttctgctgtgcaatgtagctaaaaaaacatccagagaagagctttgcttaagagattctagatttagatactttagttatttaagatgtaagagttacttttattgtgttcttggcccaatgtgcagctatccagctgatcaatttattgtgatttcaagttatatgcaaaaaaaaaaaagaggagacatctgctttacagattctattgtagaaggcacatatatctgtatgggtatttggtgttaaattttattgtagggtactccctccgtttcacaatgtaagactttctagcattgctcacatacatataaatgttaatgaatctaaacacatacatttgtctagattcattaacatcttaatgaatgtggacaatgctagaaagtcttacattgtgaaacggaggaaatagttctcacatagatctgccattgtagtggtattggtccgaccgcaagaaaacaaaactacagatgtgtcgtgtatatgtttgattaatcatccatattctgactaaat

SEQ ID NO: 63878 - DNA, 929 bp, Oryza sativa
tgtttgtttgttccaactgcagatcatagttctatatgtcacagagtcattaactattacactgtcatcggaacatcacaaggagatctgtcgatatctgtacaatcgtcaggtaacactcaatagttaacaggaagttaatggctactttttaagtaaatacacctaaaagattaattatatttcatataagatgtgaacaagacttaactcaaagtttgtgaaccagaacatcgatggaggatggggactacatgcagaaggtgaaagttccatgcttagcacagctctcaattatactgctctgagactacttggggagaatgttgatgatggaccagatatatccatgcataaagcaagaaaatggatacatgaccatggaggtgcaacaatgataccgatcttgggaaaagtgtggctctcggtaacaatactttcagctgtatcctagttctatactcaaatacgttttcagctagtaattttactaaggtggcttgggatctcaagtttccacaagttagtttaatttatcaaatataataattacctcacctgaattaaagatctttccacctacagaaatcaaatggttaatactagtcaatgagaacatcaaaatgatttggaaaagcaaggttatcaaaagtatcaagtattgttttagtagtatgttagttatgcaaatttcatttgattatgggagtggatcttccactatctacattcccctattgtaaactgtatatttaatattacaggtgcttggagtttttgactggtcaggtgtaaatcctattcccccagaattatttcttcttccatctttcgttcctatccaaccaggtaaaattttcttccttgctatatgttcaattatattagcacagatcttatcaccagactttgaaatgaaacatgctagt

SEQ ID NO: 63879 - DNA, 7937 bp, Oryza sativa
  unsure (1)..(7937): unsure at all n locations
catatgcttgtggctaatgtcaggtgttacaaggactggcgtgagtttcttatagagctatacagatgctgctgcggtctgatttgaggtacgaatcaagctctttgcaatagttgaacttaagttttcattatacctgcatgcgagccaaaacatcggaggtgtgtcttgttctgaacctattcttctggaactctatccgtgcagcctcaaccgcctcccgctcttcacttgttccaaaatttgggtcaaattcccatgtttctcttccaacatgactgtttccactctttagccatggtcctccctcggcaatcttgagcttccacatattgtagaaactattctgctacttgtaagtcttacctgttggaacaaaaaaagagtttttaggacaaaccgatatatattatcgttgtagaagtttccaaaaaggatattttatatctagatattgagattatatcatttactgttgtacgttggagtttttccagctgcaagaaagctagtcggtttcacatatatgtgtacgtgcttgtggcagatctgactgaggtgacaatgatttggcacagctagctactttcttacacagcaaatttaggttggtgtatgccctttctgatcatacaaatattaaaactttttacttgacaggttgattcttattcctccttgaaagatctgaaatattgtgtcatgaaactttcgttagtatgagcatttcctttctgaaaccattgttacattttatgcgattcttgtctacaagcaagtagcaaatcttttcgatgtgcaccttaaccttaaaagcagcaatgcatcatcatcatggtcataaacagatgctaaaatgtaggaaaacaaagaggggcattgtacttacacttaagctttaattgccttagtttcaggtgtataaaagcaaccatttatcagaagatgaaagttggccagaccaaattgggtggatcgattgatgagggtgatcgaatggagatgccacggntagattatttatgcccttaggattctgggagntgaggaggaggatgatcacatggaagtgatgaggtggtttcacttgagctgtgcacgcacgggaggagtgaaccgcaagccgtgntgggtgaagcttggcagctgaaagcatgagagaaatggcttntgcgtgcatgatgagcatgagccttgttctggcttcctctgcctcctggtcatgcgagtctgatgcaactgggtgcatgtgtgtgcaagcaaatgcctccttgttcaattggagctctgggagagccagaaccaaccactgaaatctatctcaggaggaggggatcagccaagtgttcatggaatacttggataagtttgttgtggttttcattgacgacatcctggtatactcacaatcagagaaagaccatcagcagcatctccgtctggtgttgggaaagttgcgggaacatcaattgtatgccaagcttagcaagtgtgagttctggttgtccgaagtcaaattcttagggcacgtgatatccgctaaaggagttgctgtggaccctgaaatagtgaccgccgtcactgactggaagcaacccaagacagtcactcaagtccgcagatttttgggtttggcaggatactaccgaagattcatcgagaacttctccaaaatcgctcaacccatgacacagttgctgaagaaggaggaaaaatttgtgtggacaccgcaatgcgagaagacattccaaactctcaaagaaaagctggtttcctcgccagtgttaatcttaccggatactcgcaaggacttcctagtgtactgtgacgcttcgcgccaaggattggggtgcgtgctcacgcaggaaggccacgtggtagcctatgcctcccgccagcttcggcctcatgaaggcaactaccctacccatgatttggagttagccgctgtggttcatgctctaaagatctggcggcactatctcattgagaatcgctgtgaaatatatactgatcataagagtttgaaatacatcttcactcagtcggatctgaatcttcggcagaggagatggttagagctcatcaaggattatgatgtgggaattcactatcaccctggtaaggccaacgtggtcgcagacgctctaagtcgaaagagccattgcaacactcttaacgtccgtggcattccacccgaacttaaccaacagatggaagccctgaatctgagcatagtgggtcgtggattcttggctacgctggaagccaagcccaccttgctcgatcaaatccgcgaggctcagaagaacgacccggacatgcgtggactcctcaaaaatatgaaacagggtaaagccgcgggtttcacagaggatgaacacggagccctatggaacggaaatcgggtatgcgttccggatgtcagagaactcaaacagctgatacttcaggaagctcacgaaagtccttattccatccaccctggcagtacgaagatgtacttagacttgaaggagaaatactggtgggttagtatgaagcgggaaattgcagagttcgtggtcctttgtgatgtgtgccagcgtgtcaaggcagagcaccaacgaccggccggacttctccaacctctccaagtaccagaatggaaatgggatgaaattgggatggacttcatcaccggacttccaaaaacccaaggtggatatgattctatatgggtagttgtggaccggttaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagcatacaaatggcaccttatgaagcgttgtatgggcgcaaatgccggacaccgctcttgtgggaccaagttggggaaagtcaagtgttcgggactgatatcctgagagaagctgaagcgaaggtcagaaccattcgggataatttaaaggtggcacagccacggcagaaaagttatgcagataaccgtcgccgtaacctggaattcgcggtggacgattttgtgtaccttcgaatcacgccattgcggggtgtacacaggtttcggacaaaagggaagctcgcacctcggttcgtgggtcctttccgtatcattgctcggcgcggagaagtcgcttaccagttggagctgcccgcctccttgggcaacgtgcatgatgtgttccatgtgtcgcaactcaagaaatgtctccgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagctacctgggagcgtgaagacgagctgaaggcagcccatcccgatctcttcgccagttcttccgaatctcggggtcgagattccgtttaaggggggtaggtttgtcgcgtcccaaaacgactctaaaatacatcctcgaaattatgcatataataagtaaaatccatgtgaaagcctccaacaattaaaatgtgctaagttaaaagtcaaataaggcttggaggatttttgtatatttcctaaaagcctaaaatgcgtaaataaattttagtggaattttcagagcacaaatattaattaagaagaaaaaaacaaagttaaaatggttttgtaaaaagaaaaaccctaaaagtcttttccccccctctccccctcttgggccggctcggcctcctccccgcgcgcgtgccgctgacggacgggcccgcccgccaccctcgctgacgggtggggcccacccgtcatccccttcctcccgccgctcctgccgcctcgcccgtgccctagcgccgccgccgccgcgaatcccgccgctcccgtccgccccgcgcgcaatcaagaggggggaaacactccccgtgattccctccctctttccccccacttttctctctctctccctcggatttgttcggaaacgtttccccctaaacctcgccggcgcatcaatggcggccggatcttccgcggccgattccccctcatccggccgctctctccccctcccaaccctatataaacactccccgtgcctccctccaccgtttccgccactcgccgctctctctctccgccggaatcgagctcgcgccgtcgctctctctctccgccgtcaccgccgagctccagtccgccgccgtcgtcgccccggaccttctcccgcttcggcgtcgccttctccgggttcgccgcaacctcgccgacctcgtccacccctctgtttcacccgccgaccgccggaacgccgccgtccccgtcgacccgagccgcgccgccgccttcgtccgctccggtcgccgttcccgtcgtcgctgtcgacccggggtgagccgtggaccgccgtttcgcttcccccttccctcatctctctcgggcgccgctccgccgcgctggtggtcgccggcggcgaccatcggggcgcgggtgcgccacctcccgtcggctgtgccggcgtggccgccttcgggcgcgccccgcggctgccatgtggggcccggtcgtcagccgcccgcgccctcgggtgcggctgacgcgtgggacccacggcgccggccggtgtgagccgggtgcacccggtccaccgtggaccgtgaggctgccgcgtgggccccactcccgtggacccggtccgcgcgctcctcccctcggctaacgcaataaatccgattttaaattaaaatttaaatgaagaaattcgcaaatatccatttaaagagcatataaacttcaaatggccataacttgaccatttgaactcggaattggaccgttcaagtctctaatttctccttaagaagtcaagaacccatttttgtgctttgtttctgcttgttatatggagtttattagagtataagccttttcttttccgttggtcgtgtagatgctgcagcttcggaagatccgctcttcgtggaggttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgtattgttattattaccttgttcaccctagaataaacaaaaccccaactagtggacactctactcatggtatcacttgtatgattttagttagatgcttcgctttttaattaggtaacattaggtggtttttcaactctagactttgggaatattcatatcacctggatactatggaatggtttggttattgtggaattggcttcacaccgctccttctattcaaaatccccaaaatggttttaggctgggctcggggtgcatggttttgatagtagcacctcggccatataaggaccggtcttcgggcctccgttgcatagcactaccgtacttccacatgtctagtgggtaaggcttagtttgtggctcagtctggttataaacaaaagtacacggatggagatggaagaagtcgggggtcgatggacatctccagggcaaatgaaggctacacgagctgcggcccagtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttctgtctgtataccgtggtggtatgtggcacgtggttacacgtgaggaagatgtgtcttgtgggtaaagatgtacacctctgatcagagtataatttattcgaatagccgcgccctcggttatgggcaagccgagcaatgtacccaagttagtgttttaattcttaaaacctgcttaacaactaaaatgtggaatggttagcctgggttggcttgggacgagctgggacccagggtcgggttgccagttcggtctgaatcatcgtaggccttgggttaaggcaggttcgtgtgggttcacggccttgataaataatattgtttagttctagaatcgtgtttaccaaatagctttgagcaactaaagatctttaaatgctgtttactgcaaccctaaccctttatagtgtaactcctttgtactcccttgcatttattctgcacttgtgggtgtgtcttgttgagtacggtggttgtactcagtcttgctcaatttttcccaaacccagaagaggagcccctagaagatgaaggctttggtgtctagctcgtgcctgccgtcaagcgcctgtggtcgtcgccctagtcttccgctgtttctcgattgtctttgtgtgtgctgggccttcgctgcccatgtaataaattaactatttacgctaccgcttgttaaactctgaattgtatcaacttctggtgtaccttgcctcctgggacaaggaataatacacgcacgtaaggaacgcccgttgggttatttccggtcgtgacagcatctaaatcagatcctagaagatatgctccgtgcctgtgttctagatttcgggaagacctgggataagagtctcccctatgccgagttctcctacaataacagctaccaagccagcctacaaatggcaccctatgaagcgttgtatggccgcaaatgccggacaccgctattgtgggaccaagttggggaaagccaagtgttcgggactgatatcctgagagaagctgaagctaaagtcaaaaccattcgggataatctaaaggtggcacagtctcggcagaaaagttatgcagacaaccgacgccgtaacctagaatttgcagtggatgattttgtgtaccttcgggtcacgccattgcggggcgtacacaggtttcagacgaaagggaagctcgcacctcggtttgtgggtcctttccgtatcgttgctcgacgcggagaagtcgcttaccagttggagctgcccgcatccttgggcaacgtgcatgatgtgttccatgtgtcgcaactcaagaaatgtcttcgagtgccatccgagcaggccgattcagagcaaattgacgttcgcgaagacttgacctatgtagagagaccagtaaaaatcctggacaccatggagcgcaggaccaagaaccgggtaatccgtttttgcaaggtctaatggagcaaccacgctgaggaagaaggtacttgggaacgtgaagacgagctgaaggcagcccatcccgatctcttcgccagttcttccgaatcctggggtcaagattccgtttaaggggggtaggtttgtcacgtcccaaaatgaccctaaaatatatcctttaaattatgcctagaataattaaaatccatgtgaaagcctccaaaaattaaaatgtgcaaagtaaaagtcaaacaaggcttagaggatttttgtatatttcctaaaagcctaaaatgtgtaaataaattttagtggaattttcagagcacaaataataattaagaagaaataaacaaagttaaaatgattttataaaaagaaaaaccttaaaatttcccccctccccctcttgggccggctcggcccatctccccccctct

SEQ ID NO: 63880 - DNA, 8592 bp, Oryza sativa
ccttccttctcgccggattcgagctcgcgacgtcgctctctctctccgccgtcgccgccgagctctggtccgccgccgtcgtcgccccggaccgcctcccacctcggcgccgcctcctttggcttcaccgcatcctcgccgacctcgtccacctctccgtttcggtcgccaaccgccggagcgccgtcgtccccgtcgacccgatccgcgccaccgcctccctccgctccggccgcctcccccgtcgccgccgtcgccccgggatgagctgtggaccgtcgcctcctttccccttcccttccctctctcggccgccgctccgccgcgccggtggtcgccggctccgaccatcggagcgtgggcgcgccgcctcccgccgaccgcgcaagcatggccgccctcgggcgtgccgagtggctaccgcgtggggcctggctgtcagccgcccgcgcccttgggtgcggctgacgtgtggggcccacagcgccgaccggtgtgagcccgggtccttaagaagtcaagaacccatttttgtgctttgttcctgcttgttatatggagtttattagagtaaaagcctttttcttgtttccattggtcgtgtagacgctgcagcttcggaagatccgctcttcgtggaggttgaagccgacgtttgggaaagcgagcaaggacatattgaacatattgaatcccattttataaaattattttgatttaaattattgcattatcgctttatttaaattcccgcgttatcactgttttattcagccatgcctatttacctttgttatgaccttattattatggctattgttattattattaccttgttcaccctagactaaacaaaaccccaactagtgggcactccactcatggtgctactagtatgaatttaggtagatgcttcgctggttaattaggcaacattaggtggttttacaactttagactttgggaatattcatatcacctggacattatggaatggttggattattgcggaattggattcacacctccccctctattcaaaaccctcaaaatggttttaggctgggctcggggtgcatggttttgatggtagcacctcggccatatatggaccggtcttcgggcctctgttgcaaagcactaccgtacttccacatgtctagtgggtaaggcttagtttctggctcagtctggttataaacaaaagtacacggatggggatggacgaagtcgggagtcgatggacatctctagggcaaatgaaggctacacgagctgcggcccggtagtcgagatgtcatggcacagggctggtgtcctgctgctaggggctcagtcctgcccacctgtcccgaaggttccggccgtaggtggggttgggtcggtactcttgtctatggctaggatgggttggaaactatgtcacgtctttcgtccgtatgccgtggtggtatgtggcacgtggttacacgtgaggaagatgtgtcttgtgggtaaagatgtacacctttgatcagagtataatttattcgaatagccgcgccctcggttatgggcaagccgagcaatgtacccaagttagtgttttaattcttaaaacctgcttaacaactaaaatgtggaatggttagcctgggttggcttggacgagctgggacccagggtcgggttgccagttcggtctgaatcatcgtaggccttgggttaaggcaggttcgtgtgggttcacggccttgataaataatattgtttagttctagaatcgtgtttaccaaatagctttgagcaactaaagatctttaaatgctgtttactgtaaccctaatcctttatagtgtaactcctttgtgggtgtgtcttgttgagtacggtggttgtactcagtcttgctcaatttttcccaaacctagaagaggagcccctagaagatgaaggctttggtgtctagctcgtgcctgccgtcaagcgcctgtggtcgtcgccctagtcttccgctgtttctcggttgtctttgtgtgtgctgggccttcgctgcccatgtaataaattaactatttacgcttccgcttgttaaactctgaattgtatcaacttctggtgtaccttgcctcctgggacaaggaataatacacgcacgtaaggaacgcccgttgggttatttccggtcgtgacaagttggtatcagagccacccttaaccctaggacgagccgtaggtcccaagccttagcaatattttcgaaataaaaatcctttgtatttgtgaaaatcctctagtctctctctgtcttgctgcttcgtttatcgccaaaatctgacctttaaaatgttgcttttctttttgtttttgtttgtagatggccggcagcgtcagccgtcgtggtctggacatgactggtttcgtcttggagctgcggggcatgtgcgttgtcctggggtatccgcatggagtggactaccagggcaggccgcttccggagcaggagggtgacgatgcagagccccacgctgcttgggaggttactgcagtgatcctcactggctctcccgagcggacttcgctggcagtcaccgcgggtggagattctttctccgccgcttgccagagcgccgctctcctcgccatctgcactcttcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaatctgaagatcctggagctgcgtcaagagaacctgcagctcaagaaagacctagacgcagtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcatggacttgcttcgtcgagaaccctcgtgccgagcccgcgtgtcacgcccggaaattcactagtaatttccgaactaatttgtgcataaaatcctcgtccaggaatcagccgaggtacacaaactgacaatttaatatacaaatccatcttaataataacgttacatacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagtatatgacatactcaacaagccacacagcaaatatgcaagtgcacaaggattccaaaggaatggcataatataggctcatttgcaaaagcagcatttagcaaagagttaagataagtaaaacagtagagtaattaatcatcaattttaatcaacactgaacaacacacccatgctgtacaggcccaaccatcctgaacaaccatacccggctgtacagatctaactccaaaccaggagctaagcaaattattaccaattataacatccataattattgtgaaaggtgtgagactaatcacgaaaaacattgctcaacccgcccataaccgcgggcacggctattcgaatagttttactctggccagaggtgtaccactgtacccacaagacacaaccccacatcatgtcaccatgtgcctcagtaccaccacggtacctcggaaaggagttgtgacaataccccttgcacaacataacccattatagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtctcacaacagtagctcgcgaaccggtccttaattgccatgagcacgaccttcaaaaccatgtgctcacaacccaccactaatcatattttaattaccaattaattatcataacacgattaaccatcgtgagctaccattaaatataaccataaataataatgtagtataaatgattcatcccattagtgagctaatgtctctaagcattgctaagcaattatatatataacattcagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttagaatctgtgtgacttgccttgcaacaatcgatcttcaattaatcttcttgatcacttccgacgcactcacgaaccttcgcaacgacggaaacgacaagctaacacgcaaaacgaagaaaaagactaataaaaaccaaataaacaatacatataaaataaacaaacatgtagatcataattttagatgaattatgagacttgaacagccttattctgacttcaaaagaatttattatgaattttacaagattaaatctaattaaagcccatttaaaaagaattaaataaatttaattcaatttatggacaattttaatatgtagatctttattttagaaaaatttagcaacttgaaccacctgaaacggatctacggttatttagatatgattttccgaagatttaatctattaaaagaaattggaaaaggagaagatgatgacgtcagcatgacgtcacccacggaggccggctagggttggcgacctcgccggagctaggatggtcggccgcggctttggaggacatgtacacgtagaggacgacgagacgaacccaacggtactcaccctcgaaccaaacgacgaacgacgacggccggcgacgagatgaacggcggcggcggctcagacctcgccggagatggagctccggtggccggcgacgaaaggggacgggtggccgagcttcctcactcctcggcgcacctcttggcggcggcggcaacggcagcgacggcaggggcggcggcgcgacctcgccgaagctcggccggcggcggcggcgagttggacgacgcggcgacgaggctacggggcactagagagctcgggaaaaggggcaaacgaaagaggagtactagagggtcctatttatagccttggattgaagagatcggactcctcccgcaagaaatcgatccgagaaatcaaaaactcggttttggagataaactcgaaaacgagtttgattcggataaaatacccaacgatttgctccgattcttgaggggaaagatagaggagaacgagaggataaaatcccctcaaacaatcggaagaaaagaggccggattgggtgcggatttgagaggagaaaggagcggctcgggctcggcatctcggccggcttgggcgaggccggaggttgaagaaacctctgacatgtgggccccacatgtcggcggctagagggagagggggcgggcggcgtcggctgggccggcttgggccggttcggccgcgcgcggggagaaagaatgttgggccgaattcagcccaacgacttaagggagggtttttaaaactttttcaattaaaataattcatgaaatgatgtttcatttattaaaaatacttcccttgctcaaacaattcccagaaaattctagaaaatagaggaacaagcaaagtatttaataaaattttatctagctcaattttatattgagatttagcaaattaaaattagatcttctcttttaagcttttaaaatcatttctaataattccttttaaacaacaatttataacttaaggattttaaacaagaaaagcacttaacaattataattagatcattattgatcaaataattactgaactgttctttgtatcatttaggaattgagctccgaaaaatccgagaaaattccagagagtataattaaccatggagaattaaaaaaaattaaatccatccatgctttatatttaggagattttatttcccacaattaacttcacttgtaaattaatgaacatttaatataaattctattattaatttattaaataatttataaatcctgaaacgaaaatcaggatgtgacaccgcgcccgtggttccccaggagggggaagcctccggcgttggcagcacggaagatgcgctgttgctcaccttccgtcctggcccgtcgcagcggtagacgagcagttagtaggcttgcgcgtgtgttctttctcgtttgtcttcttgttggagttgtgtggggcatggttatgccggtgtgtggcataactgtgtcggagcctgcctttattttatttgcctaagcaacttgaactttaatgaaccaatttaatagcagtaataaattcaagaattatggtagtcgtgggtggttagctttaattgtcagctctctctgtttgttggttctgtgtggggtttacagatggcgatgaccaggagaagtgctagtaccggtgatggcaaccaacctgaaggcagcaaccacaaccaccagggcagcccacctccacctcctcctccgcctccaccaccaccaccagataccaacgccattctcacccaaatcctcgcccagcaggccaacatgatgattgctttcctccaccacctccaaaatccgccacaacataatgctccaccaccacccccacaacactctaaactcgccgagttcctccgcatccgtccacccaccttctttagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggctcgcttcactgccgctttccggagaacccatgtgcccgccggagtcgtggcccttaagaaaagggaattccgagagttgaagcaaggcaaccgctccgtgatggagtatttgcatgagttcaacaacctggcccgttacgccccggaggatgtgcggagatgaggagaagcaagagaagttcttggcaggaatggaccctgagctgtccgtccgtctagtttccggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcgtcctcgcagcagcaacctcgctccgcgccccgacctcaattcgtggtgcgcgtcccacagccgcagcaacagcagagtcagcaagggactcgtgcgccccgtcctcctacaccaactgtgcagcctggtcaaggccgcagggacgctcaaggtccgcagcgtctgtgcttcaactgcttcgagcctgggcactttgcggataaatgcccgaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcatcccactcgttcatatctgtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattcttctagacaccaagaacttggatgtgatccttgggatgaattggttggctcaattccaaggagtagtggattgcgcgagacgcactgttactctgtaccgagggccggaacaaccggttgttttctttgcacccccaacctctgtcagaagttcagaacttcatcagatagtactgtcagaaatccccatcgtcagggagttcggagatgtgtttccggaagaactacccggtatgccgcccaagcgagagattgagttccggatagatcttgctccaggaaccactcctctgtacaagcgaccctaccgtatggcagcaaatgaactggccgaatttaagaaacagttggaagagttaaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgattagcttaaaagtgccacggtattctccaagatcgatcttcgttccgga

SEQ ID NO: 63881 - DNA, 8067 bp, Oryza sativa
ctctgccttgtgtgagatggcctctatgaatgacacctaatccagcagttgcactgaacttagcccagttggttgccctacttagccattcctgtaacagatggttatatgcaaatgaagatcagaaagggagaaaaatgcatgagcatagaactgcattaacaaataggtaaactatgaaatgtaccaagttttctcttaggaaggtatcaactgttgttcctgcatgcatgattgcattggaacatatagttgcactatgacaaacactattcctcatttccagagcttgttttatagtcttcaaaatcagaagatcagacctgtcaaatcaattaccaaaatcaacataagattcaaaacttaaatgcatgaccagctgcaataattttgtcagatattatcacattacttcctccgtgccaaagtgtaaagcatttttgaggttggcacggatattaagaaagtaggtgggaatgatggagaaaatgtgtgattggttgagaggaggtagttggagaaataactttattttgagacaaggtactattctagaaatggctatattttgggacagaggtagtacctattatgactgtataaaaactgcaatgtcaactgaatagacgtctcccctgacagtatccccttaattttggtcagcctatcagcgtgcgctacttcatttggatctacagtgtgcgcatttccatttggtgtgatagcatcatccgtcatttgggcatctccagatggttctgtagcagcagtttgatcgctaggtaaagtctgggcagaagtctgcaaactcagcgtgtcaaggtgatttttcacattcaggaggaaggcctggttttcattttcaacaagatcaaaagcaatttggaatgcaaggagagcatcatcctgtagagcaaaagcacatgttaggacaaataaacacactaagcagcagttaaacaactaaaaaaaaacacaagatatttccagcataccttgcttccagaaagcagcttgcccaagatgtttccaacagtttcaggctcacccaagaacataagacactggcaaatgcttaagtaatccggatttggcagtgtctggtatatttttacaagacatcggagaatctgaatagatcaaacataagttcttggtcattttatggcattccaaaatttatgaagaatgctgtatataccaataagaaatctaagagacagactttacaattgaaatctgccatgatgtaatcttacctcacagcgatattcacggtgactaacatattgatgagatagaatgatggaataagaaagagatccattaagattatcggatcgagatatcgcttcctctagcttatcaagtctcttgcattcaagagacatacccatggcctgttgatattttccatcaagtatacacctgaaacagtttccgcatcaatgagatgagaactgcatttaattacagatgagctactagaagatataagaggattctatcatacttatccagcattctctctacaattgcctccaatcttgggtccattttttcatccccttcacctgctgctttcaaggacttcgatcggatgctggcatattcatctaaagcttttgctgaagaaaggaacaaacaaattttaaaactatgtcaatattgtttctttggaacatgaaaataagaagattgcaatgaatttagtcaattcctcacctaaaagtgtttgagcatagtctgaaccctcggagggatcaaatagtggtccagcaccgagtgcgtaagacagagaatcatctaattcaccaaggtagtaaaacaccttggaaacaaccaatgctgccaactgcctctggtcgaattcctcatcttcatataagctctcactgtaacaagtatataacattataaaataagtaaccagaaacacttcatgcttaatagagaagtccttgaaaatattaagttctaccaagttattaagtgacaatgaataaagaacataatttccagaaactataataccaaattgcaactgccaaaacatttaatggacatgcctcttccaatgtatctagctcccattaaatcccatgaacaaatcataaacaagaaacgagacgacacatgtcttagctcaatgtttttacttgacaggacaagcgctaaagatcaaacaaaatgttcctgcgtatagtcttgcaattcagacacttcaaagtcaaggattatgcatattcctcaaaccaaccataataaacagaaaaaaagaagtctcaacctaggctccacctgctcgttttcagattaaaattatgcttcattagaacccttcaaacaaaagccttggcaatccgagcctaaacgcaaattatttttaaaaaattaatattttttctcgaccacagcaactcctcgaagaataatacatgaatgaaccacaacagttagggaagtttgagttatctataatccatacacaaagcctaggttttctagtaccagtgaaactaaccgcccattataatcccctcccgaaatctccagcctaacagatcaaaccaacctagggttcatccaaaaaaatcgccagatcgaatctaaccaggccaaacgacactaatcgcatgaatcctccctccacacggcaccttcctagccgaaccccacctctcatccaaatcatcatcatcacatacatagagcaccaaaccccaaccccccactccacgaatcgaaccgaatcgcgcgaaacgccgcatcgggcgcagcgggccggcggggagggaaaactacagctgaaggtgggtgggggtggagcaactcacatggcggggacgctggtggagatctcgggccagaagacgtggacgagggagttgaggttggcgagcgcgtgcagcttgagctccgccgccggctcctgcagcatcgccagcagcccgctcgccgagctcaccatcaccgccgccgccgccatctcccgcctccgccgccgctggattcgacgatttggatgctcgtctcgtcggcgctgcttcggctttttttgccttttgcttggaggaggggaagaagaagagctctcgccttcgatgggaggggcggagatgtaaatatagcaggttttggaggggctcaatggtgaaatccgagtagggcgtatttctccgatttttttttggatcgggaaaaccaatgattgaattggcacccggatacgtatacggatacgatgcactccgtatttggtggagtactgttcgtactcaggcctcggcccattgtccagagcaaaaccaaaggcccaatgccctaccgttttcacccgtgcatttaggcgcagaataagttcactttgactccctcaaaagtgacccgaatctaattcatggccctgaaccccaaaaccagatatcttaaccccctaaactgttaaaaccggtgcaatttgactccctcaacggttttggaggacgattttgctgctgtggcgcctaagtggcgacattgaccgagtattcgtttcacgtggtgttgacgtggcattagaattaaaaaatatgcgtgggacccattagtcattcacacaaagaaatgtgggcccactgacatgcgggcccacatgtcagtcctccgtgtctccttccttcctcctccttctctcccttctctctctccccttccaagccggacatgcgcaagggcgtggcggctcaccaggatccttgccgccgcgaccacatcgttctgccggcgccgccctgatgtcgcccaccctgctcctcgcagtgagccgcgccgaccacctcctcccccgctcgctacttgatgccgacgtcggcctgctcctgcccgccgccatccccattgacgcatcagtcgggaccaaatgcgtgagacaggagacaaagaaaggcagtggcgcagtgccctgatggttcggagaactcaatggtatcgtgagctaccgctactgcctttggctgagaagaggatgaggaatcagcaatcatagacgatgcctccagcagattttgtgcagatgttgcttgccccttctctacacacctgaagtggaagaagcaagctcaatgagtagaagaacaatttatatgaggagatgcacaatccatattaccaccgtgaggtgtaagttagctcacgaatgtgattaagcgttacatgatatagcggtataatttgcaaaagagatggatatcacagccgaacaagtaacatacagattaacaaacaagtaaaactagtacaggccaaaaatttatctgtaacttgcaacatgaatccaactgaaatacatagggaactatacttgaggcttctgttcccaaccacccaaaaatcatagatagccccatcgacaatcacttggaacatagcgagcgtagcatggagatggcggagagtaagaagcgcgggattagggattggattggtgactcccagcggaagcggaaccgcaagccaggccgactgttcttcctcctcccgctctcctcccgccctccgcggcttcgccttcgcggccgtgaaaccgacggaggcttcgggatgcggccgcggcggcgagaaatgaactccggcgaggggaaaaactcgaagcacttatcggtcagatccccgcaatgcgcgcaaggttgttgcggttcgccaggatccccccgccacaaccacatcgctctgccggcaccaccctgatgtcgcccaccctgctcctcgcggtgagccgcgccacccacctccttccccactcgctgcttgatgccgccgcttcctctaccaccgccgccaccggccgaagagaaagaagaaggggaaagagagagagagaagggagacatggaggaagaaggaatgagacagggaggactaacatgtgagccccacatggcagtgggcccacatttctttttgtgtgaatgactaatggatcccacgcataatttttaattctaatgccacgtaagtgccacgtcaacgccacatggaacgaagactcggtcaatatcgccacgtaggcgccacgtcagcaaaaccgttgagggagtcaaattgcaccggttttaacagtttaggggtcaagatatctggttttgcagttcagggtcatgaattagatttgggtcacttttaagggagtcaaagtgaacttattcctttaggcgctctttgtttagacttataagccaatttataagtcgaaaagtctaaagccaacgtggaggattactaggacgggattcagggctatcaccacctgccgcctacatttgacaaatctatgggatacacaacaaacaaatgtagtctctaacctaggcaccacgtctaagttattaattattactctaatacttgcgcaggaacttccttctttattcagagtcctagtcctatagcacttagtacgaaatactaaataatgaacccacaaagatggaaatctatcttactcagactaagtaattaaataatggatatcatgttttatttcattatatgcaggtattgacggtcaaatattatgatttaaggaccgtcaagagtactccgttttcagccccggttggacgaccataacaggttgttgtaaagaactcggcaacccggagtggtctttcgaagtaccaggaggacactattagggggtattggccacacgattgtatactagtatatgtaaattaggaattgagtgcatactagaagtatatgaattaattgctttctatttcttctcccacttagttataaaattaattatcatgaatgatttgaatgggaaaaacgataacctatcatgataattagaggaaagggcagagccaatttcatttgtcatgataatggcattttaattaaaaatcctcatttcgttatttgtgcgtgcaacatgcgtgggaggcgcgcacggagtccaggcatgagatggcaacgtgtggttcatcggacgaccagaaaatttggctgagataatttttttttcagccggctgttatctagtcccttgttgataaatttaccttcggaaatttaacaaatataattataatacaatcataatataattattttataacttgcacgtaactacaacttgttgtaacttttcaaaaatctcaatgcaacatgctattttcataaaaagagatcatgggactccaggtaaaaaaaaaagtcataggaccgaatcctctctcatgtacatgtgctgtgattttttttcttcctcacttgtaaaaattttaaaacaaatctaactactgtgattggtacgcggggagcacgtccgataatatttgaatgcaggatgcgaggcgataaacaagataaacaaaaacaactatttttcgtgtttaaattaaattaaacaagagataaatacatgatgattaagaggataagctaaggatgttggagccattcagaacacgggcaccaccaagtgtatgaacacggcgaggatggcagccatgacgccggcgaccctaactgttgccgccatggcgacgccgttggcggtgggcgcaatctcgatgatgaagcggcatgacccggcagaggggtcgacagtggtggtggtggcgatgcccttgaagtcgcaggcacggtcgtcctggtcgttcacctggtagtagctgttgaacgcgtacgacacgttccccttggcgtcgaggccgccgcacgacgtcttgtacccgaggcttgtgcagtcggcgagcccgcacgcgtagctcacgccgtcgccgaccttctggtcgacgaggctcgccgacggcttcatcacgcaccaccgccgctgcaggtaggtcacacccttcgccggcatcagcgtgctgccattgccattgccgttgccgccgccgcgaaggctgagagggtacttgggctggccgtcgtagtagaagacgccccagtggcgctcgaagttgcccggctcgatgctcttctggtcctcgtcgatgaggctgaagaggtaggcgtcgacggggccaggccggagtggcgtgccctggccggaggcgatgtgggtgaggaacccctggttgaactgtcgtgcgtactgcgggttcgcgttggcgtcgccgtcggtcggccacccgacctcgccgacgatgatggacacgttcgggtacccgttccgccgcagcgccgccaccagcgtgtcgtggttggcgtcgaacgtgttctggtacgtcacgccaccatccaccaccggcgccgacgagccctgaatcaaagtagggatgaaaacggttcagaaatggtcggaaacggtaccatttttctattagttcttaaaagaactatatcaaatttctattagttttttcttgaaaatgataagaataattactatatttatgaatttaactatttagtgtatcaacgtcaaatcgatactgaaaaaactatattttaagaatgctaacgttagtacgatcgaaaaattttcatactattttcacccctacctgaaagaaggcgtagtcgagcgggaagttggggtccttgtagaggctgatgaacgggtacacgttggcgacgaacggcgcgccggtgtcggcgaggaactggacgatggtgagcatcaggccgtggatgtcggcgcggaagtcgccgtcggagggcttccccgtcggcgactggtacacgtcggcgttgagcggcaccgtcaccttcaccttgtcggcgagcccggccttcttcagcgctgcctgcacgctctgcatcgccgggaacgtcgtgttcaggtacgtcccgttgaacgtctccaggaacggctcgttcccgacggctacgtacctgccaaccacaatccgtcaggaaaattaaaaaaaaagcatcattttttcatcgagtaaattctctctatatatggccctattcttttctccaacaaaacttagattaaattttggatactcgtgaaacgcttttcaaactgctaaacggtgcgttttgtgcaaaaactacatgaaagttgttctaaaatatcatattaatccatttttcaaatttgtaataattaaaact

SEQ ID NO: 63882 - DNA, 962 bp, Oryza sativa
cagcctaagagcctatctttactgttcgtagaagccatctggagcgtccgtttccaatccaacggccaagcgtttcatcgaaacaccttgcaattggcatcacgaaaacgagatatatatatatatatatttttttggcgagctggggtactgatcgagtgtctgacctgatgtcgacgccgttgttgacgtggttggagacgttcgtggcgacccagtcgtcggcggccttggcgccggcggcgaggtcggcgagcatgtcgttggggatgccgaccatcacctgtatgcccgaccccttgagcgccgccaggatgccgtcctcggcgtcgaacagcttcaccctgtcgaacccgttgtccttgagcagctgcaccaccgtgctcgccggcagcgggtggctcagctgcgtgccccagttcacgccgatcccctccgaccaccgcgccatgcacgccgccgccaccaccaccaccagcaccagcctgccgccggcgagcggcgccggcgccattttgcttctgcagagtgtagttctgatcaagaaatgaggtgtttcttgggatacttttggggattttgtggattgtgtgtggtgttaatcttggatcaggaatcggtcagaaaaggctgggagagtgggtatgtttgattcttggagatgatcatcaacagcctcaaaccttgtgacacaccaaaaggttagaggaaagattgatcgatcaagaaagaacttatatatatgtggaatctgatttgttcttggtacacagccaagtgccaagtgtaccaagaacagctgaaatggaacaagagaagtgaggaaaatacacagcaatcagcaggcaaattcagagacctcaaactaactgaaattcagagaaaatttccttgtgccaaaaaaaaacaggaatcaaacaccagcaatcaggaaacaaaaagggagctcagaaatgagacca

SEQ ID NO: 63883 - DNA, 1168 bp, Oryza sativa
cacttcttgattttgtaccatccaagacgatttaatttctccttgaccttgatgaaaaaagtaatatgtgtaacttttgtggatggagggagtaacaaccttacaggtttgtcccagaatatacaacttcttcaccaacattctcttctcaactaattataaccttccatcattcaattttctcacatacctccacttctcaatcaatcacaacattctctcatttaattccacctactttctgtgaaagggcctgtagcctagtggttacgagagcctcgttagcacatgaggttttgggttcgactcccattgggagcaaattttccaggatttaacggcgttatgcttttagtggtaggcgacgtacccgtcgacagcgaggcgcctgtggtgtcttcgtcaatctctctagaatttgccggcccagtcttcgaagatgctcataggggtgagtgcgcgtgcgttgtgagtgtctgcgttgtactgtgtaattttcaaaaaaaaaattccacctactttcttaatatatgtgtccaacactaaaaatcattatattctagaatttgccggcccagtcttcgaagatgctcataggggtgagtgcgcgtgcgttgtgagtgtctgcgttgtactgtgtaattttcaaaaaaaaaattccacctactttcttaatatatgtgtccaacactaaaaatcattatattctattctgtcatggaggaagtaatactgacatttaagatatgatgattcgataaaatctttgaccgcatataatttcttaaattagttttttctcgaagaaaaagtgtgccaaatttgtcttcaaaagtattatcataaacttaccggattatataaatttgttctaaaaaaagttatattacgtgttaaataagttcaggagaagcatatcatttttttttgttttcaagatagttattacccctttatcttaaaatataaaaattttggttgaatcagatatatcataatattacgaatctggacatcggatgtagtgcatcgaaccaaaggccccgttcttttctccaacaaaagttggaagaaaatttggatattcgtggtatgcatttcaaactgcttaacgatgtgtttcatgcgaaaactttttatatggaagttgctctaaaatattagataa

SEQ ID NO: 63884 - DNA, 3443 bp, Oryza sativa
ctcgtgtgatgtatgtgcttcggtttcgccggcgctttgcattgctcgaacgagggagaatccgtaatttatttatttatttattttttttgggttgggggagcggcggcgcctctcattgaatctcgcgccttttgttcttgggagcacgcggaatttgtgctattatgaatatatgcctttttttaaagaaaaaatgattttgattctctttgatagatagtataggtttggtggttggttcgcgggcggatgggacggcgtttgatgtctcaattgtttgcggggattccgatggggggagggatttgaaacatgtctcccaaaatttgtgcttgttttgtttgtttggattgccagttcactcttttagaatctgtttcgttgttaagttggttgctcatagttgactggtgtgcaaaaaaaaaaaaagttgagctttggcgtgagcaatcggaaccgatttcttctctcgttttgttaattttttttactagtaactagtacttgtctaaactatgctatggcatgaagaacgaaagataaattcgtttgtcaaggctagtgttgccacctttggaatggtggatcatggttccgtttgtcgtcagatttcctttatttggcttaaaataatacatgttccagtggctatcctgtttgatttgtgatgcctggtgatatagaaggaacatttcgcatcgtgctttgtattgtatattgaagttgttgttatgagatgacctgatggggaaaggtagaacacggttcatgcaatcagcgtgcattgtttggctagcattggctgtcgttatgtggcttcctgcaaacgcaacatgagtctgttgtgtattcctaacatatttttcttctcgcgctgtagcttgatgaaatatctggtggttaggatttgtccagcttgacttggtagctaaccacattagtaaatgttagctatttcttgtgcttatgcgtctaatatctgtcaaacctttcgcaataaattatttttaaaaaaggcactttccttctatccaatcactttcttttgtttataaaataataaagaaattaggatgaatcttcattggttggacaacgacacgatttccatctctgtgtataccactatcctttcgtgtcacaattctgtcaactgtgggatctcattttggttgtttattctctgttttttcagatatagtaccaagataatacacctgcttgtcaaatgatgatgggtttgctagcgtttgagagcaaccaagggctctggaatagtggatattattcccagctgtttgggattggaggagttatggtcactgttgccattctttggttatcgacaggctactttggaggaattggtgctccttttgccccatatttttggccatatctagcacaacttccaaagaagaaggaacggaaaaggcctgtgagagtgtacatggatggatgctttgacctcatgcattatggccatgcaaatgcattacggcaggccaagttgttgggagatcaacttgtagtgggagttgttagtgatgaggagattgtggcgaacaagggtccacctgtgctttcaatggaagagaggtactgcagaaaatagttcttgttttgtgcaatacgctatcaatttctccttaaaattatgctgttgacgttagcaataggattgcaaaattgactgggaaagcttgtagaatcaccatcttatcatttgatatccaaaacatttaaaagctagagttctagacctcttggaattggcaatcatggaattacacaatcttcaattgtacattaactctaaaatgtaggtttccttggctctttgctagtattgtgaggcatgctataaaatattctgaattcattttgctgaagtactctactatgttattgatgatcttgcatgcccttaaaccttcagcttctattttttaagggatcaacttaagatattgtcctctcaagagattataaactgcctagtcctaggttattttaatattttaatattaacacaatattctggttccccattgacttgctatttctgtataggttgacacttgttagtggattgaagtgggtggatgaggtcattcccaacgcgccctatgagatcacggaagaatttatgaataccctcttcaataaatataacattgattacattatacatggagatgatccttgtcttctacctgatggaacggatgcttatgcgttggcaaagaaggttggacgctacaagcaaatcaaacgcactgaaggtgtctcaagcactgatatagtcggtaagatgaccacatggttcagtatcggcactattcttttggggattgtattctcttggtggccatcaatgtcatatattcccagtctattgtaatcttaatgtgggaactgtgttctttttccacccagggaggatactactgacattcaagcagaaagaagctggcagtatggaagctaccacagatgcaaatgttgctgtcaatcagaacactggagctgatacatatgataaagtgaaaagtcagctatccaattttcttccaacatctcgccggataatgcagttttcaaatggacaggtatgaaattttaaggaactctgttttactcacttgtgttggggctaaggttactcaacattcttatggttccatgtgagtgttctttatttagcacggttatggataaaaaactaactcagctattctgactgatcacgcacattaatgataatacacccatttgtattgtttcaatcttggtcatgaatgataatgttgacagtataaagttgatatttttttttttacatatttctatgacatgtcactctattgcttttattgaacaatagctcatatgcactcaggctcctttgccaggtgctcgcgttgtgtatatagatggtgcttttgacctttttcatgccggccatgttgaggtaatttttatggttcattttatcatataccaataattttaccataattctcccagtggttcacacatgttccagagtcaagtatatattgtttttgtttaatgcagatcctcagaagtgctaggcaacttggtgacttccttcttgttggtgtccatgatgaccaggcaatcaggtacttatttggtatcagaaactagttaatcataagcgaacgtaaaatacatttgagaccaattcatgttatgtgatttctcttttgaaagttcatataagatgcttatgcaaattaaatgtccagggatagaagagggtatcgtcctatcatgcacctccacgagcgtactcttagtgtacttgcatgtcgctatgttgatgaagttataataggcgccccatgggaggtttcaagggatatggtatgttcacacatgtttagctatgtttgcatgaataggtttaaaga

SEQ ID NO: 63885 - DNA, 1585 bp, Oryza sativa
aacagttactcggctatagaaaggtcatagtcagttataattgatggccattcatcatgggaaccagctcaaggaactaaattaacagccagaattcaaatacatgattctttttcttttcttttctttttttacttttgttgtccctggaggggacaatattcatcgctgaacaggtgctcagcaaaccactgttgtatacttgtatgttattacttaacagtgtgtggagtgattagagttgcatactccctaattgtatcaatcgacacttctgagacaatgagctgtgcgatgaccgtggtctatttcatttatttcatttgccctgtccgagaattttatgttcactttgtttaatccatcaaatttctgatactaaatcagggaatgctgaagatgaatttgagttttgagatgaaatatcattggacacatgacgttctggttatagggcagtagacgactagggctctccaggcttctgtccgttcaacagcatcgttacactaaacatggttttctttggatattttatgtaatttctcacaaaataatctatacacgaaactcatctggaagagagaatctgcagatgaatttcacatggcatactcttaaccatcaaatcagcatacattgatccgacataggctagtctggatcagcacattgtggcatatgacaacatggattggaatattggaaacactctatgctagtcacatgctaacatcaacaagtttagagcaacttgtaggagtttgtcatttttactccccccaattccagcagcctcttacagctcagaagaaacctgcatggtaggaaccaatcatttcaattagccaaaaaataaaggaaaatacttacaaattgatatttcactcgccaaatatttccaatatccagcccacatgtcttcatcattactaactgaagaaataaaaaatcaaaatcaagaacaccatggtcattcagcttgatctactactctactaaaaagacgcgaatattaggaatgacctaatatcaaataattagaaggggtgagtcttcaaacccaaatcatctagcccaccactttgcggagctagctggaagacccccgtgtgtttctcgatctactactctacttattactaccagaatcctgatccctgaaggctatttttttcaaaggtaaaatcatcaccaacatggcctagttagcatcgtctgctgttcactaacctgaccagaaatgagcctgctgacacggcggcgcctgaggctgccgctgccggagctgaacctcgacgtccatcggcgccgcggcggcggcttggtctgctctgagtggcggcgtttctgaagatgacatctcatatgcagtgttcatagtgtcatggatagtctcttggccctgagttggtagcatccatgataaggccatggttggcacagtaggatcaggttgaacacctgctgatggtttctcttcctccatcgtgtttggaatctcaccatcctgatgacagcaagaagagatgaaacattagagctcatggattaaatgtttcaattgccctcaaaacatgaactg

SEQ ID NO: 63886 - DNA, 6043 bp, Oryza sativa
  unsure (1)..(6043): unsure at all n locations
gagcctcttaggatcaagaaagatggacaatccattgttggccacctcatcatgttctttcctcttcatgttcattgccacaagattagccatgttctaagctatgatgacagcctcaagacaacccaggacatctagtaatttggagtctattaattaacagaattcagccaacttatctcttgtgaacagaagagttgactaggcaaccaagatgacttggttcctcgaagttcagttgtaatttaactacaaccatggatgttattatggtgtatttgtgttgactaattcaagttgactttgcacgtttacaatgaatagagagtactttacccttagctttttttccccctttcctacggttgtttgtaggcaaaagaaaggccttttgtaaaacagaaaaggtcaaagaggctgctgggtacaaaagaataggaaaaagaccatcagtgatgcatttgacatttcaactcttcatagaacaaaagattgggaaattcatgggaatactatgagaagattacatgaaaatattttgatatttgcttgctggtgtttgagtagaacgagtgttaaatatcaccagaaattcaatataagcacaaccgaacaagcactgtttatttcatgaaattcttatggaagagattgtatcatgtattacaagtttacaacagcaaccacagccagataggtagaattaagcgcctgaacggaacatatggcgccttggacatttgaactcaattcacctaataggtaaaatgaaaagatagcctcaaagccgtaagttcagttcaaaactcaactcttctcaagcaatgaacctcatcccgttctaatcaatgattctacaagagaatcacacaatactaggtgccctttgcactattcggttgcgctaaccaggaggaactccccctcgcacactaggtcaccaccaacgtaagcttttccttccatcttggcaagaccaaatcttttctgatacttggtcagagtcattctcatgatcaaggtatcccctgcaattactggcttacggaacctcactttatcaattcctgcaaagaagaaattgtcccgagatccgccaatttcaggctgcaacatcaccagacccccaacctgggccatagcctgtgcataaaggtagcctcacatgagggaagttcagatgtttgtctacttgatgatagaacaataagcaattaaaaaacatccagccatgtcctcatctatttatgggttctaagttgcgccattggttcagtttggattatgaaaacatagttgttgcaaaacctttaccataaaacttattagttctacaagtcccacatgaaatcattggtcatggtaccaaatatccattacccacctagtgcctgaatacttggatatcaaaacttttcatcagtttgaaaaggacaagaaactaaacaaatcgattgacgcaagttccttattacttcatagtacttttcgacagagatgaaaaatgcagtaaaatggctttgagaaagtactactacttttttcatcaaattcaactttttttttattttgttaaatgagattggtaccctgaaaatggatgaattgagtatcaatatgctcagactgcaaaaaaaaaaatgatagaatgaggtcatagtaaaattaaatgaagaactaagtagcgtagcatggactggcatttctatagataatgtacagagaccacaatgagagatgatcaaacctcaggaaacaacagaggccatatatactaaacaatttgatcacagcacatggatgccaatatagtggaatcatacctcaaccatgagaacaccaggcattatgggtcgttcggggaaatgcccagggaagaagttatcatttatcgtgacattcttgatcccaactgcatattctcctcccttgtactcaataactctatcaaccaggaggaatggaaacctaacattcacattcaaatgcacaagttagagaaaatactaaacaattacatattcgtgaatcatcaccaatcatttctcttgcttgggctcatcaggtgtatatccacataggcgagcataaaaatatccaagatgcatgttagtactttctagtaaaaaagacaatgcctttcttcaccaagtgagctcaaaggaaatgaacataaagcttccattaattcagagggctatgaagcatctttttctttcatctatctatactgctttaatgatgctagtggtagtgtccgagtctgcctccaacgccacaagttgacatgtagagccataaaatccccacacgtgattgtttttgctttggacatggcattatatgcctaatcaactaactatgctatgaagttgcaatttttacttttgtttttatcttttataatatccgttgcaacgcacgggcctttagctagtactgaaaataataataaaaaagagtatgaggttaactctaatatcaggatattgttttttttttgttttcaacagattgcacgcacagttcatatgcctctcatcgaacttcaaaagggtataatttcgatttgtatcgagtaattcgaatggtttcgcattgccaacatcttacaagcgaaatgaaacacacaaggtaaggcaaagagctatcctgcagcagcagcagcagcggaatgcggttagagctcacctgtggggcaggatctcgcggatctggttgatgtccatgacgctcgggaagggagggaaccctgcgagaggcaaaataaacgaacatatctccctcagttaatggcgaacacaggcaaccgatgccatacggagcgagagagagagagagagagaggaggggaaccggacttttctcgatggggagcgcctcctgagcctccaccgcctggccgtcgcccgcggcgcggcgcgcgacgaggcgccttcccggggcggccgacagcgccggcgcgcgtcctgggcgtgctgcggcggcgacgcggctccggaaggggagcgcggatctcgcgggcgctgcggcggcggcggcggtggcctccattggcgcggcgaggtggggatgcgaatcgaggaggaggaggaggaggcgataggaacgaggctggtccaaactgcaaagagagtcgatggggggttttgtgggtttggcttccggctttggaacctccgcttccaccctgggccttttcagcgatttcagctatgctctctttccgtctctctcggttttggaatttggaaaccggtgtttgtctggtttggacctttggaacggcgattgtttacaaaattactacaagggaaaatttagtttcatgccattccaagttttcgagtttagctttatacatcaaaaggaagaagtatagttttactactactttcgtatggaatatacaatgttttcgtgagttaaaagaaaagttgttaggttgtgttcgggacggaaaaagatgttgcacattaacgcgtaattaattaagttttagctaaaaaatttgaaaaatagattaatatgatttttaaagtaactttcgtatagaattttctttttcaaataattaatgcaccgttcagtaaattgaaaaatgtgtgcacgaaagatgagagaggtgagttgggaaagtgataaaattgaactcacccttaggtggctcccaatatatattttttcaattttatgttagtttggtcataaactcaacatcatatatactgagttcttctatatactattctttccaataacgcaatctcaaatagcactctttcaaagaattttgattatttgctacctaggtctactaaaaattgttttcatttttaccattttagcttaaccaactcatcaatctggatgagaaacaaccttcttgccctctttttcttatctcaatctagtggagggggtggaggacaagaagaagccatggagaatatttagaatcgcagtgaataaaaatctggctcaactatctagttattatccttcctccgctgtttaaatcttttatttcctaaactaattattcgatctacgatccaaccacactgttatatttgttgtaattaaatatttacaacaagcacaagattatattctaataaaataaaaatatgtgtttcaaaccgtttaaacttaatgttttatacatgatagatacatgtttcaacgtatctttaccgtgtttcacaacagacatgcatttagtgacattcaaaacgatttttctcctaagctacttatcaaatttacgatctgatcacacagttatattcattgtaattaatctttataacaagatatcacgtgattatattctgatgaaaaaaaaacatgtttcaattcactagcacttaatatttcatacacgatagcgacatctttcaatgtgtgtctcctgtgtttccaaaaaaaaataaatgtttcaatagtgtttcaatgaaatgtataactgaaacatttgaccgtctaatttttttaagaaacaatcggacgtccagtttgaagtttcttccgtgtttttttgtctatgtaacatgtgaatatagaagctaaatttctatccattatcttaaaaaaggcaaagctttgagccccagatatcacaagttagacctggagaattgtgttgcattttcgctattgaatatgccacaatttttgacaatttgatcctttgcaaaaactatttttacaaatgaaccgccaccaaaacttatttcaaaaatgacccttttgttcagtaccaaattgtgtggtgctgaatatgcgttggcacgctgacttagcctcccatccgcggtggcacggcattcagcgccggttgacgtggcgctgagatgtctaagttcagcgccaggtgatttggcgctgaaaaaaagtgtcatttctgaaataagttttggcggcggttcatttgtaattttttttttcaaagggtcaaattgtcaaaatttgtgcgaatatgcattaggctctcgtgtacaggaacgagatccgtgggacaggaaggcaaaagaaccacaaatgatatttttcttttccacaaagttgctagcaacagcatatgatatacagaggtgatgctgctgttacaggacaccatgaacaactgcaatgcagaggtgagccgtgaaagaagcaacagatgctatacatacagttcaagaagctatatattgacctgcagagtcgatcgtacacacaaactagctgatgtacagaatcatgttgtatcctgagagccgccaagagaatctcttcctacgggaacccaagaagggagctgatcgaaaagatcagtgctttgtgcaaacatgtagaggcagaagatgcagagcgctggtcacaacaagttgggcaataaatcattttagacagagagaaagagagcacagaggtgttaagtgataaatataaagtatgcaggaataaatcggatcataagtaagttaatgaggtatatttaccggcgtaagcaactgcggcgcctgacaccaccctccccaaagctgctagaaaatacagagtaaaaaccacctgcaaggttgtagcttactgtaagctaaacagtgtgtatatatgcaccttttatgttatagctcaggtatgacagttcactgtaagctgaacaatatgtacataaagcttgatgtaattggccgagttcaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcaggaat

SEQ ID NO: 63887 - DNA, 3346 bp, Oryza sativa
  unsure (1)..(3346): unsure at all n locations
aaatagctttgagcaactaagtgtcttttaatgctgtttactgcaaaccctaaccccttatatgataacccgcttgtactcccttacatttattctgcacttgtgggtgtgtcttgttgagtacggtggttgtactcagtcttgctcaatttttcccaaacccagaagaggagttcctagaagatgaaggctttagtgtttagcttgtgcctgccgtcaagcgcctgtggtcgtcgccctagtcttccgctgtttcacatttgtctttgtgtgtgctgggccttcgacgcccatgtaataaattaattatttacgcttctgcttgttaaactctgaattgtatcgacttttggtgtgccttgcctcctgggacaaggaataatgcacgcacgtaaggaacgcccgttgggttatttctggtcgtgacactgctgatcggcaagagcagaagcctctacaacaagcatgcaatgcaaactcaattccaccgtgcaacagatcaactcctatctaccggtgtcttttctttctaatattaaatttttccggcgagattcagttatcagtttgaagcggccggggtcgacgtggactcggactccaaaccaaaaccattaagcaactgctcgtcatcaagcgatcaaggaggaatagatggaataatttactgtagtcatgtatgctcttgatggtgcataacttggcctacagctgtatattacatgtttccagtcacgaagctatctaccggccaaacagttttttatttttctacaaagcgcaagcattcatcaaggcacacagcttggtgtcgaggttatcaagattgcgatctggctattccaagtcgatttatatttttcgccaaaattccggctattagacctttgaaacaagagcttctggatcacaaaccactaccaggtttatcgttttaaattttcttgcataaattagattaattcgcagatcactaattgtaatttgatctattattttatgcatgtgctgccggccgccttcgtataccgccgactggtgttctcgcctgcacggctggcgtattatgccgtcgttgttgggcatctacgtcttcaccaccggccgcctcgattgccgccgactggtgtttctgcctacacggttggatgatcacaccaccgttgttgggcgtctacaacttcaccaaccggccgcctccttcgctgccgactggtgttttcgcctgcacggctggcctattatgccgccgttgttgggtgtctacgtcttcaccgaccggccgcctcgtcgatccgccgccgattggtgtctccgcctacacggttcgatggtcacaccaccgttgttgggcgtctacgtcttcaccgaccggctgcctcgtttgctgccgactagtgtttttgcctgtacggctggcctattatgccgccgttgttaggcgtctacgtcttcaccaaccgaccgcctcgtcgatccgccgccgattggtgtctccgcctacacggttggatggtcacaccaccgttgtggggcgtctacgtcttcaccgaccgaacgcctcgtcgatccgccgccgactggtgtttccgccttccggctgcctcgtccgccgccgactggcgtttttgcctgcacggctggcctattatgccgttgttgttgggcgtctacgtcttcaccgaccggccgcctcgtccgccgccaactggtgtttttgcctgcacagctggcctattatgccgccgttgttgggcgtctacgtcttcaccgaccggccgcctcgtctgctgccgactggtgtttttgcctgcacggctagcctattatgccgccgttgttgggtgtctacgtcttcaccgaccgatcgcctcattgatctgccgccgactagtgtctccgcctacacggttggatggtcacaccaccgttgttgggcgtctacgtcttcatcgaccggctttccttcgccaccaccgattggtgtttccacctatacggttagttggtcacaccactattcatgggcgtccatgtcttcaccgaccggcttgccttcgccgccgccgactggtgtccccgccttcatggctgacctattatgccgtcgtcgttgggcgtctacgacttcaccgaccggcttgccttcgccgccgccgactggtgtccccaccttcatggctgacctaatatgccgccatcgttgggcgtctacgacttcaccgccggcctgccttcgccgccgccgactggtgtccccgccttcacggctgacctattatgccgccgtcgttgggcgtctacgacttcaccgccggcctgcctccgtcgccgctgactggtgtcctcgcctatgcggttggcgggctcctccaccgttgatgggcctcgttatctacatcaccggcttgcttccactgtcaccgactggtgtcttccttgttattgatggacgactttgttcctacattggttacctctgccattaccaaggggaatattacaaagctaaatcatcattaattttcttctttatatgatatttttctttttctctaagtcactacatcaattggttcgccattgactagtgagtcgggggctatagatgttatgtcatattttttgaacaattttcataatatttatattgattgctcacgacataatctgagtataaaagtgcctatcgagttatggagttctatcttcctatgcttcccgtttgatttgtcgatggacagttgcctttgggccgattcctaccacccgggggctcactggatggaccgagtaacgcaagatgctaagtgttattcggaataaatcaaaagcatagagataagataaatttattttctgctctttacaattgcaaaagtacccgagtagtaaattctgattcgtgaaactttgttccattaatgacgaactcatatcactcatatgcatgtttgggaagtgcctaggccgactcccgatgtttgggggctatgactagtcggacagagtgtttaaacgtacggagtcatctgctcggggaaatcaaaattgacaagaggagaaatacatatttataaatattttaaaatacttgaatttttctcgagtattatatttacatcagatactactcatcctatatgtttgttctgtaggatccatatccagatatgcataaaagggattcatggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63888 - DNA, 1313 bp, Oryza sativa
  unsure (1)..(1313): unsure at all n locations
atgaccaaaaatgaaaaaaaaaaggttctagtgtgaaactttcatacttctatttattgcggttgaaaagcaagttaaatgataaaaagtgaaaaagaaaacgcaaactagttcaaagttttaatctgggatttatatttaaaatcagggcagctcatcagccaatattgctatttgcgacggcttggatacccgacactgtacggcacaaactataaattgtgacaaaaatcgtgtaatttgctgttattccattcacatcaggtcgcgttcgagagcgacacgaaacattacaaacggatacccacgtgctgcacacgagacactgcgagttagcagcgtcttagcgaataaataaagcaatgatgggactgtaacgttccgattttcgttcgggattaaaaatcaattaataatgcatttcaagaaattatattaaaagttaaatcaatttattcaagtgaattaatgggagaattaaaattttcccttaaaaatcattggccgggaatattttgcaatattctttgtgccctaaaatactctctgaaatttcccgtgaattttcggagctcaagaaataattttaatagcacaaatttcatttaaatcaattaaaataaaaagaaaacaaataaaatttcccctctttgtctttgggccgctttcggcccaagatcttttccccctccttggcccgctcgcccctctctccttcccttctccctctcgggccgacccctcccttctcggcccgatcaatttcccctcgcgcaaagtctaaataaccccctggctctcctccctcactccctccccgacaggtgggcccgacgaccccacctgtcaggtccttcctctaccttcggcctccagagccgaaaccgccattgccacccacgtcgccgccgattccgactcctcccgctcgcgccctcgcgcccaaaccgcataaaatcggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63889 - DNA, 3024 bp, Oryza sativa
  unsure (1)..(3024): unsure at all n locations
ctccgccgaaactccccttccaccatgcagccgagtcgccaccaccctaaaccgcctccagccgcatgtcgtcgccgcctgagccgctcccgcgccctgccaccaccgcagccggcttcgccgccgcgcgggcaagcccggccaccgatccgtttatcccctccaccaccaaaaaaccacccccaccgctaacctgaggccgacgctgcatttgccgcctccggccgcctcctgctgccgtcccagaccaccttaatatgcgttgtcgcctccatcggcttctccgtctggtgccgccccttcgccctcgccattcaccgccggagtcctctccttcccgtcgaggtcatcccggcctccgtccgccgtttcccgcccgtggagtcaccgcgggagcgccatcccgcagtcgtcccgaggagctcgccgccgcgctcatcgcccctcgccgcccggcgcacggtgaggcctccttcctctcttttcccttctgcctcccttgtccggcgccgcgtcgtgctgccatcgccggcggccgtccgcgcgtgtgccgccgccttgtcgggctggccggcgagcccgccccttgccgctctgttcgccgcccgtggaccactcccgtggtccgggtccacggtgccgccaggccgcggtggaccgagtccaccgtgcgcccgcccccttgtgccgctgacgtgcggggcctgcgtgtcggcgccggcgccccttgctgacgtcagcgaatgccttttcctttgagaaaataattgataattgcgcaataaatcattaataattatagaaatccatttaaatggctcaaaacttctaaaattcatatctaattcattcgaactccgaattgggccattcaaattgcaaaattcatctaaaattgagttctacatgtttgtttacttttttatgtactgtttgcttggtttttattagggtttttcctcgttttgcgtgccagcgtgtagaatccgtcgtttcggaagatcgcggttgcgaggaaaagagttcagaaaatccaagtgaagaagcaaggcaagtcacacattccccttgagcatgttgttcccaatttataaatgttttaccgtttgcaaataaatatgcatgttttgctaattacatgggatcagggtttgcctatctgctcgcttgtgccatgtttacttgatatctgtcctttgtcaaccatgggtgataaatcgcttagcttgtgttactttgatgacctanctagaactatatgcttagccatgcttaattaccactagctcagtcgatgggataattacagtattagacattctagtatcttgttgagctgcgtgctcgagacatctggccatgtttcatagtcgtaattatccaactaaaatgcgactgaatggtgggctgtgggtgcatggttttgtgagtcgcacctatggcaattaaggaccggttcacgagaaaccctggaagacttacagcgcttgccacaagcgggagtgggtaactgcttgatctgaagtatagctcgaccctttcctaggcatcggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtcttgtcacaatcactcgacatggtgacgtgtgcatcatgggcacatgatgacgcggtgacatgtcggtgggttgtgtcttgtgggtacagttgtgcacctctggccagagtaaaactattcgaatagccatgcccgcggttatgggcgatcgaccagattcaccgtgattagtctcacccttaataaatcgactcaatgcactgtagtacaggtgggttggttgggcctgttcaacgtggtgtagcgttgatcagtggagatctaatttttcttaattattcaacagttttactgtttgctaaataaaatgttttacaaccgtctttatgcaaatagccacaaaccgtccttgtatccctttgcacgtctgcatcattggtgtggcttgctgagtacggtggttgtactcagccttgctattattcccccttttcagaagtgtagtgcttctgagctgaagacgaagttggaagaccaaggctcagaccccagttgagttttgcctgtggagtggagctgaagccccgctaggatcgcctttttccgctgctgtcgttctgtttcggtgtgaggactaagtgcctcttccgtaagtattttacgctttatttacgtttggaactgtatattacttgtcgttttgtgtaccctagctggtcctggacagggatttaatacgtaaaatagtctggaaatttgggttaaatttctgggcgtgacaaggaccccccaaattgaaacgaaaattcgcgatgacacgcatccaattccagactccaatacaaatcttgatcgaactcctcttttgcaggtgaaatattttactctggtgactaataccaacaatttttccacacactaaaccagtaaatcaatggaaagaatcaattcataagctttgtgaaagaaacatttgattccatcatggctaccaagttagaaacaaacagtacaagtgtttagccctgggatcatcaagggatcacgaggtgtactcaaatggctggggtggcaggggctcctcgtcgacggccatggcggcggcgcctgagccttgctggccagcggtggcggctgcggcgttcgtcgcctgagttgccggggcgtcggtgaggactagttcctccgtctcggtgggcttgaggtcccgtaggaggacaaatccggagggcgccagcttcacaggctcgtacctgccgccctccaggaattttatgaacttctcctgggccgggacaacccgggccgggttagtcaggatctggaaggtcggttcgggctcaggggctttcttctccgccacaccatcg

SEQ ID NO: 63890 - DNA, 6239 bp, Oryza sativa
cttcctagaccttggcctcttgtgggattctagagtttgaaactttggagaattcctcaacttgagccaacaatgattaaacttaaatgccctattcttcgatgcattggatgagtacaatgcctcagcttcaagaacctgaagcaaaattcaagtgttagttcacatacatacaagattgttattaataataatgaataaacaatttaacttacaagctcttgatgtggtatgccacttggatgtcgacgctcaatttgctcgtagcagccctgaaacttgcttacttccttctgaatgttaccccaaagtgctcaagagagtttgcattcctatcagactcaaaatcacagttagcatggtagtgctctgcaatcctttgccaatatgccttccctggttgctcattgccaataataggatccgagctaatgctttgccatgaaatgcacagttgaatgtcctccttacgattaaagttgcttgatcttttggctcttccttttgcaccatttgttgaagtatgaaggtcttcattttgcattggcaaggaatatgcctcaacatgggtctcttcggacatcatgcacataaaggaatcacattcatttgccatcacaatctagtcactgcaataagtagataaattgacaacttctccaatcaatctcaggaaaaatggcagatgctagctaatatatgttggtagaatgcataatggtagcaaatttttccaatcattagaatttagaacaggttatgctagagctctacaaaattgaattaaaaagaaaaccatatagcaccccaaagcagcttattttttttctcttttttaacagtctactcgaagaacctgcatataactaacatcggtacaaataaaattgtgtagctcaggaaattaagcagcactacacccataccctctagaatacgatcacaagatttcaactggcacagtgtctcaaagtcatgcatattgaaaatcacactgaaaaccatatagcactatccaaaacttacaattcccaaaaccatattagcttgatccaatttatctttccccctgctaatttcagttacagtttttttttgtgttgaccttattactaatgcaattgtttaactacttgaaatcaatcatcattacatgagctcacctgaccatattatacatggattcagattttcatttgtcaatgaaggagttactatccaaactatgtttcctatacgcgtatgcatggctatttttcatatttctgaaactacaagattaggaacctactttcaataaattagattattcaggaaaaaatcaatcagatcattccaaagaaagtataattacatatggattatgagattaattattgtattaattaacagtcaaacatttgaggaaaacaaaatcacataataaaacaacaaaaccatctcatcgtggaaggttagttcctacccatttcttctccaaatatacattttcgtactgacaacttttctctcaaacacgctaggtgctaccatataactcaatccacaaatccactagaaaaatgaaaacatgataccttcaactagcgcaactagcaccagggagaagggcgtcaggatccaggaggatattgccaggtgggcaggtggccggccaggaaggagggcaccagggaggacgcctgcaggggaggagggtgccgccgcgccagccaggaggaggatgttgggaaggaggaggcctaccggggaggagtgtgacgggcagggaggagggcgccacccgggatgagggcgtcggcaggggaggagggcgccggccaggaggagcggcgtagatccgtggaggcgcagctagcgggatatttcacgtgaaaaaagaagtgcccgcgtgtctctgccgcggatgggggctgcggagaaagcccctgggactgggggcctgaggggataatttggaggccttcctattttaggggctttagtaggggccttattggacctgattttttagtctcaactctcaaaattagtataggggctgtgtttagaacctctactggagatgctctaagggaaaatatatggaatggagcctctgcaaccctaattagtgtggatccatcttatatatattgtcatcacataatatttcatgataggaaaaactataagctatagaactttaacaccgctgaggtcgataacatagcacacctcaaagtttaggtggatcaaacacgttagccacttgccactaggtcatggctgatcagtgacagtacatggtggattggtgccgccctgatgcttagaccattgctaagattttcagcccgtgtcaaaagacaaaaaaagaggtttctatttaacaaatactaaataaacagagtacattttacttcaatctatataaatatagaaaaattgcatgaatttcatgtgatcaacgtcaactagagctataccaaaggaacttactaactgacaacgatggtgatgatcatgactaagtaggaactaagaagaattatcatatcataaagcagtgattcagttctccttactaagcgaacaaatatagtggaacctttactgcctggaatgcacattcacatcatcatcatgagctttagttctttgaggtagctgtagccgagaaaaaacaagcttgttctagctaaataagtgaaagagaaaaagagactttaaaaaatagaacaagaagatcttaaaattatattaaaagtgcatttggctttgactggattataaaataagaggttattttttgaagggaagatgttgggttctggacagcaaagttgggtcacgtgttccactatgtcatataggacgctccgtctttggttgaggtagtgcactatgattaaatttacaatttttgtaacctgttattgaatttaggtttcgtagaactcccatccggttaatgaaatggtcgacaattttgtcgacaagagtttttttctttaagaattttgtgtaacacaatatataatatatgttttgagataggagatacagtaggtagcaaggccctcgtagcgatgtcgcaaacttacaatagaaggtcaggccaaagttataaaatttgataatttgattgtattaacacttgtggcaatgaccacgtgggaccttctcgagtctacgacggtaagtcaggatgtcaaataatcaaagtactccctccgtctcaaaaaaagtaaacctaggaggggatgtgacattttctggtacaacaaatctagataaagggctgtccagatttattgtattaggagatgtcacatatttgcttgagtttttttttttgacggagtacagtttatataggatgttaaaaaaagaagagagagagagagaaagatatctctgggccaaaggtagggtcggacaaatgggcccaacagccaatacggtactagttacgtagcccagcaacatggcgccatccgtggaacggaacgggcgtccccttcccgtgtcttatccactcccaacgttccattctgtggatgcttccgccaccgccaccgcccaacgaccagcagcaagcagctcagccaaggggctccccatcgtatcgatccccattcgcgccgtcctcttcttcttcttcttcttctcgattcataggtgtggtttccatttcttgctgtggttgctggttgaactagcttttgctttgcttggattgtgttttgattgaggggtttgttagtgttagcaatctaacccaagatatctttgcaattatatgctccagttaatccgtcaggcttttgttgcttgctgctgctgctgcggtggcgggtggggaggaaggatgctgattgcggctgatttcccgggagattcgacggtgtcccgatgcgcattccccggtttgttctgagtgatgatgcggtctccgtttcgtgatctttgattgatgagccgttccgcggtaagctctgaaggcggcattgcgctccggctcttcgtggactggaggatccggcgccggagggtctgcgcatgcaagatgttcgacactggttcccaaaggggtagggtgaagcagctggtggcttttgccaagaagaggaggcggcccaagaagcagccgtcgcggcggccatggtggaaggcgtggttctcggactggaacgacgaggaggagagcttgtctggctggagggaggatgaggagctgctcgaggaggttggcggcgaggaagggctgtcggacgacgagaagtttgagacgtggaagaggaaggccgaggctattgtcgagctgcgggaggcgcggcaggatgccatgaacgcggaagggcgctcgtgggaggattggattggcgggggcagtagcacagcgggggatggcggcggtgactggggtggggatttggatgtgtcagacctgataacggatgatcctacagagatagtgagggataaaggtttgattgaaactttcagagactctgtagatgaagattacaatgacatgctgtttgaagaccgggtttttctgtatgcttcaacgaattcggtgagctctttacctatcttgttttctgtcaccaaatgttataacccactgtccagtgataaccatgagatacttgtaatgctttttgaatatgatgaactacttcctccgtttcatattttaagtcgttttgacttttttcttcatcaaacttctttaaatttgaccaaatttgtagaaaaaattagcaacacctatcacaccaaattagtttcattaaatatagcattgaatatattttgatagtacgtttgttttatgttggaaatgttaccatatttttctataaacttggtcaaactaaaaaaagtttgactggtaaaaaagccaaaacgacgtataatatgaaatagaggtagtactatataatattggagtgcataatatagcaacaaactttaatctttacaccttacaatattatcgaacgctgagggtccattttgatggtaatgattttgcatctggtggctggtgtattttgaccattttgatgattaaaaattaaaaatgttaaaaagtgtagcagcattatattgttatattaagaccctagcaaattggatctaacaaaagaaagtttgcactttcaggccaaatttctagcattattgattgtgattccatgggtgttggattttctggttcatgactatgttctgatgccatttttggaaaggtaaatcctctcacagtgttccatttttactttcttaactttttcccctcacttcttaatgtaagaaaatgcattccatgtacacccaatctgatgtttaggaatttataaggtgaagtttcaagcactgatgatattctcagtttctcactctctgtgcttctgaaattacatgcgatcaataatcatctatgctaaatgcagaattgattacatggaacattacacaataacaggtacgtccagaaggtaccacttgctgctgagctgcttgatgtaaggcgcagccagaaactcctgatggtaaaggacataaatactgagaaagcaagatatcgttttgaagtagagattggtaaatctcctccactttctgatgatgagctctggtcagagttacgggaaaaagcgtgagaaacactctaactattatactttcttgccttgttgtaacttctgttgatgcactagcattgtctgacatgagcaatggaccttctatcctgcaatttcatatgttcaatcttaacagatctgctctgctacttgatcaggatagagttgagagatgaatggagattagaaaaccgaaaagcgtttgcaaatatctggtctgacatggtttatggaatttccctattccttcttatgtacttcaaccagagtaaagtatgttttatcagataagcagctttgttttttttttccatctttgattgtgttccaataaatttttcagctttctgagtgtgcatgtgagctaagtgattggttataaataaacaccccacaagttgacaaatttctgcactattaggcctctctcagagttatccgatttctgctgttaatacatagtacatgatgattttgtgccaaaagaactgcagtgatgaactgaccagagtattcccccattctatttgtacctggttatacatcatacttttctgacctagtgcagtagtaagaccacctcagtttctgcaatatgtt

SEQ ID NO: 63891 - DNA, 972 bp, Oryza sativa
catgttttagaaagcaattcattatatcttgtcatcatgattcatgagcgattttttaaatattctctcataagtatggataagtttgtaaaaatgcatggaagaaatattatagctattttttttgtcaggaatgaggcagatggttctgtgtttcttcttcgttcgcacttcaaatatgatcttaatatttcttcatttttctctctcttcaaagatgtttgtagcattcgtgtggcagaatcttatttatcatctagttagaaacttagaatagtgaacctaagtggtacagtatcccgttagaagttaattcacacaaatgcatatgaactgctttgcgaataatggaattcttcctgttcatgcttatgttatacatcatgacatcttttctgtttcaaacaaactatggatagtttgtaattttgtttctgctttttttcttgttttcatgtaaacgtaacacaaggttaacattgttttggtttgtctgtgatcttgttgactatattaacatcatttagctgcattttcacaggtaccattcagagtcaggttggcattctttggtagaagtcattctcgagcactacggccttgaagccgatcaagctgcaatcaccttctttgtttgtctggttcctgttgccttggatgtatttataaaattttgggtcagtccacttcttgccttcacacaatcaagctaatagggctatgaacatttattttattctttaaaaaacatttatttcattttatctttttttaaaaaagaatataagtgtttgttaaggcctcataatttatgactagtttcacccaaagttgataacattatagattcacgtttggctactcagcgctaacatttcagataatattaactgaaagttttatagtctttctacaaagtgatttgaactttattgctgggccgacagttattaggaagacaaccttttgtag

SEQ ID NO: 63892 - DNA, 1062 bp, Oryza sativa
gcatcggaaagatgaaatagatcaatgcatcaggaaagcaacagaattcatcgagaagttacagaatgatgatggatcatggtcagcactccttaaaaaaaatactatagaaaattgaagtactaattaaatctatcaattaacataatcctagttacataggagaatgatggcattgctggcacactgcctctgtttagagtgctcttgccaaaatctaagagacagtatgcctaatccggtgaaactaaatgattcaccaaatcgccaaacagaatgggctagatcatcacgttctgagttgcaacacatatttcggattgacaatgtacttatgtacagataagaaaacaatgaaaattgagataatatacagtagcaaagcatattaagagaatcagttgccgatagcattactagtaaagacttttgtataacagaaaaaaatagactggatcgaggttaaataaattcaatggtacatattagattttaaaacactgctacaagtaaatgtaatactgatagctggttgagagattggtaatttggattaatatttttttttctacaggtttggatcatggggtatttgcttcacgtatggaacatggtttgcaatagagggtctgtcagccgtggggcagtgttatgatgacagcacctgcattcggaaagcctgtaagtttctgttatcaaagcaactaacaaatggtggatggggggagagtcatctttcatccagaaccaaggtaacactcccggaatgctttattgtgtcaatcaactttaatttttgacagcttagattaagcatcgggtttaggaaaacttctatctttctttgtcttgaaataaattgaagacaaacagatagcattttctaagaactggtaatcaggtaataacactaggagctaaaatcatccttagattaattagccgacagggtcactctagaaaaaaggacaaacaagtaaatgacatgcattaattgaaacaaaaactgaaaaatcagaagagcatgcaatgtcactgaaagaaaatgtaatagctgatatt

SEQ ID NO: 63893 - DNA, 7331 bp, Oryza sativa
attttcccattccattgtagatccaggtaccttaagtgcttaagatttccaattgaactcggtagctcatcaaaatcaacgtcagaaaaaataagaacacgcaggagtgtaaaggttgacaagaagttgtcaagaaaagctttagtcatggtcccattgttatcaatgcttgcaaatgtccttgccttgtttgcctttctcaggtgcttaggaaattcaatctctgttgagaagtccttgcgatcccacacaaggtgcctaaccttttcagataaatctttactttcacaattaacaatagcatgctccttatggcacacaaacatcgcaagattatgaacaagatcatgcattttacaactttgaattgagccattataaataacataatggtcttggaaaagagatctttgatccagttcattaaagtattgtcctccaatagtttctatttcatctccttctctggttttatgcaataaccctagtgccatccagaacataattaaaagctctctcaaaatcacgtagtcttttggaaaaacagataggcaagagaagcatgccttaagatgaggtggaagtgcatcataactcaattttaaggctggcaatatatcgcatttattttgctcaatattccacagatttgcatccttaatacgcaaccactccttaacatcctgtttaccaaacagtacagaccccaatgtcttagctgccaagggaacaccgtggcatttctccacaatacatttgccaatttctaacaagagtgtgtcctttttttcctcatctctgaatgcatagcgaataaatacctgcatacattcatcaaatgaaagctctggcacatagtatggctccaacgtcttcaccaccgacgcaacattcatattacgtgtggtaactacaacaacacttcctcttccaccactagataggaggtttttaagttgttcccagtcattaacattatcactccatatgtcatcgagaactagtaaatatttgttttcctgtaaaaacccacgaagcttgttttgtagcgtttgcaggctcagttgtttgttgctttcacctgtatctgactggattatgtcatccagtatcttctttagatcaaatacattagatacgcaagcccataagttcttctcaaacattttctttatcctcatatcattgtacactagtttggccagtgcagttttccctatgcctcctaaaccaacaataggaagcacagaaaaagcatatgcatccgcagcactcagtatgatttcaacaatcttgtttttcgcttcgtctctaccaacaatgtctaactcattgatgaaggaatgtgtttccctggtattgctactgaaaaattgcgtatctatgatctcctctgttaatgcaaactcccttctgttagctgctatctcatcaagcttttgacgaactactgttatcttatggctcaattcgaatgggtaaacaagctgccgactgaccccagcatagaaaccattatgaaccttttgctccaaatctttggtggccacatcatccagaacatcatcaatgtcgtagacgacatcctttaaatcttccagccacactttaagagcacaagaagtagactgcttgcgctctgcatctttaagaacaccacagatggacttcagagatctttccaacttcctcacttctttcttgaaattccacgctgatttaatctcgctggcagcacaaaaggccgcttttccaagaacggagattgcaaaactcgatagatgcacctcagccatattttgcttggcaactgcacgatagcaagagcatcaaaacaaacatccatgagaggaaatctgatgtcataatactattacttttttttaattaaaaagaaaagaaccccacattacaatacattaatcagtaaaacctagcatgatttaagatttaagatcctggtaaaatcagactcacggaactaatcacataaatggatgccagatgaagacggctgcaagccctacattgcaatcaatccaatccacctgtggggattggagtggatctaagctcaaaattaaccttaacaaacaagcaaagtccaggacacgcaccaaaacccaccgcttcctttgcccccctcccgttcaagacggacgcgtcagatcaccgagcaccgccgcgtggcaggaagacgacgagaggggcggcctgcagtgacgccctcgggtttttggctccgcacagcttcttcggcctcacgcggtgggtggggggtgcggtgggcggtgagcggcggcgacgtcagctaggtcaaaccgcagcggccagcggcggttttttttcctttcccctttggcttcgctggcgtagagcaccggcgtccggctggtcgccggcgaggttgccaatgccggtattcgtcttctccgagtgtgggtggtagcaaaatgggcaagattaactttgtttttcactttaaatatcttggttgagctacagttgaaagcttgaattattttaagaaaataaatagaacaaccaaaaataatttatagatgctgtaatttaaaaatccaaaattaacctaatacatttttgtttttgcaagacttagtttaaatttaatatttagactttggttgtggctaacaagccaacttatatagtaatcggagataaacctattgtacgagagggatatgagtgatggtctgagagtatgagccaagtagatttttttttctcccatcggatagcctattaagccaaagaaaaagccaaattttgaattttcaaaattaagattgattttaagatatttttttaacgtagtttctttttcagcattggcttttatatcaccgagaacacatatataaaagttttacctacaaattcatttttattttctaataaattgttttggcttattagaaaaaagccaaacaatggggccctttgtgaatggaagaaagaagagagatcgtttgacttaaatttggagttgattcttgctttaaaatttatttagttatttttttagggtgagtttagtttatttagcaccttactaatttgggcaataattttctcttgataatgtatgacctcgattagtaatgtatgaaacatcttcgtatgtccccacaaatagggcaacaaaattcatctaagtctttcaagctaaaatcttagtcatcttagacattattttttatttactaacaaggtataagaaacaaataaatacaaatgatgaaggtataaatacaaatgatgaaggtgaaaacaactgtaaaatatatatatatatatatataattttattattggagtatgtatcaaatatgttttcctttccagtaactcattgcatcaattgcttatatgtatatagccacattattgtaaaatgtacaacaactcttaaatatattatcggatgtgaactaggttttataaactcaaaaatataaaccatatagacataaaagtcttatatttgttgaatgtaaaaaaaattcctacataacgtgttaacataaaagtcgatgtagcattgtcattaaacttacatcaactagcacgtgaaaccaaacccgtcggtctcttcctcctcttattcctcagtcatcactatttgaagtcggcatttcgattctcatcctcagtctctccggtcatcatcatcggccgcacagcaaaaccaccgtatcatgaccttgcaggcgccatgtccaaccggtcagaagagagagggggttctcttccatcatagccgatatgggagacgattttgttcagattcttcaaggcatcctcgaacgcttcgcggatctcgtgttcgcttcctactcttctccgacgagctaccgattgtgctgggcttctttgccgatcatgatcgacactgctgctacaaaaattcaaaaaggtaaaattccattttctaaaaaaaatagtagatgaacacctattcttttatgagcattagctacaacttacacctatcacaaaacaactcgttgcaaaaaggggagagaccaaaacttgattgctcaatgcaagagggaaggattgcaatgctcccatttgtacgtaatcctaataaaaataagaaaacacaagaaaggaaattttcaagttctccttttctttttctttggagcaatataattctctctctctctctctctttttttggcaccgctttctacctcctctactcctcttctttttagcgaagcaaaccctcacctcttctctactctctctctctctctctctctcaagctcggcggaggcggaggcaagcaaagccttctcccctcgcctcacctcgcaatccaccttgggcgggccgtccggcgagctgagcgcggcggcgccctccttactcctccctccccacgtgcggccccgtcggagcacggcggcgacgaagaaccaggggggtgggggggcgaggaggagggcatcattccaccggctgattcattcttcttggctcgagtcgaattggagaggtatatcggctcttctctcgtaccgccgcgccactggagatggatggatgggcgctttgcatggctcggattagggatccgttcggacatggcttcatttctttcccaaattgacccgtccagttaattccgtcccggtttccttcttttttttttctttttttctttttttgatgtgtgggtggtgggtgcagcagtggtagctgtttttgtttccaaaaggtgattttttttttgggtggggggtgttgttcagatgaacacccaaatgccccgcgtttgggcgagcgagttgtagtgcttgttggaaccaaatctgtgatctttgcggtttatgctggtactatgtttggtgtgatctcagaaaatcgaattttatttgggttgcttttatggttggtaccgatgattttggcgaagaatcgtggtgtgattgtaggaatgggaagctttgatccgttcggtttgctgtaggagcatgcatgcttatgatctctcttggggttcctcctttgcaggtaattgcttgccttctgaggaactgcgggagggagcgaggagtcgtggagcgactcttgaaggatggcggaaggtgccaaattccatgggatcgttggcgctgttggcgcgcatgatgttggcgggaacttctgtgacatggggtactaccagaagctaggggagggctccaacatgtcgatcgatagccttaacagcatgcagacaagcatatacggtggttcggttgcaatgtcagtggacaacagtagtgttgcatctagtgactctcgtaccgggatgcttaagcatcctggcctcaggggtccagtcattgtgtctagctattctgtcgggaacagcattttccgtccagggcgtgtgtcgcatgccttgagtgatgatgcattggcacaggctttgatggactctaggttccccactgagacactcaaggattacgaggagtggaccattgatttgggtaagctgcacatagggatgccatttgcacaaggtgcctttgggaagctctataggggaacctacaatggaggcgatgtcgcaattaagcttttggagaggccagaggctgaccctgagaaagctcagttgttggagcagcaatttgtgcaagaagtcatgatgctcgcaacgttgaggcactcaaatattgtcaagtttgttggtgcatgcaggaagccaatggtttggtgtattgtgactgagtatgcgaagggcggatccgttaggaattttttgaatagaaggcagaataggtctgtcccactgaagcttgcagtgaaacaggcattggatgttgcacgtggcatggcatatgttcatggccttggatttattcacagagatcttaagtcagacaacctattgatttctggagacaaatctatcaagattgctgactttggagtggctaggattgaagtgaagactgagggaatgacacctgaaacaggaacttaccgctggatggctccgtaagttggcatacatgctctttatcttgcttattttaatcagtaattatctcaaattcgtattaagacaatgctgttttatttttcttcactcggcattacccaaggccacagtatttctcaaatggtaaatgcaacacatttgcagtccttgtatgataaaatgcagtaacctattcatgtgaattagtagctaggtatgcacatgtgttctaattacatgcaatggcactgtgccagtcctgttatccataatttatccttttttttttgctaaggctggttattatcttgaatgattcatgcatcgaatacttgagttatgtgaaaatgcatggtcatttgcatgtaaaacttttctactggtgctgcccataactgtaatattttactttttttgttctctgtttttcttattctcctctgaaatctagtttggcagatcaaattttataatatgtgaaacaagcatatgctgtgacaggagatgtcttgtaaattcttgtgtgtagcttcatgggttgaaatatatgaatgctatttagacatagtccaagagatctcattctaaaattttcattacatacctatatacgcttataattggttcgtgggtgctaatatttaataaattattgctgtttaaggtattggattgcattaaccgtgccctatgaaagcatttatgcactaaaccctcattctttgctgatagatgcacaaggtgttcatcttaagagcattgaaattgcagcttgaatcttctagtttagatgcttgttcaagatatatttgttgctaattctcggctacaaagaaaagatggcagcatcggttaactcaggcctatccttggcattaggcacaccaactatttattaggtgaagatggatcaattatgaataggattatttggatagggtttctggatttaacagacaatcaatactcattcaatgttgactaaccgggtagtctggatatcagtgccacataaggataatttggacaaaaactattaaccgtacaacctagtaacgcaaaaaccctagcccttagaaataatatgtctcctggcttccgtagctaacctaaccttaggtaaggcatgctaccagctagaatgttgaagacctgttttgccgataaagggtgatttcatgggtaatgaaagcatctgcacccccaagagagccttgtgtaggtaggaaagctttagagcaagagcagcatgtcaacatgatacactccatgcgattatccacaatcatcaattcccgtccatgggatctatgagtaatc

SEQ ID NO: 63894 - DNA, 4318 bp, Oryza sativa
caaacttgtgctttaccctttttaagggtaagcaactgcacaaatagtttcacctctcttaactatagcttaaatgcacaagtgtgttcctagctaagctaaggtgcaaaagatcaaaatgttcatgtataatgtaatgttgcttaaacagtaaggtaattgcatgcatgtaactacctggcaaaatgtgttatttgaagcaaaaaagttcctatgatgaactttctgctgtgcatgatgcatgaatagcgagtgttttgtgttacaatattagcaaattagcacaaagtggtgggttttatttaaaactttgcagagaggaaaagtatgctatttggttcttggtgcaaaatgctgtttatatctggcagatttactaactacaattataactagcacttcaaaaaagtcaagcttgagcttttattcactagtcttggcctgttatggagcattttctctcatagaaatagagcatcaagtttattcctttcttatccattagattggaccagcatattttcttataaagtatgaattagtgtttgggattatagtgcctatcctggaacctggataggtggataaattattggatctctatgatgttcatgttcaaatatagtgcagtatgctagaattggatcaattattgctcattgtgtttttttttcattggttctagtcatgataactttttattttgacttgcagtgaggtgatccagcacagaccatatgaccaaaaagtcgatgtctacagttttggcatcgtcctgtgggagctagtaactgggaaccttccttttgcaaacatgacagcagtgcaagctgcatttgcggtggtgaacaagggtgtccgcccagccataccccatgactgcctccctgccctcgcagagatcatgaccaggtgctgggatgcaaatcctgatgcccgtcccccgttcaccgaggtggtcaggatgctggagcaagtggagatggaggtcgttaacactgtccggagggcccgcttccggtgttgcatctcccagccaatgaccctagactgagtcacagccaggatccagggtggaaaaaggcaacctggagaaaagttaagtcctgtgtacctatcatattaataggcctgttctgcagagaagatgaaagcccaagctgagtgtacttggcgtcgcgcgttctcttcgtttaccctagacaatacctagtatctatcgtcagactggaatgtattagcggtagctttttatctttgacaacaaaaaaacaccatgcagggctcttgttgcaacaaccgcatgttcctgctgtatgttatctgttgtaatcatcctgcttggaacatgtgcaaggctgcaaggcttgatgcctaatagtatatatagcatatgtataattacctggcatgtgtcatacctgtttttatagttctggcatgtgttttttaacctgcttccatagttctgaacttcttattgatgcagctttcatggttaatgttatataccatgtactattaactagcatgtgtttttccctgttcccatagttctgaatgatacacctacatgcttaatggtatatatagcatgtacagttatctggcatgtgtgtttcatagtttagaatgatgccaagtaaatctgtcatggcatcacgccaatttcctccttgtgggttcttgagcatatcatggtatatcctgtgatgtgttcactagtttgattgctataataaccgtaccaaatgctttcaggtttgttcagtggatcagctgggttttcagttctgaatgcttcccaattaggttccccttgtatcacaagttgaatatttcagtcatgaagtaccgcgtgaccaaaggagctttgctacagaattgtgctacatgagagcttaagaagctccaagttcacaagaaaagaatggcgctctgcaaatatacaaaggatggaaccagagagacatgagactggaaagctaccggcagcataattatgcagcttcttatggctaaacaccaccactcacattgaacagcattcatgacgcaacacaagtaaaagcgaaagggaacacattgagacaggaaagaagattgacagcaagaatttcggaactatgaaattggaattataacctaaagggaggtgaaacaaagcctataatgttgtacaactgaagcagcagcaacacctgacataaccaacctgctcttttaacccttctcacctccataagagcatcatatgatccaactgctgctccaaattagtaaatgatatgggggagaaaatcgactgctttactccacagggctagcgttcgtgctcgccgttccatcttcagccttggtggttgcggtggacgcttcatcagctgaagaaacaccctcaactgcaggcttgctttcgccattctcagtttcttttagctggacagtctgaccaaatgtgtctgagatgtgggccataagttctcctagggccttattctctgctggtttctgcagctctgggctggcaggctgctgctgacgtctattctcctgcaaggctttctcccgctgctcatagaagtcaaagtcttcaagaatgttcgtctccgattcatggttcttgaagatagttaacatctgcagaccatgttccagcttcacctgcatgttttgtctctcaagttagccattttcagaaaaagctacattcactagatgtttcagaaaagcagagatctctacggaaagattaggattaaatcaacagaagctggcaaaaagacagcttttttacctcctgggtgtccctgctattagttacaggtttgttgtcattgttctcaagaatgatgtgccgcagcaggttgttcgggacatccttaataatgtgccacttcacagggaactggccactccacttgtcctgctgccaataatcgacacttttgtcaaaatcgacgggtccaatcatctcagctacaccacagaactgaccactgccattaacctgcaaaaaacgaggttatggatcaatttaaataaaatctttaaaaaatcaggacatagatcaaaagtagtcttatagaaaatcagctttttgttacttgctttttcccgtagtacagagaataaaataataaaaaaagaggggcttgtcttaccgagaaaaatagaaaaatagggcaatagtcttctttttctttggccaagcgataagcagaatccagctttctattcccactagctgtactggcccaaacattgtacttaatgctcctatgtacatggtcctcagtgtaggactttattacaaaaaattttgcatccttgtattcagtgacaaaatcagggcgattatacagttcactatcaaccagaggaacatttttctcatttttgtcatctattgaagagttctctgtgtcttgtttctttggttttgtagcacgtggcccacggttttgctcattcaggaactcaagagcaccattctgaataccaaatggcatgctccctttctgttgattggcgcttaagtcaaaagtaccaaatctgcgaccagaactccaacttggagtagtgcctccaaacttaccaccttgttggcgtggcttataggatccaggggcatacattgacccatgatgctgcaaaaacatacaccgtcagtgctggacaatgaagagcacaataaacattaggactgacaattttagttcaaccagtatttgccaaagcccaattgcaagaaagcataccattccaaaagccagcggtgtgttcccttgaccaaacaaaccaggagtgctgcttggttgggtggatgctgcaaaagaaattcatgatatgttaagcattggcctaatcaattattacaacagaaataacttgcaatcatcaaaagttcgacttgaagaacagcaaagattgaaaaggagaaatattacctctgtcaaaagacccgaatggttgatgataacctggtgttggcgagtagagaaggccgtcaggaaggaagtactcctgctgcagcataggatctccttgagacattccagtggcggaattagagtatcccatgctaggagaggctggtggctggtagtaaggacttgagaagggaaagtgcaatgggaggtatggctggccatctccaacgccaggagaataagctccatacatcatttgagggttgtttgcatatccaggagataacatgattgactggttgtcgttgtaaattcccttcagcaaaacaagattaagaaaactaaactatgaaaaatggaaaataacttcagtagtcatagtactt

SEQ ID NO: 63895 - DNA, 2213 bp, Oryza sativa
ccattagtaaatagcgcgacacctattgtagggaaaaaaaactgataagacaattacctgctctttagcagcactcttggatgcgttgttctcacctacaatttctgattgtggtggaatcatgcaatctacataacaagcagagttacaaagattgtaacatcctcatagcggttatcaaaacttaaaaaatgagcgaagtaactccacagatatataaatatatatagaaagtaactatatcctacaaaccataaatgcatattatggtttttactccaccaaaactatcaactcgttctacatgagcaagcatttaataaacgctttacaattgcacatgtcctttcatcaacactgcaaatcagccttttgcatacacagcgcataaccaacatgctcaaatcaacactgcagcagcagcagcagcgacctattcaaatacctcctccgattacccagagtcgagaggacgctttagtcctttttaaccgcactagaattagtgaattaccacctacccgctcgtactcctaccggcgtaaatttccaaactacggaattattacttaattctcccaacttttcccccctcgatagcaaactgtcctgtacgcgttagctcccaggggcggggaggggaggatcaaacatgtgacaatattagtaccaaatttaacgcaaactaagagagaaaaaaaaaccttcccagatctagaacagaagctagggttcacgcgaattcgaggggagaaaaacagaaagagcgcgtgggtagagagagagatgaggaagaggacgatggaagcttaccggcggaagcagccgggcggacggcggcgcctcgccggatggagatcggcgcaggcggcgggcgaactcgcgcgaggagacggagtttgggggggagtcgacgccgaggggaacgggaagactttggtttttgacaatctagccccttttagaaaacttattttgtaaatagaccctcctaaaagctcgttttcgtggataaggcctttcagcggtctatctatacattaagctttttctaaaagggccagattgtcaaaaatccaggaacagctatagaccatgtgggccgcccggcacggcacggcccaggcccggccgtgcctgggccgaggcttgtcgggccggcacggcccgaccgacgcaccgggccgtccgtgccagcccacgtgccgcactcacggcccaggcacggcccaacacgcctcgggccgtgccgggccggcccgaaggcacgatgggccgtcgtgcttttcctcagaataagtctaaatttactccctcctattgggctgtgacatatgtacagctacaaaaagtctattttttctccctcttctttgggctggggtatataaatagctaaaataagtctatttaaggtccctattctttagacagttacatttatatgtctatttttagtcccccatactttatgtaccgggcctggcctgccggcccatcgtgccgggccggcccgaccgtgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactataggaacagcggaacgtggacgggagatacttgaccagtttgaccaggctaaacaatgattttggatacaattatgcttattactccgttcggttttttaattttctaacgtttgaggatgatcttactcctacttttctattttatctatactagcaaaagacccgtgcgttacaacgggaagtgtaaagatcagaaaatcaaggaaaagttaaaaaagacttatattatgtaattagttgaagtacaaatttccttaaaaatttggatattatttaagttggtaggtgtataattaaattaatttacaagtaaaataagtgtgaaaaaagttatatggttggatttaatttttcaaaattcttcataattaattacactctttgaaattttattgaaattttcaaaacttaattgctaattttgataatataaacataatttcagcatttattcttcaacccgcgaattgaaatttcccgttcgttctcttctgggtaaccgaaggtggagtgttatttgatgcggac

SEQ ID NO: 63896 - DNA, 2248 bp, Oryza sativa
ggcaggggcagcgccctcccctctatcggatccagcgggaggggaggaagcggcagcccgatgtccctgcgacgatggcaccctccccttccggcgtcggtgtttttgtgcttgtgatgttcttgtgttgtcgttgttgttgatgaaatatgttcttgtgttcttgtaacagtgttttctctaggatttggccaaatttgattcggactcgcattaagtgtcaaatcgaattggactttctttttttttatgttattttcgcccttttttttgttattacggacgatggaagcaaattgaatcggatttttttttaaaaaattttttttcaccctttttggttattaaggatgatgacacctcttattttttttaagtagtagagattagaaaaaatgcccgtgtgttgtaacgggtgaagtctatttttaatcttattattgttatatggtttagttaagatgaagttcactctggaagtttgcttggatatatatatatatatatatatatatatatatatatatatatatatatatatatatatatagaaaatcatgagctgcagttagcaatctgatcatctcaagttagcatgtaagtttttttaaacatatttcttatatggtttcttctatatcaccaaaagtgaacgatcttaaaaactgactcaaatatggatatgtatttccaaaagcaaacgaacttaaaaaccaatttatacacggatgacgtatcaaaatatcgacaaaaacatctttaatttttataactagtagagattaaatataatcttatcgtattttcaatcggtacttgtatgcagcttgtgtggttatagccatttatctcaaagcttgatatagccggttcaactcttggcacctcaatttatgcttcttttttttttattttttttggtgtgttgcgcgagctgcttggtgacgcctgtcatcacgtcgtcttctagcgcatggctcgacgtttatctcaccatgttgcacgagctgtttggtgatgctttgttttcacgtcatattctagcacaacctgacccggcccatggttatgacgctggcattctggcaatcacatcgtcctcctacgtgacgccatcacacaacttcttgggctccatgacgtcagcgagcggctagaggcaagccaaggtgagcatgcagccgcacttgcaattaaaatgcacacaggagtttatgcgttgttggctggttgtctaggaactcgttggagttgatgcactgttggagacgaaagcattcgagtgtatgcaagggtatagaagtccaaagtaatcattcaaatgccaaaacatcaagaattctcatgcaaaggacccaagcgtcaaacatcaagaaatatagtacctagggagtagatttttttgacagtatggtggtgtttgaaaatcctgaagataaagattaagtgtttcacgcaaaacgagatggtagtagcgtgtgattaattgagttttaattattagaaacttgaaaaatggattaatctggtattttagagcaactttcatatagaaagtttttacgggaaacacactgtttagcagtttgaaatgcgtgtcacgagaatctaaaatttcattcaacaattgttggacattcgaacgcagcctatggcttttcataacacgttgattatttgatcaagctgaaataagaacactcaattacatagtcactttcattttgcggtcaagcacggattggaataagcgccggtttgacatgaagttcttgaaaacacagggcatcgagataaaataaaaatttatatgcttgttattcatacatctggttaggttagagggtcaacctagattttcacgagcataagcagatcctagattgcacatcaagggtgctagccacatcctcgcgcgagagagagagagatcgaggtgctagcgcatagtgtaaccatcaccatgcgcaccttgcatctcagcacaatgaaatgtgtaacctatcttttatccaaaatcaatcatttcatttcgtttaattcgtagcacaccagagataaccatttctcaaattcctctttcttatatcgattaatgtgtatagctgttcttttcaatgcatctttcctttggcacaaatgcagtaagcaagcttatttcgttaaatagtagcttccgcactctttctacttactaaaattaatgtgaatgatcagggccctttagaggttctaatcatggagcaca

SEQ ID NO: 63897 - DNA, 1021 bp, Oryza sativa
aagccgcttgtttcacagaggatgaacacggaaccctacggaacgaaaatcgggtatgcgttccagacgacagggaacttaaacagttgatacttcaggaagctcacgaaagtccctattccatccatcctggcagcacgaagatgtacttggacttgaaagagaaatactggtgggttagtatgaagtgggaaattgcagagttcgtggccctttgtgatgtgtgccagcgtgtcaaggaagagcaccaacgaccggtcggacttctccaacctctacaagtaccagaatggaaatgggatgaaattgggatcgatttcatcaccggacttccaaaaatccagggcgggtatgattctatatgggtagtcgtggatcgactaaccaaggtagctcggtttattcctgtgaagaccacctatggagggaacaaactagccgaactctacttcgctaggatcgtgagtctccatggcgttcctaagaaaattatatctgataggggaagccaattcacgtctcacttctggaagaagctccaagaagagttgggtacccgattaaatttcagcaccgcgtatcacccgcagacagatggacagaccgagcatctgtcgcgtcccaaaacgactctaaaatacatcctcgaaattatgcatagaataagtaaaatccatgtgaaagcctccaacaattaaaatgtgctaagttaaaagtcaaataaggcttggaggatttttgtatatttcataaaagcctaaaatgcgtaaataaattttagtggaattttcagagcacaaatattaattaagaagaaaaaaacaaagttaaaatggttttgtaaaaagaaaaaccctaaaagtctttttcccccccctctccccctcttgggccggctcggcccacctcccttcctctctctcctctcccccgcggcccattcggcctcctcctcgcgcgcgtgccgctgacgggcgggcccgcccgccaccctcgctgacgggtggggcccacccgtcat

SEQ ID NO: 63898 - DNA, 1802 bp, Oryza sativa
aaagtacgttctgtctaaacagaagcggacctgtacctctcgttcttttgggcctttcggcctcgtctcctccttttgggctgtctgtactacgggcctcccctggttccttcagaaatactgggcttactgttgaggcccacaatactacaagaatatggtgagcccatcttagcatgggcctcatttttttcctttcaaaaacatctagtagtaccagcagcagaataaattcagtttctgttctttttgttgtagtacaactttgactcagttggccacttggcaagaaataattctggattttgaatcattcctgtagagagagctggtgtacggtgcgaatgctatcctccatactcgtttttttttatcatattctactccaagaaaaactgctatagctttccccccatatgcgacatcagtactgtatgcacgggctggcggtaaatgcgaaaagggtaccacactaccactgcatatgtgaagcagacacgtagtagcagcgaccctgcagctgcaaatgggcggcacatgcttatatttacaccgccacaacagtaacgtgagttgttggtaggataattctagagctccatcggtcagaagcagcaatgaacccatcgacacaacacgtaccagattgcacccaaaaaaaatcgcaggatctagcgatctcagatcaaacacttcgagaattacactaccaagaactcgtacaacaagagaggggtagagtaaatactctctcgtgctttctctctttgccaaagcaaagcaatcccaaaaggaaaagatacaaacatcgtcttttccctcgtctttttcttcattccgcttacggacactaataatggagtatctaatctgcctttgcaaccacaaactgacggcgaacgcatccacacacgccacggccacgccattgtaaaaagagattcacatcgagctagtaatatcttattgttcataaaatgcgcttcatctctaacctcgctctaatacgggacacgctagctaatacaattactactagaaagctgcataaacgcacagctttatcatcaactaacttttttttcgtacgtggagtacgtaattaattaactcgatcagcacaagcccccgccattgccatggattggagcttacgacgacgaggcgcattgctggcgccggaatccgagcctctccttctccaggtcgtactcgatgtagtaattctgctgctggaagctcccaagaatgatcgccggcccgccggaggagactccggcgccgccggagctggttgggacgtcgctcaccacggcaaggcagatggcctcggccatagccggagcgccgccgctcggagccggtccggccaccacgaagtagttctcgacggggaggttcatgacggagccgcccttgaagtggagcgacatctccggcagctccatcgtcttcgtccccggcggcatcgcgaagcaggggctgaggccgaggccctcctccaccaccttggaccggctgtacctccctcccacggccgcgaccaccgccgccgccaccggctcgaacaccgtgcggtcgaagtaggagaacgtcgtgccggagtcgacgatggcgcctcccccggcgcccccggcgacgaacgccctctccggcagctgcacgctcttcccgcccaccgtgatggcggtcagagccaggtagtagtagacggagtacggcggcctggcgctcgcgctccgagccaacggggcgtactgcatcccgacgccaccgtccttaccacccgcgccgtcgaggat

SEQ ID NO: 63899 - DNA, 8605 bp, Oryza sativa
ggccgagctgggacggcacagacggcgcgccgcggccgaaaccggcgaggccggacggcggctggtgcacggacgccaagctgcagccgatgacgaagttcctgacggcgcggccgggcgtgcgcagcgtgtcggagatgagcaggccggcggtggatcctgagccgtagacgacgaggtagggcgggcagacgttgttggcgttggcgttccgtggcgtgcagttggcgccggggcaggaggaggcggcgcggcagtcggagaggtggtcgggggagtggatccagaggcaggaagggttgcggcagccgatgaggcgggaggaggaggagttcttggggtggaagacgtggaggggggaggccgcggagagggaggagcagttgcggcactggtaggaggaggtgcaggggacccaggagaggtggctgccggtgtcgaggagcacggggaggggttgcggcggcgtgccgagggagacggtgaaggcgtagccgccgtaggagtgcgggtagagcgaggcgcggacggacggtggcggcgcggttccttggcgcgagcgcgggcgcgggcgggcgaggtgcgcggcgcgggcgagggaggcggcggcgaggcgggagagcgggtgatggtgggggtggtcggtgtcggcggggacgggcgggaggttgcggtagagcgggagcgtgatggcggtggagaggagggggaggagcagcagctgcaggaggacgactagcggtggtggattcgccatggtggtgtgcgcgtgttgatcgatcggcaatgcagggcaagctagctgctgcctacgagctctctgtgctttgcttgtgtctctcttaaaccgggaagtgagagttttcagagttgagcttgattgcggagggctcggtttggcatatgtgcttcgcttgcgttgggttgcattggtgggggccgcacgctcgatcggttcatggatttgatttgggatgctcgatcacgggcgcggagacatggatggtgaacggtctccgcggatggagtcctagccgcgtcggcggattcacgatcggcgccgctctctgttcccacgtacgcgcgcgcgcgcgagatggtcggtatcggccatgccacgctttcacgtacacttgagccgcgcgtccacagaaacatgatggatagtaattagtgccaccaatgcatgtggcacgccctcggatgattggatagtagcgcacctattcctcccttccagacactagaagcgtagtacgtgccctgccactgcgggttcttatcatcaacaccgccatgtgatgctgctgacgaattcatatgcgatgcttctgctatatgcatgttcttctaccgcgcatctaattaacgtcacccgtgaaattagaaaggattaattcatccgtcctccgccacgactgctgcaatgagtatcgccaccacacagtacaactgacacagccataaagacgaaatgatattgcaccttcaatgcacatctaccgcacaccccagcaacgcatctatcctagccagtctccatggacgtacacaaaccaactcgtacagtagtcatccttcttagaaatttcccgaggcgacaactatcgacaggcaggaaccgcagcttttgtttatttctctccactttcaccaattcaccatgcacgccttacttttactttttttaaaaaaaatatagtacatctttggatggacccgcgtccatcagattagatccaacggaccagatgtaatgggagctgctatatcataagatcccgttcgaacagtacagagatcggattttgatacctcatcctatcagccgatacttattggtatcatatatgatacttattgatattgtatcaatgctaggctagtactccatccgtctaaaaaaagacaaaccctgatttcattgcccaacgtttgaccttccgtcttatttgaaaaaattataaaaaaaaattaaaaatacaagttacgcataaaatattaatcatgttttatcatctaacaataatgaaaatacgaattataaaaaaaatttatataagatggacagtcaaagttggacacgaaaatctagggtttgtttttttttttacagagggagtagctgatacccggttagtaccacgtcagtatcttttttttctccccctcgatatgttctccgatgacaacgacgtgctgcccagtgacgtactacctccgttttttaatagatgacgccgttgactttttctcatctgtttgaccattcgtcttatttaaaaaatttacataattataatttattttgttatgagttgttttatcactaatagtactttaagtgtgatttatatcttatacatttgcataaaaaattttgaataagatgagtggtcaaatatataagaaaaagtcaacaccgtcatctattaaaaaaacggagagggtatctctcatctccggcgagagcgacgtgcccctgttgacgcgggactcttctccggcaagacccccttccttcccctaccttcctcttcggtgacgaaccctccacctcgcgtaggcatgcttcattgtaccggaagaaagcacatcgttttgccgacgagaagctctggatttgcaacaaaaggctggagcaaactggctccccaacccacacccttatggaaccctgcaacaccaagaacatgtcatacacaaaaacaaaatccttgaccaacgagcgctggggctcgccagcctgatcgccgaacgcaaccatagccatcgccgcccgtcgcaccgctcctctcctaccgtacaccctggagagatggggaagagagggagatggagaggagagagagggccgctgacatgtggagcccacatagataccactcgccatgtcagctaaaaattggtcactatattgcagatggaccaaaatttaacatggtattgtgaatcgagggatatgctatacattgtatttctgttgagggatgaagttcacactccgcaacaacttaaggggcctaaagtgaacttatttcgtgtgcatatgccaccattttctccgtgggccgtcaacgttgattcacatggcccatctactaggccgcagcccagcctactaaaccagtaagccctagctccgaacaacccctcgtctgtctctcttccccaaaccctccacccaacccgcctcctcgagcgacggcgcagccatggcggaagcagcagcagcacctcccgccgccgccgccaccaactacgaggtggacctcggcaacctcatggcctacgacccgtcgcatcacctccccgccgcatcctcctccaggtccgcacccatcgccgctactgctattgtgccgtgctgctttgattccgtgaccaagtttcccggggttgcgcgcagggaggagctgagggaggagtgcctgcggaaggggacggagctggcgcaggcggtcgccgacgccctcttcgcgctgccggccaccgaggaccgcgacggccccatggtccgcctcccgccgcccaccacccgcttcccccgcgagaagcatgtaagacccgaacctatcgcttgcatactcctctccaatctttgtgatctcccaagtatcatttgctgctgctgatctgctataatcatgtatgtggagccctaagcttagcttcactagtgtgattcgttcgtgtgaatgaaattgatacttcgatagttctccttgtatggttcacatggttctccttgctgacttgctgcggccataacattgagattctcacatgttcgtactgttattgagtcttgtgacggaatttcgtagttatgtccaacttgatgcagctaaagttagctctatatggtgtcaaatcttaacatgtaactcaagcggctggcacaatgttttttttcttgcttatctagttttttggacaacactaaatcactaatccataagagtagaaacatgctgagcgaacagttctttatattgatgtgtgcatgtacagtcacatatacagactggagaatacgatttattgcagtgtttcacttctttaacttatatttcttgtctccagctaccaaggccgaagccccctactaaatgggagcagtttgcgaagatgaaaggtgaacttttttaaaaagcaaacgttttgttcttgttgttgcctaatattaaatgtatgttttctcattaatgtccatatgttctcacttctcgatggatatatgaatgctacttgcagggatcacaaagcacaagaagaacaaacgtgaatgggacgagcaaactcaaacctggaagcggacttatggctatgaccgtgttaatgatgataaagacattccaatcattgaagccaaggcgacagatggttagtaatttgtctttctttaactaccctcttctgtgacaaggatattaccttttcctttgttcaatagcctattgcagttatcaatgctacacactcttcttcttatatacaacattttatttgttttaaagctagcgctcgtacactactttagttgaccatttctaaatattgaatgcttgccctcaattcatcttagatagagtcattttcttttggggtccttgtttgcaatgacacttgttctgaaatatgcatgtctcctaatcctgattcaccaatctgataccccttttgttgtaacttttcgctacagagcctggtgttgatccttttgctcaaagaagggaagataagaagaagcatgttgaaaagcaagaaaagaacagactagaaaacttgaaaaaagcagccaaagttggtgctttgcctaggttgttatcctttcctagtagacattgtatttatcttgtacattccttttctgtgttggtaaaccaagagccttgtgtaaatctgcaacgtaaagtacatttgtacaatggcagctcaagtttttcatataatatgtctttttttttatttgcagtcatatacaacttgctgcaacagcgttgcctatcacgggaactaaagcagacatacccaaaaaatctagaaagaaagatctcgaggatgttgctggcatggcttcatcagcaacagctagtggtgggaagttcgatgaaaaattgcctggcgagaaacctccaaaaaatcctggcaaacatagaaaggtttttaatctgaagttccctgccttttatgtgcaactatgcaccattaaaggattttataagtgcattatctgaattgattcttttctgcagttcctccctgttgttgaaggaaaaggaatgggcaaccaggagaaacagcaaaatgacaaaatcttgaatgctctgctggccaaaagttctgaggatcaaatggatgttggcagggtaatattcaggattaaatatcttgaactaatctgtatataatttattatcttggtattgccatttgttgacggggtgaactaacagcatctatctaaaaatttgaaaccaggcaattacgatgtacaaggtgaagaaggagaaacaaaggaggaaagataaggaaaagtcttcttcatcgaacaagctgaagccccagaagaaaacactcaagaaatcttcgaagaaaaaggcttaggttaattacattcttcggacctgctgtaggaggtgagcatagttttcgagactcaaggagaattggcaaattttgctgtctgtttgtccaatttgaacacatcggagaaatcttgttattgcaattgttggttatgatgtaagaacctgaatgctattataacatggttgtcatgaatatgcaatacatatgcattataatttcaaaagttctggagttcgttttggtaacttgttatcaatctaaagcaaggaacagttttctgatcttatttagttcttggattttggtaccgtgtaactgtgtatgtagtacctagcagatattttttatcctcacaattacctgagttgaaattgatatgcctataattttctagtaaggtattgaatttgcgaaattctattgtgttgttaccaagctactgtgtcgtccctctgaattaatctcaggaccaccacgcataaaacatgttagatttgacctccattgtaaaggtgaacatttgtctgtgtgtgcaaaatatggtgtggtcacgacactggggagtagccagtaggggagtagatcagtagattagggatggtggtggtaccagttcgaattaggctcatacaattgaacgacaattcgctgacatactaccaacctcagatttggtatacaggaagcatgttgttgagattctgtgttaatttgcactagtggtagaccagcatgtctgtgtgtatgtatagttgattgcttattccttggaacagcatatgatttgggcgctgtttctgcctccccttgggcagtgttgcctggtccttgccattcattgtagcctctcccatggtatcttttcggttgtagggttggggcgtttgccagtagagttcgccgctatcgcccccgtgatttcctcccaggatgccaccaaaaacagtttgctttctgctgccactcatctatgattctattccagtagccaagttatcttgttagcttgtggagatatccttttgttttcgagagaagagaacatctcaaacttgaaatctgcatgcaactattaaggagatcggcctggggatcactggttttggagtgtggaggagtgcaagggcccctgttttttttttctttttctttttctgatgatcgatgcatgccatgctgctatagctgggccaagagctgcactgtttcggctaggctgttgtggtttggttgaggccgcatcaaacagtggcgtcttatatattggtgcgcccacacatgcaaacaaatttcttgagcccggcttcgtggtgcgccatccaaatcgtagtgtctccattttggcgtctttcacatgcacaccctatcatcctttcctttccatgctcaaccaagtcatgggtaaataatatatacggccttcagttaaaatttgccaaagttgttttcttttcttttagaaaaaacacaatacatacgtagatgctcgtataaacacatgtagctatgaacatacacgcacacactatctctataagcacatctctgaagttgatttgagcgagctagttaggttattgctttgtttttcgcacaacactcaaatttgtcgaagttgataggcgtggggattttgaaatgttgttacttccttagactacccgcggccatttttggcgcgagtggcaggtagtctgcagagttcactgaaagagtgaagcagtacatactactagctgccatggcatttcaaaatgaacttctgctgcgtctgagccatgagtcctgcgttcctgaaccccagggtgcatgagggagtagtgaatggatgaggcagtactacttaacagtagtatacccgcatcttacaatagagcgcgtttcgcgagaatagcatatttttggtatgtacgtatgtcccgtttaaatttcacgagaaaagtatgttcaattccaatgtggaaattaacatgaacattttctcacgatctaaattagaggcttaattagccctcctttgaaatagaggggtttcaaaagttcgtaaaattactgttctctaaaggagcccttgtaagatctaagatgaatttgggcatcatttaagaacactatatcacgaaaatcttttttttgacagtgcaatgtctagcgcaagttgttgataacatgatggatagattatattaagacgatgcaggagagaaaacgacgggtaacaactagtgcacgcagaatggagtacgtagtacacattgacatttgacaggtgaggacgaaatctcgatctctcgcggcaaagcagcaatatacagcaatgcatctcactccaacccaatcaaacacacacaccagtcaacactgctacagcatcaatcataccatggccatggcatacattatgcatgcttccaagatcaatcaatcaaacgtagtctctcgcttaattgctctacctagctagctaatacagtagtaattattgtgctcatggatgagctatagccttagcttagttaatctggctgcctttctggagaggcagctggaaggcggaggaggaggcggtggcggaggaaggagaagacgcgagcgccacgaccaagtcgacgaatgctccgacgatgaagccatgggtcttcttgccgttggccctcaggtaccagccgagcatctcctccagccacccccagtcatggcccccgccactcatgtggctcatcaccatctcctccatcgaccgccggaagtctccgtacgggtcggccgagtcgatggacatcgccgtcgccccgtcgaacgccgccgcgtcggcgtcgacggcgcgtcccttgacgacgatggagctcgtcgactcgggctcgaagaagaggcggcggttcgacgaccggagcccgcggatgatcacctcgtcgtcgtcgtcgacgacgtcgttgacggcggaggcggcggaggagtaggagcggcaggtggagtggtcgtcgaggaagaaggccgggttcatcacgct

SEQ ID NO: 63900 - DNA, 3031 bp, Oryza sativa
  unsure (1)..(3031): unsure at all n locations
ccgaaccatggctagctaactcctagctagcttacgtgcagctagctgtgtgagagtgatcgatcaatggatgaagcttaagctaggctatgtcggatgtcgctgtaaactgagttggccttttggtcggagcgagctgcgcttagctgtgcttttaaagaggctgctgcggcgtgtgcaagtagctatcaaagatgcgagcgagcgaaagcctgtcttcttcttctcttgcattgcatgttgtttaattaattagcagctacctgcacttaacacgtctaatctaatatgttagctacccatcacacacagcttaattggcagctactgatactaatgctacttaattataactgaaacttgtatgttgtcggtttacgctgcaactggagcataaaaaaaaatgtacgcatgcaggtaaggtaaggtaccaagtacgtaccattttgtcattttgagaacgcagatttgcagtcgtggctgtatgtatgaatggccagcagcaaacagcatatataccacattgatacggatgaattacatgaccgggaggtggaaccgcgcgctaattaattaattatatcatgtgtaatcgcacggccatctgatccatgttttcctgtattttataagaggtagaagttgctagctagcttgatatctattaattatacatgtacagtttagtccactgctcgcattgttctctaccagcaatacacgaagaaagcgcagcgacgtttccctgacacacaattgatcgaaatccaggatcacacgcaggccggtcaggcagcagaaaatgctagtagctctatagtttaattccccttgtgcatgcgtatcagaaatgaatactacatgctgctgcgatggtggccgacttgtcctctatgattgtataaatggattggatcatatatatattgattcatatatagggtggatgcggctgtcaatgcaagaactgtgcagccatgcatgcaggagggaggaggtgggggacatgcaagcggtgtttgctgaatttctttttgcttttcatgtgtacttctccgtgcctgatgcttgagagaattatttgaacttgccaagatcctagcttagcccatctgtcatgtctcgacctacctagctagtctcacccagtcaattaattaattggatgctttagtttcttgatctccctaagcaaaatggtttgcacaaataaactagctgatgaactcaactgatgtttgtaattagataatggtgatcaactcaactgatatatatagtgatatgatatcatctttactagtgcctgcaggccatgcactgttttagcctttagacttgagttcagaggtaatgacggatgaatagagtcgtctgaaacctatgtcttctcatgaagtttaatgaacagaaatggcagtacataaaggcaaagacatgatatcagaaatactaaatgcgtttctctgatgttcccgtcctgattttgtatctatggtcgcgacctcttgtcgtaaacttccttttgtgtactgccaacttgccattgtgcagtgttttactactcttttctgcatgtattttttttattcaaaggattagaccccaaaattaatttaagattatttatgcaagcttgcctaaccacgagaccgaatttattatagttccacctctctatatttctttctcttctacatctgcgattctcatagtactatatctcattgatcatcgatgtctgcatattcagatatggcatgaaagagaaaacaagcaaagcgaaggcatcattctaactgaaccaagaaacttgtgatacattaatggtactctctagtagtatctactaagtaggtggctgttatgaactagtatgaagtattcctaaagaaatgagatcttctaggatcacgtttggtatacgagattctagtatttccaaacatttctgtgaacaatttaaacatggcttcatgtatatgtaccagccagtcagttacaagttgcagcatatacaacattcagagagacagagaaattgctgttgattgcttcatgccgtagacaagcaacaagatcttatctaggatctcgttctaacaccaaagaaaaaaaaagctggcataaattgatgtctgaatggcataaatttgcttagcaaaacatgcagttagtgacaaaagagaaatcatggcgtttcaccgctgaatgcgacgtgtcgactgatgtaccaccaggaactccatgcatgctcctctctgctttcagttttagcattatgttaagttgagcaacaactatcaaggcatgcagctgcttcccaaagacacagaaacgactgtttattgcagcaaaaattactgaggtgttgtgctgcgattagctgaagctactggcttttgttgctgagtagcattgtgtgtgttggttcgtagtaccagtgagtcagtgttaaagctggttgatgccattgcctacttgcacactgtagtacgctgcagagaagatgcctgtggctgaaagcctgcatatgcatgcagtatggactgtttgcaaatagtattactggcagttagattacccaaaaacacatcaccagatgctttgcagcagctttccatcgcggaatcaacaccagctgcaatggacaggataagtgtcttgtcatcgcctcaaacacatgcttcacgttgatgggttcttgtttctccacctcacactttcaggctaactgcaattcaagctcatttacagagaatcgagaagcaaaggaagttttgttccttccttttgaaactccaatacaaacgagatgaccttgattcagaactaggaagttgatagaaatgtacagcagtttttaaaaatgtgcttgacaggtttgcagtaaattttggaggcagggtaatacaggagaacaacgtgtactgttgcaagggccatnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63901 - DNA, 7661 bp, Oryza sativa
tatgcatcaaccatactgaagtataaatcatcatgccaactaaaattgatctcaatcagaaaatccacaagcagagcaagcaagaaagcacttacggagctgatgaagtcgacgagagcggcgttggcctccccgtccctcgccggcgcgtcgatctggacgccgacggcctcgtcgccgatctctgcagaatcgaaggatgcgcgtatgaagtaagtaaagggcgaaagttggtgttcagggaggaggggaaagagggggacggaccggtgatggtggcgagcttggagcctggcttggcttggatggagatggcgacggtggagggcggcatcaggcggaggcaggccgggaagcctccggcggcggcggcgttgggggcggcgggcggcggtggggcccctttggccttgcctcgttgcttccccggagccatgtctgacggtgactgacgacaatctggtcgagccgtggagacgtagagagcaaaaaccaaccgatatggcccagtttgggcctggtcgctggaactgggctcggcagatgatactttgcaatcaaggcccagcccatcatcaccttggcaggatgatccatcaagctaggagctacagccagcgttgccggcagtaaacaatccaagaaaaaaacacggggagttctgcacatcttgaacaacaacttggcactgaatcctttagatgagtgtttttttagaaaaaaaaataccactaataattttatggtagaaagactttcgtgataactgatactacgcgttttcccaagaacaggccaaaagaaaaggtgtagcagtagcatcttcaggattgccgaaaacttggcaataggaacaagttgttagagaaaaaaaaactatccgacctgccggattcgaaccagcgacctaaggatttatctgcaaacactacagtcctccgctctaccaactgagctaaggtcggtttctgaaaattttgttgaaccatatgatacttttacacgtcttccgcgtcaaagagctactcactctctaaattggggattgtgtacatgacattctatgctacctctcacggtcgctccaattcagaattcggtaatgcaagtagaattgaattgagagaaagatggtgatggtcaccagtagtccctgcaagaacaggcgccattctgaaacctgtggaacctgttggcgtccctcaccaccaccaccctcctcaccaccgccgacaaccctttcaagaactcgtggcagtcgccgcatacccgcaggttcttgtacaccctcaccacctcgccgccgccgccgccgccatcgtctccggtgccgtcgcgcagcagccacagccccacggcgagcctctcgctgtgttccctcaggctctccacccgcgactcctcgtccacgtcgtgcagcgcgcaccgcgcgtcgccgctgtaccccagccgctcccgcatcctcgcctccacctcccgcagggcgcgccggatgtcgccggcctgcgggtgcgcgtcgtcgccgccgccgtagaagaagtgcacctccttgtccacctccgtccagctgcacccgccctgcttcctcagccccttgcgccgcatggcgccccttatcccctggcactcgcgccactcgccggcctccgccaggatgttcgacagcatcacgtagttcaccgggttgtcgccgtcgacggccaggaggacgtcgcccacctcccgccccaccgcgacgtccttgtgcaccctgcacgcgctcagcagcgtctgccacacgcccactgttggctccattggcatgctgaggatgagctccttcgcctcccggagctcgccggcgcggccgaggaggtccaccatgcacgcgtagtgctcggctttcggtctcatccgccggtcttgacagattctcgagaagtaccggcggcattcgtcgacgaggccggagtggctgcacgccgacagcaacgccaggtaggccacctcgtcggcctccacgccttcctcttgcatctcctcaaacaagtcgatggcctcacggccatgcccatgcttcccgacgccattgatcatcgccgtccacgacaccacattcctcgccggcatctcccggaaccgccgtccagcctcgccggtgaggccgcacttgaggtacatgtcaaccagagagttggccaccgacacgtccagcccggccggggtcttcgccgtgtagcagtgcacttgcttcccctgctccacgagagcaaagtccgcgaacacggcgaccacgctggacagaacatggccgtcggcacggacgccggagctccagaaccgccggaacaggcacatcgcttccttcacctgcccctcctgcgcgtggccgacgatcaccgtcgtccactggatggcgttcctccgctccaacccgtcgaacacctgcatcgccaccggcaggcggtggcacttgacgtacacgtcgaggagcgctccggcgaggatagcgttggacgctggggagacccctctgactgccatggccgcgtggacctgcgccccctcgcgagccgcgccgaggccgctgcacgccttgagaaggctggcgaaggtgaactcgtcgggctgctcgtcgtgccgccgctgcatctcccggaagacgagcagcgagtccctgccttggccggcgtgcgcgtagccggagatcatggagttccaggtggcgaggttcctggagggaattacgtcgaacacccggcgtgcgtcgccggtccaccggcccttggagtacatgacgaccagcgagttggcgacgacgtcgtgcccctcgaaccccgtcctgacgcagacgccatggatctgaacaccggctctcgtgccgccgccgcacgccttcaaggtcgccgacagcgtgaactcattcggcgaggtccctgaaccccgcatttccccgaacaggcggaggcactctctggcctccccgtggtgcaggaagcccaccatgagcgccgtccaggacaccacgttcctctcgggcattccgtcgaacacctcgccggccatgtgaagcttcccgcacttggcgtacatgtcgatcaggttgttgttgagcatggtgtccgacccgaagccgagcttcatcagcgcggcgtggagctggacgccgccgcggagggacgagcctctcgcgctcgccctgagcagatcggcgatcatcctccgccgctccatcggaaggaaccccagtagatcaatcgctctcagctacgcgacatcaacacggcgcccgaatctgaaggtccaggaatggcactgctcctgatcattgctgctagcaaggagatggattgcaaatgcggaaaatacctttaaggcaacagaacagtgagaaacgccgagggatcttccagctagctccacaaggtggtgagctagacaatttgggttcgaagcctcaccccttatagttatttaatattaggtcattccctaatattcgtgtctttttggcaacagaacagtggattgggggggaagtcttgaaatgtttggataggagaccgggtttcaacacagacaaacagtggatatgaaaatgcattttggttgctgtgtacagaactcccaacttatattcacatttttcgtgtaaaaagtctacaggctacagagaagactacaggaaaacaaggttttgaacacaaagaggtacctgcatatgtccaagtacaacaaacaaacaattcaactaatcctgaacttcagatgatattgctaagcttgcataggctcttcagtaaggcgtctatggtctgaggaagctgtggctgaagaactcttggaaggacaaccttttcactggaagcaattatggaaatttgttagcttcgcactctccatattttcagtgagaggttgtaacaagatcaaaggcgcacctggattgctacacagaagtctggtgcatatatcaatagaatcaggacgtagcttggaaataacgacttctgagaatggaagagacacggttcggtttatgcattgaagcagctgcagagacaaatctgtgatgagaacttattgaagtttagataagataaacaaggttgaagagagaactagtagccacctggacattgcttctaccacggaatggtggatagccattcaagagctcgaagagaatcgcggcgatactccacaaatctacctgcacacaacatacatatgttcagatttctcccgtttgtgtgtgtggcaaagagagttagccatgtgagtacatacaacataccccaccatcatacttctgaaacagcataacttctggggccatgtacaaacaagtgccacaatttgtatctgtgtattccccgggacgaagaactctagagaccagaagtaaaatttggattagattgtcttatgagtagcacgatgccttttgcaactaatacagctttttaaagactgagtaacctcaacctacaggttatgtatgttgagcagtgtaccttgacaggccaaaatcagatatcttgaggatcgcattgctgtcaggagaagagagcaggatattctgcggcatacaacagttttatcagtcaacaatggtgtctcaaatcagttagagcttaataacacaagtaattaagagatgaaaagagagagatttgtggacctcgggttttaagtccctatggacgatatggtgtctgcggagcacttgcaagccagctcctaccacaaggtgttgggcaagcataatttcttacacatgattatcttcttgttgtaattgtaacacaactctactgtaaactgtgacatttctcttaatggaaatggaggactaaggccctttgatccaaaaaaaaaaatttgtaacacaactaactaaggttgcgggtaatgtgatagattggggggcaacaagagaaaagagatgctactagggctagaaatgaaattgatatggcaaatattactaggtgaattaccgatctgtctcatgaaattgctggcgacgcgctcctctaccctcccgttgcgctggatgtaggccgccaggtctcctccctcgcacagctccaggacaaggtacaggttgctctgggtctaattaaggagaaaaattcactaggattggtagagaaggaagaagaagaagacgatggagaagacaaaaggagacctggatgaggtcgaggaggcggatgatgttggggtgggtgacggcggcgaggaagcggacctcgcagtcgaggctgtcgcggagggtgctggggaggccagtcagccgcacctgcttcaccaccacgggggatccgctcgaccgctccacggcgcgccacaccaccgtggacggcggccggccgcccagccgctcccgcagctcgtagcctcccaccgtcgtctccggctccggcgtgctcgccatcgcgaaaccactggaaaggaaatggatggattggattttttttcctcctcagttttcgatctcatcagattttggcccaagcaactaactgggccaggcccagcccaaactgctattttctttctttacccgtgtcaaaacatactactccctccgtttcacaatgtaagtcattttagcatttctcacatttatattattgttaatgaatctagatctagattcattaacaacaatataaatgtgaaaaatgctagaatgacttatattatgaaacagaggaactagtttttaatatgtttgaattgcttccagttaggtgccaaatctaactagagtataaacaagggtttgggatgctaccaaattaagcttgggcatagccaacaatttggctccaatcctatagacaagcatcaaaatggaattcagcaaaagagatatggttcttcatctgaagttctgaagtctcaactaagttattgccggatgtacatgagccaaaattgcacaggctggaaacacaaaaactagagctgtattaaaatatcccagtggctgccgccttgttcagcgttcttctaaatttagtacacatattatatgacaaaacagaaaactcataccaatcaggtgtgagtaaaaaaatattatacatgcaagcatccgacatatatacaaaatcatttctatgctgccgtgctagcaacaaacagtagcctggtagttttgaagaaaacctctaagctgttttcacaaaggtcacaaggagcccatgtattctctatcgcgccgatttcttttgtatctttgctttgggatgtcgacttcctgtcttggaaacctacaacagatatgcagcttttcagcagtctcaagcatgaacctagatacttcaaattcattatttttttccgatcgtcgtttcattaaacctaaagtgtacaaagttcagaaatttaccaggacatgccgtaagatatcttccaattctacagtaatctctgagaaaaggggccgcacatgaggattttcatcccaacatcgttcaatcagtttggacaacctcggatgcaccttcggtgggatctccatgcgcattccctaaaataattaaataagggtcaatgtttacagtcatcccttcatccttgagcatccattatttgttaatattatttactttttttaacatccaatgtgttatgttggagcttattggcatcaaatacatacctgccttactcccagtgcagcttgcaagggtgtcagattttcgtatggtatctacatagcacatgtattagtggttattacatctgaccatagttcactgctgttaaaaaaattgagaactatgaaaacgtcacacaatgccttgccagccacaggttacctttgtagtgaccaactcccatagaacaatagcaaagctgaagacatctgccttatggtcataaggcttatggtttattacctggtaacacacgcgattctaataagtacattgcacatgcatattgtcttagctttgcataactcttctaagtatggcttttgcacactgatccaaaaaatcagtgcagtaagtaaatgcaagcgtgatcaatatgtaagccaacatgcttgcaaggacagcatagtcaggtagtctgtgtatgcatacatgtgaaaacagtaaaatagtgcatcatgcatctgtatatgtgcctaagcctggtgaaatgggcttgtgaaactgaacttatcattagcaaacagaaaagactttctgttgcagtacaaaagtcttatcgagtaatcagaaaggaaaataaagggaaaaaagggacaccagaggataaggaacaaaaggatcaacatagtacctcaggtgccatccatctatacgtgccagtttcagcagtcatttctcccccttgagatcggagccgagagacaccaaagtctgcgatcttcacgacctattaagaattgaatcagtgcttcgacatccttcaattgataagcaacttcgaaacaatatgcatacttgaccagagccaattagcaaattggcagtcttcaagtccctatggatgatattattctggtgcaaataatccattccttttgagataccaatagcaatcctaagaacaacaggaagctccaaagtattgttttgcttatgaaggaagtcatacaaattacctccgggcatgtactctggatgagacacacaaataacaaagcaaaa

SEQ ID NO: 63902 - DNA, 1837 bp, Oryza sativa
catttatggggtagattagatattttagaaaataaagtcaataaattgtttagaacaatggtttaagcaatggagtagaaggattttttttttcgccaagataacatacttttagagacgtggagcaaataagctgatgaacgaagtagctaaaaagaatgaaagagccaggatagatttgatactggtggttcattgacaatttcttgaataaactgtttagtatacggccttactgtgcttgggatggcaatttgcttggtgtatatgatgaaatcaaatcaaaggtccaaacagtaaggcagcaatatgaatgaaggttgtaacatgacaaaatgcctgaacaatcattctgccaaatttttgctgcaccagaccttcagaaatcagaactggtgcttccctttgccctttctctgggactgacattatcattcagctaatgataaatatacatagtaggcaaaacaaggatgacgcataagcactttcccttttcctttaaccaaagaagcaaagcaaagtaaagatgacataatagtaactgaaacctcaactgttagagttgtggaccgaggaatgtatagttagaaccccaaaagagaaaaatgttaatgacagagacatgcaaaaaccatatgtctgacaggccaatacatacatacatacatgctgctagctagttacttactatcatatgacagactctgatcatgaccacgttctccacaagtggctaggttaccttgagtctctgccatcatggcttgctgatcagctcatccccatcaccattctccggtccaatggcgttgtgccgctccgacgggccggacggcgggatcagcttggcccgcggcaggtagccgaagagcctccccgacctcatcatcgccgtcggcgccgtggaaggcgtcctgttgatgtagctcgcctgcatggttcttgcaccgtcgacgcagcttgcgacgaatgtggcggcgaggaggaagaggagcgcgatggctatgcatctgcgcagctgagccattgattgatgatagtatctttttgatagtttgggactgcacagtttgaaaggctgatgcagatgaggttgcaagagctggtttgggaaggaatggaaggggaagtgcagagtatgcgtgagcaagatgacaatggtgccatatatatgctgcaagtctacagagagaggaggcgaaggtgagggtgaagtcgccatactcgtacggcggctagcttgatgggacgagagagatgtgtggtctggaacgtgaggtaaaaattcagaagaatgagaaagtagtaccaagcatgcgtgtgcaagaatctggataatctgatcctggagaggataaaaagggtgctagcttatcgcaaggagtagactaattaattagagtaattaagtatggcgtgaatgaagtaagcactgcacgcggaatcctaacagaatgttgaacagttgaaaagtggggaattcattggtgagcagctagtcctaaacaggatatgtactccatgtactgctgtgttgtgctgttcgatcagcctgcacaccttttgggccctgcgtttcaacctgcaggtacaccattcggattaactgtgtacagcattcgcttgctttgtatcggtacaccggttaaaattacacagtggaatcaagaatgaaatatcggtagtactataaacaagcattcaagcattcgtcatgatcaatcttgagaagaagaaaaacgttgccgaattgttcctgtcgaaatgaaatcattagctccagagggacctcttcggtaggagtaggacaaacccttcttgaccggattcaccg

SEQ ID NO: 63903 - DNA, 5415 bp, Oryza sativa
tgggccacaggaaaaacataggaatttatggagagataaagactcaaagtattctttccatgaggttctaactcatgttaaatttcctccaaaatttacatgagaagagatattccataggaatttcataggatttcatatgatccattcctttgattcaaaggggtatacagaaaaaaattcatatatgaataaaatcctttaaaatttctataaatttactttgaatcaaagtggccctcagcgagggcaagtgtgtcgtactacaatcgatgctgcccgcaatcggaaaaagaaatattactcgtgctgttttggttgccaaagagtatttgcagtagcagtagaactgacaactgataggtcatgaaatgcaatgcaggtaccttcaattatttttatgtgtttgatttgtagtaccatcgtggtggcgagtgttgtgtgccaggcagcttggagtgatttggtgagtgaaaaactgtctttaattggtgagaattcagcagggacgggatagtatatggccacaatctttatttccttttgagacgacgtgacctgccgctgcaatgcaagcctccaagtgaataatactatcagccagtactgtgcaagtgcgtgtcatgagtcgggtaggtagtgtggatttctggagtaattgtcagatcagttccaatcgatcgatgggacttcctccctttaaatttccagtctgcctctacctcaccatgggtagaggcactactaggcaggagtagtacgagctttgtgctgattggagtgaaatctttgtgcttggctgcgtataggtcgatcggtctgggggccaggtgtgaggcgatgtttcacgaggatggagtgccaacggcgatggatgacaaggaagaaaaaggccaatcgattgactgttgctcaatgtttccgtgccgtgccgacggttcagttcattttggctgctgggctggcagtcaggggactggactggcagaataggcaggcttgccctggaatgttgggatggaacctgcactgcacctttgggttcatttcttggggagaggacgacttgcttgctgctgtgctatgcatctcctcgaaacctcgatcggctgtcgtcgtcgttgccagcaaacaagatcagtgcggtggccggcggccagtggacattctgcaccggtgtggacagagaacgacgactgagcaagcatttcatttcatttcagagaaaggagccttgccattaggctgcctgcttggctgactgatgcacagcaatagtcaagctcagttttctctgctagtgaaacaagctactagcaggtgcgttccttccatcaccagccatcgaatagaatcgaattttcggtgaagtccagcactgcagataaccaatctttatgaatcaatctagttctactactagtatatagctgcaggatctatccaattaaggaatcgagcttgcgtcgtcatccttacctgatccataatctactttacgggagcatatatataggcctttctgttttggatgatgaaaattgacatcgcatcgcatgcatacttgtatagctgctctcatcagtctgagatggagccgcgtcaccctttcgccgacctctcttgctaaaaggcaaattccaaccttatcagattacatttccacgacgccaaacttcacttgcaattaacaccaaatgcatctacacatttattgtggtgccattgcttaattgaattcctcccttctttgtgatattcacgtccacaaacggaatccttgggcagtgcattagtaccaactagaaccgacatttcggcgcttcagagttcagacaaaagcagcatttcatgataatctttcagttcctcatactcatttcagacgtatggtagcacacatttgagatcaagaaacccatcgtccacttccaagagcattccgtttcattcatgtaaatgaaggagcttttgctcaagactcgtccactaactcccacgaatatacatacagacatacacagcctcgtatcatggtcaacagagcaacctcactgcactgtattaccctattcatacgacacatcatcaattctgattccttctatacaacaatagtacaggagaagatagtcaggaagagagcatcatcaaatacatttaggcgagggaaaaaaagatctcttctgagatctgaatcagtttgagaatttagcttctagctggtattatcacactacgctgtcatcactgaagaaatccgatcagttccccgcacgttgtatttgtcgtacactttttcacggttgtcattccaccatgattccgcctgatgctctccaaatcttctccggctgtaaacaattcgacctccatgtcaggctactcttattcagggcacgcatttcacaagttagagcttagagaaaacaaaataaaatatgttctttaggagtagcgaatcttggttacctgaaccgcactcttttcagctccttggttccatcacgaagagaaactagtgttaagtatacccctggttcgtattgttctatccattcagcttcgacttggttgctgggtgagctagaacctctcatgttgaaaccatggaggtttatttggaacctttctgtttcccgccgatcatgatcttctgttcttgggcgataccccgtcatcccaccattggtcatctgctgcgcaactgggaactccttagtgttgccattgttttcatgcctgctgtcatgtggaaccatcgtgttaccattgggttcacttatttgatgggcttgagcaaggaacccattaaaccgggccgatgcaacagaagtaggtgtttgtgggtactggaagctgcctggctcatatctcttttggttttctctccctgtatcaggagaaactgcaccaccaggtagataaggctgccgtgtttgcttcgtgtcacatgatgctggaggaagcctttcagccatttcttttagctgcaaaaatggggagtgtttttaatttctatattatccagttggggatataacaagtccagaacatgcaactatctatatgtgatttatataattatctatatgcaattatctacaagcacagttgtcactgttccactgaagaaagcacagctaggcagtagcagtagaaaaagaacaaatcaggtttaccttggtttattcacccctagtatctatgactactagcaaggtgcaactaggatcaacaatgagatgagcagaaacatccatatcaactgaatatgcaatcattttataggggctgaatgcacctccaagcacgtgtgggtgcatggagcaaaaggcacatataagagacaaggttgctgttgataagaactgaaattagtgccattttaactgtccatgtcacaaattaagcttaccaacgttttgtttcaatgaatgagcaatgcaaaaataaaagtaaaaataaggtaagtgaagaaactggcagataatatgcagctagagccaatttaacattaagacgtgcaataataaattcggaaaatcacctgtgctgttagtgatttaataacatcctttgcagccttcgatttggatgcttcttcagaggccagggtcatggcctcatgagcttttgcctctgatttctgcaaatctgcatcttgctgttcacgttgctgcctcaagctgttaacctgcataatagataagcataaggacgcattccccggatattttagttattaccacaaaaaattagaatatagaatacctcttcttttagtttttgaacctcttgcttcagaagttcatttgcatctctaagaatatcaaagctttctgaggacaaggaactagaagaattcagatttggcagcctcaacaaaggtgaactatatgtggagtcattaggttgctggtcagcagccccaatgaaagggatgtccttcagctgcaaaatcgcagggaactgtggtggatagtcatacttctttgtctgctttgctgccttcacatccaagttcttgatcatatctgagctattagcggatgcaactctgtttccctttgagtccattttatcagccttggaatcacctggtatgcgaggcgtattgttcttgttatgaccgattccagaatccaaaactttacttagtttcaggtaacatgaatcacatacgcgatatggctttccaggattaggggacaatgctgctcttagagccttttttgaactgcaggaatggcagtgtactaatccacagttataacagttgtgcctctttcgggtgaacccaaatggctgtctgcatgatgagcactgagactgctccatcccagacaccgatttatgttgacaaattgcagctgtgaagcctgatccacaagcgatgcgttttacagacctatcccttaaagcctcaacaaatgtaggtgtcttacgatctgcaatatcaccatgacccaatcttccatttgcacccttaccccatgtgtagacttcaccgctctgtgtcaataccgcaacatgataagctccacacgcaacttccacaacaccaccaccaccaagcttctcttcaactaggcgtggataccttccatcattattgggattgccaagctgtccatacacagagctcccagcagtaaatatatggcctgaagtatcaatccaattgttagagtatgaccacacacagccttatggaaattgtaatctattaatgaaggcacacaggttggtttcagttttgaagacctgtcaccatgcccaaggcgatatttatctccatcaccccatgtaaatagctttccagatgaagtatttgactgtgccatgataacctcaacaacagcagcagtatgccacaccccacatgaaacagaaattgtcctcaaacccttcaatgactccacttctttcgggtatgaaatagtttctctatttccatgacctaagactccaaatgtgccatcaccaaacgtgtacaattttccagaactggttatcaaagcagtatgccatgtgccacaagaaacagctgacacctgaaggccctccaaaggacctgaaactctttttggaatccagtggctcacgttacttccatgaccaaggagtccagcgttgtgggtaccatctccccaggtgtaaaggtcaccagttgcagtgatagcacaagtatggaattcaccacaggcaattgtttcgacattgcagatagacaatgactcaacaagacgtggttgaaaatgcttgtgccggccccatgaccaagacggccactgcattcttctccccatgtaaatacctctgcctgtcgagtaaccagtgcagcgtgcttcacaccacaagccacataactgacatcaagcattacatttgactctaagggcttcggtacaa

SEQ ID NO: 63904 - DNA, 3059 bp, Oryza sativa
aatagatatggagcatgttcttgacagttaataaaccacaggaatgcattattggttatttaacatacaagcagcagtacaagataatatgatgtataaaaaatatgttgaatgaacaagataaagtaaaagaacatgttgaatgaactaggtaaaacaataatataaatatgcatgtaaccctatagcttaggccaaaagtgcaccaaacaaaaagttggtaatcaaacaagaagctcaattggatagaataatcaaaactgtggttctgcttctatgagatgttcctagatgctaggctagttctcagaacatgatggataatgcgtattactactagcaatgcatgtgggaatttcgtcaacaacaataacttgtactagctactagagcataggtggtggataatgacccaagagttgaacacagtgtacagacagaaactttgaactgaggttgctagaaatactgatagcgttctgcccaaagatttttcttttttcttaaaaaaaaaagctgtaatgatgatgtgaaatcatgactcaaacaatgatatattcacaaagtggtctgtgttgaagagagtttacctcaaaagacagggcaccgttgcgtattccatcaatgtgttggtgttgggatccatgctgtccaggagatatcaatacattaaggcctgcaaaccatacttctgcctcaactttatccttgcagatctttgaaacaagattagggctcattagatgaaattcattcagaaatgaaagagaagaaataaagttcaattgatccttgttgtaataccagatcaagagaccgcttgccatcattatatatgagtgagaaggataaatggtccttctcagggagcagaaaacgttgaaaaaccaactgaaaagaaacaggttgaagatcaaatgcatgaaacaaattgccatatagttaaaaagtaagtccttactgttctttgtcccgagagaactctagacacagatgatagcttcaaacttttctctttgttatttgagacccaaattagtgttgattcatcctgtggagcatgaaaaagaaagttgcgtaagtacatataataactacaaatggaagttgcattgctctcagtttcatattaatatgtcataaattttctagctgtcaataatttaagtggtttctgctccaatggttgtactcttgggtaagtagcaccataaacaacataatatggacctagatattttttttaaaaaaaaagaaatcccatccacatttcaggctggaactgtggaattcaaaaccgtactttgagatcacctttatcaaaaaaggttgcacaagacagtaaacttacatttgatagtctgaagggagtaaattttggcttccccttgcgaccatatttaagcagttgggtgcctttctttaaagcaataagtgcctgccagatgcattaggacgaacagaattatgaagcagagtaactggtgcagaacattggtaaaacattagcaaaaaacttcaataacagatcactagagtttagaacattttcttggaaatgtaattgacaattaaaacttcgatagcatcaatgctaatgggaaaattccaagtgtcttcttgtctattccctcaaaacaaaagtaactaatggaagtgtctgcctgtccctttgttttctccattgcattttgacattgttaaaattttgattttgatattttggttagctccaagaacccagttatccagattccaaaacaagagtaggatctatctgaaggaaagcagacatcgcagtcatatacatataatcaagattactcaaaatctttttcctgatcgtcaagatttctaggacacaatcacacaacctgcccagatagtgatgctttaaatgatgagatttgtgagatagtgctaactcctaacaaaaaaaaagaagaagacaaaactgagttcatcactagttgtatgtctctcacacaaatggcacacattatttatcttaagcactgaaccaagtaggtaaacaagaccctgaaattcaacttcatgattctttttagcaagaaggcagggattctgtcgttttcattatccagagagagtaacgattttttttttaaaaaaaaggagtaataagagtaaaatcaaaacatcagagaccccataagaataggatcccataaaaaagaaaggaatggcaactagaaacgataagcatcaattcaacttgatatatagaaactaatctaatgcaccagcttctcctcctttctatatctgtgcatagcacaagataattcgagcagggggaacaaggcctgaaactctttcggtaaacaaaaaaaaaagcctcaaactcgataagccacagcattctccagtgaaagtaacaatcctccatccgactaataattgaattcagcacagctcaatcggcggtttgcaattgcacatcgaaaatttcgaagtatgtggagtggaacttgacaaacctttcttttgttcgttcccaatttccccttccatttatgtttttttttaaaaaaataaaagaacagatttttttcccctcccaaaattgggcattgcagtaagcataaccctggaaggatctccaaatgcaaataggcaggccaacatttgagagagcaggggcagcattggctacattcatgcaacccacgttgtgattgttggcattgaattaaaagtcaaaagtgcgtgttcctcaataatccgcggtgaatctacaacaacaccagcaagaaggctacaacgacagagattgtcggagcgaaggaaaggctagagctttggttgcagcaatcaatgatagttgccggcatttagcagcacgcaaggtataagatgggggagaaagaaaggtggtaaaaggcgcgaagagatggaggcagcggcgggtgcagggagggagggagagggagagggagagtaccttgtcgatatcgacgggatctgccattccatcggcggcctccggtcatcatggagctggtcgtcgggcgctcatgaatgccttcaaggctggc

SEQ ID NO: 63905 - DNA, 1676 bp, Oryza sativa
ccaccttagagcaggtacaatagcaggctaaaagccagctgcaaacatattttaaggagataaatgaggagagagaagggcagcgggttacatatttgtagccagctgtagcacggactccaagacgcagcgtgtgtatggcatgtgggaccatgtattaatagtgtagtatgtaactattatataaatgagctattaggttaactatagatgaattggagctagtagttggctatatactagtattaaacttgctcttaatgtgaactaaacacatccttggtggcaatggcatcctcgactcgactcgactcgactggacgtgctgtatgcacatgtagtagtagtactgtactagtagtcataaaataaaatgcaccatcgatcacatcagattactcccgtctcccgaccaacgtacgcagatgcatggtgcagatccagaagagatgggcggtggaagaccgtgtctgttttgtggcaatggcaatgtcccaggggagggagctgctgttgcatgtaaactctgttcgatcagattcagagggtatcagctgcctcgtgttcagttgagcgttgactctgataacccaggtcaccacgtctctgcctgacaccaactcatcgccacatctgtttttctctgcaaatactgtactactccctcctttttttaattaatcatcgtaaaatagaatttaaaatttttcaaattaatcatcatataaccatatgaacatagttttcatcgtaatacaattaatacagcatgagagaatacatgtgtgcatactaaggtgcaattggcatattgttttaatcaatacatgtattatggtagaatgtgtgcatgatatcttaattgatgtgatttaaattatctttagtcttggtgcataaacataaagttttatatatgatgatcaatttgtaaagaagagagtactactattcctacgtagtgagaaggctagtagacagcaaaaatacattgattgacgtggaagggagtgatatatcatatgttaatatattttcttattttttcgtaaccatttgagtggtatgcaaataacgagggaatatcccctcgagaatcaaaatagtttcccgacgtagagccccgttctttctagctgtttaattgagtgagctagttaccattttcccgtgagcatatttctcaaattactaaatagtatgtttcgtgtaaaagaaatttgtatagaaatattttacactatgccaggtctggttataacttctgacgggctcaacgttcatccttgatgtgtttgatcttggtcaaagatgagtggttagtgatgacttcacttatctctaacggatcaatgcccgttagagggcgaccttttgtcggacacaaatgacgccccgtcacatgtgatggcctacctgtgatgagcctcggctgatgtcctcacctattacgacctttatatggactcgccaaaggtaaggccatttgtgataagcatttcggctcgtcaaatgtggaccgatatagtatagtgttaaaatgttcaaacaaatttatttttcaaaattttgtaatatttaatactcgattaatcatacggtaatggcttatctaatttcgcacgctgctaaaaatgtaagccaaccagctagttactatggaactcacccatccg

SEQ ID NO: 63906 - DNA, 1647 bp, Oryza sativa
cctgcagcccacctacgcagtgcgtaatgcgcctgtgtctcacaccactgggacgagagagtttggtggtctcgtcgattgatcgtgtgctttatttaatttttggcaaacaattgccctttacttgtccatatctccggctgtgttcccatccaatgaaccatgcagatcgagaaatgcaatccaacagcgcagcgaccacataaatactgttgccgtttaagagcaaatttaatagtatagtccaatactagctccaatttatctatagctactataccattaatatatagtcccacctgtcatacacacattgtgcctttgagtccgtgctgtagctggttataaatatgtagcacactgcttttctctctcatcttgtatctcattaatagtctcctattgtacatgctcttactgctactaccaagtcgatcggcctggactggtttttaatttgcatgcacgcgacgccttgtacccgtgactctcgacactctcaccacttgaccaatgtaaaattgcaaattccatctccggtataacctgcaacatggattatatatacacgactcgatgcatgcattttaaactttttcatggcactccgttcgatctatagattcgtgttccattacatatatgctattggtatgatgcatatcggttctcacgtataagtacaattggctgattgacacacatagattttactctgaattcggaaacgattgatgaaactcttgcaacttgacgtaaagcaactctcccgtgagtgagcgcaacgcaagaatattcgttccatcatcatgcctccctcatctgctcaccatcgctatcaacaacaggatgcatatatgcatgcacgtacgtttgttgactggatctcatcgatcgtgaatactcgagctaaaatactttacatgtctttattccagattgctttcctccttcagttgatgcaattaattatgtattaatgtactctatatgtacttccccagttccaaaacaagttcatttctcatacattccgtacatatcaatacaaaacctaagaactagaataccctactttatcaaataatgcaaatattccccacattatttactctagatacaattatttttttactttcacaaactccgatgtaataattacttaaaaaataattttgttttacaataactgaaaggagcttaaaatgaactgaacttattataagacggatggagtagtaacttctagcgttaaaatattatcttagattataacaatttattcaacaactttatcatctcaaccggtcacaactattttctatttaattttacatatatttttaatcaatgtgtaaaaattcataaactattattatattttggaatagatgggcactgtacgaaagacagcgcgtattcgtacaagacaaaccacctgaccatccatccaatcatgagacatgtactgcaggcaccatggcccatgcaatgcatgccctatggggcgctatctgcactgtgccccaatctcgaggcacctagtacctgccaaggcaaagcacacgacgagcaagccaagcagcaagcaaacatcaaacatttctctcgctcttgtagcctgatcccctattttacaccaatgtt

SEQ ID NO: 63907 - DNA, 1321 bp, Oryza sativa
cctgtcgcgagtgcatccgtcaatgaaaacgacgatgttgtttgtgtctctatgcttggatgacaacgacgcaaacctaaataaaaacacaaaagaatcgctgtcaccacgcccacacttggattagttccaaccattagaagaaaggaaaatcctcggcaagacttggatagatatccatccaccactccaccagcaccaaggagaggagaggcactgaaaagtgaaaaggagatgctctttctgaaacaaacgattttctttctttctttctttcttttgaaggtaaagttttgaaactttttcattatacgattatgtggggtgctcacctgacctgtgaatttcatcacgtcacggcttgcccgtggcaaagatcaatccaacaaatgaaaaaaaaaagcagagaagctctgatgtatgaacaattgaacactggtatctcagtaagaaggcactcgtaataagtggcacaactcagaatcaaccacggaatcataatagatgtcactcatagaagtaataggtgatcctgaataaaatctctgaatgtatcaaccaacatacagtcatatatgatctgaacagcagtaagtaagccgtacccaaaagaaaggggaaaaaactaagaagaacaagacatggatcgataatatgtgcatgacaagcgctagctacaagggctagaagatatgtaaccacctaaaccacagcgatgtacagcaacatccggcgagctaatccctcatcaacaaatcgaaagaaacaaaagaatccatccgtccatactggaagcagtgctggctaatagtaatccccaaatgcgaagcggaaccaaccatcgaaatcagaaccagactttgcagtcggtgcgctggaatgcgggggcgttgggggcggacgctgggacggtgatggggcagctgatcttggccttgggtccgggaaccttgaaggcccagaccttgaccctgagcttggcgttgagcttgacctcgatgtcgaacttgccggcggtctgctgcgacctgaagttggcggcggtgatgtcgccttggagcggctgctggcccttgaaggcgggggagagcttggtggatgcctcggtggactggtagaaggagtcgaggggggcgtagccgaagcgctggccgtcgaagagggcgagggactcgacgttgtcgtagtagaggccgacgcgcttgttggggttgcggacggtgaggtcgacggtgaggctgtatgcgagggcggagttggtggagagggtgaactgggtgagggcggcggagtctacggtggcggcgatcatgtgggggcg

SEQ ID NO: 63908 - DNA, 1425 bp, Oryza sativa
aactctcgctttatttgttttgtcctataccttaaaaaaaagaaaaaaaaacacgcgccacgcttttgcaggccaatttctttttgctgcagcaaccaccacgaggatattgctaatattttcgcatcccaaactctgcccatgatgatcaagattatatcaaattcttaaggtttttttttgttaatggatgtttagtccttgctgacgccgtaccaggcgaagacaagttgaaaaataaagggcccaatcgagagtgagggacgggaaataatccttttggcacggaaaacggagcaggcttatcggagaatgaactcctccaccagaaaatgagatattggaaggaggccaccgaaaggaaagagcaaacagaatgtgtagcgtggggacacaggctcgtgggaacctgacctcgtttgctaagtggtcgtaggcttcccaaaatggttgggaacccatgatgggaggccctcttcgagctaaaagtttgaaaggtcgcgacatgcaagcaaggtttatgtttgctttattcatataagcgattctttgctataagtgtggggctacgattactagctctatcctagccctgcgtcaagctctgggcgtcgtcgacgtctggggccccctgtgctggctcttccgtagcggttggctttggccccaccggttggctacagcactcagcttggcttgatcgtgggtgaagattattggctatggaaagtttagttctcgcactcgcgcgaagataatcgctcacatagaattattattgcttatatttatctctcgcccatctcttcctcgcggtcccgcggtacccacgtgtcgcgcgctggtttacctcccttggtaccaaaaagtttgtattcgcttcatccattcaaacgattctttgctaaaagtgtgggggctacgattcctagctctctcctagccctgcgtcgagctctggtcgccgtcgacgcccgggccccttgtgctgactcttctgcagcagctagctttggccccgccggctggctacggcgcccagcctagtttgatcgcgggtaaagattgttggctatggaaagttcagtcctcacactcatgtgaaaataatcgtttgggtagatgaagtagaacgcaaacagaggttaacaaaaggcaggggcaagcaaggtacgcggcgtaaggtcacgggcccgagagaatctaacaatgtttgctgagtatatacaggaaataagttcacggcctaaggtacgggctaaactcccgagcccacagcgcctcgaaaatcgggaggaaagtgggaagttaaggcgacgtatgaacgtgactaaactcccaccgcccaactcccagaatgataggacagaagatcgggcccacatgtcaactgactagtagattggcgtcaaccctgaccacctg

SEQ ID NO: 63909 - DNA, 2611 bp, Oryza sativa
aggtcaccatgtacggtgggttaggtgtccgcctacatatgcctacctacccgtatttatggcgacccgagcggtcgcggcacgccacatttaatgcggcgtgcagtgtactcaactggtctgtaactggccgaatgaccgatgggactggctagtgcgcttgtgcgctgctcgtgtgtcaggcggcgtgcagcctgacatgtcccatcaaataatgatggtgagaggttctcatcctcttatcccagccggagtcggccctcccgctctgatcaaagctaggctcccgtttcctggtgtaataggagcccagaagtcttcacccattaaatggtgaatgacttgggcgccccccgtgtcaggcggcatggtttggtaggccccacgaccgaggcgacgtgtatgcagcttcaaagttaaggaacaagacatgcatttaatgcaaagattgtaatacttctcgacgaagttaggttgttgggccaatgtggtaaccccttgaggtataaaaagaggtccaggcctagtgagagagggggggacttccgagcgaaccggcacttgggtctcgcaaccccgagcacttgtgttctacactcaatcaatcaagcacagtagtagggtattacgctacttagcggcccgaacctgtataaaccttttttgtctcatcgtctttgggggatagaaccccctcaagatcacacagcttcgctcaccaagccctcgaatctcacacgctgcccccggccgaactcacaaaggggggcttcacggttccctggtggaggagatcactccccgacatctaacacacgagcagcgcacaggtgcactacccagtcccatcggtgattcgaccggtcacagaccggttgagtacactgcacgccacattaaatgcggcgtggcgcgacctctcgggtcgccataaatacgggtaggtgggcacctgtaggcggacacctaacccaccgtacgtggtgacctagagagggggtcgggctcccccgacccctcgggggagggccatgtggcgcctggggtagccttctccctctagtctcgatcagggagtggccgccaccccacctcgggcctgactccccttgggggagggccacgtggcattggggggcaacctcctccctctaaacatgatacccccgggcccatatcaccgacaaagctattagcgcgtgattaattaagtattagctatttttttaaaaaaataaatcaatatgaattttttgagcaacttttatatataagctttttgaaaaaatacaccgtttaacagtttggaaagcatgcgagtgaaaaaacaagctgacaggagcggttgcccgcaggaacgagcgcacccaaaatcaagggaaaatttgaaccatgccacacaaattttgatatgccaccctgacacacatgtcattgactcatgtgggtcctacatatcatttagatacgggtggtatatcttaaattttaccgaattaaggtggcatgattccaacaaaccccaaaatcaaagaggaagaagcagtataaaccgcagggacacagcctgctgcgctgtacgtgtctgattgcaacggcggggggcgcgcggcattgtttatctggggcgactcgtcaccgtgaaacgttcgcttgtgccgcgcttgcttgccactttcttcgattcactcaagcccacgtcgctcacgtgtcgctttcaatatagatttgtttagcgtttcaacgggaaatttcgtccaaactctaccgggtattgagctgtttagctcaaacaagcaatcgtttcgtagtcaatttatcgcgcaaagacgcgtgacgcgtgaagacttcaccacgaattttccttttcctttgattaataactagtatgtttctctcatataatagcatatatgttttctcattatattattcaaatatattaaaatgacgacataattttaaattttgcaataactttataaaattgctaatgtgtaatattcatattgtattttatatacgtgttagttattaattatttttaatatcaaattttagttatttgtaaattatatatattcctatatggactctagactcgtcttttaatatttcttttttttaattctgaattttcagtaaaatgtatttctatatagactctatactcttcttccaatattatttatttttatttctgaatttttattatttctaattgtatttctatgtggactctaaactcatctttcaatattctttaatttttaatttcgaatttcagttacttctaaattgtattcctatattgactttaaactcttcttcccatgtttttcttaatttcaaattttatttatttgtaaattgtattttttacggactctaaactctacttttaattgtattatgtttattccaaattttagttagttttaaattcctatatgtactttatactctacttctaatattccttattttttaattccgaatttctattttttttttcttaattgtatttctatatggactctatactctacttctaatattccttatttttaattccaaatttctattacttcctaattgtatttctatatgg

SEQ ID NO: 63910 - DNA, 6783 bp, Oryza sativa
cagaaggcccgcggattcccagtaaccccgcgcaagaggccagcagcccaatgcgatccgcgttagcgcgacgggccgtaactgacccagtcaatgtgtgtgattgcatttgcatccactttcctgctcgtcccagtcgctccgtcgggtggcacaactggcaatccaactctgcctgttccttcctccaaaattttcctctttcttttgttcaccagcgctgcgttcaccaaatcaccaatcctatattcagtggccggatgggcagatgtatgcatgcatatgttgatcggcagatgctgtatcgatcacaattcccaaataaacggcattttcaaatatcgtcattcactcaaccatgtgctcaatctcatattctcatcttgtttgggatacattgccgaatatatatatattgactgtgatggagggtcttcccttagaatagcagccaatcacccttgcctttttcactttccccctttcgaagaaacctcaaggaaactagcagctaaagtcactcgcacttgatcaaaagctctttctttgcaggactagactacagtgtgctactagtgcctcactctaccgctcatcctaaccttacccaccggccaccacgtacatacatacctgcttccctgcttataattacctgcttatgatcaaccttttcaaattcgaatacatacatgcatacgtactagcttagcttagctacagtacatatatagcaggtaagcaggcagtacgcccccaaattataagcccttatgggcacgacattcttcatgcatggagccagctctatctctgtctcagcattatatcatcatctcaaccacacagaaaggtacagttcaatatacatagcaggcatggtgtacagttagggcccatggattctttcacaacccacctcccttaaatatttttagcacaaaaaaaaaactactaaatttcaacccaaccatttttggacccaaccctcacattttgttggtcaaaatgttaggtccattaccaccctatgtacagtataagaacctcttggggttctcgagattgtaagaagcagctgatgagtatcaaacttttgaaaatttggaaaaaaatcaggttttttcaacttttggctcttaatttatattattttggattttacaactattgattatgaaactctatgcaaacaaactaactatgtggagaagccatagattatgaaataagttaaagttgctataagttctctaaaacccttcctccatcctaaaatattactatctaagataggatttgacctatcgaaaatttatattaatatattttttaagtttaaaataatcaataatcaatcaatcatatatgctaatggctcgtatcgttttacgtatatgaattttctctttttttccctccacttaaaaacactcttaaagtatgtgtactgtataaccaaacctcaagcctcaaagcaggctatcgatcgaattgattttgatagggccagcaggtattctgcagaatatttttgcaaccatgctctgcaaagggcaagcagctatagctacctacgttggtgcgaggcaatcgagcgaaagggacttgcaactgaaagcgttatctgctactctccattctcctgtaccagtatttactaagattaattaaagatggtgatctaaatctatatagagaacatattttttgaagagcagatggtagtagtgatctgtatacgtgtgtgccaccaactaaaactgtgtaagctactatgagtgccctaacaaaagcacatgtagcgtttggtttaatttggtcgcatccaccaaccatgccaaattggcacgcattttaatcattaacacgcgagatcacaaagtgtatgtatggattataatgctccatcatgcaattaaattttacttgtattagaccatgagttggtcgatcatgacgacactgatctccatagtagaagctttagcacccctcatctagtctccatgaagaactaacagagaccactttacttactacttgtgaaagaatcacaagctagtagtcaatgaagtatactaatactctctccgtttcaaaatatttgacgccgttgactttttagcacatgtttgatcgtttgtcttatttaaaaaaattaagtaattattaattattttcctattatttgattcattgttaaatatattttgatgtaggcatataattttacatatttcacaaaagttttagaataagacgaacggtcaaacatgtgctaaaaatttaatggtgtcaaatattttgaaacggagggagtactagctgttaagtcatcacatgctgtgatgctggggttgacgcgtgcttagagctagcaaagtagctttccataattccgatgataaatatataaaaaggaaatgcatgacatatcgtcaatcactgtgcaagaaaaattggcaaaagatggcgaaacaaataataagagtgagtcgccatcggcatgtgcagtgacgtgcagtggctccccggcacacaacggggaaggccagctagtagcaatctgcccattggtccacactcgtaacaaactctctcatcgatcgatcgctagcttattagattttcgttttcaaaggagcgctttactaaactaaaagctgatcgatgaggtccaagataaaggtcaaatatctcaggcacaagctaacacgaatatagtctcttttcttcaattttttttatagagagaatcgaaaggcaagacgagcaaaacacacaggtgtacatatgaacattttttttaattattgatgtactcacattggaatataattattgccaaatgcaaatcgaattatgcagacacttcacgtctactcccagctgtacgtctattatgcatcttttcagaataccccaattttccctttcactccaagctacactagctccaaaccaactacggtctaaattaagaagctagtactatcatcgatcggtttttcttcattgatatgagatgattgattccggtgagaaaaattaagcaagaagaagaagagaagccgtgaaactaattaaaaagaagaagagaaggaggaggaggaaatgaagaaagaagacacagctagacatcgacggcgcatgcagctgcttgctggaagcggaagtagccatcgccgccgccgtagttgacgccgtagctgcccttgccgtcgttgacggtgaggagggcggggcagttgacgcggaggtggtagtggccggagatccaggtgccgaccttccatcggacccagccgtcgaggcggatgtcgacgaggacgtagccggcggtctcgtcctgggcgagggcgacggcgaggttgggggggaggacgacgtggtcgagcgattggaggaagggggaccagacggactggtcgtagtggccctggtactccacggggagcctcgtcggcaccgtgatggccacgtccttgtactgcgcgtacacgtccaccttgtcgtagtagacgcccacgcggccgttgtcgttgcgcgccgccaccgtcgcctgcatggtggtgaagaggtaggcggacgccggcggcgtcacgttgaggcacagcacggacaggtcctgcaggtagaaccgcggcttgtgcggccgcagcgccagccacaccaccagcacgatgaagagcgtcaggagcaccagcgccaccagcgcccagcacagccgccggtgcaccttctccttctcgcactcgcaccccttgtgccccccacaatccttgatcaccgacatcccctctttgctctccttgatcgatcgaaatggctgggaggaggtcgcggcagcgggtggggagggggtttatatatgagctcagatggtggtgtggctcatgtacagcaatggcaggttgattgattggaaggaggtgatcagcatcggctgacagtgtgagcagagcagggtaggttcagttgttggttgctgctgctcacttttgggtggcttactagactttgcacggtcgcctgctgcttaacttaatttcagctttgtaagcatggtgtatgtctcaaaggggtggattatgatggtggagctggtgatcgatggtggtgagtggtaagctccaaaagaagctatgattgattgaaaggtaatcaagttttgttaaggactcggagaaaacgcctttcgtcgatacaaaaagtgaaaaggaaggattttgattctctcaaaaggaatccatcagcgatggaaattaaagggaaggaagcagctaaaaggaacgttgggcgcagcccgcaggtgagcgagtgcctttgcatcatttggaaggtgtgtgagtgtgacaaggcgcgttaaaccttcttttgcacgccacacccacatacatcaagttataacgggcattaccaatgtcatttagtactagattgaccttgctttccagtaggttagcaggtgcggcactagtgatcagcacaaatgactccgcgtcaaacagagctagtggactcgtattgcatacttacatgtccgatcttctgacgtgcgcatctaagcaccaacaagtccagataatgacgtacaaccgatcgtttcattcatgatgttcgattgcactgaagactctagtttttacgtttgaccacctctgtaacataactacacataatagcgaactgtaccttagctatcagcaggtaattaaccgagcaaggaggattcattattggctgtaagagagtcaccgagcgggtagggtgtccacatcagaggaagagatccaaaggaaagaaaggtaaacaggaagagaagaagccgtcccatagaaagataataaatgggtcccgtactctcacttccttgtccagttgcctagctaactgtaatcttcattcatatcacattctcacttcaaacaaaacaaagaaaaaaaggataacgtgcgactacactcctgtctactgttcaccgtaactcagaaaaatggctaatttacaagcatatggctataagagtttgcgaatattaggtgagatagagaaccagaagcacgcttgcgattctatcatccatgtgccaacaaaaccccagcttaaagaatgtaattaacgagtgtggaaacaaatcagtcaatcacagtacaatgacaatagatcgaaataaacgattgcctagccagacacgtatatcagtgggacacaagcacacagcatggaagcttcttatgctacagccgtccaccatgtttgagcttgtgcggaaatgaagggcagagaagaagggttgttggcaggtagagtccaaaggacagctcacatagggaacccatgttagggacgtctcttaagccaaatgggctcttgttatatgctatgcgcactgtaatcttccaatacataattgtattaagaaaagtatgattagatgcagtgaatttgtggtaccataaaggtcacataggagtatctttcacactaatgcgcgagactttgaaccagccaaccagagtttctgataattgattgtctccactaggacataagatgcaaggaacggtgcgccttccaattactgtacacctgatgcctgccgtataatcactgctaaatgggcagatgtcgactaatagcatcaaatgccaacggcagtacgcgcagatggttacgtggaaatacaaagagctgttgcattaggggctcacctgtgcagctgcgctccaagttggcattcggaaatatgccctcgtggtttccatgcgctttagctatggcagatgatgaataaggcttggagcctgctacctcgttcgctgacttcgcctacaggagtcaaacctgagacgacaatgtcatacagatattaattaggggaaacagtaaagtatgtatttatcttataaattgacgaatgaataacctacatgacagcccgagtaacaaaagtttcatgccaaacgaatcataacagcaggaagcaggaagttaacagagaaattttgccttgccaaatgttatctacaagctatataactgtaggtagcacggtaaccttttttttttaatacaattttgtaatagaagttaacatcctcggcctctactatagcccaaaactagcatgattaactatgttaccccgtctccagtgacggatctaggaagaaatataagaggagtctgaacaaactagacaaagctacagccccctcttcccctctacatatagcaaaaaaaaatattttagtggtgactcccatagttctcgcgcgccaatagtagactcaaggccctgctacccccatccgcccttgccataatccatagtctcagatggcaaccaaaactagcaatgcttatctacccagccaaaagaaaaaaaaactagcatatgcttaattaaacaatgatatgaagttccggcaggagtcaatgggggaagcttcaaccatgaagcgaacatagagaagtaattatgcaagagaaaatggtaaatttgctcttttctcacaaagttatgtacctcttcctgaaaaagtagtactacctacatcctttaatgaattaaactaaccagcttcgtacaaaaaagatcggagggagtattatacaaccatacataaggtgatggggcatgaatgcacgacacctctcgaaccaactccactaactgcgatattgccatgaaactactaacaagaactcgtccttttctatcaaaatcactacaaaccgtgcaacttttcagtctgatgacaggaaattgaaaga

SEQ ID NO: 63911 - DNA, 24239 bp, Oryza sativa
gggatcgatttttttctcaataacctaaactagattaaataaccactgtccactaggaccaatttaacactttatcttttacagtttttgaggagactcttatgacttggtttgagaatttgagtcttcaggattggagccaacgctaacatgcatctctcaagaggaatgcaaggctgatcatgcagttagccacttggaacagtttacagtctacggtttgtttctttttcataaaaaaagagataaatgtttagacttggtctgaacctccaggcttagagaaagagtatgtcagtccaatgcaaacatgcacaatgcaggcagcaaacaaatgcaaggagaacacctggttattgaacccaaagttaaatttgcttacaatggatttggctagctgtctgaaaacaaaatcaaaacaagatgacaatacttaacaggtaaaatgcgctatgaaactaaaatgcacccctttttgttccaacacactatgacactgcatagtacagatagggttcaggaaggtctcttgacttacagttaaatgggatgtttgatgcaatcagaatccctgatgacctgatcacttcgtaacttctttgcaaatagattaccaagagcttgctcaagtgattctggagtgtacttcatatattttaaagcgctgtggctgttctcaacaagaggcctacatgatgaaaacgataaccataacataaccaaaggagaaatgtcttgaggagcttgataaagaaataaaacaaagtcgtaaaaccagagcaaattggaaagtacccaaagtgtttcaggaaagatctataagcaggtaacaatatttcagcaatcataagaattagggaatctcgtaaatctctgtcaggaacaccccagttcatctgtttctggcaaatctcttcaaatcgcatgttgaaacatttcaatctgagaagagttagaaaaaaaagaacatagtaaatcgcaagatgaatcaccaaaaactgagtacatactacattgattatattggtatttcagcctaacctctccttgatcacagatctggaggttgtactgttcttaatatttctaaaacttccttgagtgacatcaattgaagagcctactgatgaagtgagaccttgagttgatagacactccaatacctgcaaactcagaacagttaaaaaaaaccttgtaaaaatacaagagatgctcggttaaatcgtgctgtcaagctttttgtgatcagacctttagccaagcaactcttctatatcgagtagcatgttgttgcacaatccttcgttgtctttcaatccaatcagcacctaataaatcttcaattctgatctgagaataagaaaatagttatatcattcagctaatcagatttttggtccttatatgatatctactgacctgccaatatacttgacaatataatggatgttgttcatcaaaaagaggtgccccagagcaaggtccttgtattgctttgccttcatagctagattggtctccagagcatgtattgcaccaacaatttgagagaccacatcagtatctttttcatcttcaacacagggatctccaaagatctgctttattgatgattgatagctgcatcagtttgatagctgttaagtcagatagttgctaacggtattaggccatattctattggaggtcatatgaagaaaactcccaatccccagatttcacttactcaaaaagaaacttgatataatcagtgacatagctggtcatataatgcacagccccatcaacagtcgtactcgtcaccgagtgattcagaatgtattccatgaaatcacctattgtctttttcgcagtctgtgcaaggcttttagttaaagtaagggcagatttctggttttcagagcatgcattaccctcaaagattgcatcaacctaacataaccggcccaagaataatggttagttctttgaaatgagaaggcatactcagtcagaatgaaacttacttctttccctcatattttggccctttgaacaaacaaaatgtaactatgtacacagcaaaggtcagatatcattgttctttcaccttggattgaagttccaatgttgccttatacatatctagaagtatatatagtttgtctggcaatatttgggattgaacaacagcatctccaaaactgagtagaattgaaaggcttttagctgttacttcagcaaaacaatggtctttccatgtatactttccttcaaatacttgatcacacagaatgcgttcagcgccgaaaagcaactttacctgttcgaataaatagtcagatattactgccaaacaacatcttgcattttaaactttatgcagtcaaggcaagagcatcactgtaattcgggagaattgtgtccactcggcgattttagcttccatgctctgagcctcaacttgctgcatttcttcttttgtaacatattcaactcccaagcgcttaagagtccgttccaaagttgaactacgaatttctctgtgggaatgatggaaaatgtgaacaagcaaaatcagaaactcagaagcaaaatattgcaagtagaaaagactttagaacttttgtagattgcacctgtatatttccataaacttctgatggcaatcaagttgaattgatttctgtgctaactttgagagcaaagtcaagtaacagggatcaacgagtgtaggaagagtgcactcagcatactgttttagcggtgcttcagaataatcaccggctgatgggccaataaggtcctcacttgacaattgccgattaagacttgatagacagttgaaaatattctcaagatctacaggtttgctatagggaaaatgagatagtaaagaggtttctgatgaagtaattaatttctgaacattcctaaatagatatggggtctaaacaaacagataaccgaacctgcatttggttaacagcctgtggaattcattctccaacccatggattgctttagaaagcaattcgttaacacgttcgtgaacatcattaccaactctacatcttatcttggaagtaaaaaagtattcgacactagtcaacttatcaatcgcctcaagataggcattaagatcctcgtttggtctgtccaataatatcacatgttctgcctgtacacatggaaaatcaatcaaatgtcagtaataaggaacccaattctaaaaggtaaagtatcaagcaatctaacatgatcacccataaaaaaggactagagatttttttacgaagacaacaaccaaagagtattctaggtcctagcatgcatttatcagagaaatttgcatcatcaagcaacagaaacgagtgattagaattagttactacccgcgggtgccctaatgtaaaaagtgaatcatggaatgaaagcgagaacaatgccggtcgattgctactccacatcataggcgactatgacccaaaacctcagatcaaataggcgggtaggtacacagtgcagaaaagtaggagcagaattggtgaacagactaggcacagaagtagacccgcagcaaagctcggattgaaattcgagaccacgccgggggaaccgcaatcgctctccgcccaaaacccaagcaattttaccgcacaagccaagcgaagcaaagggaggagagtacgggagggcggcgcacggcagatgcctcaccgcggcgcgccggctccgtcgcgcttgctaggcgccgccggcattgctagccctcctcccattcccctcctccggcggtcgccacgccggaggaggctgcacgccgccggccgcatatcgagggcgcaatattgggcccggattggggttgtttagtgggcctgaggtggtttatgggctggatgggctgtagactagtaactctgtttatcgtgggcctccgcttcaatgccaggggccggcccatcggacaggcctcgtccaatatcggctaaattcaaacttgtagtagtaacaaactgatcgatcgacggaggagggggtgaacaaatatgaactctcatcatcagctaatctaatctgcacctgatcgaggaacgaattgaagctacattagattacctcccttacaaggtcgaggtggcgcacgatcgccccggccgccgtgaggctcctcctgatgttgtcatgaaccctgcacgcgttgtacgtcctcttctgcatgcaaatcgctcacaatgagattctgagattgatagatagatagatttaaagatcaggaagaacataatcccttacatgggcagggcgcatggcctcgtcaatggcgaccatgtggttgttcaagcgagtgcctatcacggcagcctccttttgcatagcttcgctgctctgcatcgcctgtcgcaggagctcaatcttcgcgcggagagcctccgccgccgcctcctcatcggctgctcgctccatcgatctcactgcccctctctgcctactgctctctcagttgaagaagaactgaaaggaaaacagaatagaacaaatgacggctttatactcgcggggtctggtggtgtctgcatctgcatgcagagataagggaagggcgcttttgaacgaaaggacgctggttttttttccgtatctctctcgtacacattcttatcgctagtccatgcacgttaacatcgggtcgcttttgtatccaccatggacatatatccactacgccaggttcgatccatcgcatctgttcaaagtcctcaagacaccaggatttagatcatctttgtttataggctctttgtttagtctaattctaaacaaataagcagttttttgtttggtttttttaaagctataagtcactcttacaacggtaagtcaaaagttatgttgaagaaaattttttaacttccgtaagatgaagcagtttttttgtttggtttttttaaagctataagtcactcttacaacggtaagtcaaaagttgtgttgaagaaaaatttttaacttacgtaagatgaaggtatgtctcttttattcaatttaggattttaaatccaccgaattataaaagatataagctaacctaaataaagagggcctaacaactggttcatatcttctgttttccatagtaacaactaggagtagagtgaattttcatttgagttttccagaaaagaagaaaataaagcacacatgtataatatttcttacgaacacctgtaaaaaaaaaactgacggcatattttgatattaccgaagtcacccatgtgctttgttaaaaaagtaattacccataaatataaagacttattattatttactgctccgtattaagggcatgtataataatatttatgaaaacgacactaataagagttgactcctgtttttttttgacaaattggtcattttataaaacttatttcgaaactagaccgtgaaaaaaaaatacttcaagcaaatagaccgcgacctcaacgccaatgcttctggcgctgaggttagcaaaaaaacgcttgacgctaagcacctgccagcgtggcggccaagccattcccccccgccgatgtggcaggggtctgagcatggagcccacggcctttttttttttcacggtctagtttcatcagtttttgaaaatggctaatttgtcaaaaaaaaaatcgagttgaccctgaaagctcacaaacaaggagaatacaggtttgcctttgtgggaaacagttgcgactatactcccgcaactgcaaaatggaggcactagaggttgcattaacattggacaattattgcacactgctgatactgaataatgaatgcactaacacgagtttccaacatatcagaacgaacctagcacctaccaaatcaacaaaaacaataaatggcaactaggacagtatctatacaaatcatgcaccccagcaaggaaaggtgcacatagcaacggttctgagcagcagcgctacacaaacaaaagcaatgctaccagggtcccaatttacagagaatgacatcacatcgtcgctggtgtatattaagcagccacataccccaatcaagtacgctcttgttttccttcaaacaaattggcaagcagtagctcaacttgctctggtgtgtgcttgacatattttccgggtgccttgctgttctcgatgagaggcctatagattacaagtctcataagctccagggacaagaactcttgagtctagtgaacatacatatccatagaaacatagaaataaaagaaaagagggaaaattcatggtattaaacaaatgaacagatggcaatgctcaatcatcaaaattctgtggaccagggctacgccggttttaggacaggcaaatttgttaaagtctctttcttaaacggcaaagcagaggagatgcaagcaacaattattttgccgagggacagtcggtcaggtccaggtctgatatcagtggcatgtggtatgcaccaaagctgggcctggtgaaagcacccggaacactctaattcctactactgactaagatcttagtcaggggctgctgttatttctactaacaaactcataattaagtgccagcctaaacagtcaggattcaggtctagatagaaatcaaaaggagaataaggagtgtctcctaaacagccgtgaagtgtatcaggttctagccttctagggataacgcctttgcaatttatattgtaaatttgtaatgctagtaaataattttgaattcataaagcaccaaattggtaggtaaatataatcttcatggtttttttaaacctaattaaataatataactggcacaaacaagaaaatgcaccaactcacatttgacaaactgccagaaacaaaaacatgagcaggagagtttgaatagaaataaaggattagttatggtccttgtccatgcattaatatattatttacatgtaatgaagtttcaaagaaacatacccaaagcgctttaggaaagatctgtatgcaggcaacaggatttcagcaactgcaagtcttagtgactcacgcaactccgtatctggaacagaccagccacactgcttttgataaatctcctcaaatagcacattgaaagacctgaatctggttacaaaatagtgggcaaaacctgtttcagaaattgtatggtaaaacatcattcatcgaaaagcaagctggaataattagtgtacatgaccacctctctttgaccgcagctcttgaagctccactgctattgcctccctcacttcctacttgaccactacctcctgatgaagtcaaaccttgaccagagaggcattgcaagacctgtaaaatcggaataatgcatagatctttaggctcactcttcctattaaacatcaacaatggtaacaaaatgcaagagaaacaaacagtgagttttgttcaaatatgtctagcaaatggacctttgaccaagcaatccttctataatgatttgcattttgttgtacaattcttcgatgcctttgaatccagtcatcccccaataaatctttggcttctgatctggagaaagaaaagagagcattaaactatacccactcatccagttactaacctattggctattgcgaatttgtttataccttacttcataagaacatacctgcggacagatttcacgatataatgaatgttattcatcaaaaatatgtgcatcaaagctggatccttgtattgttttgcttttgcatccagattattctgtaaagcctgcatgatactcatggttacagtggccaactcagaacctgttccatcttcccttttgaactcctggaagagctgttttagagttgactggtagctgcgaaagattaaatgttgtcattttttttgcaaagctatagccagttgcagcttgacaaaacaagacattctgaaagagcatttaataggtacaaaattggatatagataatgtttgcaagaacggtacaaaagaagttcagctacattggagtgatctatttgttgtcgtatacagctggggaaaaataatctggtcttggtgaattagaaggctatccaatagaagagatacagcagcaacgattgcaaaacacaaatatcagcatactggtggataggattgaagaagaaatgcaagaaagtatagcaatgcaactatcaaattacaggaaagattaagtgcacatgatcatatacttactcaaataaaaatttgacatagttaatcacgtagctcgtcaaaggatgcactgtcccatcaatatgaatattctttgttgcgtccttttcaacagcttcttcaaagtcactgaaagtcttctgtgcagtttgtgctaagcattttgtcaaactcaatgcagactcacgcatttgagagcatgattctccaacaaagatggtgtcaatctacacaatccataaaaaatgtagatattacttatttccgtgtcaagaaaatagcaccatatctaaaataaatttacattcagttgacagtctaaattctccatagttagttagttactataacatttgtctagtgaagtcgtttttcattaaagaatatgcaaacaagaaagtccaagttccaaagaccttggtgaaaattgatttctggtaaaacggcgaacttcaatatagatggaccaacagagaaattttggaaatatggcaccacactgtgtcatataagtatgataatgccccatgcacttctcatactttgaaatctgcagtgagaagtttggcattttgccccttttttcacaaagcattcacaatatcatttaatcatatgtttcttttgcaatgttatcaacccaaaaatatcaagctgttgagatcagtactgcaggattacgtcaaccataaattggtccgatggcataaggagctcaaaatttttagaaacttaaaaacagatcttaactcagcatgcacacacttatcatttcgcagttctgcacaaaagggttgtggctggccaatgaaacaattaatagatagctatggtatgaatcagaaacttacatctgcttgaagttcacacattatttcatacatgtctagcagcacaaacagcttctctggtgatcttttactcatagcaattgcctctccaaagctgagtagtgtagccaaactattcctagttatttgagcaaagcacttatccctcaaagattgactgcactcaaaaacctggtcacaaagctgacgttccgcggcaaaaagaagtttaacctgtttaaagcaaaaggtgtcaccagaggcatgttgcaccatacagtagataagagaaaaatccttacagcaattcgcatgaagtgaatccaattccctattttagactccaaaatttcccatggcattttctgcacttcatctttgctcagtttttcaacacccaagctcttcaaacttgactctaaagcagaggcacgggcttcgctgtgcacaagaggagaaagtgcttgagtattttgccgcataggaggtagttagcacataggccatataaacaagaaaaatatataaaggaatgcaggagacaagtgctttaaacttattcacagggagaacattttgtttttcctttcagctggaactggcagtccaaactaaaaaaatcatttttcatggttttcacaaaggccaaaaaagtttataaatatactcaaattgacaagtatgaaaatagctcgcctagccttgcttctatcttcaatcaatcaatctagacaaacatatgtattttcaacccgtttcattattcatgtgagcatcaaaaggacaaacagaacaaaaaatttccagatattacaacaaatttagtgtctagtatccatgaagtgatgaatagatatatagcctgaaaatatttatcttccttttacctgtatatttctgagcattgttgttggcatcccgcttgtaccaactgttgtgctaatttagccagaaaaggaatgaaccttggctcaataagagcaggggggctgtatacagctgcttccgagttttgctgattttcagaatgtgattggttttttccaccttcaggatgagattcagatgatggtcgaagcgtacttggaaggcaatcaaaaagacgatcaggctcgataggtttgctggaatcagtcaggagggtgcaaaatgcaagttagatgatgttggggttaaaaacatttaaactaataatgagacacaacctgcgctgagtcaattgcttctggaattcatcttccatcttcacaagggccttagaaaggagggcattcacatggttgagcacaccatcactgcttcggtagctcctatttgagctaaagaaacgctcaatacttctcaaccgatcaactgcatctagaaaaccttgaagattttcatgtggccccttctgtatttcacgctctgcctgcacagatgacaataagtcaataactgaaatcggacctttctccaaagtaatccaacactgaaaaatagctaggtacattttttggattcaaggtcttcaaaaatcggtcaaaaggaaaatccatgtccaaccatttagttgccaaacccaatatgggcagccatcaaggcacatattgaaatacaaatacttactgtaattcatgttgaagaaaacaatttatatgcataccgccacatgcaatggagaattctccttcctaatgtatctataacaaatacatgtggaccatgtggtaccaaaccaacaatacgctgcctcacagtgatgtatacaaactataattcaagctataattgcccccaccaacatgcaggcgaaacatcaaagaccatccagagaaaggacaaaggggagtgaagctccttcgagaaaatgagaaggattgggcatgctccacagcactcctgagcactgctggttcatattcgggagcaaagatgcattttagaaacttaaaaaatgaagggctaatccaccgtgcaagcttgcaactaagcatacgcccagtgccaggagatgcagatcagaaaatggactgatcacagtcacaccaactacccgttccccgcattcatcagccacggaacaagcagttacaattccaagttccaaccaaccacaagcgggcggggcacacatattgttaatagcatatgtagtactagtaagaagtagggaaatctggggttgaagcgatggagcacctctcgagttcgatcgaactgcgtgaggatgacatcggcggagcgcagcgtccggtcgatgttctcgtgggccgtccgcacggcgtgcgtcctcacctgcacacacatatgcacacagcagcagaggagaggcagcggcatcagaacagcagcctagaaggaatcaaacggcgaagaaccctaggagggaggaggggggggggcgaggagcgagcagagcagagagcaggtgtacctggatggggcgcatggcggcgtcgagcgcggagaggcggctgtcgaaggagccgaggatggagacgacggcgtcggtcacggactggctcttctgcagcgactcccgcagcaacgccgcgcgctgcgcaagggtctccatcgctcctcccccgccggccgccgctgccgctacagcttgggcggttgcttcctcctccagatggttccagaaggttcgggaagggggaggggtggatctgggggggaggagagagacagggtggaggaggaccccaccgacggcgagaagagaggggaggagaggaagcaactgcagctgcagcggtggtgggtggggattgcttagcgcagctgggaaggaaagtgaagaggggggaaggggaacggcagcggagagcaagtgcaagtgtctgtcgcgtgggccgccagacgcgggattgtccagtccagtccagccatggaccgcttgcttgctgctgggtgggtcctatactggtactggtactttgcaggtagtagcacatggatcaattctgcatttcctctcccctaatgtgattttttttcttttttttcttataatataaaaatattgaagctttttacaatttctaattttaaaaataaacctaaaaaaacttatttccgaatcttttagccacgccgatctagctgcttggcgaaacaataatattagtctaccgcgtgtagtggcatggctaaaagaatcaaattagaaataagttttacgagcctttacatttaaaactaaaaaagtttcaagaacgatcagaaaaaccctaatgtccattgctcttcttcaactctaccaacttttcattcttctttatagcagaggacctatgaaacacaatgttagtaatgttttctgctttcaaaaaacaataagttttctgctaataaagtacagtaagttttctgctttcaaaaacaaccctcgatatttacttaaaacgtaggattttagcagtctaaggttagaaaaaaaatcatgtaaattaaatactatgtattttgagtatttaaaatatttgataacaaataaccctttattttagaaactttatcgtttggataacacgcctacgtgaatgggagacatacataaagagagaccaattggtgcgtgtgcgtgtgcgtgagagtgatgtgattgggtatttctgtagagggaaatatcttgttttttcaaggaaagtggaggaacaaatatgggtgaagagaagaaagagaaaggtaactcctcaacttgagtgcatccattattttgtctatcaacaatccacgtttgatagtttggtcctataatagcaggtataatagcaaactattaaccagctataaacatattttaatgagataaaagatgagagagaagagcatgacagttgggactatatactaatagtatagcaaacaactattgtataaattgactattagattggctatatttgaattggagctattagtgggctgtagtattaaacttgctctaagcacaactacccaattagagaaattgcattctttttgttgcatgtatttataacaatatataattacacattttattcatgcgtcatccctgaagtaataaaggaaaataagagtgattttttccaatcaaaaacacgaaattaactccctttaccttctgtcttccatcaactcttgttttctcctacgtatataaatttttgctcctgtaaatgtttgtttagatataccagcaatctctgtatgtttgaaaaaaccatggctggaaacgtttttagacaggcattggtacattcctagcagattttggcagtccacaaaagtacgtgtaaacaagaaatataaaattacagaacataatataataaatataagtacgacgcttccagctctagaggtcgttgttggcgaggttgactggtttttgacagcttctgttttgtatactggaaaaaacatcaatcgacctgctagcaataaccgggtctttggtatgatccaaaacaacagcgtggggaatttgagaaaagtactgcagtgttgaatttgtttatcattgacgttatcgcagcgttaaaaaaaaaacaactcgacgaagtttaattaatcaattgatccactgttgttgaaaaatccaggaatcgagtttgacttgtcacctgaagggaggagaatcacatcatccgctctacgtaccgtgatctcgacaaatgtagtagtattcgattagagccatatatttgaaacggttggaggagcaggtcgtgacagatggcacatgatttcgctaataattgtgtgattaggtcgctaatggccacgaagacccggtcaggcactcatcgatcatgcatactcctacgtgatacgttcccctcccctgaaacaagtagcagctgcccattgttttggaccatgaccgtgctagtatatgcctaattgcctatgctatgctatggtagctgccattggcttgttcggttggttgcgagagagaagagacgggttgacaataagggttggtttggtttgtggcctatataggtcttaccaaatttcaaattttagcagttccagattttgacaatttttggtatgactaattttggtaaggtaaagttgtgtttggattgaagccaaaatagcctaagttcactattaaaatagtctttttcttaggcatgccaaaatttggtttcaaaccaaatagacactaaatactattgaaattgcaaaatattggtaagcttaatttaagcctcaaatcaaaccagccctaaatttgggggagacattggcggctacagtgttaattggcatttaaataatggattagtattaacgcacacgccacaattaaaatcgcacgttttagcgttacgcgtacctctgtcctgtacccctggcctccaatcgtctgcttccatggctggacgagatggatgattatccatccgttccatgtaggaggaggaggagcagcaatatttttccatggaattgagttccatgtaggaggaggagcagcagcaatatttttccatggaattgagggctccatccatgacgtggtggatgatacgtactagctgacagcgcttcacgtcgtcgtcgagcgtacgtgcgtacgtgcgagaggactatggaatatccggcgtcgagaaaacacgacttggaacggccaatcttgtggatgaattttcgccaccttttttccattcacgcatccagcccaaaaaccacccaaaaatctcgaatggtttgttggttggtttcgttgcgggaaccgattgaactcgtcgtttttctctcacccttcttcgtttcgatacagctctttcacggtttccaccacacacatcagaattcagaaaaggaagaaaaactgatctggagacaaaattcagcacatactcaagtaggtactaaaatgttgttctgcatataccactttgatataccaggaacaaatgccaatcatccagcaggcatctctctctctctctcccgctctctcagaaaaactaaaaaagaaaaaacagagggttccagagatgttggtccaaatctctggattcgaccgagccacattggtcaggctcgtaccacctcataccacctgtcacatagcactagcagcaagcagtaaccaccccaagaaaaaaaaaagaaaatttcttcgtaacagctaagctagttgcaggctccaacgtgtccagcgcctctggactcgttcgcacttggccgcttcctcctccataacaaaaaaaaaaaaaaaaaaaactcctcttctgcgctggtgcaccaattccacacgcaagcctccccaattccagttttttctcctcttttttttttacatttcttttttcttctaatcgaatcgacggctagtaaacgggcatcatcccgacgaacgacggcgggagtcggccgggggtcggcggcaggggaggcggcgagggcgacggcgagggggatttcttcgccgggcgctcgattggccccaccagtgagcggaatccgacggtgaccgcgtcgcgcacgcaccagtggaaccccggctcccgcatcatcgccgccgccgcctcgcactcggggcacgacgagggcgtcccctgccgcagcagcggctgcgctgaccagaagggcgggtcctcgcgctccggcgccagcgggaagtacggatccgccgccgccgtgtgcatgaggtaccactcgcgctgccgctgcagctcctggagctgcgcctcgtagtcccagacgccgaacatggccgccgccgccggcgagggggtcgaggccagggaggccagatccatcgcggggaggcgcttgaggatagtcctctcctgcgtcggcgcagcgggcgcggcccccgccgccgcggccgcggccgccgccttcttctcgcggcgggagcggccgccgcggcgctcgcggcgggagcggcggagggcggcgaggacgtagcagccggagccctcgcgcgcgacggcggcggcgaggtcggtcccctcctcgaggggcacgcggcgcgcgcggcgggggcgcgcgagcgaggccaggatctgctgcggcgcgagccccaccctgtcggcgacgacggcctgcagcttgcggacgccgagggagggctggacggtgacggtgccgaggtcgacggtctggtcgccgtcgacgaagacgacgggcagcaccgccgcgggcggcggcgaggaagccagctctcccatggctccccctaccagcaagaagcaatcgaattccggcgagtctctcccggggcggagggcacaagcatcgaatcgaatcgaatcgaatcgaaacgggtggaattcgtgaatctgtgaaagaaatctggggagtgggggacggagggggaggttttatagaggggagataaggcggtttggggttgaggggtggggatgataatttggggaggacggtgcgggcggacctgaagtggtcgctttccttgggaaccaaggcaggccaaggtacttgaggccccacgcggcagtgaggggcgaggtggtcccacgcggtgactggctgatcggcgtgccacgtcaggcgcgcgcttacttgcccgcgggtgcaatcgccggcgtggccgccacggttgcgagtaccagatttttcctgccggtttccgttccgtacgcgcgaggcgtggtcggccaaggcggtgacacctgtgcgccaacggtgaaacggaagaccgcctcgcgttctcgttgtttggctggcctgctcggctcggctcggttcggttcgggtcgggtccctgcagctgcagcctgatgatgatggccgcggtccacgtgaagccgccatggattcggcgtgataaacgcgttgaaggcggcggctatatacacggaccgtttccgccttcctccgtagcaatagcagcttagatgtattctttttttttatttctgcttatgtatgcccgcacaaggttaaaaaagcgtgtaaatactctacttttaaattccggctgtttttatccgtccctatcctagttaattttctctatctatacagaccagtggaacaatgtgtctatatatatatctaaaatcggaaaacaattcctccaaattaatttactatggtcaaatcctactataaattccagcaacattaataaagcagatcctgacaatacatgtacaattgtacagtacgcaagttaaacaccgtactaccaaagatttaattagaataaataggcattcatttcattttatttattaccgtgctactccttaaaaacgggttaaaacatggcaaaatagatgcacatgtgataaaacgtttatggactccaacagacaatacaaaccaagcagagagtacgcgcaggagaaaggatatcataacggacggattcatatggccgtcgcagcaagttatggggggccctttgactgggctgggctacctttttcctttcttttcctccaggatataaaacaatgggccgtcactcctatcaacgtactgtatgatagtgtggcccaacaatatttgtctgtttaagcccctttgcttgtcttttctggaatgaaccgacctgcccttccctttccttgtgtgaaacaattttagtccagtatccgaattagatcagtacaagtttcgccgaatacttcgacgaaatttctcaaattgtttgaacggagcctaacctaaaccacctggttggctgccccgtttgaccgtgcttaaagcttcgctacaagcacaacagtggaaacttcttggaggttggagcggcaagttgacaggtagtaccaagcaaaacgggagcacaacacagttgagtgctccgtacttgcttagcggcggggtttgggtccagttaaaaaaaatcagtgtattttattttcttttttaaacaatgacagagccaaaaaattaccaaagactaaataccagggctagcttaagactcaactaatgaattattatttttcattataagtacatggtgatttatcatttaagataatttatacatgatttttgaggtaagcctaagactcaaaccttagttgctccatgcttgcatcatcccctatcttggagagaaacgaatcacacgcacgagcaattaggcaaatattcctctgattaaaagagtatttgccatgtaggacaaaaaaatatgtattcaaacttttaacatttataaaatctaataagtttacgatattactatagcactttcgagataagtctatgtatatatcatttttagttttaaactaagaaattgttgatgacgaaaatttgattaaatattatcataaacaaaaaatattattgattggatgaagtaaaagaaacaaagtttcgcaaaaagttccctttaaaaaaagtttcgcaaaaagaaaaagaaaaaaacaaagtctcaggcgacggtatattggcccgggtctccctgttaggcctgcaggccgaaacgcgtggcaaaatagtgtgggcctggcccaactcttgacgggcccacctgtcagcgaagctgcagggcaaatcggggagagagagattcttccccggcgatccatagccgcggggcggagtgatggtggtggtgtccgtcgcacgcctccccccaatcctcgtgagccctatccgattccgcaccaccgctactcgccgccgtctcctcccctcctccgcgctccgcctcacccgcccgctctcctcctcctgctccgcgtcgccgctcgccgtcgtagcctccatggagacgccgccggagaactaccgcaccaacgtcggcatctgcctcgccgacccctccctcaccaaggcaagcggcgctcccgactccactcccgcgacctaacccctcctcttcgtcggtgcttcaactgaccaattttttccgtgtgctctctcctctgtccccagattttcaccgcgtccaggatcgacatcgccaacacatggcagatgcctcaggtgaggtgatgaacaactgctcctatgttttgtctcgagaggttgttgagtgttaatccgcaagtgcgatgttcgccacagggtggtattgatgcgggagaggatccgagggaagctgctttcagagaattgagggaggaaacgggtgttacatctgcagaaatggtggctgaggtcagctattggcctttcgcccactcccaaacttcttctgtttcacgcaaacggctgctaattgcttgcaaacctgcagcgtctctcctaatactgcgtgtttatgatacttgtttgtcataatcagtctcgtaactagttttgctgactgagttgcatgtatatgttcatgtaggtccccgtttggttaacgtatgatttccctgttgatgtgaaagaaaagctgaatgctaggtggggaggaacgaactggaaaggacaggctcagaaatggttagccttctcatttccttgggccaacaatgatgctagtaaccaacatttgtgtggtatctgtttagacctgcaagaatagtctgacaagaattatctgataaacagccatatggttaagatagtatggtaattgccaggcagaaactcacagttatgactaaagagtgccagattgctcttgttctaagtctctgtgctagagaaacactgtcttgtccacgaagtgtaccggtttagcgattttcgtgctaaatatgatattgattaagttataagcaccataactactataaatagtatatgtaaaatgtggaaaatcatctatgccacagctgcagcatacatgttacacctcactttcctagaaatgatactatacctgtcggaagcctatgccagcaccttaaacctagtgctcttagaatgtttatatagattgaacctgagctgccaatgaatcatattttcctggctgcgcccatatgtgtgtgtatcagtatatgttacacttgacacgcttgtattgcacagtgtgcacacacatgtgattgtccagttctccagctgtagcgcattggaaagtttcaatctatctagagtgcttacagcttcaaataggaagcttcaatctatcaggggcaaaaattcaaatagaaagcttcttggagaggggctgggtacagaaatcagaagagccactaaactgtgagagatggacagccaaatctatctaccccgtttacactcgctccaaaggatcatacttgtgctgagccaatgtttctgtgttgcatcctttggtaggaagcttcttttttatttttgtccatgatatgtagcataccatacagtctcagacagctagatagtcccatacttagtggaagtgtggaaaaggtccttcagttcagtgtttgttatggttcgtgatccctcagatagattggctgtaactcttatataagtgttttctgtgtgatctctggataaaatctgataattttggtagcctccagtagatacctgtcctaaaagctcaaattactgatataaattggtggctggtagtttgtatggtatcaacttcacatatctcacactcttacttttacgccaaggataggcctgggcccagacatatcattttgtcctatcctagacattaataagtgaaaagcccaccaaatttgtcaggtaagtatgtttgtgtaatgcccatgcgcagcattcaaatactaatagtgtgtctgtaagctataaactattactcacatgtcttcaacacttcatgattccaaagtgacttgtgaaccatttatgaaggattgtggcccatttatgccatcactttacatctttcacactcattcacttaggccaggggttgggcctgggctcatacttgttatttaggcctaggatagacttgactaaatcacaagatcacaactttctaagacatggtttgattatgttaatgcaatgtgcaccattgaaatgccaatagaaaaaggataatacccacttgtctttgtgatccacaagtaacttgtgaacatatgggtgcaaataaacaggtttctatttagatttactgggaaggaagatgaggttaaccttaatggtgacggatctgagaggccggagttttgtgaatggacatggatgacacctcagcaagttattgaaaaggtgggtctgtttaccagctcaatgtttttctgattccctgcttctgtagtatctgatataatttcatattgagcaggcagttgaattcaaaaaaccagtatatgaggcagccctgaaacactttgccccatatctacagtcagatccagcaactacaacttcatcatagctgcaacgaatttcctgaagttctttatatagagcgctctcatgttgccatagatccacaataatttattagtatgaattaacggatgctagtatctttgaatacttggcattatcctgacaattattatcccaacattggatcgaagtgtgcaaactgatacaataattatcttgttactttactccgtaccgtatttctacctccaacatcctctcagtatggaattcttagaaaaggaccagagagtttctttgacaacaaatatcaaggcatgaaggttgctgtggcttttgttgtgcgaggacaaactgccctttatgctttgtactgtgtcatgatattgtcccctatagagaaaaggaaatgtggttaggaagatgtattgcttgctcctccacctccagatgtggctctgattgtacaagatttggagtaccagtagcagcatgaagtgtggggattcttaaatgccaataaaggttgacctcgagcattggtgaggaaagcaagtcgactgaatttactagtccctcatgaactgctttatttcatgtgtgtctgcttcttttccctcatgaacttgcgcaggcttgatgcctgctagtagtagtgtactagtaccttactaacttccaccccttttctttcgtgaaccatttaactgctgtggtgtttagacagaataactgaactgaacacaaaagtagagtattgtactacttgtatttacaccctgaagatggattatttgggtatcttcaatgcttaatcatggatactagtactaacatagtaggagtggagtaactgaacaatctgggaccagagatggagtattatcagggacccatgcatcacacacacccccacaacgacctcatctgaccggcctagattgaacggcgatgcaaaatgcaaatgggcgccattttctcttggctggaacaagaggccattcttgtctggaacaagtggcaaatcttccatgtggaaggcaatgccaatggcaatggccgggcagagagggagttaagcagcctagctggtggggctgtgctcttcaataattgccgtgccactgccgctgctgccccaaagaggagtagagaagacacaggcgagaactccctgtgccaccacatggcgttcatgctgctcttcacatgcaaagcctcgtgcccaagctcacacttgtgttattccatctcatctgcctgccccctcttgtgatcttgtccttaccgcttcttttattaacaccgagttggggaaatggcatgttatctattcctctgcagtgtcgtctacatacacagacgcttctttacatgtctgtatgtatgcactagctagcagtgacttgacacctgctttggtttggaccagaaactaagtttagctcaggcagctgctgataaagggataagcaatcgtgtaatgccaatcgtaccggtggcgtttgagtattttgctcctaggccttctctacgtgatgcagatgtgctgcctaccttacccccgtgatgaggccgtggtggccattcaccggctcacgacaagagcgtgagagctcttggtcacagattacggactgtccgataccaaatcacatagagcaacaagttcctcttcaaaaaattcttcagaagattatcccacataagtactatttatttctcacgatgtactgaacaattacacatgggtgtacagcatatacttgtgcatagtagtaagtagtccccatactgcgacgaaaattttgcaatgatatgcccgtacagtagatacaatcaagcaatgaagcaagaagccatgtatcatgtatgtatacagatgtagtaacctcactcaaacaccgacacatctactccgtcggccacaaagttaatgcatgctagctggccatagcgacacatcattaaacaacaaatcgattgatatcaacggtgagtcctcaagaaagaatgacacccattatctcgatggagtctttgcagtcattgtcaagccaaaaatctagagaacacagggtttaggtgtcacaactaaccacactaaccatcactagttttacaccaattctacatttgtacagactctattggcgttaccagatcaccaaatcagtggagcacaaccactaagaaaatgaatagtactagcatgctgcaactgcaaacaaaattcaggaggaagctcacactttggcctatctctgcaagctcaccattttacctgtgctctagtaattgttagataatctagcatctgcttagatcatatagaacattgataattatcaaggcatgatgcaacctgtgtagagtttcagaaaagtgccaaatgcaagcctggattggtactaattgctccctaaacagtacaagactcatgatatggatcattgatgccaccagatgccattgcaaaaattttcaagtacagtaaactaaagaagcattatatgaccccgatgactaaaaaaggcagaaacttcagtctcaagattggaataataggaaagcaatcctaccaaaaaagaaaagaaagaaaaatggatgtctatctacagaagcataagcacatggacaatgcactcttttacctacaagaacactatagggaaacaggagaggtccagaggagacatgtacttatttgtattgtagatatatgatgcttcaccggccatcagccgaggtgaacgattctgcaaacccggcaggccgagctgggatgctgcccttgctgtcctcaaggctcaggatgcttccatctgtcatgctggcctctgcgtcctgccagcccttcaccatctggagcaacggctggtgcagatcaatgcccatgtagtcctcggtctcgtcgttcacaggcttccatttctctaccatcgggacgagcacgttcacggcgtggcccatgtccggtcgctgggtgggttcccgggatgtgcagtggccagcaagctctgcgatcacggagatgctctcaa

SEQ ID NO: 63912 - DNA, 6739 bp, Oryza sativa
gtaggatcaatggctgctctgagcctatcttcatccttccttatctgacagaaccatgaggccagataacgggtttcctcctccagacggctctcatcaatggcagtcattccagttatcagctccatcagcactaccccaaagctgaagacatctgcttttgtcgtgattttcccagtcactgcaatggtcattaaagcaacttatcaaccataaattcaggagtcataatagcaaggcagcataacaaacagggaaaggacaaatactaatgcaacctccatcaaatgatatcacacatttgttctcacagttccatggaagagaaacaatgataccatctcgtcaagtggttcgagatgtagtgtattgcaagctagtagtgacaagttttttttaagaatgattagttcatcaggaattcagttgtatctagcacatccttaactcctcaaaggcattttcatgggctacaacagtggaatgacccttagtcactgggacaggtagacaatataactagattcaaatctaattcatgtgtcatctgttaacgataattgctgtaacacataacaaagagaactagtacaatttaagcatccaaattaacacaacaaccatatacttccagagaaagcgattcttaccagcatattcaggagccaagtacccaaaagttccagcgagtctggttgccacagagaagtttccatctggtgcatgtttaactagcccaaagtctgatacctttgctcggaaatcgtcgccgaggagaatgtttgctgacttgagatccctatggatgtagcactgatgtgccaggttgtgcagatattccatcccacgagcaacatccagtgcaatattgagcctcttcttccatgagaggggttctaattcaaactgcttccactggaacagatgcttgctcaaagccccgttggacatgtactcatagaccagcagcctctcattcccttcaattgagtaacccagtatcgagaccaggttgcggtgccgtaccttggttagaatggtaatctcggcttggaactcatccaaggccttgttgctgatcactgcagcctccatcctcttcacagcaatcatcgtgccgtcatgcagctcacccttgtagacgacaccaaagcccccacggccaagcacattgtcctgggtaaagttcttggttgcgccacggaggacctgcacagcaatcacgaaattgcccgtatcgatcatgtgaacatcactagcgcggctgctgctcccgctaagtgtattgccttgggtcgaactactgttgccatcattgttcaccatgacaatcttgaccaagttgtctgggtcagaattctcgcgggggtggacgacgacggaagctgcatttggtggaactgatccccttttcttacggaagatgagcacggcacacactgaagccagagccaccacactgactgcaaccgggatggtggtggccaacacaacagctgatcttttcttcttattttccggaaggacgccctggccaggcaaggttggcgccctggacgacgaagacccaggagtatccttggatggcgctgatcctggtgccgtcccattgaagttgagattgccggtcacattcaccttcacactcgggctgaaggtgggcagcggcccggtcaggtcgttcccggacaggtccagcttctgcagcaacctgaggcttgtgaggctatccggcacatgcccagtaaggttatttccgatgaggttgatgtccgagagttcactcagattcccaagactgtcgctgattgtgccattgagtccatactccggcaaattgagcatcgtcacattccctgcaacgcagctaattcccagccaatccacgcaggaattgttcccggaccaactagctaccagcctcttggggtaatcgacctcggcgaggaagtgaagcaatgccatcacctgaggcgagcaggcgacccccggcttgtcggcgcagaacccgttctgtgagtaggtgtacttgggcgccttgatcgccgggacggggcccaagagattgttgttgtcgagctgaacggacttgaggccggccatggactcgagcgccggtgggacgaggccgacgagctggttgctgttgaggcagaggtcggagaggcgcttgcagtcggcgatggagtccgggatggggccggagaagtcgttgccgtggagccatgcctgttcgaggttgggcatggtggcgatgaggtcgagcgtgccggagagcttggggacgccgtgctggttgttgagccagagcgtctgcaacccggaggcgttgaaggtggaggggatgggtccggagagggcgttgtaggcgagcttgagctcctggaggctgttcatggcgccgaggaagtccgggatggcgccggtgaggttgcatccgttgaggctgaggctctgcagctgctgcgcggcggcgacgtcggcggggatcgtccaccccccggaggagacgttgagcgggttctggtcgagggagatgacgaggagggaggtgaggccgctgaagaagtcggcggggatggagcggaaggagttgttgttgaggaaggcgtggcggagggaggccatgccgcggaaggacgggaggtcgccggagaggttgttgttctggaggctgaggtcctggagcgcgtcgagcgcggcgaaggtggaggggagcgtcccggcgaggccggcgttcttgaggtcgatgttgttgacgcggccggcgcggtcgcaggagatgtgcggccatgcggcgcacgggtcggcggcgttggggtcgccccagccgaggacggcgtcggcgttggtcagcgagcggcgcaggtcgtggagcacggacaggtcgcccgggttgatggcggcgtctgatacgtggaggaggaggaggaggaagagggcggccatctagtggaggcggagggcattggagacgggaggaggaggaggaggaggttgtagttgtggaagcatgcggcctccttccgtcgctcgctggctcgccggtgagggcggtcagcgtggtggtggtttgttgggttgggttcagttgtgtttggggggaagagaggagaagaagagtttgggacaaaagaaggcgatttcattgtttccggcgcagcagggggagcgggtgacggacggacggtggactgtggtcagcgtggtgttgtggcggaggaatgaatgctggttgctgggtcgctcttctttttactttttgctttttctttttgttttacttgttcagttttataaaaaatatatttttagttaattaatgatttccatttttaagaaaaaatcttagcagtgataagattagattgctccttgttttagcttaggcttatcttttggcttttatacgttggtgcttttacgagggtatatttggtacaacttcagctcaactccatctcttcttgagctcgggctcagttaaacaatttcaacaccatctaacatagaagcggagctggacaaagctctctcacaaaatgtactagaggaggtgaaactgggtatagacaacaccacaactccactccagatccaactcctaaagcaccgacgtgcctatcaaactttgctaagtttttaaatctaagtttaatagtggaatcatattaccacttcaaataaccaacaaaatctactacaatattccatgtgttttatatatgtcgatgttgatattttagatacgtttcaccaatcgcattattaaaagtaattatgtaatactcatttttattttattgtgatttgatttatagtcaaatgatctttaaacactacttatgtttttatatgtgaaaaaaaataagacggatggtcaaatatttgttaaaaaatatcaaatacatcatatattatgtattaaaaacaacaataatataagaggggtactttcaagaaaaaatgacaaaaaaaggcttacaaaatcaaagagggtttagtgcttttattagtaacatagtacaaacacggggctcacaacgcgtccacacactctctatttatatcttcgtatcaacgaagtcatcacgaatatctcgttgttcaatggtacgtcacctaccactaaaataataattaatcataaatacggatgcgtcgtctactaattaaaaaataagagcactcgtataaagtttaggacttgaactaaacttgccaattgaagtgttttttggtttgtcttgttttctttacatttgaatttgtttttctctatcttatctcccatgtgaatattcacatcatgatcttttgttttcttccttccagccaggtgattaattgcaacttacagtgcaagtcttgatgtagcatgccaatgcgcgtggcagcctgggacaataaataaatactaaaagaaaataaaatgcaaaggtttacacccccccagtgtggtgttgttgatcgatggaattgcgggtgtaacagaggacacccggaaactcgccgggattggctcccccacattatatttccccccttccttcctaacttgtctggaccaaccaaccaacggttatcaacaacactgtagtagtactatctttctctctttctcttttcggaggaacagtaaatatatattgtactcctaatatcgatcgaatcagatatatattttttatgctcattcaattcaattccatggcatcaaatccttgatttaattgttgcctcttatgtgagataggagtataaatctcctctaattatacaccgcgtgcatgccagccggtcaaatattgggaaagtggtgatggcatcatcgaagaaagaaacgccaagtttatacttggaatggtgcaattacctacggttcgtgggaacagctagcaccaagtatattaatcgcatcaacatccatgtttcttcgattcccccacagattaattaaacgattgtaattacattgcatcgtgcatgctaagggcacccgcaatggttatttataggctctctacaaaagatctatgtcagcgtatttttctacttgaaagagattaaatgaagagaaagagcaaagctatctactaatctgaagatagtctatagagaaaaacgaggcaatggattagagagctatagatactcatgtagacataccattaaagtggtttactattaatctagtctattattgagatgtacatgttttatagatagtaccttactttactattatggttgctctaattgcgccaatactgtagctaggtcgatgatgtttgcaattcatcgtgcttcatacattgtgcgtgatgacaaacatctcacgtctcgcggctctgaatgttccacagctatgtactccaccttaataaagtggcatcatctccttcttgtccctccccctatagagtaacaatttgcattcatttctagtgccatatacatattggttttcgctatctctgcatatatacatgtttttggttcagtttttgctatttgcacgattattcggctaaatatgcttctctcctttcacaaatgtatgtagcctaacccactcatctaccaacctggtactccaaatagacagtttttactagtgcattgcatcagtacaaaatttggcattaccagctacagtatataccaacttatcaaggagctgaagtccacattgcagtgaagcttccggtttactttttgttcttgtttgcactttgttcactaccggctggggtttgaggcttttagtgatggacatagtagcagtcctagtctggtagtggtagtgatggccatgcatgttccttccttcctttcatcactcaatcaaagcatgcatgcagttttttgctttcctgtgtcttatgttttttgtgtccttgtcttgacagattagcattcagtctaccaaggaaggagaaggaccatgtggagcaatgattctgttcttcagcaccggccttttctctgaaaactgcctgggaattgtataatatatgatgttcctgctgctgctgggcaatgcataaaagaaaaacataccagcctctctgcaaatttctttaatttctctgaagatgaaagtgttaatccttgagtagtctgaattttctgaaggtgcagaaatcatcatgcatagtagtagataaatactagataggtagaaaaagatatacagttaaaagaataattgttcgctcatacagtcggtgtgcaaaagacaaagataggcacgcttgcatgtctttgtgactttgtgttgcagaaaagggaggaatggagagcgttaatctgttgtcgagcagctaccgggcaaaatgtcaaagagagaaagcaacatgtatccatactactgcactatggatacatatatacagtcaaaagaactagcacatgctcatgcttcagttatcccatttatctattctgctatgctacaattgtactccacttgtctggatttgtgcacttgtacagcatattgctgctagctcatgtcaattactaaattgttaatactctccctatgtgcttctatgcatgttactgatcaaatattccaatccagtgtgcagatttgcctccaggaagacgctaatacagctagctaggtagctagctgttgagcaatttgcatctacactccaagaacacatgcatggggtgcgaatcagatggatcggttgtactaggattacgctgaccatgcaggctatct

SEQ ID NO: 63913 - DNA, 7262 bp, Oryza sativa
ttttgaatggagggagtataggatgaacagtgtatttaacgacgcggaatgaacggaaccctaacaacgaggagaaaatcgtttgtatgatggtatttcttggaactcacacttatcaatgacatttcttggatttggaagcttgtcgatagcatttcttagattatctctacatataatatcatttccacgagcagctgacaggcttattgtattatgtacatacgaattaatatacgatgatgatttatttatttataaaaggctttgtcccagctttacataacatgggataatgattaatatgtgacgatggatacaatttagcacaccctatatcttaactaatttaaaaatgcgtaactttccgatcgtcacatctttttgtctgcgttttcgtccgtcatcgcgctaatttttcgtgatgacgcatgcatgtttggatatagaaatccaccaggatagggggcatgggcccccagcacacccatgttggattcgctcctgatcatgcaattgatcacgtgcacttgtagtttcatcaacatgtaaccgtcatctctctatcgtttgtgttatgagtttctcataatccaatattttttgccggacacataagtagtgcttgaagggccttgggcatcagcactccaattggcattgacttccaacattgacttccactatgacgggtcgggatgccacgcctccttcaacttgatctccttgtatataaccactcgtacatggacgtcgattgtgatgacggggctcgtgaccttctagtagaaatcctgcttactatgtagggtagtcatccaacgccaaaccgccattgttctcgatgtagaaaaatgcactgatctcctagttgcgttgcactcctcgtattgcagtccacgaactgttgcaccgacaatgacaccaacttgttcgtcctaagagagttgacgctctctactcaccattgcatggctccttgtgtcacagtacacgagctactacaccgacaatgacaccaacttgttcgtcctaagagagttgacatgccaatcaactttaccgggaggtcgttgcacatgaccacatcgacagacccgccttagtgcttctcgccgtcaaagatgcgaggttgtgggatgcgatgtcaacctctgccgaagagattatgcctagcttaggaagggttgttggaactcgtagctgtgacgcatgctttgcttgatgacattgaagcacaacctcttgttgctgatgtctcatgcaaccttgtggtgctcgcactagcgctcatcgagcgcccatagtgacttatcgagaatccatagtgactccttaggggccatgtcctcttcattgaaattcaacatactcagctagcactagtaccacaattagtatgacctggctgtaatcatagaagcccttgctaatgtgtagtgtttttttttacagacacccactgacatgtgggcccaacatattttattttagtatttttctactggcaccatgtgatacgtgagtcccttttatgatctatcttttattattatttttattattattacttctaatatgtgccacctaaaagttatatgggataaagactaagtcaacaagccgcataggtagcgctgacttaggcacctagacaggtgatgcgaccgactagggctcaggctagaaggtaaggagggggccatccgtaggccgtttattcgaccgtatatttatatgcttaactaatacggcagagcggcagcaagctaatcaaccaaaaaagagaaatatgcttgcacttgtggctatactagatagatcactcgatgtataatgtatatacatatacgtatacataatacatgttgggctgccagactactatcgaccagtagaagctatctaccaatatgtacgattaacatgaagatgtcacgattaatttgctgcatgtaattagctcaagccaacagaatatatcaatccatgaatgctgcataaacatatgcatgccgcacccctaagtcaaattaaccaactaaggaaaaccaaactaataagccaatacacgtgcaacacgaaatatatacagtaatatacgtgtgcttaactcaaacgcaggggcggatccagaaccaaattgaatctcttttttttttcttcaattcccctacgtacgcttcattttctttctctttttcctccttcctctctcctatcaacgatgatctcacgaaaatcgtatctatcggaatgatgcaaacaactattttatgtacatcacacttcccgttcatttctccaacaagagttggataaagataaagattttcgtagcacgcttttcaaactgctaaacggtgcgttttgtgcaaaaactttctatatgaaagttgttctaaaatatcatattactctattttccaagtttgtaataattaaaactcaatcaattatacgttaataacacctcgttttacataaaaaaaacttaatctttatcttcatcttcaggagaaaagaacaccacctaagatatagaaaaatatttagtaatttctctccaaaacacaagtagcctaaaaggcccatatcattgagttcgcctagggcccacgaaactatagaaccgtcctataggcgtcacgtcagttgaaaccgtccttaatagcgtcaaggaacttgatttgtactgattttagaatttaagggacgctttgtacctgattttatggttgagagacgcaaataaaacgtgtaccatcatttgagatgaatagtagactttcttcgatgttggctgcatgggacagtaccactaggcccaaatgctgtgtgccgaaatgatgccaagcctaagatggccctcgagattagaagtactgggcccttcatgggcttaagtttcccgtttggcctacatttatgagattgttcctcgacatgaaggtggaccaaatggatgcagatgcctgcatgcttgagtgcttcacggaggaggacaagcagtgtgttccgcgagttcaaggcccagacggacagggctggattatcctcatcgatcgatcgatcgatcgatctagctctcgatgaatgaatctccgatgtacaaaaacattattgcatgtcgatttactagaaaaaaaatacgaatattaaaaaataaccttatatcaaataaataaaaggagcgagactttaatccaggtcggctagcccaccaccttatgtagctagctgaaagacctctgggcgtttctgcatgtcaattgaccagcactctggtcgtctatgatcgatcgatgatggtggaaaaactagctatatatagttctaaattttatgtacagaactcagcttccaagatcgaaattaagaataatttgacagtagacgattataaggagatatttcgagacccaaacaaaaaaagctcgcgcatgatttagttcatctattgcgtcgatctgtacactttgattcataggactacatcgaacgatctcaactcaataaaattaatcgagcgaaaggaagaatcgaacaagtgttcaattctctctgtgctgtatgttggtagctagctagtgatgaggccggtgatcatgaatcagaattcgatcagcaagaagggtagagggcctggaggtgaggctgcaagcagggcgagttcctccacgctctggcgtgcagccgcagcgtctcccgcgcccgctcccgcgtcctctccccgcactgctccgactgcgccaccacgcacagcttctccaccgcccccgtctgccccatctcctgcaccaccgccgccgtcgccgcgtgcctcgccaccgaccgcagcacccgcaccgccttctcgctcgccacctccgacaccctcagcaccttcctccccaccaccgccacgcccgcgccgtgcgacaccagcgccgcccgcccctccgcgcacccgcacatccggtccagcgccgccagggccagctcgcacccgcgccgctcgactggcccgtccaggagcatgtcgaccagcaccgccaccgcgccggcgtccaccgccttcacgcggttgcggccccacgacgtcgtgccgaccagcacgtgcagcgccgccctcgtcgccgggctcgataccctgtcgcggagcagctgcaccgcctcaccgaacacctcctccgggagggacaccagcctgttcgacggcatgaccgccgtcacggcctccaggagcagcgccgcgtgcgcccgggacgtggtgttcgtccgctgcagcgtggcgacgagcgcgtcgacgagctcctcgttcctctcgacgagccgcgccaggcaccgctccgagagctccagcgagcagacgatctcgagggcctcgtcgcacgcggccttggcgtctcgacacgacgcgacgacgacggcggccagaacatccaccgcgccggggacggcggcgaggagcttcctgttacgctcgctctcggcggcaacgtccctgagctcgcgcagcgcgtcgaggagggcagcggagctcgtggcggcgcggaggcgggagacgaggtcggcgacgcgggcgcggtcggcggggggcttgggggtggggacgaggtcgacgccatggtcggcgtggagggcgcaccacgactggatgaggcggcgcagggtgtggttgggcgtggggtcgcagtcgggcggcacgggctgcttggtgagcgggcaggtgccggcggtgaggagccatcgctcgatgccgtcgcggtcgtaggtgatgccggtggggagcgtcaccgggtcgcgcatgatctgcagcgagatggggcacacgaagtaggacggcacctccacctccacctccacctgctgctgctcctccattgccgtcggttgcaatgctgctgctagctcgtcgtcgtcgtcgtcttcttggctcttgctccggtgatggtgagctgagtagtagttgttgtattgtatgtggtggagatggcagcaatggtggatgggagatggggagtactggaggaagagatcgaatccgagtagttttatggagtacgcgggaggaggatgaggtggatggattcaaagtccacacgcatgagcgagagcacgagcatgagctgcccgaatattaaagaattcggtcggtcaaggtagctagctagctctttggttgttgctagccttccatgaaggtgacgcctcagttgattaatcttacaacttgattctctcttgtcaccgccccaaactttttctttactccctccctctggttctatactaattatcgttttggataagattgaggttaaacttttataactttaaccatcaataactttaaaaatatttagtttaaagaaactagaaaaacatatatagatttgtctttcaaaacactataataaaaataaacatgcatttatttattgtatatattataataaaaaataagctcaaatgtatatcttgtagaacgtgtcattgtccaaagcgtcaattaaaatgaaaccggagggagtaatagcactaactgatttttttttattttcagaatctttttcttgtttttgtaaaaaaaaaacactcctcatgcctcattttcaatactaataaatcctttgtccaggccactgttgttgactagccatgccataacgaagtatcgtattgccatagacatatattggagttatcatatcattgtcaaaaatatttatagtaacttgaaaatattttgttggttgattttgtaaataaaatcttcagaaaacaagaaaaaaaatcaaacattatcttcgatccaagtgatttgcctaagcagatagtgcttttgtagtaaatgagatgaagatctccattcgtgaataatatcaagattatagtactgcacataataggccacgagcattgcatgatacccttttaaattaaaaaaaaactagcttgcaccaaattataagataagtttgtttcagttcgtgcgcgcgcgatgctagaggtgaagcgagtgagatgaagcagaaaagagttgacgaggtgagataaaacaattggattatcgagagaaaaatggccagtgacgtgaggtctccaacgcctaggaggccgctgctcctctattacttaatttgcttaatttacagtggatttctcaatgttttggcctgcacctcttgttggagacgtaagatttgtctaggtgaattactaggcagatataaacgagaaatttgcctaggcgacctctaatgaccagcagggcatctttgaccacacttgttaattatgcagctcatccctccaattgtttacaagtacagttggacttggaattaaggaaggtttgcatgtggcaagtaaaagactaagcatttgtttgttgtttcttcttttttctgatacagtgtgctcattgttttcttgctctaggtgaactgaactgatagattataatctcctctaccgactccagatctgtctgatctgacccaaactatagatcatttcattatcacggggcagtttatggaatataattataattattcgatacggatgatggcggcttgtcatctgtaacgcttgattaaggcgatgttttaggccttcagcacactgtttttagtgaataatcagactcttgttaagttgttattcattttcatctgaattgaatgcgatactttaatttacgtccatgtatgcggctagctgaaacgttaggagcaaaattcagagaaagaatagcgtcaaatgaacaggacatgatgcattccaaagagaaatccagggtaaagactagtgatgaggacatgagaaaggccaaaactttggtaaacggtaggcctcggtctgaggtgtacagtgctggatttgcaattaatctgcggctaatcacttaactaatggtcgctaagttgctagttttggttgattaatcctgtgaatttgacttgcgatcgagaatgagacgaaatgctgcgtgaggtcgctgtctctgtcaaaccgcccgaacgtgagtacacgctaagacaaacgggaaaatgatagaaattttggagcaacgaggagactatacacgtagatcggtagatgcatggctagatgtaatcctattgatacttcatcgatcgatgtgatggcaatggttactagtattagctaattaagcatcctatgagaagaacttttgtttcttccatttgactagttgcgccatagaaatttcaccggtatttgctacttgtttgcttacgaatctgacc

SEQ ID NO: 63914 - DNA, 2374 bp, Oryza sativa
tatctctgactaaatcgcttcccttgttcagttgtactggcttagctaataaatatagtggaatgcttttttgaacgaaatatagtggaacgctcatcaacacgtacgtttgcgtgcgcgtaaattaagattgatcgatcggccatacaatgtgctgtgctgtgccctggaagtataaggatgaaattgtgttctgtcattcagaactgttgaatctaaggatattcagaaccgatgcgacttttgttctggtatgcagacatgttgaatcaaagctggattttgcaaatctgacacgcattgaaaaaaaaaacgggtggactattgcagcgaatgtatgtatgaacagtatcggtttggaattgggataggtaggtggtgctggcacgggatggggagagtcggaaaattaatgagaacttggatggctcagatcatacaacatgatcagcgaattggatagttcgatatcgatcggatttctcctctgatctgcagcgatccgattggaatgatcaggtagacaaaccggcgtggtccgctccgctacttgtggtcgcataaattatgcatgtttggttgttgacgaatcgatcgagcgaaactgttgctgtccattcgctgaaatctctgaccgatccggttcatccgtgaatttgaaggaccaatgtctcctcctcgacttctttttcttttttttcttttgaagtttttggggttatctatataggattcgtatgattttttagacttccatcatacagtgtttcaccgagtagatcgaaaatatttcactgaatagatcgaaaatgtttcaatctttttaaaaagctgtaatacaatcaaatcaccccatgaaaacattttactacaacgtatgaaataacgcttctaaatatattgaaacatgaaacaaatccgagtacattgagaaaaagtctatgggattcccatgattttttagcttccatcatacaccaatcgggcgctgtttcaccaagtagaccgaaaatgtttcaccaagtagatcgaaaaagtttcaatctttttaaaaactgaaatacaatcaaattacctaatgaaacatttttctataatgcatgaaacaaagattctaaatatattgaacatgaatgatttagctatgaaaaaacattcgacagccatttagtcttcccgtttttttttttttttttggaaaggaatacaccatcgatttcatatgttatttatttgggccaagatggttgtagatgcgaagcccatgtaaatttacgccgaaatagacattcggtccaatacagttgagaaagcccggacgaactctttgcggcccacatatatttcggtctaaacagttgttgggccggaacagtaaggcaacgtacgtgctgccaatattactggaccatagcccacgtaactgttagcgggccgggctttaaacgagccaagcccagacaaaggtcgcgactcggcctctcgtatccggatggaaccctccgccgccgacgccgccatcgcccatcgccggcagttggtgctcgtctccctcaagccgggccctcgcagattaagccagcgataacggcaacagcctagggtattactattgctacttttcttgcagttcttccattatgtttcaaaactttcaaccaaacagactagacatacgcgtgctctgctctcatcaatttggtagttcatcattgtttgttactagttgtttattttcctttccgaatcggaaacgctacttaccggtattccgtctcgacgggaaaccatttttggttccagctatgcaccgattcgcatctatcttatttaagacactgttgtttttgggattttttttttatttcagacaaaactaaggcaggcttgggaaggaaagacaggctggcgtggatgaaggaatcggcgaatcctgcgtcaacaacgacagcgccggcgccgacgcatgtggtcatttttttcttcccatagtgcactccaggttcttcttctagggtttgtgtgcatgtttacgatttattcagtggctgctattccgatcagtgataaccaatagcagttgggattgtctttgattttctagggttcagagttagtggagaaggaacatagttaactccttggtaatgagatatgttggggctttttttgcggaggctgattttggcaggattagggagagagaggctcttttaatatcacctgataccttgcaagtgtcacctaatatatggtaggaatcgccttacctgacaggtattacctgatacttcgcaagtatcacctgatatgtggtaggaatcgcctgatacctgacagatttcacctgatacttcgcaagtatctcctgata

SEQ ID NO: 63915 - DNA, 797 bp, Oryza sativa
ggcggcggcggtagcgtgcacgggtcccctgacattaggaacgtcatctacgagcgcctggtggcgattcgcaacgaggaggccatctccaacccttcctccttccgcgttgagctcgaccgccacttccttcgcttgcccgaaaggtagtacacatacgatgcttctcgcctgtctctcagttgttttgcttttctcgcctttcaaagtgcaatcttcttgcctgtgcagctatttgatcgatctggatgtcagcaaggcagagcaagtgctgctgcaccggaggattctcgccgactgcgccgaccctgaaaagcgcccaatcttccatgcccgctacataggggtagactctggatcaactccaactgaaaacggtaatggtgggggctttctccctatcaatttgaggtataggtcaccaactttccaatgcttttatatatatatatatatatatatatatatatatatacatacatacatactttactagttgaggacacagttgatttcagtggagtgtatgtacctttcttttcgtgttcggaatggtatctctttgtccaaacaaaaatgcttcttcttctgtaaatatcaagccaacttatcagtatatctttcgtgttaacatcgattgtgcctgtgaatattggacagagatgatgaattcacagaatccgagccaatgaaaggatgatggaagacctgagtctagagagaggaaaaggtgtggatgacttcgaagccagttctgcaaggtatttttgttactaagctgttgtgctgtgcgaatg

SEQ ID NO: 63916 - DNA, 2887 bp, Oryza sativa
cttctgaccagacatatcttgcactattttccatcatggtgtagaattctttatgcatggacgcaacaagcaaatgtaatggttacagtatccctcctatagacttagctgctcttgaagtccctaccaaaatggataaaagacaggagttatcccccgtctttcgagattttttgtttttaacaattccacctaatgacgctcaccaaaatgcaaaactaaaaatgttcaatcaacagttatttacattagatgccaaggaaactggagatgaaaaaccaagcacattggttatacccagacatgagctcaatcttttagccaccaacgctactcagattgtaaatatgcccaagcactgctatctgaatcttgagaaacaaggattttgattcctacgaaaaaaatcagcaggcaagattatcagcaatatttgtgtcacctgttacaatgagatactttcgatgctttgtgcaagctccataaaattggacaacattttcatgatcaacactcctggacatgacttcactgtattagaattatctggaattttaaatgattcaaagtcaagtctatgcatcaaagtgatttcaaaagaaagcttactttaaaatcattatttcttgcaagaactccactttcgaagaatcgttaacatgttcagatctaagaaattttactgcaacatccacaccgagataagttcctcgatatctgcagccgaggatacaaacaagaccacttggttaatgaactgctgatcttgctagaaacattaaaaaatatagaataatgcacacagcaatatgtctccacaagttgaaatcagaaacccagaacacaactagctttgtgactatttgttgatagtgcccccttgtgaaaccatttgcttgtaaacagatgtaagaaaggtcatgcaatccacactagcagttgagttgtacctgttgttctaaataactacctccgttctttcctaatattcattattcctaagtaataagagttgcatgtttcttacagatccccagaagatccggatgcaattttctccccaatttgcagcaaactcctgtcgaattcagaatctcctatcttttcctgcagctctagaactttctctgattgtgacaaatttgtcggattagacaatgagccctacatacaagaagttcaattctgtaaaggaaaaggatagggatggcatattcatttcttcaagtcttgtaatgctgacttgagagtatttacaggactgcatttaatgcaaaaaggaggtaacttgcaagcatgttgacttcctaaccagcaagacacctttaaatttcaagcaatcgtgttgattaaatggagaaataggaagaaccatacatggctgcttgcctctgcctctataagcttctgaagcaaaccatccgtttcctgcacatagtgttaggcaatgttttaatttgtggaacaccttgaagcatagtgtacttaacaatctgattatctaattttatggtttcccaccataagtagtcatgattaaaagttcgaaacataatttgtagagttctgtaattgtgtgaaaaaaataagctataaccatgacgatgctctaagtttacctctgtatcccagccatcaacaacaaacacatcgagacaaaagccatctgatgttgagaacacatgagcttcacggatgttcaacccaatatcagacagtatcgcggatagctgtaaaacaatatctcacagttcaagcggtgacacaagaaggtgtggtattcgtatggaggtctctaaatagaaatcacaaagtacatggccttgccttactgaggagctttggcttgtctatggaagaaaaaataatttcatgaacacggacgaatttcgagtcccttctgcaaaattaagagaatggttatggacaaatcatgtaaaaaatgattaaagatgattgctcaggcaaattaagagaatggttcacgaaaagaaagcatataatacatgagtgctaaactagtctggatatcagaaagaagtccatataaaaagaataggcaaagaagacgttactaatcatttcaaagaattatatgagaactgttgtgcaccgatgtagagagcaaaggctcatatccacaaaactcaacaattcaaacaaggctgattagagcaactagcctgattgcatataactgcagtaacaccaactatttttttttgcggggagcagtaacaccaactataaaggttgctcttaagtatcatgacggaagctttgtaccaaagaggaacacagtgttgttttatggacagaacaacctttcagtcaagttagcacccttctggaaacataatctatgtttatacaaatgaaatggaaatttcgcattcttgcagtttttagatcgaaccagatggttgaaacctgaaactgacgttccggattaattgattgttattatggtatagatatgtcattcgcacagcacaacagcttagtaacaaaaataccttgcagaactggcttcgaagtcatccacaccttttcctctctctagactcaggtcttccatcatcctttcatatggctcggattctgtgaattcatcatctctgtccaatattcacaggcacaatcgatgttaacacgaaagatatactgataagttggcttgatatttacagaagaagaagcatttttgtttggacaaagagataccattccgaacacgaaaagaaaggtacatacactccactgaaatcaactgtgtcctcaactagtaaagtatgtatgtatgtatatatatatatatatatatatatatatatatatatatatatatatatatatatatatatatatatatatatatatatatata

SEQ ID NO: 63917 - DNA, 3757 bp, Oryza sativa
cggcggcacggggagagggtcccgagctctcggccacgccctcctcgatgtcgtcctccatctcccccgcggcggcgaggtgccgcctacgcgagtccccccatagcgacgtcgtccactacgtctcaggaggaggcggcgagagagatgcggtagtagaagcagcctgagctgaggtatccaatccaagaggtggtgaggaatccgaggggatctttttggcgcgagaatcttctagaggatggcgcgcgccggccggccgggcggtgggctaatatttgtagggtgaaattcctcgccggagcggagattccaatccaaacgccggcgaggcgaagcgagacgacgaactgagcagcgtctcgctctctcgcagtcgcaggaggaggaggagggagattttccttttctcttttttttcctttctttttattatgaatttttggctttggtggaatggaattatggaaaaaaatggaatggaagcaggaggaggaggaggaggatcttctgcgccgtcgcgccacaggagatatagcttcttactgcatccagtagggacgcgacgcgtggcggcggagggggtgtccttatccgattccggggggcgagatggacggtctggattcatcgtggagcaatcggacggcggcgggaggggcgcacgccggagagttagagtttgggtggggaccaccagtcctttccgcaagtaccggagattggacaaacggacgctggaaagggtggaatcagagtacggctcgctgtacggtgggcccgccgtgctttccatctccttctctctttgcctggcccaccgggcagtgacctccggtagtagtagttcccctaaacttgcactgattaattttcgagtaaattccatttgataaaactatcactttgctacagctttattcagagtaaaccataacggtgtgtgtctaacatgtggcctgacataattttgtatttttgagtgcgtgcctagcaaataagcctagagaaatcaagctattacggttacagttttatgataaaatcatcagctattgttatagtttgctgaaatttacttttattttttttaatattaatttgcaaacaaaatactcctacaaatcttactccattgatttatggttgttttggcaaaactccatatccttaatccacgacaaatttaaagtttgtaaattaaattataatgatttatttacattctgtcttaagtgatgataaaatgattcttcaaattttatcaatgtgatctcagatttaggatcatgccaaacagagcacaaaactcacgtatttacaagcggagaaatcatgtgtctgctagcctactccaattgttaaatacagtgtactactacttgttataacatcaatatcaatgtcaaaccttcgttttatataatagcaacggccaaaattcactgctagattatgctaacctgatagcaaatcaatgttaagttattagtacttcattactcacatacataagattctagcaactggatccaagataccacgcttgaccgcatccagttagcttctaatttcaacgatgtgccttgcatgcttaattcactaactaagcaattgataaacaatttactagtttgcatcaacagagaaagagatcgtacttgctccaacttgtcccgacgtgtccaacacgttcctcttcgacgtaacttgtgttttaaagttggcaatgacacggagttaattataactgtttttcaagtgataaacacattgtcaatgtcaccactgtgctggggcactactcgagcaaaacgcatcaagttgcaattaaaaaaacttccggtgaaagaaacataaactcagaagaataatcaacctcgatgatattacgatattttcattgattaagagcagcaagggccaaatcaaatcttcaggtcagaagcagcggcagtactcaactgctagagcagtaatcactgtcaattactaagtactccctttgtttatttttaatttaacgttggcgtcaaacaaatgagaatggaggaagcaattaactactccagtagggaatacatagctatagcgtttgcaatgtacggcagcaaacagcaaaggccaaacctttgtttccaagcgtatgtatgctagtcaagaatctaattaagcaatattctgttctcaaaaaaagaaaaaaaaaagaagaaagaaagatccaatattctaataaccggactccagattctaagaaagcagtttcgtcgtatcaatcagaaaatagtagtacaacgcagttgtttctacataccataattgtagcgtacgtcaggctgcacgcttggcttaacttgatggattagtgccaacctacaaatactccttccatgcatacaacgatcatacaaagggtaccgtacaaggtagtaaacacttatgccttctttcaaacgggagagcattttgaaggatcatcttagggattgagctagattctaaaaaacaaaaggaaatacaaatacacatttctcttgtttcaaaggaactctcctttggaactcaggattaaaaaaaacatgaaaagaaaaaaagaagtgttggattgaattgtcaaggcttgttaaatccttaggatttcaaacaatacaagaattgatctaataaagttgtttggagtttcctagggaaaaagcacgagaattttgagagaggaagacataggaagattcccatgaggttggaatttatgctagaaaccctccaaaattctaatgaattgaggcaattcataagaatttatatggttttgagatgaccactcatttgttccaaagatatgcatagggactatttccaccggattcaaaatctcaaatatcctttgtttcaaagaagcccctatatggcgcatactgtaatataagttgtattaccatagtaatatatgtggttgtatcagaaacagcttctatttaacagttagctatgacatgagcttttattgttctaaatttcaagggatagcaagtagtaccactgtgtgaactacgtattagttagaccaagcacaactagttgttgcaagattttgttgttgtagctgccagaaattgctttcagctagcttctgcgtccaaccataacagtttttaaacgtagaaaggaagaaagtcgacccaccatattatgcgcatttgtgctgtaagcaccggaacaaaaacgcatcaagttggaataatcaagttccagacttcctgttatttggcaaagtattgacaaagctggggtaacctgacctgaaatggatcatgacatcggcacaattaaagcccacgctttgttgtcgccacctacaaagtacgcttatgctgcaagtgcaaattaaaggatattactgtcacttccaaagtaattatgtcacgcggtagtgacaaaagctggagtaaattccgtattatcgcgcagtaagtaaccagtagtgtgaagaagctgtggccggctgcgatagcgatgtgaaggtgaagccgctctgctcaaaacaatccagcagcaactagcagcagcgagtaagttgatgggaaaacaaacaaattcagtagaacatcaaatgcagcagcagcagcttgtgccaatccaatccaggattaggtaagaatagcacgggatcaagtggacaaatcggacagcagctgctgacccaaaagatcacactgccgagtcatcccaccttactatattgtgcatacatcaatat

SEQ ID NO: 63918 - DNA, 18183 bp, Oryza sativa
ttatactgtagctacaactttatctataacttaacaaataccaaattctagtttgaaaaatgcatatattatctttacctaaggcaagcaacaaactccttattcatatgccatttatccctgaccccagaccaatgcccataatgtttgagacaggcagatgaatcgtcaacacaaaagatcatatcacttaaaaccttactccacctaagcaaacaattgtaaaagctgaaagcattcatgaacaaagataatacttattctggaaccaatgttagaactaaaggttgtagcactgaccaataagcacggcccaaaacgaagatacgcaacgcatattatactccttgtgtctttaatcaaagctaaaataagaactaaataatgtgttcaccacgttaagtttagtaaagcacctcatcacattgcaactagggactaaattagtttgttataacccaaggttgcatgaccatgaactgtttcaatctttggcaaatgggcttccttactacactatatttctaaaagtaccacttcatacagttcataattagtgcagctgtaccctagctttgacttttgtgtagactcctgactttctgaattcaaatatgagatgcttgcatgtcattatgtcaataagagcatgcaagttatcaattatatgaacatgccttgttacgaaacaaaacctgacaaaaccttttctataatgttcaccacctgaacctgcaagcacagagcagaagaggaatgcatgctcttttgtgtagactcctgactttctgaattcaaagatgagatgctcattttcgaggaaaaaaaagttgaggtgcttgcacgtcactatggctgtgttctttgcccagggttcccaacccctctccctcgttttccgcgtgcacgcttttcaaactactaaacagtgtattttttgcaaaaagtttctatacaaaagttgtttaaaaaaatcaaattaatccatttttttttaaaaatagctaatacttaattaatcacgccctaatgaaatacttaattaatcacgccctaatgaaccgccccgttttccacgatcactgttccggttgggatcctgggctagcgaacacaccctgtcaacaagagagcacgcaagttatcaattatatggacatgccttgttacataacaaaacctgtcaaaagcttttctataatttttattagctaagatcaccacctgaacaatgtacaagcacagaggaattcagcaaaagagtgtgttgagatatttgaatccataaggaattaagaaccataacacagcataaaacatataatgttattgctgaattaactaagaacatagacacgtttatggtattggaatacctaaaagctattctgtatgtgaaacatgctgaatgaagatatatatatatatatatatatatatatatatatatatatatatatatatatatgcttgtgttaggacctatttttagcatccctgactctgctggatgatatttcatataaggcatcccaatagcacatctaaggtcagaacaaatgaagcttaagacctaacaaacttgttttcatgttcatttcagaagacaaataactagagtaccaaccaagccctaggaaactataaattcaaaagatcaatagtaagtacagaacacacacacacacagaggaaaaattgtatacttgcctgcccttgctatgactgctgataacattaaagtactgagtagaaagaactagggcacacctgaattcattaactttatatatagtgattccccacttcatgcggccagtaggaaaactaattatgtactgactactgagaactaatatgtaagtagtgtcgcgagtcaagatcagcaaagttattataacgatgtgatcaccttgttcatgtaacaagcagagtgatcaccatacacatattcccccctacgaaatcatcaaaacaaaataaaagtaacctgaattttattgtctgaagcaacaaaccctgaaaagatatttaaaacatttcacttttaacaagtacagcaattgaaagtatctcatgatgctacgaaccaagtacaatgcaaataaaattctttgacatgtcaattccccctgcatgcaatggatagatgtcccgaatcaattaaaatcttaacctgagcgcatttagtcacgcaccggactggtatgtgttctccatagacttcagggcatagcagtgaacccaccatcgaacacaaagccacggtatacgccatcactgtacccaggaacaccatcaacccagtcccacttgccaccgctgttgcctagctcatcctcctcccacattgccagcttccctcgcacccgctttccagcaaaccacaccttgccatcaccgccaaacaccttgaccttgttgttgccaccagcaacagcagtaggcatggcattaccctgtgcagcagcctcacagaggccggtgaagcaacggtacatattgggaggcatgcggccagcttcgtcccactccatggtggccagatctaggcgtaggatgagcaccgtggagcatggcgcgtctatggcgaacgaggacctgaggccgccgatcatcaggacacggcggccgccggcaccagcgaggaggcgcgggcgcttgaggatctcgaagacatcgccccacgcggagcgctcgacgggggcccagccgcctgtgagcatggagagcgggcaggagaagagcttccactggctgcgccacggggtgccgacatcgcaaagcgcgaagacggcggcagcgccggaggcgagtatagggctccgcggcttggaggggagcgagaggggatgcttcatccacttgccggatccggatggggtgtaggagagggcggcgagctcggtgagcacgaggacgacgccgccggggccagcgaggacggtgccgtggcgcgcccaggcagatccgagagggggcaggaagctgtaggtccccgcgaaggggttgcagacagcgagcgatttgggcgggtgggcggtggaggcggtggaggaggaggaggaggaggaggggagggatggcggggaagcgaaggggactcgagccagaggtagaggagagagggggaggaggcgacggggagaaggactggttggggaggaaggcggagaaggggaggcggagccagtggcggcggtcggggtcgaaggcgtggaggcagccgccgccttcggggcgcgggtggcggaggaggaggaggcggagggaggggaggagggcgaggaagttgtgggagagggtttcgtggaagaggcgcgataccgggcggcagacgacggcgtcgcggagggggaggcggaggagcacgttgtggagcgcgtccggcggcaggaggtggatgggcgccggcagcagcgaggcggcggcggcggcggcggcgtcggcgtcggagtcggagtcggatgcggccatggcgagagagagtttggtggggaactggagccagccgagccgagatagcggtgcgcaactacacaacacagaggaggagcccgggggcatttccgtcatttcagccaggctgtagagcggattataatactagtactatacggtgggttcacctactcgcgcggtggccccctatgcatgtgggtcccaaggaagactggacccactgtcagtgaagcgtgtaagggaggcgctggtggaagacgtgagtctgacgggaaagccgttgcggctgcggcgtcgcgatcccttgctgcctcccttcccaccgtggggagtagacttggaagccaatggcaggtggggtccacctgtccgtccgtgcccgtaatgcccgtatgcaggccagtacagtgtcgggtgtttgggggagggcttaaaagggaagtgggccgtatgccactacaattggaaaagaggccaagcccatttatgtacaacccactaccctccatctcctttatagtagtctaaaccggcggctttacaagttacaaccgtcgagttggattcagataagtgttgtgactgcattattacccgatcaggttgtttacaggtggtagagacgatgtaagatgggtgctttttggtaacaacggctacggcaattttctatgaatgccagattttgatatatgattttgttaaaatctctgttgagcattgtaatagggaagccaattgtgtggcacatgttctagcaaatcttacttttttaagtttaggaattcttgtaattggtttgatgaggcccatattttcttgttaacgttctaaacgttctagtgaatgttgtaacaatgtttgtatattaataaagcacgccaaatgattccctaaaagaagtgttgtgacagtattctgagaactgtacgtaatctcagccatttatttttatgatcgatggtttagatttactgttacagtaacagcatgaatagtatcccttgctacgatgtttttgctatagtacgatgatgaacagtgtgatcacagtctggatcgtccgatttgcatccgttgatgagaactgcagtcagatccggatcccgtccaggtgcggtgagcacagcgatgttttgtttctggccggcaaaaatctcaatcttttcatgtttcttttcaacgatcaatcgatcatgcgttgcaagaggcagcccttgttgttgtttttttaattaatctgaacaaacaaactgcatttgtgctcgtgcagtgcatgcatgctcgcttgggcgaccccaagggccatcctcaatcagctaaaatgctccattatatgatcgatcaaggcaggaaaatggcattagtcagtctacaatgaaaaagcaagcagggatcagagaaagcgagagagagagaccagtggcatgatacaacaacatagagtggagaatgagatggtaaagcagagatggagcagaacacaaagatatgggcaggcagcagcagccagccagaattcgggataagattgataaaaccgaaagagggattagagtggtgcctttcgtgtggacgccatgcttatcccgcactatatctacatatctatatgtgcttgcctattattaatcctctattgtgtctgtctgaactcttaacccctaatcaatctgatcacttgattaccaattgatgatccatggcgcgtgatggcggctagctcgatcatcatcattcttaatttactctgattgctagctctttccacacgccgttcttccggtcggctgtttgggcgagccgttgcttgcagcagctacgtaccatttctctgatcgacctatggtccagtggctgccgattcagcactcactagatctcgcccgatttttcacgaataatcaatacaacaaatctctccactagattgtttttatttctccataatctccaacatacatggatgatggatgagtgccatcgagtagcgtacctaacatcttgacctgctctgctgcactttgtcatcgtcctcttcgttttctttgaaaactcttgtcttctcttcttcttctgtcgttgatctttgcccatggcagggagtccatcgagctgccttttcttcttcatctttttttccatttgcaaagttgtgtttccgttcaccacttgtcatctttccctccaaaagttcatgtctaatgtccgctcaaagcttttttcctttattttttgctcggataaaaaaagacaacagtctccacgagagggatgcctgcaatttgattaatttaactgatttgcattgcacaccttgacattaatttttgtactactacatacattttgactaatataaatatgtatagtttttttcttctcttctgtgagggaagcaagatgagagcaagcagattcgtccattgggctcgatcgaagccgttctagaattaatacagaccggtgtcttttctttctttaatttgttccttcttggattctcatgttaaaaaaagtgcaattccactcccaagcactggccgtaaatatgaagtgacaattaaggaaataatgaggtttcatccgacaaggagaacattcccctgtcaacttaaccgaatcccgcacactttgactgtatgagctagctagctacaattgttttcagtataccgtaccgtctttaggaatttaaagccctggtgtagtggcgtgaaataaaaaaagatgtcttaaaattgaaaaactcatatagacaaagaatatttatataacttcgatatatatgtaattgcttacaacgttaaggtagtgttaatttaaggtgggcttttctctgattctaagtatagtacttcatctaccagtagtaaattgagctagcaacatgcatgatcttcaatgcatggcatatgctcctttactttgaaatgcatataggaggagtatatgctaaagagagcgcatatgttgcacagtgaaactaatgtaatcatttcattcaggtacaattaatggcaaacgagtcgatcttctgcttagagtagtccaccaaatgtagtaagttaaggtacgagaggcctcttttgtcttcaagggatcttgcacagttaccttgaagctgaaattaagcatcatctagtacgtgctaggcacttactatatggcttgcactccatggtgttcagaagtcagaacagggaatcgatcagtgcaatcgactggtatgacaaatttcactgaacagtacagtttgaagatataaatgcatgggaaatttattatattattaaaggaatagaaaaaggagcctccacgttcgctctcatgacctggaaattctcacattaatcggagaaaaagaaaaggcagaatccatatagaaatacaatttagaaatagctaaaattctaaatttaaaaaataaggaatattagaagaggagactagagtccatatagaaatacaatttagaaataattgaaattcagaattaaaaaataagaaatattagaagaggagactagagtccatataaaaatacaattagaaaataactgaaattcggaattaaaaacaaggaatattagaagaggagactagagtccatatagaaatacaattatgaaataactgaaattcggaattaaaaataatgaatattagaagtagagtatagagtccatatagaaatacaattaggaaattaggaaataatagaaattcggaattaaaaaaaggaatattagaagtagagtatagaggccatatagaaatataattaagaaaaaaatagaaattcggaattaaaaaataaggaatattagaagtagagtctagagtctatataggtatttaaaactaactaaaattcggaataaacataataaaatgaaaagtagtgtttagagtccatataaaaatgcattttataaataaataaaattcgaaattaagaaaaacatgggaagaagagtttaaagacaatataggaatacaatttagaagtaactgaaatttgaaattaaaagttattgcaaaatttaaaattatgttgtcattgtaatatattttaataaaataatgagaaaatatatatgctaaatatatgagagaaaatataatgatgctagccgcgcaatctgcgcgggctaccgtgctagttcttttgatttctcaaagggatgtccactcgtttgctaaaaagtattatctcctatcaaaattcatacaatgtatatacatacaacttcataaaatcctaaatctatactcaactcacatattgagaaataataccaaaatatggtaaggtttattttggcgacaaatcaaacacatcagctggttatatattggtaatatatatagcctattaagtaattgtcagttaagtcaatgaataattattaatattagatataaatgtaatttgcacatacacaatcggcaagcaccgatattgaagaataggtgactttaaatgttcgtggaaggtggcatcatgtcgaggagcaatacaggggagcaaaagtgaagggtgttggtctagagaggtagatagctaaaaagagatggatcgatcatgcatatataacgatgcactgcactgcagctagtgtagtagctttaaaattagttggcgacacgcaatagccacaccaaaacctcctgaaaaccactataaaacacgccaagaagcgtgctcgccacactgcccatccatccactcgatcgatctcagctaattaattaagctaacaggccagccaatcagccatggcggccatgatgaacaacgagagatcaagcagcaacaagctgcaggttgacgccgagaacccggcggcggtgggcgacgagctggacctggcggcgcgcgccaactggctgcgggcggcggtgctgggcgcgaacgacgggctggtgtcgacggcgtcgctgatgctgggggtgggcgccgtgaaggcggaggcgcgcgccatggtcatctccggcttcgcgggcctcctggcgggcgcctgcagcatggccatcggggagttcgtgtccgtgtgctcgcagcgcgatgtggagctggcgcagctggagcgcgatggcaagcgcggcggggaggaggagaaggccctgccgagccccgcgcaggcggcggcggcgtcggccatggcgttctcggtgggcgccgtggtgccgctgctggcggccgggttcatcgtcaactacaggctgcggatcgcggtggtggtggcggtggcgagcgtggcgctggcggcgttcgggtgcgtgggcgcggtgctggggcgggcggcggtggcgcggtcgagcgcgagggtggtgctcggtgggtgggccgccatgggcatcaccttcggcctcatgaggctcttcaaggccagcggcatatgatcgatcgatcactagctagttaattaagctctctgctctactactaagttcatttttttttaaaacttactgcattaattaaactaaactaaaactgcatatgcatgtggacgacgatgatgttttggcgccatgagcgcatgatatatacgagcgcacatgcacgcgttcttcgtgttcgatctttcctctcctcctcgatctcctctgcttacaagagattgcttgtctagctgctccggctgcctatcgaggctaactaatagtcgatcgacgactttacgtagcaaaagtaaaaccattaagccttgtactcagctccatacatatatataataataataataataataataatccatgcaaattactcctaagtttttcttccttaagtttttgaagctaccaatcgatctctggttaattataatgtttgcttcgcgcgcgcgcgctctctctctctctctatatatatatatatatcgccaaatcgatgccatatataattaacacagcttgaacatacagctgttactaatgatcaagccatgtatatagccttgggaacagcgattaatggcaaaacaaaaccaagcttttttgctgtgggcaatcatgcatgcatgcctgctctcgcttgcttttcgccacattccctttgaacagctaaactagttatatatatctggtatttattctaaacctcatttcactccttttcttttcttaagaaaataagaattttgtcttgtcgcccactatctactactccgtttcgaaatgtttgacgccgttgactttttaacacatgtttcaccgttcgtcttattaaaaaaatttaagtaattattaattttttttctatcatttgattcattgttaaatatatttttatgtaagcatataattttacatatttcacaaaagtttttgaataaaacgaacggtcaaacatgtgctaaaaagttaacggtgtcaaacatttcgaaacggagggagtataacaaagatattttgttttcctttccttttaccatcgcggagatatggatgttctccattatatttgcgaggacgtcgtggctgttgtttgatctggttgtggagaacgggctaattaactaggcccagtttaactttttgtctaggagaagcctgaaggaatgcctgatcaatgggccggcccacctaccccgcacccttctttattagcatgacgtgagatatggctgacgtggccactggagaggccgcaccttgcatacgcatatggcacaagaaaaataatggggaatggacaccagcaatacagacaaatggaaatattgtgcattaattactactctaacttaataaaagtggagtttattttacacgaaactacgtaataggtttactcacacgttgtcagctataattggtagggttcgttattatggttattcacgtaattgcgcgggaaatatatcggttcatttaattatatagtcgtcatactagaatcataacctttttttattattttataaggacttcatccaattgcgcgggaaatggttcacggtgcaatcttgattatatatcactcttatgtttgcacacaggttagtggttgtataaaggttgagagggtgtgctttgcatgtgtacaccatctaggttggaatttgtcagcccgatgcaaaactttctttagtctaacgtactctgttatgttgattttatcagtattccttttcttattacgcgaactatggtaggcaactattgaatattggagtattactcatcaaatcgtggtacattacgatgctgtagtcgtaggagtacataataacataaacaagaaggacaaaactaagatgaactcagtttacatatctagagaagatatttccctcattatattgaacaactgttatgaccttatctactccctccgtcccaaaatatagtaagttttggttggatgggacgtatcctagtactacgaatctagacatgtctcatgtcgagattcatagtactaggatacatcacatccaaacaaaagttgctatatatattttgggacggatggagtatgttttagaaccaatttcatatatagagccatgtagccatgtaaccatgtcttaggggggcaccacaatataaccatagcgattacaatgtagcgtagacacgcagggagatgatggcggcgtggtcatggactcgtagcggctagtagctatattggttggagaaaaatatccataatcaaagccctggggatgtaagcttcagctgaacctcattaacaaattaatgtcgtgtgttcttatgtcgtcatctagcgtgttttaggtgatcaataactgaaacgatcgagaaagttagtcgtcgttctgctgtatcttttataacagaaatcacccgattgatcaattccagaggcaaggcgagttacaaaaattattcgatctctccagctacatattcaatttatcttttagaaaaatccattgcacattcccaactgctagcttaattattagaaaactgattaaaccggtagaaataaattgatgacttctagtaacaacttcaatagctagaaaacatcgatcagcaaagaaacgacagcaacactcatcatctccagctacatgcgtccatcagcatcacggcatcaagctagggtcaatgctagctcatgcatcggcaggaggagccccagcagcagcgttgttgctgttaccgttgttgatggcggcgccgttgccgttgctggcgatgttgccgccggcaggtggcgacggaggcgcctgttgctggtggtggcgacggcggcggcggcgaatgtaggtgtggagctgggcgaagagcgttgatctcctggcgtttgcacggttgatcctcccaatgatcctcagcagcacagcagggcccgggttgtttgcttgggtgaacctgaacagctgctcaagcctcctgatcgtctcatccaacaccctgatctgcatcacacacattttcgatcatcacacttacatcaacacacatatttatctgtgtgtagtacacacaatcatgtatgcataattgcatagacatgcatgatatgtataggagattttttatggtccagcaaattgtaccgctcggtaccagtacgcatctaccgttcgtttcggcatgggtaggatcggaagagagtagcgccagccatgcgttgaagcaatcaagtggcggcgagcggtggattccgacatacgttgaagcaggccgcggcggcggcatcgaactcgtccttcccagcgacagcggcgttgaagcaagcggcggcggtagcgaactcgtcgttcccggtggcggcggcgtcgatgtcgtccttcccggcggcagcggcgtcgatgtcgtccttcccgcggcggtagcggcggcgacgttgaagcaggcgacgccagcagcaaactcgttgttcccggcggcggtggcggcgtcgatgtcctcgttcccggcggcggcggcggcggcggcgatcgatcgagaatcccagcgcttctagggttcgagatgcccgtccatccctcccgatccggttattgcacgtgaagttacgtttttgcccttccacctcagttctccacgtggtactgcacagggacagaattggtaccgccggtaccaaactctaccagccgttggatcgggccagatccaacggccaggattttggtaccgggcagtaccggtaccgaccgctgtaccgtaacaacactctatgtatagatatgttacagaaacaaaaaaaaaggattgatgcaacaagtagatagaagatgagatgtgttactcatcgtatgagagatctctccaagactcggtcgatgtcgttgatctgtagatcaccgtcgccctgcaggccatgatggttgccgttgctgttgccgttaggagcggcggcggcggcggccatgatcgatacgagaccaaacttacagtactgattgttacagatgcaacacttgtgctcaagtttgaagatcgaggggtgctaactgctgcttatataagcgtttctaccaacaaaatagttaataaggctaattaatgtgtgatacacacatatacgtctgcagtgactggccacaagctgacgacggtatcccaagatttgtttttccaatcaatggtaaacataaattccagaattgataaagatctcgatttgattgctttgcttgattgaaatccaagtgtatatatcgtcaaaattgccatcatgtcccggcatagacaatgttaaaatgctccatttttatttctttattttttttagaaaatgtcattgatgcagttcacagaaaattagtaagtacatctagaacaatcggtttcatattcattacatttctcatgaaacaaaagaagataatcatgaaaggatggttaagttcagggacattttctaggttccgatgaagctatgtgtaccacagtcctgattttagttgaaactttgaaatgttgaaacatgtttagtacactaatagcaacgtacccagtcaatttttcaagagcatatatcactttacattggagggtacgcatatagtaataatagtgtacattacataattggattttctctcttgtgtgtgcccccccccccccaaagcgtgcgtgtagttttgtatgtgcgccccccccctccccccagtgcgcgtgtggttttttttgtgtgtgtgtttgggatgaggtgggaggtagtgtgtgggtgtgggggatagaacgtttatgtatgtgggtaaaagtgtatcgtacaattctatatatagaacatatttgagaacatatgtatatatgcacgtttatttgaatcaatgtaggtgcgtgggtaatttatttgttaatcattctttttttaagacaacaaatataatcagaaagagtcaatttaacccatgcactatctgtccacgaagcacccgtgcaattgcgcagaaaattttattatttcgaataaatccgtgcactatctatctagcgcgagatacgtactctgacttcaacaggaacgggagggaggaagagctggactgagaagggaggatatgcatcttctgactttggctaggagcggtaacacataacacgggaaggagaagaggcgagattgacctaggtaacacatgacatgggaatgagaagatgcgagattggaaacgggataagaaacagaaaatgtgtcgtcctgtagcatggacctcccacttcacgcgttgttgtctgctgtcacccgttgtcgcccgtccgttgcaaccgacgagccatcctccctcgcttttgctgccgcccccgctaccgcccgcatcagcttgccaatgttagagcaaggataatagtgggctataaacaagctatatgcttatgtggaagagagagataaataaaagtgtggagtgttggctctcatgcaagagctaactgcacacaaactctaagaaatatgtattaaattcatggtgagagaaagagagaggatgaagaaaataaagatagccttatagccaacctgctatacatgttagctttaacattgactaatagtaactagtgagctctactattaaacttgctcttagcctcctgttaccgtttgttgacgtcgtcctcccgctgccaatgatgccatcccttgcagccgtcggtctcctactgccgccgatgccacccgcgctggcctcctagtgtagttccccgcgtcggatgtcacctcccgccatcagctactcgacgccggatctagccgtgggggcaccggatctggtcggtgcagcactagatccaccacctcacgccagagttcgctgtcgtagcccctccggcttcccaagctccacgtagcctccctcgcgtcggagacggagtgtcgcggaggtctagccagaattttcacaaaagaatttagtaataaatccaaaatttatagttttgcagggtaaaaaaaaacacaataaaactttcattatatgtcatcaagcaatcattttaatagttcatccagaaaataattttaataaagtagaagtgatttagaagttaaaatgggaataactttgtatcggacagcatctaatggacggaactaaatcaatatattaaccttgatgttttattttttttttcgatgggatcacaaaagaagagtatgagctctgcgatgggtttttgcggaatgggggccaacgcgtttgtgcacacttctcagcacgtggtttgacctgctataatcggacgggtgagataagagttgcaagattagaccaaccagtgacggtgagattagagctacacgattaaaataaggatgtgactacacagcgagtggtagctgtattgtctaaaccagctaccactccatatatgagagaccctatccacctatacttcaaataaaaatttttcttaaactacttatccgatctacgatccgattacaccgttgtgttcataacaattaaatctttataacaagatctcacatgattatattttgatgaaaaaacataaattacttttatagtatatctaaattacttttagatttcactaaattacttcttagacatataaaaataaattcaataaaacctaaaattaatttgcatatattatagaagtaacttataacaaaaggagtgtaactttaatgcatgtcttttttttattggacgtgactacacagatagtggtagctggtttgtactccatctcctttgaacttgaaaaatgtaataatatgtatcttttttaatttctttaataacttatatctttttaaaaaggtacactggtgggcaaatgcctggtagtattcatttcaaaaaaaacttatgtcttttagatcacatattacttctaatgtcgtgataaagttacttccattttgttttaagttacttttataatatatgtaaattacttttagactttattgaatttacttttatatgactaagaaataatttagtcatatctaaaagtaacttatatatatatgataaaagtaacttacatatataataaaagtaatttataaatataaatattttttcatcgtaatataatcatgcaagatcttgttgtgaagatttaattgtaacgaatacaatggtgtaatcggattatagatcggataagtaatttaagagaaaactttatttgaataggaaaaagatatacatgtctattgagaaataaggcacacactatatcaatccttctcgttgcgccattacagcgtggccacgtggatggacgataggcgcgatcgatcggctatgaaacgcgtcgcgtgatacgactaaagcgagaagcctctcagtttagattttatgttaaaacaactagtgcacaccgtttagattttcataaattcatacagagaatcgatggtcgacgctctagcaaaatcatcgcactacaattagggtgtgttttagaattgaaaaaaataataaaagggatgtgcttctgtgctctggaaaaaaaaaacttgcacttaattaaaagggagattagcacttaattatcattagtgagggggtaatttcgtgcaaagattttcgagcccatatccagctcagtccatctgaagcgatccccaccccctactaacggcaccgccacgccgattttcgccttgccgtcgctgctctgccctcttcttcagttaaaaggatatctgagtagctatggcctgagtgacagtaaattcagtttcagccttaaattgtctcctcaaagatttgccttcaagttacagaacagagtcaataccttattgctgcaacccgacttgcaaatttggttgtacatatttacaagcaccatgaaaacctcatatgcagtctcagcgctgccacttttcaatagaattgagagaatggcattcgcaataggtgacgatggttgggcgacgccgccgacgcgcgggttgtggaggagcgatggcagcaccgacggtggcggagggaggcaggaagcagcgtggggagggagccgggcggcaaggcggcgttgcgaggggaagaagagggcagagcaacggtggcaaggcgaaaatcagcgcggcggtgcggttgaggagcggcgccgtggtggactgatgggggtggggatcggactgggctggatatgggctcgaaaatctttagacgaaattacccctcgctaatgataattaagtgctaatctcccttttaatcacagccactgattcgctttaactttcgtgcaagtttttttttcggagcatagaagcacatcccgtaataaaaagattgataatatacacaacacaagataagtcactagtacatataattaattaagtatttaattatatcaaacttgaaaatggattaaattttttaaaacttttctataggaaaattttgaaggaaaaaaagcactatttaaccttcaggaagcgtaagtgtaaaaaacgagggatttttctcccccttgtgcttttctcaaacacagccttagagcagatagaaataatataacaagaacagtaattcatgtcaataaacgatccggagggacagaagcatgacacagaacaaattcatgtctgcccaaacttcacttattcataatttgtaagtatgaaaccacatgcaaattgatacacagctggagggtaaaggaaatcatagccagccccatagcactccatttttgtgaacaaagtctctactccagttttgcagttggcacaaatacaatattttcacgataaagatcgggtagcactctactgcctcaagctttgcaagatatattgcgcatacaggtccctgagattaaataaacaaaaatatgtgtcaatatatgccaaaaggaatagtggtatcttcatacctattccacaacacacacaatcacatcttgttatggacttatatttcactgcagaacagagaacttacatggagtactgaatggcgtcacgagcagtgttggcaggcaagaatgcatcaacagcaacctccttgttctcattcttcttgtctaaaaacatattgttaaggacaataacagatgtatgcatgaccaatactatactatatgggatatgcaatttaaaccataaaacggactatgaggatacagtcttcaaagaagcgtttaatctcttggagcggtgaggagacagctcactgatgtcattgtaatgacggtattcaggatcatcagcacatactgctattatcttgtcatccttctcaccctgatcacaaaatccaatat

SEQ ID NO: 63919 - DNA, 2876 bp, Oryza sativa
gctacaaacagaacagtagaaaatatacctggtcaatcatgggcataaggccaattgctctagcacggaggaaggaaccaggaataacaggctcctgtgtggattaaaagaacacattaccacgagataatggcacaatatattccacactgtagtaaaaaagagaatggttttgaggtgcaactaaaaaactactggtgcttgttcaaaagtgtcaatgccaaaggacttgcaggctgatcccctgctctcagacactatcagttaataatgcaaaggactgttttgcatgtttaaaagaaaagaagcacaatggagttacctgcatcaggaccagaacatccattggatcattgtcttcacaaagtgtccttggaatgaaaccataattatggggatacacaactgatgagtataggacacggtcgacctgtcaaattatgaagcacagttacaaaaatgtaatattctttgacaagaataaactcctacagcttacaaatgcagacctatcaaataatacaacacagtaacacaagtacatggtggtggtgcatacttttaattccttacgtaagtacacaaaaaataattatgaaattagtccatattgttcttgaaatagagttgtggtaatgatatgcaagcaatcattttacaaatagaacacacaccttaatcagtccagttttcttgtcaagctcatatttcactttgcttcccttggtgatctcaacaacctgtggtgtgatataaatggaagccattaaccatgtaggttgcatgcactgtcaggaaccgactgtagataaagcttctagaatcgttaaacagaacaatcaaaaccactcgacacacttgttttgactcataagcaattgtttcccagcagactaacattccttgttgtttacccccacaaaaaaaaaatccttgttgtttgcaccagaatcaaatatcagtaaagttaaaatattcagtgaaaatcttaatagtagaaaaagggggaaaggtgaaattcacaacgtgcccatgagtctactagtggttctattttaattcgaatcaaaatcctagctacaatttatccaaaggtataaacagttcaagaagcataaaattcccatggcagcatatggctacacctaccagtctgccacctaatacacatcatcctgctactaccaagatttacagaaggcacatgctgcgcccacaaaagatagatgcttgatgccatgatatcaacaaagttgctgagaaactgatggagatcagcagaaggtttagaaatgttaagaacttataaatgtaagtacttttccaactaggtttatttatgattggcatctgttgttccatggcttgatcaatccacttaaagttccaggtttggtgcaataccaaggatgttgcaactgtctttaatttttgtttaacttaaattcagtggcccccattctcttgcctgattaaattggtatgaagagctgaattctaattattcattcatcatgctctttgcctggtgagtgaatttctttattccttgagagtgtcatgttacttctttgtaactggaaagtacaacacctattgaactgtaaatttagcaaacaccaaagctgtcgcggacctctacagagtcgatattaattggacagatattatttccgatttcaacatgtttcaacccgtctagcggcaaaattgtgcagcctacagcccgccaaggaaacttattttgcacgcactctggcatcatatgtataggtaaaggcagagatgacacttacaacgttgaagacagcaggagcaccagggcctgttgaaccaaattaagtgagatgatgcatgccacatagtgttgtgggtgagccataaagagagatgggaaagacagttccataccgatctcaagatcatgccacggatgtgcagctactgatctcctcgacaaggaggacaggatcctctcgttgagcttaggggcgcgcctgggctgcccagcagcagcattggtgtcctcttcactcatcctcctatgatcatatcataataggaaccatagatcaagcatcaatatagctgctatcagaatgaaaaaaaaaatatatttttaattagcttgagctgcagcctagcaggtcgagcaaacatctagcaaaaagcagagttgcaacttgcaaagttgctttcttttcccctaccggaactaaatacagtcaagctgtatacagtatacaaccccctgacctgaggctaacatccatgagatgagcatccgaacaagatacagtcgttgatccgattgatcttaacacctacctactacactcagatcagatccagggtcatgtatgaaccccacccaatccctttggaagcagaaaccaaatccgcaacaaactaaactcgatgtaatatagcttccgctcagattggacgcaacccacagaaaataaatccaagtcctgagaaatagcgcggatgaggagggggaagggagaggataccttggattggagtggcggctgaaggggtggaaggtggcggcggcggcgaagaagaagaagaaatgaaatgattccctgcactgcactgcaccctccgtctgaggaaacagtattaaagacgggtgggatgacaatttctacttaactccctccttccaacgttttaatacaaaatgagcccctaatggaagtacttgtgctaaggctagtgcgcgtcttgtgtgccaatctttggactgggagctcccatgttttggcagcaagtgggaatatccaatatcgcccctgaactttatatactcatcactaagggagaaactttttattctttctttgtgatggtagaaaatcatgtccctt

SEQ ID NO: 63920 - DNA, 4161 bp, Oryza sativa
  unsure (1)..(4161): unsure at all n locations
attattaggattttttttatcttattttctttctttcttgcttgcttgtgtggaaatgtgaaaattgagcgtctcgcttacaaatattacaaaagtatgggcgaaatgaagaagcaaaacggcaacggaaaaaaaatgaaacaaaaagaaggtatagtggtcaccgttgtgccagtaggtactagaccttttcatgtcgtgattcagcaacgttgttggagactcgagtggagaaggcgttgttggagtgcagcctgtcgccataagattggaggaaacgcgcagtttgtcagtgtgcggtgtgcctgagttgcggctcaacttgagacgacgtccgaggtaaagaaagcgtcgacagacgttgccggctcacaacggaggtggaggtaggtatgaaaacggagcggatagtttttagatattttggatacggatacgaatacgaatattttttcccggatacgaatacgaatatgatatcagggtttccgtcggatacggataatatttcggatatccggtgaacagtgctattcggatatccgcaagacccatgagacatacctcatttctttctaactctataaccttcaatatacctttatagattttaatagtagtttatctcttaacactagtccatactattaatattatttaaattttaagaaatatttataaattatacctcattttatataaaatgagctaattatatatgttgatatttgtttctattagaagttgagttggttttcgtgttccgagaaaaatttgtttccatattcgtgtccgatcacattcgattcttattcgtattcgagataatccgtatttgtttccgtattcgagctatccatattcgtttttgtatccggtaaaaaaaaatgaaaacgaatatggtatgagaattatccgaccgtatccgctccgttttcatccttaggtggaggcagagacggcggcccaatgggacggattcgtcgcaaagaaggtaaaggcggggacgtcatttgagttgggtagagtcgccaccacctattgcggacatcgggattagacggtgtcgcagcgctaggtaaagatataggtatttggtatgcttgtgtaatgtatcgaactgttaatgggcctattggacctgctgggagtaattcagtcaatctagttaactgaggttggtaattgaataaaattcggttagttagatcgtaagatcaaatcagtggccgagttttttaattttacaaggatgccacttgaacgataattttgacgatatttttgtaattttatagcggtaatcttataataacgattcaaaccaataataaatttataattgccccctttttttccaccactgggttatagattgagatcctagcgagttggttatgataaacttttccacaagtgatcgagagagagagagagagatggtacagtgaccgtgctagtagtccaattctcatgcccccatgtgggctcattcatgtttgacagcagcaggctttgcctcctcactcctgactatagatagatagctcgaccatactagtactatactgtactgtatatcgattcgattgcgattgcgattccatggcgttttggactcaaactcggttttttcggtcggtcggtcacacaggtaacaacagccaagtttactgctccagggaggctcgcaaataattacacgacgctcgagcatccaatgcagtgctctctcttctactactcttccttacctagctagtactcctacttgcccatctcagctagtacaagcgtggagatggatcatacacagaatttatactccagtactagtcgtaaattaattatcatcttgtcttatttctttctacaaggcgatcgagtacttgcttgcttacagttacagacactagaaaagtactccatgggcgaaatgaagaggtaaaacagcagcgaatggaacagaaaggaagcatggtggtggtcgtcgtggcatggatggcgtctagtgttagtagcaactcttctcattattactgtactggccatcagcttttgctgctaacgctaatagcctctctcatctcagtatattcatcagtaaaaagcaatggactgctgcttgtgcaggtgagggagtgagcgagcactatactagtagtggtaagagaagagagaaatctaagagagagagagagagagagatggatcatcaccagcaccacgagcagcagcagcagcggatggtggagatgcggatggggatggcgatgggcgaggcgtacgtcgggggaggagaggtggtggcgcgggaggcggcggcgcaggcgctgggggcggtggtgcagctgcacttcgacaagacgctggagaagaagcgggcggcggacgcgcagaagcaggagctgtggcgcctcttcctcgccttcttcctcttcctcgccatcctcctctccgccgtcgcccagtccccgccgtcccgcctccagtgccgccacctctgggcccccgccggcctcctctccctcgcccacctcgccttctacgccgccgtcgcacaccacctccgatgcctcaacggattcaggtcgctctaattgcctcttgcttaatttgcttgctactacttaattacttgcttacttacttagcagcaattaatggcgcgcgaatgaatatactaggtaccagcggcgttgccacaagctgaccctggcgctggcggcggacaggctgcggatgctcaagtccggcggcgacgtggtggcggccgccgacgtggaggtgccgtaccaggagccgcccgagagctacctggccaagttcaagcgcagctgggccatccacttcgccttcctcatcaccaccttcgccttctccgtcgccgccgccgtcgccatcctctgcttctagctctcagatctcctctcaactggactactcctccaatccaatcttactagtaggagattttgattgatcatcagatcagatgatggaagagtcgttcgttgtttatctctactgtaatccctccctctctttctctttcttgtcgtattcattgtgatttattagtagaatgttctatgttaattgcccttcagcgagaggccctcacatgcattatctcaattgtcagccagtgtcacattcactcgctcaaatcgcggcagcagccagcagccactgtggcaaaagcaactgtatttatccttaactacagtatctagtactatgatctctcttggagattggttagtttgtgagtaaaagctgccaagcttgttgctatcattattgatgtttatgcaaccaacgtcgcttttaagtaccacggcgacgatttcattgtaccaatagtacatatttcttggttccagtcctgctttctcccggccaaatcataacataaacccaaagacaacatgacgccacatcgtccagacaattgtttaggttaatcaaatcgtcattagttagagcttgttacacagtgccgcacaacacatgacacaagaagaaacggcaaacacaggtgataggctcttcaatcaacttttctcatattgtttgtgtaaaagtgtgtttctgtgaacagtgtttgttttattcgctcaaggaataggaaatcaaatcaaatgaaggaatagatgtttgttacagtgattagtagtacgtacatgtttgttacaacagcacaaatccccttccttctctgagcttggtgagttggtgaactgaatgtgtcatccgattgatgctctgaaacaatgcagcagcttcatgcttggccttgtcagctacaagccttgaaatgctgttgctgcgagttcacagcctccagcaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63921 - DNA, 7208 bp, Oryza sativa
  unsure (1)..(7208): unsure at all n locations
caggatataatagaatgaaagggttttccatggcagcttctgattgtatcttcatggactaataaacagaattcgattatctatagctggcatttaaatttttgacatgcagtgttgtttgttgggctaatatgtcagctttaatattcttgtccttcaacttctgtttcttgggctcataaaatttgatatccttattggttcaacacttttggcctgaattcatggacctatccacttttatgccagcaagaaaatttagataatggcaactgtatgtttaacttctgcttggcctgaactctttaccttttcacttttatgtggagaataaatttagacaatgccaactgtatgttgtagtttgaactttgaagtgacatttccttgtgagaaaacgttcttgttcttctggtcactccgccatcagttaatgttgaattgtagatttggatggtccagtaaatatgtgctatctgatatgctctattttattttaaatgactaaagtcagagcatactaatattgttgatgcaaatctttcaggtattgaatcaaattgtgtacgagctaccagaagagcatccattatcagagacaaagccattgcgtgaaattcttggacacacagttcctcaggttagcttagtttgcatgattctgtcgaattttagctatttctgtggccttgtaaatactgatattcaaagcagaaagaaccgtaggaagattctctaagcataaaggcagatactagatacaccttgtagcaccctaatataatgcaactgtcgaaagttcatgggtatgatacaaacacaatatcgttaacaaacacttaaaacttctctgaagaaataaacagtaggttaagtcataggacatcttacagatacattatctactctgttttttttttggggggggtggggggtgcgaatatgcagttctcattgtttcaagaagaggaggttttgcatgtgcctcagcatttttacactcttctactaccatgctcacatcggctattgggcatttcttatgcttgtcagaatcatcaccagatatacattatatgctcgtaatctaaatgtaatttcgttctcttttttatgtcaggttgtggccggttgcatcattggaatccttatagctgttgttatgcgcttagctctatggagttcttagacacgcattactcgtaggtatttgcttgatcacctcatatcgcatcgctgatgagttgtgaagcatgaaaactcaaatctcctcttggatgtgatttgtacaaatgctcagttttatgactatactataaggttcctaaccggtgtaggtctgcgttgtaggaggtagattgtagttcagttggtgctgtacatcgtagaaatttactgtgaattggaagctcatgtgatcaacctttgttatacaactggcaatgatcatgctgtcaacttttctttctggcacgcagtgatattttaagttctgcatcactgtccttagtttattattttactgtgctgtgcttgttagacctagaatgttactaccatacaaatgtcccaaaatttggtcctgggcagtactcagtagtgtgtgtgcctatgctgttttactgtcattcatagttcagactaatctgttttcctctgaatcctgaaatgcaagaactttttgttatttcctctcggtgaacctgatatatttgatatttcagaatttctagtgcaaacaaacaggaattgttctctgtttctctcttacacagatcacagatcaaacaaaaatattttcttaataagtatgagcaaagtactcggagaagttacacggagagaattattaccaccttgtatatatatgtaagtattctaagagtaaagtttgaagcctcgtccttattatatgtagctacaacgatgaggtatacatgtgctcaggctctcagagcttgcacggcgacgatgctccggggtggtgcaccacgatgaggttgtacgcgtcgagcgtgaggaagtcgtccagctccggcgcggtgcactgccggctgaagatcctgccggcctccgcgtaccggccgcgccggaacctctcggcgcccacctcggcctccaccctcgccatctccacctccacgacgcgcgccagcagctcgggcgtggcccggacctccacgccgccggcgtccagcaccgcgccgtgccggagccactgccagttctgcacccggctgatctccgcggtggcggcgtcctccatcaggttgtacagcggcacggagcccgacccggatagccacgccgcgacgtactgcacgccgacgcgcgtgttgtggcgcaggccctccaccgtgcgcgccccgcgcggcggctggagcaggtcctcctccgtgacggcgacgccggcacgggcggcgtcgccagccgccgcgtcgatctggttcggcctccctccgaggtgtccctcgaacacctcccggatcgccgggatgagccccgggtgcgccgcccacgtcccgtcgtgcccggcgcgcacctcccgcagcttgtccttgcgcaccagctccagcgccgcctcgttcgccgccgcgtcgtccttgatcgggatctgcgccgcctgcaccacatcagcaaccgtttggttaatcaactagctcgaggagctctccaacgggcgagtggatcgatcttttttcgatgactgaccatgccgcccatggcgtggacgccgcggcggtggcaggtctggatgaggaggtgggagtaggagcgcatgaagtgctgggccatgccgacgagggcgcggtcggggaggaggcggtcggggcgggcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccccctccctatccccgcctccttctccgccctctcgaacacccccttccatatcctcgcctccctgcattaaaaaaaaaagttacatacatcgatcagttcaacccaaaaacgtatgttggtgataaaaatcaggtaattcactccatattctaagcactctccctcacgcaaggttccttaagtatcaaacgtggaatgaaagcggggctatttttttttattaattgcgtaccagccagaatttgaacttagatatgcccatgtcttgatcatcacaagctttgtgccagtgcgccatggatggatgtgtttgtgcgtgcttacctagagtgctccatcttggggaggtagaagaaggggccgaagtcggcgccctggccggagcggaaggcggcgtggctgtggaagaagtagaggccgaagtcgacgaggcagccgatggccggctcgccgtcgacgaggacgtgcgcctcggggaggtgccagccgcgcggcctcacgaagagcgtcgcggggcggtcgccgagcctgtactcccgccctcgcgccgcgtcgcggtaggtgatcgtgccggcaaccgcgtcgcgcaggttcacctgcccgcgcatcaggttctcccacgtcggcgacagcgcgtcctcgaagtcagccttgcacccacaataaccacgacgtcacgctcacgccacgtcaagatcctcaccgatggcgcgccggagttgtgtgctgcttaccatgaagaccttggcgccggagttgagggcgttgatgaccattttgcgcggctcggcggggccggtgatctcgacggtgcggtcggcgatggccggcggcacgggggcgcacgcccagccgcctgcctcgcggacgggcctcgtggccgggtcgaaccgggggagctcgccggcgtcgtaccgccgctgcgcctcccgcctgcgctccatggcgtaccggacggcgccgcggaactcgcgctgcaggccggccacgaaggccagcgagtcgcgggtgaggatggccgcgaactccgggtcgtaccggccgaggatgtccacgccctccggcgtgtcgtagcacgggcacggcggcgctgcggcgttggtggccatggagtcagtcgagtggaattcgttcgagcaccgatcccaagtgtgagtagaaaatgggagtgtgcagagagcgtgcttccttccgttgtataactccaaatatatacgcgagaggtagtgtaaaatttgaagactatcgtctttgatgatgtggcaaggatgaaattttgtcatttttctccaaagagatcaagattgcactagtttgtaatgctgaagcggactctggaaattatcatgatgctaggttttgcagagccactacaatttgaaaaataagtgtcatatgcacaacaacaaacatagcaaccataatccatgcataaactgccttatatagcaatgcagtctaattgtaaaaagaaggaaccacagttcaaagtacttaatttgtaggtgtggccgaccgttgattgctggggattttgttttacttaccagttaccaacctacatagatgtcaaaagctcctggcttattttcagagagtaaccatacacagttcgtttcttttgtgagagaggaatttatggatggactaatgaagaggtgctccaggtttctaatacaaagttaagtaattaagccctttcagaaaatctgagtactgaagcctcaccaaaatgactaattaaggccaagtttcgttgtctatgcgcaaagcagctagctggtgttgtacaagccaattcaagctgaattaatcgcgcatacatccaaattcatcacccaattaagttctgtagtttgcagtttctgagctaacataaccgtgtttgttcactggcgatggtcgtgttaagcgcgggaagctcactgtgtcccatcagctaaaactgtatatatgttattccaaataaattgcattagcttgtctaacaaatgacactcaactcacgccactaacctttgctgctttgcccggcgtgtgtttatataaggcgttggatgagatggatgacgatgcggcatgcatcagcgtgcatatggagacggatcagtagacgtggtggttacgataaggcagacggggagcaagtgcggtgcgcatcaatcagctcgatcgcgtgcgtgcatgggcacttacgtacagcacaggccagcagcaggaggaggtaataagcgtggcttgtttcgttggcgcaccgagagaggcgagtggctccaaaccgcagcctttggctgcttgtgcggtttctctccttatccgcatgaactgcccaatttggcccatttggggaagggagagccgtgccgtcacgcccccaacctccattcgccgccgccggcagccgactatacggccagcctagatgaaaaatctcttcgggcctttccgaacaaattaacctcacggcagcggatcgctgcgggttgcgcaggtacactgggctctcgcgttttgcacgcaacgcaggcgttggacgggttcgatcggccggcggcgaaacgtggcggttggagaacaggagaagcagaaattaagcgtctttcacgatggcgttcttgtgaggtttttcttgtttcgttcctcttatcgtcaggtgagcgccgaggaggcaggtggtgtggccggctgcaaaagaagcggattccgcgcgtgctggcacgggtctcgtgcggcacggccgcacggtgattcgtggcgccgtgtgtgcccgtgaggttcgattctatatcggggggcgaattagactgtcgtaggagcaagagcaagtttgatagtatagtcaactattaactccaaatcatctataatcaatttaatagctaattcatacaatagttatatactacactattaatatctagtctcacatatcatacacactatgtcttgaagtccatgttatagccggttataaatctgtagtccactgctcttctcttatttttttatctttttaaaatatgtttatagttggtttatagcttgctactgtacctgctctaagagcaaggataataataaaaccaattgcttacttatagcctatctatcagctcactcatacagtgcttaactcttcactataaatatatggtccacctatctgtctcacagatatttttatttatatacctaagccgactgtaaacttacagcccgcttctcatctctctcctttcctgtctcattcatctcagctgtctgttatacttgctctaacgtgagtgcgtgacggcggtgttgatgggcgatagaggcgtggcccgcactgtggttggccattcggcctactcagcctcggccttggcggcctggcttgaccaggagccgcagcccgcagccctcgcggggctctcggccggttcgccagaaggctgggcgggtacgctatgccgatgggctgtttttcacttgtttcgccgggcctttccggggacaatgtccgcatgtgtgcgtcgtgccctttctcagccagaggctaatatacttttcctccgcagccactctcaaacatgttaaaaagtagtactgtgtcattttattatgccccattaatacggctccagatttcagatttagagtttgtatgttaaaatgtatgttaatatgcccgtgctaacactacgatgacgatatatgataatacagatcatacaatttaaaatgcatcacacgtgttctttaatcttcatacaaaatttaaagaatggcataaaataaataccgtttcttgttttccttcacaatactgaagttttaatcctaaaaagtatgataatttacagagaaatttgagcactcgatacaaaactcactttatgagcttctctcatcctaggtggcttgttgccatgtggtaaagaaaaatcctgcctagcttcaaaatagaattgctccacctcctacttccctgatttgctcatgtagtgaagcaaatgacatgcgatttaacgggaaaaaaacactaatattttaacactgcttgtgacatagctagaatgagtatctctgaacaaatatattttttaaggaaattcgagttcaataattaggtatagctatcagtcaaagagcatcctcagtagctcaagcagtaactacttaatttactgattcagtttgaaggagccgaacaatctactacagactctggtgcattagggcct

SEQ ID NO: 63922 - DNA, 7829 bp, Oryza sativa
caactccactccagacccaacttctgggttaaatttaggagttggagctataacaaacaggcccttaatcacgaaaaaatgtggatcagcaacaattatcgaagcaagaattactgaatcatgagtactaaataaaaatgataagcaccaaacctagatcggcatgagtaccaaatggaaattgataatcataagtactatcgcgacattgaaggtgaaatacagttccatgaccaaaatgaactattctagtctaatgatgtctcgccagagctcattctgtcaactattgccaaacaaataatgtgcatataaagtcacacaaataccaggttattgtgtatgctagactaatgagaagtaatttaaatgagaggcaccttagcacttagcagctagacatttatttctccatatatatttctacaatcatatattgacatataccacttgtataggaagcagaaaagactaacaaatttgtacctgcgttcacatgatacaatcattctctgtgataccaagaactacactgataacaaatttggttcttacatcatttggctttttctaattgtagaagccattaactcagaaggttcaacctccatttttctattcttcatcgcattagcaatcttaaaaatcatgaaatatgcatgtacacccgttggttactttcaaataccaggattcaaagtcatggcaggatttacatccatatctatactacaaatgcatcaagatacatggtgtaaaggtcatagaaataagtgattgtcctgccaaaaaaggtgtatttggttgagattggctttgttagaaatgaaaagacaaataagataggcaagatgatcttaattttagctgctagaattaaggccatgtaataacaaataggagaatttcaaaaaattaaatgattttcctattcaatctaatagtgttttgactttgtgattccttcatatggaagggcagccaatttgtaacaaaggcggaaactgggactatcagatcgtaaaaaatttctaaacaaatgcataatctcggaagtgaagcctaacctattttccttaacagctgaacacatttagaacaaagtcagaagctgagacacctgaacaggacaatttgttaagctatttctaaaatctagatctcatgttagtccatctaaatgttgtgcctatttacattctgagctttaaacttattatacatattttgaaatatataccatatgctgaatctgaataacacaatttgctttctataggtattcataaaaaaaatgcagcaatcctgtataacgtattaacgtatacccaaacaagatgatcttggttatatctactggaaattatgcttggaattgattcagtaaaatgaacttggccaacaagcagaaaaacaacagccgtgcagcagtcttagatctatgtacaccgaataccttgttttatctcaaagggaatatccgcgacagacgttaatatgttcatggcaaatcacaatcgaaaataattaagtgatgacatatgcatttcagcatatggcatcactttattattatgcatttcacactaaaaattatcaaaaatccagtgttaattaagtgatgccaacaacaaagaagattgaaataaaagtgcttgtgatagcacctcgcaacataataatcacgtagagtggatagcaagcacaaaaacaaaatagtgcagaggagcacaaaaaggagcaagaaatagtgcagaagaggataactggcattaccttaaatgcagaggatgttgagcagtagtgacctggagcagatatgctacaagaaaatgtaagctgttaaaacaataatattcagttagaaaccaaactatttgtttccattgaagattgtttaacagagtaaaaaaaaatccatgtgagagactacactaaaccgaccactgcagccggcagctgtataccgagccaaccaaatgaaatcaaatcagaaccttggagctgcattagtttgactacaaataagcgtgagaccctggggtgcagcggcgattgaacctgagatctacttctctctttttttctgcaatgtgcccctgtgccggcatgaagtatgaacacatgtgccgtcgttcacctatacagctccagcaatcatgtgccatcgtttttattgatggaagagtagaaaaaaaatctaataccatgggagattgatttattgcaaggagcagggtaatctgtgaccagctgaatttccagccactataggagcatctccaaacctccaattctgatattttggctatgattataggtctcgagcaagcaaactgatgttgcaatgattttagcttcaataggaaaaaaatgggtacaaatcagctgcatgctaaagatgccatcaataacaaagtaacttaacgggatttacaaaatgatcagagagccatgatctgactctatccctcccaaggttgcgctcctacagaacaaaaacgagacaataagcaagtttcaccagcaaaatgcgtgaaacaaatagtaactcattgcacagatttcagttggcaactaaacatcgaagtttgtgggataaaattttggggagaacttactgctagcatatgggaatttgcctgcgcaatctgccagttagcgagccgcagcttctggcccatttccgctcaactctatgattttgctgcatgcaccaaaacaaagcaaaaatagagtcaaaccaagagcacatagcatcaaaatccccagccactcaaagcctcaacagaagggatgaactgatgcaaggaatcatgtggtttcagggacgtactccctctcctcaaggagccccagaggttccgagttctcctggaattgacacaaaatttagaaaaaaatatcaccgttaaattagtagcaatctcatgaggagatcgagattaacagagagagatgggatcttgccttaccagctgcacaattccctccttgcccgcatccgctgcacacaccggtccgtcatggtccatgggtgtacctcctcattacagccccgcccttggatatcgagctcacgccattcgcggccatcctccccggtgcagcagcggcggccgcctccgcctccaccgctggcagtgccaggatggcgatctggtgggggagcaaagacgacagcctccatggtggctcgtctcaatggaggaggtgcagtggcatccataacgcgaggcggagatcggggatccgcagtgccggggcggggtagggtttggggatttggagtggcggcacgacggcagcggcggggtaggatttagggattgggtgtggcggcgattggcgagtggcaagaatcgcggaggcgatgggtgaagggaacgggcgaaaatagcggtgcgagagagaagggggcgcgtgagaacgggagttacgctgtcacaccattaagatctttcccaaacctaaattgaatttataatccatcagagaaaatatcggtgtaagagcaaaataaaaccctaataaattaatgtaaataataatcggatttgttatgtggaatttttattgagttctacatgtagaaattcgctaacaagatttttagtggaattctcagagctctagaaataattttaaccaattaaaattgagcacaagcaatatttaatcctagaaaaatccatttccttctttttcccttttttttcttttctctttttctttcaattgggccgccggcccattctctcttccccccccccctctttccgctgggccggccgacaggccgaggcccagccgagccggccgcctcccttctctcccccggggtcaccgacaggtggggcccacctgtcgggcctgtccccttcctccagccggcgccgccgcgctccgcaaccgccgccgcgcccacgttcccgcctcctccgggccacgtcggccacgcccgcgcatgcgccgcgtctcccgcacccactccccctccctctcgcccgcgcccgcgctcgagacggccgggattcgaaattcgaatcccgcctctctctcctcctccacctccccacatcggccggcgattcccgcctttaccggccacgtccgggctccccctcctctatttaagcaccaccgccaccccctctctctttttccccatctcgccgagccctcccgagccctctaacgccctagagccgtcgccctccccttcgccgccgctagccgccgagccgacgacgccgtcgcgttcgccatcgtgcgggccaccgcgtccacccctcttccgttggccgccggaacccactccgcgccgttcgccggtgagcaccgccatggccgccgccttcggccggcgtcctcgccctcttccaattccctctccctctctaaccccttccaccgtgttcgctaggtggttccagagatcgtcccgctgtcgccgccgccctccgtcgctagccgtcgtcggtcgtcgtcggtgaggtccctcctccccttcctctctctctcccgcgccgccgcttagccgcttcgccgcccgcgtcgccgcgacgccgtcgccctccgccgccggccggtcgccgtctcgcgccgccgcgcgccatggccgccgggccggcttgagccgtgcccgcgcacgccggccgcgagccacacccgccgtccgatctacccaggtagatcggggccgtccgttcggccgcccacgtggctgccgcgtggccgctgcgtcggcgccacgtcagcgccacgtggtgcgccgtcctttcccggtccgtggactcggtccaccgcggaccgccctcctcgagtcactgccatgtggggcccgcatgtcggcgccgccccatctctctcccgggatttatttattgcgcaataattcaattaaggatttttctgtttatagtaaaaacacagtgaatcttctaaaattcatatctaattcacccgagctccatttaagcccattcaagtatcagtaaatcaagaaaaatgtgtagaatccattgaaaatggttttgttctctgtttcagtagtattatagcctatttgtattgtttgctttgtatgtcgcttagattttggctctcccgacgctccggtgtaccttaaaatagtcgccgaagttcctccagctgcagagcaaggcaagtcatgcttgccacttgaacatgttgatcctatattgcaaatgctccattgtttttcttcaaatactgcattgttttataatatcaccatgggatgtttacctactgtcatagccatactatcttgtaccatgttcctttgttagcttgggatataacatgactagagattggactagggaatgcttagctttgcttagttcaactagcacacaatggggaactacattaaatgcatagatatcagattctaggattgatgttggttaatgctcaccactccggtgttggttaattaattaatattaaatggtgggccgtgggtgcatggttttgatggtcgcgcacagggcaattaaggaccggttcgcgggaaaccctggaagaattcctcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcatgagaggggactgcccgctgccttgcgaggagtgggggtgaaacctgaggtgtggtgtacttggttagagggggttatgcgaagggtcctgtcacggcctctttccggtatgtcgtggtggcatgtcggcgcgcggaaacgtgtcgtggggctgtgtcttgtgggtatagttgtacacctctgatcagagtaaaactattcgaatagccgtgcccgcggttatgggcggtcaaccaaattcaccgtgattagactcaccctagactagtctaatggaattgaatagtataggtggatggttgggcctgttgcaacggggtatagcgttggacagtggatgattaatattgattaattattacaactgttttactgctttcaacttctgtttataaatgcccgctttatgcaaatgaaccattatagctatcccttgataattccctgcatcatacccctattccggtatgacttgctgagtacagtgggtagtactcagtcttgctctattttccccaaaccccagaatttgagtatgcgtcagatggtggtttctctgaggagtaggcttcgtccgtgccgtcgaggatgcctgtggagtggtgttcccgctgcagtccaagtcaaggcttagctccagttatcctttaagttttccgctgcatttatgtaagacttttataatatttgtaagacgtggatctgtatgtcaactttgtcgtttgtgtaccccggccggtcctggacggggactttaatgcacattctgcttggaattctattcgggaatttctgggcgtgacaagcgcggagggaagggggtctcatctggcacgttcgattagagttagatgaatatgagccattggatttgatgaatgagtaatgtaggtgtaagagtgagttagtgaattatagggtagaagatagatgggaacttattaattcatccaattgttgtaacataatcgcaaatcaaaatctatatatttatggagctagaaaacctatctccatgcaatctttagtccaaaaatgtgctaaacaggatccaaatatatggcatagttgccttctttttatcagacttagataaacaatatctatttaattacaaagtaaagtgaaaggagtatctctaagttgtcatcgaaccttatttgcacaaatattactagagaatataaatagtcaaacaaaatttaaaattcaacttcgttatatgtttagaaatagtaatagcatattagaaataaggatttgtagaatatttaaagattgatacgcttatatttttatcgtatccttcattacatctttatccttaagaagcatcagaacgtcacaattttataaccagtgatatagtgtcgggatacaaaaggaaggtgagaggctaagaataaaacgagaagctcatctacatcaattgtatgaagtagtatgagatagaggagtggcaacaaggacgatattgtgcatcttacgcaagatttaaagtgcaacccgaaagaaaatcgaggttagtgaatggacctactagcgatggtgatgatctattgatggtgttgtttggggtttgttggtggctatattttagggcatattacacgcttgcttgaaagtgaagaagcatggccagcttcacatattgaccgcacatacaagtctaaggcaaaagacaactatattccgcgctctaccttgtttttctagggctcaaaccgtaaacacaagttgctatgggtttagggaaaccactccagttttcatcctaatcgacatctttaacacaaatgagaacttgatcgattcctcgtattgttcaactcacaatcatacaacatgagagagtgtgaaagtcatttggaatagatatatgggatgttgagaaagacagtataaaaatgatgtaataggtataatcatcatttttatcatgatttgccgacattctaagataccaaacaatcagcctcatcggatgagcatatgaaaaaaaaaaacgccaactgacgtattagccaaaaaaaatatataatttgtgattagaacttttacaatttcgtggcagggggaggatggtaaggccccgtttagttccccaaaattttttccccaaaa

SEQ ID NO: 63923 - DNA, 8604 bp, Oryza sativa
gtccgaaaagcccttccgatatccggtcaaacatccgatgtgacatccaaaatttttttttcacgataaatgaaaaaaaaaaaggccatactgcccggctccaattatccatgaccgtctcgttctcctttcctcactccgatgcacctgccctcgccgactcgccgttaaatgccaccgacacactccactcctcgctgccgccgccgccgcatctgaccacccggcgatggcgagaccggcggcgacggcggcggcgccgaaggcgccccctccgaagcacctgattgcgctcgccgtcgtcgccatcctcggcctcgtccttgtcgccgacttcctctgggcctcctcctcccccgccgcccccgcctggtcctccaggatcgatctccccggccgcccggccgccctcgtgccaccctcggggaagaaggtgatgctcctagttcccatctcgcagcgcgcacacacactcttcgattgctgcctccggtgccttctagtgttctgtgtggtagtacggagtcgcgcgcgattagtgagatctggttggaattaggtatgcctctgtggtttggttggactagtagaacacatctgggttgattggtatcttcccctcgacaccaaatgccttgctctctagttgcacttatgagctatagtttaggcatcacctttgatagtactagcaggttgattgcttcctgaagggtcttgatgtgccggttgtgaaatttgcaacagtatttttgcttcttaggagaggaagaaattaatcatgcattcatgcctgcaacttctggttgagatttcagagtgaagagctgtttgcgaacagtaatctttaggagaacccgcaaaatctatactcatgctaatgtttatgaactgtaatctctgtgtttttgaattaacataggcatggaagcagcaaacacatgctaaatcatgtccgtttcaccatttgtttgagctagaagcagcaaaaagccatctgattttcattccgatcccatgccggattaaattaagactacttattttgctgtaactgccagtttttgtttatctaggcatatacagtcctaccatctaatctaatatcttggtcctacacatcagagtaaacacttaattatgtttgatatcttatttctgtgtatactgcatgaatttggcaagtgttgtaaaaaatgtaaaaactcatgtatctcacttcgatatttcttccccttcccattagttttattatataatgacttatgctatgaggactgttggcgtgatctataattttgtatggcattttcaagttgacttgttttttaagtagtcgtttttttttaattttcttgtgcagcaaacaaaggaaaaaatatctataggttccacggacataaatgcaacctttgcagatttgccagcaccagaactacaatgggaggagatggctgaagcacctgtgccacgtttggatggtgctgctatgcaaattaagaatctcttatatgtgtttgctggatatggtaccattaaccatgtgaggaagcttccctgttatctctcgcatccagtcatactttgtgctctttttcttgtatttataaaatctcttgctgaagaacaacatatagcatgcaacatatttaattggtgagttggggttacagcaacacattatacttgttccctttcagcaatcaatgacctagatgtgtaattggacttatcgttttggatcactcaagttggctacctgcaccattgtttttaatgaaatataaattcacataatattgtcaagttgtatagatgacctgtgttccctagcttgtttaaacatgatcttccttactaaaacacaattgaagtacttgtgcttttggttagcgtgatcccattataatcatttttggctgaaagtttaatattaatggtgtgtgtatatatggcttagtattgccagattgtgaattaacccagtaattccttgccctgctgattttgttggtacttttaagtttaccataagttaattcaagatgccatcaagttatttaaccttttctaatgttttccatgtataggtgcattctcatgtggatatttacaatttctcagataatacatggggtgggaggtttgatatgccaaaggaaatggctcattcacatttggggatggttacagatggaagatatgtttatgtggtaacaggacagtatggtccgcaatgtagggggcccacagcacgaaattttgtgctggacactgaaacaaaagaatggcacgatttgcctccattgccagttcctaggtacaaacagtgttgtatttaggcattattgtacttgtatggtcatgcactcccgttaatcttaatactacttttgaagtttggatatttggtctgttgtatgctgtcaaggaaaaacaaatattgttttgagcccttatttgtttctttctttatcccaaatctattgttcagatatgctccagccacacaactttggagaggcaggcttcatgtgatgggtggcagcaaggaggataggcatgaacctgggcttgaacattggagcattgcagtaaaggatgggaaagccctggaaaacgagtggaggagtgaggtaccaatcccacgtggaggccctcataggtctataactccccctccacatgatttctattgttgccatttttgttggaaagtaatgttgctatacacctgaatggtcttgatgtttagcatctgttgtattcagatttttatgatgccgcccacaatatgtatgcttctaggctatttctttgatcaagtatctaaattaaaattagttctgggccagaaatatgtttgtacgccatacaaagttcttatgtggcatataagtatataacctgtttccgagaatggtcctgttgttagcttagcagcttaatcatgatttttctcttttgataccagggcttgtgttgttgctaatgataagctacttgttattggtggccaagaaggagattttatggcgaaacctggatcacctatatttaaatgtgttagaagaagtgaggtatgctgatctgtagctcaatcactatatatgctaatttctgcatattgtataggaatttgttttgtacattttgaagttcgacatggatcacttttgacaatgaatagtggaaagtctggttccactgaaggcacaaaatgtataatgtgttacccagtagatggtgatttaacttttgagctgtccgcttaacctgttttagcactttgtgaaattttacacctcctagagacctatgttcattgttttcttgtaataacttttagattttgttctatagtcattttgatcttctgcctatgcaggtggtctacagcaatgtctacatgcttgatgatggaatgaagtggaaagaatttccacctatgccaaagccagattcacatatagagtttgcttgggtgaatgttaacaattctctcattattgctggaggaaccacagaaaagcacccaataaccaaaaaaatggttttagttggtgaagtgtttcggttcaacttgaacacactggtacatgcctttccttgctccatattttagataaaacacttaaagtgataagaaatgatggatataacatgaaacatcacctatcaactgcctgttgtttgtttgtcgtgtggtggtttagatacttcttgttttgcatcattcttctgtttataagcacataaacccagtacaactcatcatcataaaatctatccacagaacaatatgaagccaagaaaaaatgtaaatcagtaaatggcaaacactacgaaaggaaactttggaaagtgcactgcatgtcagtaatttcctcagcttgtcaactttgtattgctactaaaactattttggcatacaggaatggactgtgattgggcggttacctttccgaatcaagaccactctggtaggatactgggatggctggctgtatttcacttctgggcaacgagacaaaggaccgaaagacccttctctagaaggttgtcggatgcatgtggagaactaagttgcacctgtgagatttttagaaggaaaactgatatgaccattgactaagcccattctttatgcattcttttgggtacataactgttccattcccctatggtgggcgagttgtttattatcatacgaattgttggctttgttgtgcattgtcacatcatgccactaatctgttgtatgcttacctttttggttatatcatagaatgaccgacttttacgcaattttgtacagagaatcagagataattgatcttctgttcagtgattggagtgtgacagatacatttgcacttgagttactctaggttagcaatactggtatccagtgggtaagcattcttactgttacttataaactgcttacatagttcaacataaataaccaccatcaggagactctgcagtaacttctcaactggatttgagcccatattcagtatcctaaaaacatcaacttggtatttgactcttgagttattctggcagttgacttcagctctatcaacttaacacctgtcacatgctctctgtggatgtaagtgcatgttctctgatacctggtactttatacccgtgttaagctttattaaagtacgctggatggttcgctcattatgatttatgacctaatgtttctgttagattccacgtcttggtgttctccaagacttggtttgtgccacagattgttttcaacttgttactgttgatgaccacaaaaccccattcccatgaatatttttgcacaggaccatggtcattggcaaagcaggccatatcgggaggaaagctattgctgatcgtgtagcgctttctggcttcctgccttttgccaatcttttcatctcttattaattcccctttgttttgatgtgcatcaacattttttaggctctcatcgaactgcactcctgctgcatccagcttttcctgatgtttcagcttttcacaaggccacacacaatggcgctattagcgtgtaaaacaaccatatatccctatactaagtagtgtctgtatagtgctttcgttatctatccaaaatgtagtctaaatcatgcaacgaagtgtcgttgttgggatcacaaatagtctattgtttatatagtcctttcatcatccagcctaatgtaagtcataatcattcaacaaagtgtcattgttgggctcactttttcttctctataaaaagccctaggcatacacaaagcttatatacagttaatcacagcatcacacacatcaattggcaatagtctcctccagaaaaaaaaatcaatgggtaatagtttcatggtaattactacttagtcccttgccgtgccatttggggtccccttctcttccggtctaatgaagctgcaattagcacatgtgggagactttgcactttgccggtcatctactggcgctgtaggccatccaaaagcaacatctcagtcggacggagaaaaaatccccatcaaatcgcagagatttcacgtgaccagtccattgcaggatggtgatatctctttcctcggccgcatgctcatgatagacgcatggcacatcgctggtgcctggatttctaaacctgattagatatttgaagtgaagaagcttctttaatctttagtttggccctcttcctcgcttataagctgtataagaattggtccttggactctgattagggggctaggggccaaaggtaggataccggccgtgttcttgttcagctgttctccttttctcggtagaatagtcgacatgtcttagacaatgaacaccctttagtaaataactgggtctttttgtttgagctgcggcttacaagctacaataaaatttgaattttccggtgtcaattagtctcaaatattgaaatatcaagactagaggtgtaaaagtctaaccataaaattattttctgtttagtcacgtgtctacggtttaaaagtaatactctgtgtccaaagatacacaagatttttactataccggtatccatatacatataagggattttagctatataccagcggagggagtaacagataaaaaaaaacattgcctcagcaaaagtctctagtagttaagctaaactgctagtaccatttttataccaaaggaagctaaactagaacggtagaacctataaaccactgctgctccaactttggtgaacacccacggagttgtgccaaaaaagttagtgggggcgaagggcccaatttggccattttcctagtctagttgcaaggcttggagagagtagtcaccgccttcaccagccgaaaaatcgtgtagtacaggagaggtcgccgcggacgacgcgtgcgtggacgggcgcagcagcgagtttgcatcggcggcatcgcacgcacccactctcccttggcccttggatacatggggcaatcgggcacgcagccacgcaccacgcgcattttgggattcgattgcaaaaaaaaaaaaggagtccaccgaaatggacgaatttcggaaaatttggatgaattttaatcaaatttaaaccaaatttgataaaaattggtaaaaatgaaccatatttaggtgaaatagaagtgaattgttgtcttggaccttaccgaaatgggtgaaattcaccgacattcggacctttcggaccgaatcccagaatcttgaattggtgaacgggacatcagccgctgtcgtctagcttggttttcccgttaccagctcgtcggcttgattcagctattgcgtttgcatcatctaaaacgaggcggtcgagaggatggggaatcgggatagtagcgtaggttggtggcttcaattttattttcctcctccgcgtgttgtgggtgactgggtgatgggctcggtagacttggcccgatacgatggcaagcacgtggctgggcgggggatcgaacggggcagatttttgggcgacatggccgcgcgggtgagtgagcagtaacagcgtgaggattataatattttatatgataagctattgcatttgcattattgcatagtatctggcttgcccacaaataaatcacgctgttaagaggggttagtcgctgtaaccaaaaacatggtttatactactctataggttggcaaagtttggtttgtgaaggttttttttttttttgcaagattttttaaggattttagctcggttgtgcaagggcgtggagctcagtggctgcatttacttaaacaaattatttacatcctcagtttactatgtaaaggatcacataaataagaaattaagtttttgaaaaataataaatgaaaccaattgagaataataatatatatggaccctcttcctcctatgtcgtctctttcgagaatgacggcaatcagaaattaattcaaacgaatatcagttggtgttatcgataaacgaatgtctctatggcaatctgcatttggatcgagggttatgcttaattggcacctgcaacgagcgtatttcaattattgctatctcacgtagagcacacaaccaatgattcctaagaattgaggtgacggtgcactcctatatgtccctcaaatatgggacaagaaaaaatcaagtagagaaaaattagtcctcaattgtactagtgatagagcaagttgaaaccgtgcagtatgccatgtggttagagctcacaaaacttaaaccgtggtaatccatagatgagcacacaaaatgaccatccaatccaatgagttgattcactctcacaacggcttctatttggatagcatatattttatagattttccacatgaaatagttccatttctctaaatttttcagaaaattcctcctatttaaataggctcttaagcttaggcttacgtgccacagctatagttataattttcaaacttaattttagaacatattttatttttacacacttggatttaaactgctaaaatagaagtgtaaaatctgtactgtaaaattatttttgttgcatcaatcatcttttttcctctcacaagacacaacccaaacaatatcttatgaaccatcacaaattcatgatgaagatatatcttacattaatgacatttataaacggctagagacagattttcacccagcccccgaactcaattcaatggcacaacaaccggactacaggagacgaatccacgacgatatgtaagctacgcaactcctaaaactctctttaaaagacggtagtcctacattgaaaacactccttaaactccttaacaccgtacaccacagttacaaaagcacacgtgtcgtggagcccgaaaatcgaccgagagggaaggaaccaggccaaaaaaaccgcaccactccgcgcgcactgtcactgacgaccacggggacagtagtcaccaccaccaccaccactgtggctcggtcacttcttcccaatctcattctcatctccctcttttttttccaccaaaaaccaacccctccccctccccgtcgcagcgcggcgcagcccaacccaaccccaccaaaacccgcaccaccccccatcatccgctcca

SEQ ID NO: 63924 - DNA, 8066 bp, Oryza sativa
tccaacaacgcgctggtgggggttatcccgcccgcgctctgcgactggatcccgttcgtcgtcaacctcacctctccgggaaccagctctccggccagctccccagcgagctcgccaactgccgcttcctcaactcgctcaagctctccggcaactccttctccggccagatccccgactccctcggccgcctcgaccgcctcaagtcgctcgacctctccgacaacaggctcgacggccagatcccgccccagctcgccacgttcgggaaggactccttcgccggtaacaagggcctgtgcggccgccccgtgtcctcgcgatgcggccgcgcgctgagcggcgcgggcctcggcatcgtcatcgccgcgggggtgttcggagccgccgcgtcgctgctcctcgccttcttcttctggcgttgcaccgggaagagcaagggcggtcgccgccgccgccgcggagggagcgagtccggcggcggctccgcggaggacgggagctggtgggcggagcggctgcgggcggcgcacaaccggctggcgcccgtctcgctgttccagaagccgatcgtcaaggtcaagctcgccgacctgatggcggccacccaggacttcagcacgagccacatcgtggtggccgggagctcgcgggcggggacggcgtaccgagccgtgctgcgcgacggctccgctctgacggtgaagcggctccactcgtgcccgttgtcggagaaggcgttccgggcagagatgggacgggttgggcagctgcggcaccctaacatcgtgccgctgctggggttctgtgtcgttgaggatgagcggctgcttgtgtacaagcatatggagagtggagctctttcttcggtgatgaaggagccaggggaggcaccgctggattgggcgacacggcttcggattgctgtcggggcggcacgcggtcttgcttggctgcaccatgggttccaagttccgcaaattcaccagaatttgagctcaagtgcagtgcttctggatgaggactatgaagctcggttcacagatgttgggcttacaaggctggtccgaatggcaccaggcgagggtggagatacaagccccttcctgaatggggacttcggggagtatgggtatgtcgccccagagtgtgctagcaatccagttgctaccatgaagggtgatgtgtatgcatttggtgtgatactgctcgagctcgtgagtgggcaggaggctgccactgtaacgggtgatgcggcaggtgaaggattcaaggggacattggtggattgggtaaatcagcttaaggcctccggccggatcggtgatgctgttcataaatcattgcgtgggaatggccatgattcagagattgatgagtttgtgaagatagcttttgcgtgtatcatggttcacccgagggagaggttctcaatgtaccgggtttaccactctctgaagagcattggacagggtcgtgatgtctcagagcaatttgatgagttcccgctggcctataacaaggatgaatcagataccatgtaactaatggtggtggtcttgcttgggattgtgaaccgccctcggtcaggctcaatggatgcttctttgtgtagtcctgctacttgaattgatgaagagcatgctgaggcaaccatattggcatgataattattgctggatgatcaattcgatgcttgcctcatctcctgtcgagataatcgtgtaagctgtaagattttagtctgtattgtctttttacattattgctagcgcttgtagtatctcgctttatgcctaaattctgatatgaccttccttcttggaacaacttgcctccttccccaatctcctaagaacaatattggcagtgaacaaaattaatcttgaccaatttatctaaagtttacaggaatgtttcgctctgtcatgtactcatgtccttgaaacctttttcaagtagcatgttatatcatttgccatcttctctttgtgaattttcttgatgataccatgtaccttattcacatccacttaaacaatgctgtataaacatgatttatcatagttactattaagtgcgcccttatcagttcataatttttcagttttgatgtcaaaatctgtatagctataaactgggtgttatacttgtcaaccttggaccatctacctgtggtcactgctctatattctgaccatacatttgaagcatcacgattggaaaatgtcaccttcagcctcgcttttagccattgttttctaatttggttgtgtaccggtatcttgagtgttatctagttgtcttacttgatgtattgtatgctttctttgatttcaaagtcagctcttggtggcaaagaacaattatcaattccctttgcacatgccgttccacaataattgtcaccatcattgaacaatcgtaaatttgacttacctgcggtagcgaatgttacctttagactacttcctgttaagattttcttcacagttaacaagatgatgcgtgaagtgactctacatagataagtataaatcgagaggtgaaaaaacgggccgtaccttttgcaaccctgttcgaatcatgtgcttagctggtgcctgcagttattgtactatactgctagtggctgctttgtccagatttgcatgagcatatgctgcacagagaaaatgcggtgagatcaagacaaaaaaaaaaacgcggctgcaccatataaatcttttctactactcccaatgttgcttccaccaatcaagcgaacatgtcttagcctaattacccaactccctcccaatccagttcgacttactcactgtcagtctctggatcaattgacagcgctcatttaccgcggttacatttcgcaaaagtttggtctgtgtgttgctgtgtgcttcggagttacagcatcgatttgctggatgtgggctcaatggacaacggttggcatctgcagatcggctgatgctgggatgatgatcggggccttgtctctgaatgataatgatagtcaaggacgaggggacaacggagatttttcctcaattatccgtgcgactgtgcgagtacaaacggtgaacgcggccgtggattatctcgtttttccccccctccaacccctcggcttcgtttccacggcgaccagtcgcgtgccgtgtaattatcgcctcatttttccggcggtttagctgtttttccccccggcggatgttcggaccaacgacgttgaacacccctcggcacgatatgcctttggcggcttggcctcgggctggcacgatgtggtaagctggcagcgcgaagcagcagcagctctcgttgcgatctgtacacgcggatagtctccgcgccagatcggaggttggaagttttgcggggaaggggtggattgcagatttggaggctttggacgacgcgagtggtgtggtgctcggcaacaacggccgtgaccggtccaagtcgctgggcgcatgtcgccgtcgcacgctcaggttcccatcgttgaccgacttggccgagctgcgagcgagtcagtaggattttacggcctcatcaacagccacaaggtgacaaggggggaagagtccttccaattcttgacgtgcggtgcccgcaaccaaacagaactgcagaaatgttaaaatgctgtagatttccatgtactcccatcagagatgactttgagaaggctgaaactttcatatcactcttttctccgcaggtaggatgcagcttaagctactggtctcgaatacagatgcgatgacgatggcaactcccttgggagttgaaactttgcgggcattggcctaactagttcgcctgatgcaataaggttgaaggctgaaacacagattgctcagcttgatgttagccatctaaaatccgtccacccgacaagaaatccacactacagatgtgtgcacatcccatgttccctcgtgcttttatctcagctgccctgttgcacatgactacatgaggcaaacgatggtcccggaaggcattcttatgccattttcaatcaaacaaacatcatacaggcaggcacgaaagatgaaatagacccacccaatcaaacacatttctgatagccacaaatgatttggtagggtgaaatggaacacggatacagaaacctacgtctagtgctaacaccgctatgccaaacaagctcaacaaagagaaacaaggcaccccagcacttctgttacttgctgacgagtgtttctactacaggaaatgaattagcaacagagtgattttcactggtaatattcgtcgcataggccaagcgtgaaatgtagtgaagatcacaccacataacggtacgtcacatatcttccagcggtctcactagcacggatgatctttacaacttgcccacgcttcatgccgtaatatcttgctattgggtccgtaatttgaatccgggggagctgcattcataatacaaattcaatgtcatcagaacagaatgtgctactgcagtaaagtttacagaaacatctgcatgtggagtccattcaattagttatctaataaggtttgaagttatcttgataattgcgaagacacttatattttagaatgaggtgtcaaaattgggggatgtaaaaaacgtaaaaaggaaacagaggtgactggtactcattgaatttcttctattcccttcagaaattatgtatcaaactaaacagattgcaaattaacaaagaaatagaatgttagaacatgaaaacaaagagcttctcagatcaacatccccagcacatcgggtgccttatattcttcccattatccaacatgacacatgccatagtaaagaatcacatgcaactgagtaagtcaatgccattagagtatttatcatggtaactttgtaacaagacaagctcgtcagcgttaagatctgaaagtgtcgcattcgaagcatataaataaacagaaccttgatatcctattgtattaggttatgctgctaccacctcatataacattaaaactgcattatcacattgctcaactagcagctttgactctaaaacaagaaccagattgtcatttatcgtgattgtctactgaagtgatatagaaaccttgacaccttgttctgttaaactatgacctaacacattttatagaaccagttatcttaaaactaacatgaacaatgcaagttcgcattgtaaacaggacataataaacaacaataagttaaaagttcacaaaacaagattactttttttaaaaaaaactcgaccaacctaggaggaactaggtggcatttttaaataagaacttgggtggtctgggcttacattcacacacttgaccaactgagttaggctcagtatctaaaacaagatgacttaaaacaacaacaacattatgaacagccctggtttccactgccagacaaagttcaacagcacataaacctgaatttacttctcttaacaattagaaaaaaaagatcgataaaaagagcattcagggaatgtggttaaaacttaaaatgtatgcccccactactatcaattatattcattctaacaaattttattcatttgcagcactgaatgtcagagagaactgttgatttattagtttattagatggtttacagcaaggagttaggttacctgagctgcgatgtgttaactagagtgcagcagataccaaacttcgaatgcagtacaggtaatgaaggggagtttatgtaaacaagccacaatgtctcgaaaagtatcaaggctatgaggctatttcctcatagcctcatactttcctatgaggctactagtaattactagtcactagtctatttcctatgaggctatgataagtatcaggaaatatgtgacatgtttaatggcgacacaaacaatacgtatgtatgcaagcctcctggaaaattgtcatgattcaccaatagttgtccaaaaatgctgcccacaaaaccttttactgttgtgcagatatcaacacatgaatgaaacatcgatgacattatgctcaaatcaattcaaatactacacctatgagaaaataaaaaatgtctatttccagacctgagtctctttcacggtataccgctccagcagcgtcttcttctgctcaggcgtcaggagctcgtgctctggcacaagggtatgatccttaatgttcacaagcagttccgcttcctgcacaaacaagtgctacctcaaaccactgctctccacggtgccagtaataaatggggagtacacgagtacagaggcgaatggatgtggcaagagggcggacctggaagacctcgaggtggaacttctgggagacctcctgcacggcgctgcgggcgaacgcgctgagcgcctgctgcacgacgaggatgccgttgaacacgctctcctgcttcatcctctccacgtagctcctgatcgtcttcaccccgggcttcgcgtccttggggaagaagacgtagatctgcgaagaggggaagaagaggaaaaaaaacaaattcgcggcgaccgctcgtcacaactcacacggtgtgcggcgcccgcccagtcggaaaacagaggcggcggcggcggcggcggcggaggaggaggagccgtacctggtcggcgccgttgtccttcttgtggcggctgaagacgagatggtcgcggtcgacgggatccccgaagcgtgcgacgaagtcgcccctcgggaggtcgatgtccaactccgtcacgaggtagcccctgtcccgcagcatctgcatcaccgtgcggcggatgcggaaaagccggctcgtctcctcctccgacgccatctatctcctctcccttccgccgccgccgcggggtttcgctagggttttgtggggggagcgtccgcgccgacaagggggaaggcgggagcgggaggaggatggcggcaggtagggtttcgattgttttgggggagaaaaggctaagctcgccggcgccgaggtaagtttgggttaagtcggtcggtcggactcgcacccgagttgggttcggtggatttgggccgagcaaagcattggtgctgggccgaattcagggaggcaaccaaacgagagagagcaaacccccgatcacaggtgaagtaaaagagaaacagatgcaggttttggcacagccttgttttattcgtgaaaagaaaacttttaggagttacattagacgtttgattagatgttaaaagaggttttcagacacgaatgaaaaaactaattttataactctcttagaaaccgcgaggcaaatttattaagcctaattaatccgtcattagcacatgtagatgtagattattgtaacacttatgactaatcatggattaattaggctcaaaagattcgtctcatgatttccatgtaaaatgtgtaattagttttttattttatctatatttaatattctatgcatgtatcaaaagattcgatgtgatatttttgggaaagaaattttgggaactaaacaagcctaaaatggtcgaggttttactgtaacttactgtaaaatttctcgcagaacaatcatcacaaaaaaaaatctaaaaagcagaacggctgcagttaatattgcagcaattttcagacacaggatgcaacatccaacgatagcttcaataattcaccaaaagcaatcatctctgcttgaaatgtttcaggtttttactccatcaaaatccgagcgaactaaacaagcactgaccatagatcattccaagtaatgctgcaagaaattactgcaacctaaagaacttacaggatcacagcaacatggcagaaaatgagtcaatgacttattcagagtagttcatcgatagtcaagcactgactcgaaaatgacttatactcatctcattccgaacttattcagagtagttcatcgatagtcaagcaactcgagtcacaaattctgacggaaaggcaaagaggatgaacgcgatactacgaccgcctaacgaactgaacagaaatctccaaggaacccgagttacaatttctcccgggaagaaaggcggacgaatgcgatactactgcaaccacctaaaga

SEQ ID NO: 63925 - DNA, 6598 bp, Oryza sativa
agaaactggaggaggtcggcctcgccctcgtccatgggttccgcgctcgtcgccgaactcgacgccgtcttgtggcgcctcgcgcagcccttgtcgttccgggcagaacccggcggcgcgcggtggaggaacccgcgcaagccgccgccgactccgctcaccggaaagtgagcaggacgtggtacgtagccaagacggcggcggcaatcagaacgcgaggtatggcgtcctccccctcgccgaagacgacgacgaaggcccccaactgggtgagggtcaagacaaagaccgaaacccagagcagaagccgacaactccatcgaaccatgtcgcggactctgtctctcgccttggactgcttctgcttttggaatgtggcggtggcgatggcgcggtggcaatggtgatggcgaggtaggcctcgctggctggcctacctggctgcttatcaaacgtgggtggtgagcaccgccgccgtcgatcacagatcggacggtggaagacggtggttctggaagatgccaaccagttagttccatgtagtttggaggtggaagaagagggatgccttgccttgccttgcgttgcgggatgaaacggtattgcactggaccccacttggaaggccaccggcgagcttagcgtggtccccgcgcgcgcaccgatgccgttgatcgcagatcggaaggcggggagtgttcggctagttcgttaacgagttcttgttcttagtgagcaatatgatttggccgagcaagaaacaggaggcttatgcggctgcctgtgacggattgggtatttgggttttggaatggtaattgtggttttcagtttcctgcgaagctaagcaatgccaagcaaaaacatgcagtaggctatagtacaaccacttcagtacttcactactgtattgcatccttgaacttgttcagttcagttcagttagtttctgctgtagcaagttatctctgaaaatgaactaacacactactgcatgttgcatctgtgataaactttctaaatttctaatcaaatgaacttgcaaagtgcactccatagctacgggatacaaactagtgttagaactaagaaccaagatggcaaacccacacaaaattcagatagttcagatagcattgcagaattttagaccctcaatggcatgccgtctctctccactgaatttagctggtcatttctgttaaactgtatgatcaaaaaaagacttacagagttaacagtgtactgatcaattactgtaaaaatcggcaatgccgccgaacgatttctgaaccaatatgtagttctcaacacaagacaacatatcgattaatcagtactaattcaggactagttattggcttctgccttcttgcatcgacaaattcaagaattggcatccccaaaaacttcagatgttcatattccatatccagatattcagacttcaccttgttacaggggaagcaacatgggacacagttctggccaaagtgaatcagaaggaactaaggcaatactactaccgaagaaatctaacataaatcctaagaagaatctaacaaaaatcctaagaagcgcctcaaaaatcatgtggcgagtggcggcgacagcaaaaaaaactaccagcagcagagggaactatccaaggaccagccatccaggtcagacatgatcacacacatcagagtggagaagaaagcgttagaatcctaagaaccgccctcgaagatcagatcggtggtggcggcgccggcgatagggtctcgtcgttgtctccgctctccaggcctcgaagcagcgatggtggtatgtctccccgcagcaggacatggtgatgacctcctcgcggcgcttcatgccctcgcggcaactggtctccttccgcagccacgggaggcagccctctcgtctcgtgcgttctgtgtcgattcgaacttcgaactttcgaaggacggcagtggcgcggaggagtaggaagcacgaggttaaggtggggcccagtacaaccgccggcttatctagaccgttgatcggagaacaaacgttagatcacttgccgtgacgaagtagagctcctaactaattcgcaggggttaacggaagtgcattaggattcgtgcttcttttgttctcggagatgacttctcgtcgcgagatcatacacagctctacgtcgactcggcacgcgagtcctaaaccgaaccgacttccgatgcatgccgactctctgtttcttctaccagtataagtatcgcccccgtcgacgaccggctgcaacaaagatagtaccacacaatcgtcgcttgccacacaatgacagaatccacaaagatcaagtattgtcgcgcagattccggctccggctccaagcccttgtcagcagaaacaaagacacgtttgatggcagacgggaagaagattgacgaagaaaagaaagacggcactgcagttcgtcgtgtcctcttctggttcgccgtcttggtcatccggttcgcgctcctgatggcgatgcactactaccacgtacggatgatggcgaaacttgaaggaactaataatgatggttttggcctttttcttacatgtagccactatgttttaatggctggctttattataaccagctgcatgggttactagctagctacatgggtgcctagccgttttgatggctttgttccaataatatcgttagtgtaagctatacctttttagtatgtcccttcttctgaatttaaagctttactgtaatgaatatttctcatatttatatatatattgtttcatccgatagtactgttaatgcacctttgtattgttttccattgggaagtctatctattttagattttcgttatgctttgtgcggttgtcctttcctgtactatcatcgtggaagatttacataattgcacaggctgttccgttactgaacaatgagatgggttggaacaattggctagggtctagttaggggattagggttttttttttgggtggggtaaacacaagttcggtacgggcgaggagagcgcaagaacaagatgatgatgatgggtgagggcgcgcatgaacatgtggcggcggtgagcggcgtggagggaggaggaagcggtagcgacagtgagatggccgcgcgccatataccaccagctcgacgcgacgcggcattacctgccgtcgaacgaggcggcggcggtggacgcgtacgcgtgtgatgggcttaggatgtaacgagttcaaggtgcgacggtgcgcgcgcgggcggagccaggactggacggagtgccctttcacgcgtccgagggagaaggcgcggaggagggacaccggacacgaggccgtactgcgactctggcacggcgtgcctggacttccgcaagggcgggtgcaatcacggcgacgcgtgcgagttcgcgcacggggtgttcgacaattcgagtgctgatctcgcgtaactgccaggatgagaaggcctcggcctttttctccttcccatcaggccgaacaggcataaatccttccatccaatggatttaggaaaaagtatacttcgactccctcactatgacccgagtatgatttatatcctccaaccacaaaaccagatatatcgatccaactatcaaaaccggtgcaaacaatgcctctgtgtggttttagaggtggttttggctgacatggcgcctacgtggcggtcttgaccgggtctttgtcctacatgacgcttatgtggcattagaataaaaaacattaaaaaaatatgggacccgttgacatcctccctctccttcccttcttcctcctccctccctctctcccttatctccctttctctcccccggcctggtggcgtcgtggtcgtcgttgcccatggccaccggacgccggcgccgaccgccgccgctcccgaccaccggcgagctccagatcctcccccgtgcgcggacggacggcgagctcctccccgcacgcgcacccccaccgcaccgccgctgctcctgaccaccggcgagctccagctcctcccccgcgcgaggacggcatgcgagctcctccccgcgcatggacggccggcgagctcctccccgtgcgcggatggcctgtgagctcctccccgcacgcggacagctgtcgccgtcgccgtcgttagctccctccgccatccacggctagctgtacgtcgaagcaaaatcaaaggctagctcgccgacgccctgggaagcagcatttgactgcagcacggcggcggcgcagccggggggatggaccctatcctcacctctaccagcacgacgccctcactgggtggacgagctccctctgccgcctcccgccatccgcaatcctgcttccgccacccagacccgtcgccggcctccaccacgctcgaactcagctgtcgccgaggggacgggacccacggaagccggcggcgcaccgatggccttcgtcggccttccgcctccgtcggcttgtcccaccgggcaccggcgcacgagatgacatgtggggcccacatgacagtgggtcccactattttctgtgtgaatgacatgtcggtcccacgtatttttttttgtttttactctaaaatgccacataagcgacacgttaacgacacgtgggacgaagattgggtcaacagtgccacgtaggcgccacgtcagccaaaatcgcttccaaaactactcagggatatattttacaccggttttgatagttggaggagtcaatatacctggttttatggttggaggttatgaatcatactcggaccatagttgagggagtcaaagtatactttttccatggatttaaggcttgttttatttccctcccgggcctcattcccatttgtgctaaagcccagattccctggtcctttttcacccctccctaaaaccaaaatctattgatctcccctccctccctcagcccaaggaatgtttccttcttgggaaatattctatgtttagctgctaatttgctgtgatgcatctcggttgaccggaggtaacagcaattgtgtcccaggactggtactgagttccgcaacgtgaaattgacatatgctgacatgcctaaaagaacagcatcatagattcagagagaagcaaggtgacactgacaaaacatatcccactgaaagaaactgcattacaaaaacaccatttacaggtaatactaatactgaagctccaatcacagtctccaactgctgaagctctagccacactaccggaaacatcacatattcagatagtagcaaggcggagattaaactgtgaatctaagtatctgacagaacaggtactgtgaaagactacagtgagatacacatatcagcctaagcaccgtgtccgttatggcataaaaatccaatgagagctcataggatccagtacactgaaggagctcaacgtttgtcaaattaatcatcaacacctcgaacaccacctcaaactaaagattagcattcaacttattagtaggccgaatgaacaaataatccatcatcaaatttgtcagccatctgaacggctgcagataccatcttaaagatcttcaggaatacactaacacgcaactatccaaaatatactgaggaacttacacaaactaaccatcttcattcaggtctctagtccatcagaccccaaatcacacgagagatacatcattgaacatcataacaatagtacaaatagcacaacggcctgccctaaatagatcacaggaatcacagctaacaagaatgagtaactgttattgatcatttattcagatattcagatagcaaaaaaaaagaaagatattcagatagcagcatcaaaaagccaagcagatgatggaaagaagaagcggttgaatgcaacactatatatgacaacttaaagaacaaactagaatcaaagtgagtgacaaactttaattctttatttaagtcattgacgtgatcagtacaaaatcagactgagtggatgtccagtgttcagtctacctcccctatgtgttaaactaataaggattctaagaaaagcgtgacaataaatcaaaaatatgctccaagcttccatctgttgagactatcgtatgataaaagaagcatttcgaagagcgagatggtatacttcagttcagattggcttatatcaaaaacagaaggacatatatcaaagatcatcagctagtcatcaaggcattcaacaccacatcaaactggagataattccatcagcaaccaagttacaaactctgacagaatgagcatgactccaaaggccgtactgacatcgatcggcttctagaacctaacgagaagagccccatgaatcttgcgtggctgctaagaaatctgcctacactaacagatagagaacctgtcctggatctgatccggactaacctccttgtgtccgacgttccccgttccgagatcccatctaaccctgatcatggagacgcagatggccgcataagtggctcctccaaacttgaagtgtccgcggagctcgacgacgtcgccggcgccggccgcggtgggtgctgctactgcgggcccttgggcgaacctgtcgccgggggcggtagc

SEQ ID NO: 63926 - DNA, 1730 bp, Oryza sativa
agccttgcgggatgaaacggtattgcactggaccccacttggaaggccggcttatatagcgtggaccgcgcgcaccgatgccgttgatcgcagatcggagggcgggtagtgatcggctagttcgttaacgaattcttgttcttggtgggcgtatgatttggccgagcaggacacacgaggcgtatatgcggctgcctgtatcagattgggttttggaatggtaatcgtggttttcaggtttctgcagagctaggcaaaaacatgcagtagtacaactcgatctgtacaagtgcacaaccacttttgaaaagagaagtgtacgaccacttcactactgcacattgctttgcatccttgaagttgttaagttcagtaaagtcagcttctgctgtagcaagttatttctgaaaaatgagctaacatactactacatattgcaggtttgataaactttctaatcagatgaacttacataatgcactccgtgggatacaaattggtgttagaattaagggaggacaaagatggcaagcccacacaaagttcaggtagttcagataacattgcagaattagacccacaatagtatgccggacattaatacgattctctgtacactgaatatttagcaggcgatttcagctaagctgtatgataaaaaaaaaagacttagagaattcctgcagtatacataacaaacaacattgtacttgtcaagatcaatagttcagtatgcagttatcatcgcaaaatagcatatcgcttagtcagtactaattcaggaccacttcttggcttatgccttctttcattgacaaattgaagaattgacatctcccaaaatcttcagatcttcatattccatatccaaatattcagacttcagtttgttacatgggaagcaacaagggcaacaattctggccgaaaagaatcagaattcagaaggaactctaacagaaatcagaaatcctaagaactctaacataaatcctaagaagcgccccaataatcatgtggcgagtagcggcgacaagaaaactaccagcagaggaaactattgaagaaccagacatccaggccagacacaatcacatgacgcatcagagtggagaagaaagcgttagaatcctaagaaccctaaacccgaagatcacatcggcggcggcggcggcggcgacagggggtccaggtcgtagcagcccgggcacgggcagacttgaaatctcgttgttgtctccgctctccaagcctcgaagcagcgttggtggcacgtcttcccgcagcaggacatggtgacggcctcctcgcggcccttcatcccctcgcggcagatgatgcaggccgcgcagccggtctccttccgcaaccacagccacgggaggcagccgtgtaggagctccctccacggaacgcagatggggcgcgaggacgcgagccggcggcgtgctacgtccctctccgccattgctgccccgcccaccctctcctctctgctccttccttgcttctccctcccctcctctctcgtctcgtgagttctctgtgtcgattcgaaggatggcaatggtgcggaggaggagggagcccgagatttaaggtggagtcggtggagtcagcaccgcgccggcttatctagaccgctgatcagagatccgacggtagatcacttgccgtgacgaagtagaactcctaactaattcgccctaattcgcaggagttagttagcaa

SEQ ID NO: 63927 - DNA, 1901 bp, Oryza sativa
tataaccaagtctcttagctatgtaaaggaaaaaatgttggttcagttgaatttcatggcatactttttttctttatttttttgtgactttacatgtcctttaacatgtggtttgattatgccatgccatgcagaataatccctgcggtcgcaacattagtaagaaaataatgtgcacaaaattcattcttgatcaattgatttactatagctatgttttccagggggaaactagttgtcctaacgtatgtttagttgttcgaatgataaaatttgcacttttagttattattccatcttcactttactatgtgttggccccctttttgggttaaggttatcaatcacatctagaggttaaaactctatctattggctccatttgctccttttctagatgtgccaaactgccaataagagcagtgcatggacttttggttcttcatttactgttggggtgtgtgttttgaattgcatgtcaaggtttcatcatttgatttgtgcttcgttgctaatatgctttatttctggctatatgatcaatgtaatttattatataaaggattgtaatttttttatttattaaatgatctttattttttttatagtgataagatatgtaacttatgcactttgcatgtttcaggtgaaatttcatcaatataggaaaatagattataccatcagtttttgcacacggtgagaaatttaaaccctttatttttaatgggggttacttcagttcatgcatgaacacataatgcactatcttgattccgcagcacatacttgaagttgttcatcttgggttgaaagaaaaaggtcaaaccgattgtattaattttgcagcaagccaacaaactaattgactggtggctatgctaatccttagcttaattgaggttttttagtctggttttggttggttccggcggaaccgtggatgatcgcccttgccacatacttgtgccgaaactattctcttctaggactaataacttcttcattctatgacttctcttatttctcagcggatgaaatttgactaggagaggcaccatggagaaagtcgaggtcgatgggaacttcattggtacgggtaattggaaggtaattcacctgacctcatttcactaaaagctaattgttctacaatgttaatatgattaattatgttgatctgagatcattttataatgtagggaactttcagaacaatactattgagtttttgtgatacttgtgtacatattatatagtcaccctttaaaagcaaaggcaaatgcctcctgtaaaagtataaatatcacaatactaccactagttcaacaaaaagttagaagaaatcataacatagttgcatcatatatatatgataattttttatatatgaagatatttgatctcataaagttaccaattattagttggtaaattgtgataaataatagatctcatccaccttctttctttctttttaattttctttagctccgctgtttgatatcataattttgccccccccccccctctttggggaggaatgatttctatttattaataatgtgagtattaggatggtagattaagctggtttgttcctacctctttgtgcagctgcatggagcactatgtaagcaacttcacaaagtagttcttgaagtattggatgttattcctgtccttgaagctacaaggcctggaaacagttctggacttcttgcattgagttccttgcgcatagctgttgagaaggccaagaatctacttcagtattgctcagagtgcagcaagctatacttggtatgcagttttcataagtgcaaacatatttatgtttcctagttttgagaaataaaatgtgtgaaatatggatacatgtctttgtgctactgtatata

SEQ ID NO: 63928 - DNA, 8637 bp, Oryza sativa
tttcataagtgcaaacatatttatgtttcctagttttgagaaataaaaatgtgtgaaatatggatacatgtctttgtgctactgtatataattgatggtacttggatatgtttcatcgtatatggatatcaagtactgccaaatttatttgttattatagaaatacaaaatttcatacttacacatcctaactgcatgcaggcctttacagcagaaaatgtcctggcaaaatttgagaaagcaagatatgcgcttctggaaagtcttcaccaattggaagaaacacttccagaagcagccagttctcaggttgccactggttatacaagaatttgtccttgccggctctgtcttaaatagatacctataaaatattgcggaaggatccttctttatcagtgttatatagtttactaaattaatgaatgagtttgacgtattgcagctttcaccctaattgtaatcgcatgatttaatttaaccttttcctctaattcacacttatttgggaaattttcagatactagatatcgcaaaagatctggagaaagcagtttttaccttggatctgattgaaaagcaagctggtgtggatgtgaatcaattagttcagaatgaggcaaaatccaatggctttcttcatgacaatgaacttgaatttttccgacaaactgcatttcgggtcggcgttgcgtcatcggcaacagctcttaccgagagaagagcacttagaaggcttcttgagagggctcatgcagaggaagacataaagaaagaatcagttgcatcttatctactgcacctaatgaggaaatactcaagcatttttaggagcgaaacgacggatttcaccaacacatccatgtgctcaagcccttcttgctcttcccgttcattgtccagctcgattgatctccatggaaatggtcatgttattgaaaagtcgatatctagggttggctccttcaatctcaggcagatcaaaggcttatcaggtagcatgccattgccacctgaggaactaaggtgcccgatctccttgcaactcatgcatgaccctgttattatcgcatctggtcagacatatgagcgggcttgcattgagaaatggtttagcagcggcaacacaacctgcccaaagactcggaatgaattatcccagctctccatgacgcccaactattgcatcaagggtttgatagcttcatggtgcgagcagaacggggttctagttccatcggcgccgcctgattctcccaagctcaagtacctgaggatatcatccttgaatagtagcaaatgtcttgtgaccaatggcgttagcacggtcttgtttgaagacacatgcgcggaggatgatattaaggatggtggtaaagttgcttcggaggagtgcactcggcagaactccggagaggctccatctgagatatgtgaagttgatcaggcctcaccagaaaaacatcctcatgagaactccgagaaggtagcagaggcgacatgtgagctttggctgcgtgtgctgagcaaggacgacgatgagtgtgtcgacgagcaacgtgaggtgatcgagcagattagattccttttgaaggatgacaacgagcttaggaaatacgcgggtgctaatggtattaccgagctactcatccactttgtgaagaaggcagtctgcagagatgatgttcagtgccaggtggttggaacaatggctctgttcaaccttgctgtcagcaatgataggtaaaatgtcacgtatgctttgttccttctaacgatgttgttacaatagtttattacacgtacaacttgcagtaacactctataggtagatgatttaattgatcttagttgccatcatctcacattttccacctctgcatttgattttccaggaacaagaaacaacttctctcaggtggagtcctccccttgatggagcagatgatacagaagcctgaaacctacgaggctgccgtcgcaatgtacctgaacatttcctgcctcgccgaggcgcaggcgatcatcgggcagagcgaggccgcgcctctcctgatcaagggcctgcaaggagacggcttccggatgagcaagacctgctgcctcgacgctctcctgacgctgtacaacctgtcgctgcaatcgtcaaacatcccgaccctcatctcctccggcatcatgcagagcctccacgacgtcctgacgccgtcctccccgacgacggagaaggccctggccgtgctgatcaacttggcgctgacccgcgccggcaagaaggagatcatggccgactcggacatggtgggcgccatcgtcgtcatcctcgagaacggggaccccgccgagaaggagaaggccgtgtcgtgcctgtggatcatctgcagcggcgatgacggcggcagccagatggtgctccaggaaggcgtgatcccggcgctggtgtccctgacggccaacggcacgggcaagacgaaggataaggcgcagaggctgctcctgctgttccgcgggaagcggcagcgggaggtcgagcagctgcagccaagggtgcagctgcacgaggtggtgagccaggcaaccgcgcagcacgagcagcagcagcagcagcaacaagaagaaagcagcgagccaggcagcgacaagatgtcgcggctgcgcaattcaaagtcgaagttgagaaggttcacgagggccctggctaggttgctcaagaaatggggcatccgctgatctgatctactacagaggaaagaaccacgtcggctagtgtgaactttggcaaatgcaatatcaatgttatcttcccgtgtgggttgactcactcgttttcgtctccttcgcattgccgcgatatccatactcgtctcacttatgcgggcattgaccgtctctctgtacctattaaccttgtgctaaggcaaaattagtaaaaagggtttaagcttattgtgttttgccaaaatgtaagccaagatgtgttaacaaggattaagtgcgatcatcaaagtgtgtaacaaggattaattcaggtcataaatctaattatataatacgtaacccaaattaaagatttttaagaaaacccaaattaaagatttttaagaaaagaataggaaacccattttattgaggtcgttttagcctaattctatttggaacatacttcatctgtcaaaaaaaaaaaaccaaatccttactaaacatagggtatgttcaaatacataatcatgatttctttttttttcggatttgctatacaactggcgacagttaacagggggtgaaaactttcaaattttaagctgtctaatatgctttgagatttgtgctagtgagggaaaacagcttaaaaaattcaggggtgaaaactttcaaattttaagctgtctaatatgctttgagatttgtgctagtgagggaaaacggcttaaaaaattcacacgcgtgcagtagggatcaaacccaacacctccaacttggaggcttgttcacctaaccagttctcccatcgggctattttgagttacacttgagttacatattagttatatagtagttatatagtagttacaatgtaattacatagtagtcatatttgaaagtttttcatcccaaaaactgtcgacagttgtatagctactcccgtttttttcgagacgggagtagtcgcgtacgtgtgcgttcgttccaagcacactttctgtttttttaaagaaaaatctttggaaatgttgctttaaaaatattatattaatctattttttaaattttaaataattaatatttaactaataaattataagctaatgacttatctcgttttttatatactacctccgttttttaatagatgacgccattgactttttctcacatgtttgaccattcgtcttattcaaaaattttatgcaaatgtataagatataaatcacacttaaagtactataagtgataaaacaactcataacaaaataaattatgattatgtaaatttttcgaataagacgaatggtcaaacatgtgagaggaagtcaacggcgtcatctattaaaaaccggagggagtatttaatcttctctctcggacaaacagtgcaccctggtatttgagcggaaattcgcatgaaccaaattgtgggccgtatgcacgccaagtctggctgaccagttgggccttggcccgtggagtacaatactaaaaaaaaaggtcaaaactgcgtgcgaagcctgtgggttttgacctcaagcctcctcggcgactagtccacgcctcccactcccagtccacttctcttccttccttccttccccaccggctccgatccgaaggacgaaccccgcacaagacaacaagtaaatccccatccatagctatccaagagccccaaatcagatgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcaggtgggtggggagccgcgcgcgctctccgtgggttcagttctgccctaggtttggggtgccgtgtgcgtgtgagtggggaggttgttttttttgatgattgatgaaatggttgcctctctgcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatggtgagcgcgctttggtgtgcctcgctgcttctgtttgatcacaatctcgggctgtgttggtctgcattgctgcaaatgctgcttctgtatgttttggattgtggcgcactggcgctgctgcggctatttgagggctggagcacactagcgagtagtgctccttggtgcgcaggctgaggaaacttgtgtttgtgaacgaaatgcaagctgctcactaatgcagacagttgttcctgcaaatggagaagtgttttcttctgcattcgtatcccacaacagacgtgaaccctttctgctatgagcatcattgaacaccgttatgtaacttatcatagcctgattcgatttcattcaccatgatctataactattatacttaccatattagttactttgtactactcttagtaaaataaataaattattttaatactccactgacaaaataggttaagattgtttcattgcttgggcacatgtgcaatactagtcgcattttttttacctgcgtgcaaatcttatcatgcctgcttgattcaatttgccgttctctctgtaatttaattattttgcctccagacagagagtgaattggaggcaagcaggcttattgacgatcttggcctacaaggcaaacagcagtatgtatgtgctaatgttatctgtgatggttaactgctttgaatgtcttctgtttcataatttacactgatatgtttaatatttcgatatcctttagcctaactcacaacacaagcgttacattgtcaaagatggagcaccaacactggtaaatagacttttcatgatatgatgcattttgttttgttcttcctatagtatgcctcacttttgaatatatttttttgtcacataagattccctcagatcccattgcgctcatgaaaagcactgttctttctacaaaatcaaaggtatgtaagttattgagtgctaattgctacaacatatcatgacctcctgacctatttgcaacaagttgcttgttgtttccacttgtcactgatggattaaaattcactagtgtagaaacaatcatattaaactgatcaccgtgacttgatttacttgttttcagttcactattacaaatttgtacatttcctgatctttcgtgttcaagctgtgtgatcgactgattgcaaccgtcatattatattactgtattgagtttagtaaaacatggtcttatctttgcagctcaagctatttctggaaccatttctctatgagaaatctagcagaaggacctcgggaaaagtgtctgatgaacatttaagtgagaggtgagccttcatactgatgttattttgagttgttgtaaacttgaaccactgataatatagttatatgtttttttcctgtgttcttccttcattctcatgcccttgtgaaatacaaatatatacttcatatcacacactccctttggtcatttttcatgtcaaacttttaaaactttgtacataaaatcagttcaatatttagattgaacgcatgagaaagtattttcataatattatgattttaccatttttttcatatacgttgcaacagaatttagtggtcaaagctacactttgaagaccttattgatgtcaaaaacagcatgttttctgaccagagagaatacatttgcagtgtgatttttctgtgtatatgtagagataatcaggtttctcttttgcagtgttgcaagtttctttgaacgccactttggaaaagaggcaagttcatttttaatgaagaaatttatggattgttaagtgaatacaatcaacactttgcaacttacatgcccattataatcagtagagggtaagaatttataactttattacaggttgttgattatcttattgatccatttgtggctggaacaagcggaggagatcctgagtcattatcagtaagttattataacatgtctcactatttgcattttccatatcagcacctttgcatttctacagtaaattgtagtcataattatttttatgtaaattgtgcgtataaacaacatatgtgcttgactttgtgatgtgttcttggggatgataactgatacggctagaacttttgggggctaatctccttgagccgtatcagtaagtcataacaattctcattcataatgatcaaaacatatcaccttcttgtgtagaactgttctggttttgagtaatattttcttctgtgcagattcgtcatgcatttccagcattatggaatttggagaataagtaagtttgtagtagtttgtttggagaataagtaagtttgtagtttgtgcattgatgttcattcaagatttaccttatcaataattcacttgtccacgtccatatgctcgtgctatatcctgtccattcaaatgtcaacaccgccatgtgaatttacagcatagtgcattttaatgatttcatttatccttgttgcttgcatctcttttttgggctcctgctgttagcttgtttttggttcctgctgttacctatttcttttctatcattttttcattggacagatggtgctctcagtccttactgcttattatttgttaacctgatatgcacctacttgaagttaatgttatgatttttagtattttatagtcaggtatcattaatacttatttttggcaatcgaaattaaaaaaacatgatgtcaaaataaaaaatcatggcagttgaatgcagtgggtatatgtatcaagaatttaagatcttgaacataagtccaattgctatatgttcaattcgttggagcataacatgatctaatttgtaagttaaatttatctgataaacgatggaaggaaattctggtaccactcatgcaactatacaagcttcaaaggcttcttacatgtggaccattggacctagaatagaatctaaatttattcataagtatataattttttttccttcatgggccatgatagttaactatatgagcttgtagagtcaaaataggcataattgcttctttgggtttccacttaatttaccctacaacacttctattgcaataaatatggtcaacaacatttctttacggtccgtttggttggagggagtttttaggagggattgggagtttagagggatggagctattaactgttttgtttggttgggagagatgggaattttggtgggatggagatggggaattgaggaaggaactccctccttttcaatacctgggtagggggtggtaattgggagggaattcctcctttactttgcctaaacaaatctcacccatccgttttcattaatgacctaatctccaactaaacttcctgtcaattcccaccacctctgccaaacaagatattgggataaaaaatcaaattcccatcttaatctcaccatcaattccctcgtgtaaactcccaatccctttccctcaagttgccaaacaagccattagtgcccagttatgttctttgggcatcttcttcataatttgttgctccatgcactttcaatgctcacaggtatggctctgtcattgctggtgccatcttgtccaaactatccactaagggtgattcattgaagacaggaggtgcttcgccagggaaaggaaggaataaacgtgtgtcattttcatttcatggtggaatgcaggtactccacagatgtcctgtagtttcttttgtcagtgtcaaagatatcaaagacagtgataaaccctgaactttagtttgagcaattctacatgccactaaaaaatgccgaattcatatgttgtgaattga

SEQ ID NO: 63929 - DNA, 948 bp, Oryza sativa
ggtgatttttaagtaaattttccattcccaatcaaaacaagtaacattatatgttgaacatgtactgaattgaatatggaactttatgctggagatgccagactttattttactggcatgaatacacaattattgtaacaatggtattattgcttggttacttctccgctgtgaagacatacctttcgtcaccttttcttgtttcccatattctgcaccttatgggattgtcttccacatgttaagatgccttgtagtaccagttcccctattatttgaatgtgttcttccttagatatatgtgcatttggaacgtgattggaaatacaacagcaaactggtattgttagctgcttgcctgccacagcctacatatgctgccatattacagaattatgagataggtggactttgatttctgtcataatgattaactaacttgatatactcaaactatgcagctcctagctggtatccttagaatttatcgagtatgcatagaagtctactcttaatccatatctatttgatgtactcaaacttgaaactatgcagctcctagctgggctccttagaattatcaagtatgcatagaaatcttaatccatatttatttattatatgcaggtcgattatctaccactatctctcatggtaacagcttttaagaaggaagatgtcaaaaaaccattggaaggatttggtgccttgataccctataaggaacagcaaaagcatggtctcaaaacccttggtaggttaattcagctttacacttatattttatccagcttgtagctgcttatattttgatttgcgaattaaaaattattaaaacagccttgaaagaagaaaccatgttcgctgtggagactagaaattcccacattaattggggaaagagaaatatttacaccctatgattttggcaagtgcaagttttaatgg

SEQ ID NO: 63930 - DNA, 11104 bp, Oryza sativa
  unsure (1)..(11104): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaaagttttaccggtaccagtttatatcaaccagaggctttttggatatagtctctcttcaactattactgcaagaattgtatctcttgcatgtctaactagcctgcacaacgcaaggcatatacacggttgattcacacgaacaaatcaaaatgaacaagtgcaaaaaaaaaaaaaatcctcgtggatcatcagaccacgccttgctggtctcgcacgacggcgtagttgatgacgcgggcaacggtgcccatcgatggccggaacgtagggtcgtactgcaggcactgcaccgcgattctccccagctgcattgtgacattgccacaccctgacggttagaagtagaaacctactagagatacatagatagagatggtaatggttgggtgcaaaaatgcaatgcaggtgaatagttaagagagaaaccttgagagctccggtaggaggatacttgtcgccaagattggggtcgatgcagtcctggaccctgtcttcagtcaaaattggagttgcctagcatatcaaatggggcaggagatacgccaggtcagagtctgaacattgtgtgatagcatcatctttgtttcaagatatactagtactatgctcgtactgccattgtttttgttttcgttggattgtgttgtttatttaggaaagaaactgatgcaatttgtttcttgcgtcatagcacaaatgcatctcctactgtcttatcgcctttggaaagtgacctccataaaattttaatcaaggggctagaagcttctggtttgaggtttattgaaatttggcagacgaattgcagtttgataattgataagtacgtgttcggtattccacagcttagctatcagataaatctttcactaaaaagcttttcagctgcttcttaggtgagaaaggaagaccaaggatgaaaatagacgaggtaggtgaccaatatattaatgttctttgggttagctggtacaactgagagggaaatgcagtgattaagacaaagaaaaggaaatgtgaaaaccagaaaagaaaaatgcttacccagttaaccaggcttctctgaccctgcggcaacgtccggtccagcggcttcctccccgtcaagagctccagcagaacaatcccaaaactgtaaacgtcgctcttatcgttcatctgaccagtcatggcatacctggaacatccccaaaccaacgaaaatttcagcaaaatcgttcgacgacccaatccaacaacaagaaagccatgacgagatcgatcagccatggccagacagagatcagctgggcttgtgtgtgtgcgtgcgtgcacgtactccggcgcctggtatccgaaggagccgagggtgtgagtggagcggttgaggcgagccatgtcggcggcctggctgaacatgttgtagtcggcgatcttggccctgaacccctcgaacagcagcacgttggtggaacgcacgtccttgtgcgtcaccgccggctgcaccttctcgtgcaggtactccagcccgcgcgccgcgtccagcgcgatccgcacccgctgctcccagctcaccaccgccttcgcctccccgccccacccctgtccgtccctcggccctgcacacgacgacacaccaatggttcagtcccaggctgatcacaccgtttagcagttcggcaagcgtagttgtaaaaaaaaatgagagggagtgactgatccttagaagtagagattgtaccgtgcaggacgtcgtggagggtgcccatggcggcgtactcgtagaccagcacgcggaggtcgccgctgatcgtgtaccccaacagcctgacgaagttctcgtgcttcagccgcgacgccaccgacagctgcagatatatatggtaagtagtagcagagtgagcattggtaaaaagcaccgagaagagctacgcacctgcttgaggaagacgacgttggacgcgtgcttggacggcttctcgagcttcttgacgacggcgggcctcgcgccgcgcatgaggaccctgtacaccttcgcgtaggagccctgcccgatgaggttctcgttcgagaaggagttggtgatctcgttcagctcgcgcacgggcacctccggcacctccactgtcaccacctcctccgcggccgcacggtccgctcctttccgtttatctgaacacagtggaaaaaagcaaagatttcgctgttaatccttcacgcatgctagtagaaatggtcgattgtctcctgtttaatcactgtcgactatcacttatcaaagcagagctagaaagaacacaagaacgcaaaagaatatatcgagggcctgtctacctgctgacagacacgatgagaatcccagaattgagctaatcaaattacagctaaccggagtagagaaacagttgagaattcagcaccaaaagcaacgtggtccaattgtcaacaaaatggagaaagaaacaacaacaacaacacacacagagagacaaaaacaaaattacataccatgatccactggataagagtaaagatcctcggactctttcttcccaatccgaggtaggcagccgttgcctccctccccgaacaagctcctcacgctctcccacaaccccatcgccggcatcaactgatgatcagctagcaagcagcacgagttaactatctataattaactcctctggggtaggtttgcacgagctcgagagggcggctaagctgcggaaagtagtcgcctgcttatgtattgcacggaaatctatcgattgatcgcgttgctgaagtttcgtgcctagcctgtggacgatatcgctgcaagggaggccagggcgagaggaagtagacaaatttccgagactttgaagtgaaccggcgatatttagtcgtcccagccgccgtgacatctcgccgcggacttcttcttcttctgcttcccgcccttgtagcggggcccggctatcagctctactacagtcgttggagttgaacgaccaagtctcgggcaaattagctctcgataggcttgcactgcagcctgaagccctgaaccgcccggtacgtagtacgctgtcgttggcgcggtagcgtcgctgtttgctaggtgggacaccgggattcgtcctactcgatcttacgttattcctaacccaacacactagatatgatttttataaactccacatcattgaaaaactagtacgagacattatccttccaatacaaacaccactattccatacttaaatttaatactacttatctcacatgatgtcttggatgttgtgtagaaactatgatatgcaagatatggtttccttctcttttctcatttattcacttgccacatcattttttattctaggtgacagtttatttaatgctatgaacaatattcattgggttgggaattaccttaccccttttatgttatcccgatcgatcgatagactttgatgactacattgacgcgtagcgtttcagaggaggggaaaagcgtgtgcttcgctcgctggcgctgcttccatccacccgtacgtcgtccggtcccggtctggggcctagcttgttaccgtttcaccgtcgcttttgcgtgcggttgcacgttatttcggcctgcgtctgcgtatgcgtgcgtgcgcgtcgccaggcagagctagccgcggccaacacgccgcagcggggcaccggcacggcaaacgttcgtagcaacgcgcgggccatatctctatcaacggcctcgtggcggcggtgcggcaccgcacgcgggtggcggatcgatcgaccacaacccccccgcatgcaggttcgttggttccacctgcctccccagctccccgcgcgtgagcccttgtcgtcgcggaagcgcacgctgctgcacggcacgggcgtcagtcgtgcggcggccagggaatgtaagccaatctcacgcgacggcgtgacgcggtgggcggtggtgtggtgtggagcccgtctctccggcgcgtacgcgaagccgtcgtaaacgtctcggttttttgggggcttcactggccgaatcagccaggatctacgataggtacgcgttttttttttttgacggagacatggaatagtccactccgtagacggtatcgtacggtataccagctaccggagtactattctgtactggtatgtgactttccaggcagcgccggtgatctgaactccgaacgcacggcaggctacgatcagccaggtggactaacacgcctacttataccgaccattcctatttgttgtaaagtttaatttgggtcctgtgtatgtctcacggtagttgactaacactcgaaagatgaggacaagtattaggagttaggagcactgtccatattccaatgtgctggacaatcaacgtatcggcaacttaattcctttccaacaaggggtatttcatatcccacgttgcatggaaaccggccagcggcagattagacacgcggacgagtttcgtcatcagtatcagaatcctcggaaacaaggttgagatgccacaaagaatcaagaatccatgattaaattttgagtggattcagtttcatatcttataaattttacttcctccgtttcttaaatatttgaagccattggctttttttcaatatatttgaccgttcatcttattaaaaaaattgagagtaactatatttatggcgccatatttttcaccaaaaaatagtcagcatgtatttacattgcaagtccctaaattacatatgtaattttagtatatttacagtgtaagttctaaaattacatatgtaagtcctgaaattagatatgtaatttttttcatgaaaacacatgctgacgagataagaaatttgaattgattggcttcacgatgcaacacgaaacacataaagacgttcaatgcacatggtattgcaatcatagcatgaatctcaagggagatcaaattgaacaagaaatcaactgtgattactcacaaaatgtgtcgacataattatagcaacacccaaaaaatttaagtaattattactacctcagtcccaaaataagtgcagccgtgagaatccgtgtcgaaggtttgaccgtccgtcttatttgaaaaactaggtgaaaccccgcgcattgctgcgggaatttaatatgataacaatagaaaaaataacgtgtcagataactagataacatcagattaagtaaattaatgtggtttatgctaatttaaatttaaatagtatgtagaatggtgattcaaatgtaaaaagtaaggtggtatgactttatagaagaagaaaagtagggagatagtttggacaattgatatgatatgacttaattagagaaaaaatagaaatataatttgtaccatagattaatcatttaagcactaagtatcagtgaggatgaactatataagtatataggatatcataaaacataataaagatatacgttgaaacattacgtgaattatattggatgataatttaacatgtttgtatttgaaatgctcttaaattataaaaactataaagatataatatgtttgcatgatgtttaaatgtgatgattgttagtggatgataatgtggcatatttgcatgttaagcttaaggagttagtgggggataactttatagtaagataggatttatgaaaatattaaaaaaagttagtcacacataaagtactatttatgttttatcatctactaacaacaaaaatactaatcattgaaaaatttcaaataagacgagcagtcaaacattggatgtgaccagtgcaaaactgcacttattttaggacggatggagtaattctttttctatcatttgattcattgttaaatatacttatatgtatacatatagttttacatatttcacaaaagtttttgaataagacgaacgtttaaacatgtgctaaaaagtcaacggtatcaaatatttgaaaacggagggagtagtggagtactatactggccaaatatttgtgtgttgcagcggactattcaaatcaaaaatagcaaaaaagaattgtgtccttgttgaacaaatactacatactagtctgtcaaaaaaaacaaactctggctatgaatctggacacatgaatctgaacacacatgtgtccagattcatagctaggattggacttttttggaacggagggtgtatatactagtactaaggtcctgtttgattaagcttaggattattataatctgcattattatgagcaagctgaaacaaacaagtagattattatgctagattattacaatgtataagccagattactataatccaataatctcctctagaggagctttttccagattattgagtggctaaagacctactacccttagatgcctctaataatccagaaaaacaaacaactagtagcttattttatatcagcttattataatccagcttagagtaatctgatttaataattcagattacaataatcttaagctgaaacaaacaaggcctaaattcaattgtcgacacctttgtttggcacaactcctagcagtctagctcctagacatccatgaatccagctttagggttcttctagtgatttcagttcaaattatagaaagttcttcgtacatcatggactcttttatcatgaagttttggatctcaaacacagaccgcgatccaaattaattcccagaataagggactcatttgcaaagttccagtacgggacgtcgagcagccgttacccgttggatagagaagtgggcgactaggattgacaggcgagggatatttgcagaaagaaccctgggtacttggctatcttttaattgtctttctatgagatgaaccccatctctcaagtgtcaagtctgcgaccgagttctaaaaaaaaaaaaaaactgcgagaccgcaaaggaagaacaaaacccatcaaaaccctcgttcgccgccgccgccgccgctcgccggcgaagaacccctgaaccctccggtaagccctggtagttagaaaccgagtacctaatctcatggcgctcttcctgcgccgaggcgcggcccttgctgcccgctccatccgcgcagccgccgcatcctccgcttccacctccgtccaccgcctaccgtccgtcggatccctcgccggcgcgagggagttggcccccacgaagctgttcctcctggaggcccggagaggcttcgcgaaggggaagaaatcgagtaagatattcatccgctctcctcgtgtactccccactccccattcctcattagatttttgttgaaaaaaaaatctttcctgcctgtcgattactacttgtattagatgtagttttattgagttaataattttcaaattaggttaatgcagttgacgtgggatttgcaacatagctttgtagggcttaaatgaaagcattcactctgatgaatcacccatatttgttttgttgtatgtgattagaggatgatggtcgaggcgatacagttcaggatgctcctgacattggaccgactgtcaaatctgctgcaactcagcagatggaggcagccgttgttgcattgtcacgggagcttagtaaattgcgaacgggaagagcttctcctggtaccgtatcgtcgtaatctcaatctttaccatgtcattgtttcttcggatagttctatctcttgaacagaagatgcgacgaatttcttctgcaggtatgcttgatcacatcatggtggagactacaggtgttaaggttgcgttgaatcgcttggccgttgtttctgtccttgatgcacataccctatcagtgatgccttatgatccgagtgtaagagtttttcttgcttccttaattgttgctttgacaaaccaatagattttgttgtcacttcttttttatccatattttatatgtagaggattgtgactaattttctcaaaatatcatgcttggtcgttgtcattttaatcacaagttatacagaagtccaatatactagccttcgtacaaatgtgtttattatatgttttctctctggaggaacagcgttacattggatcgctgtttgtacttaggtttctgttggggcttcctttgacttgttctagtatactcgtgtagtcaatgaagtctattgagcatgcgatcatctcatctccattgggcatcaatccaacacctgatggcaacaggatcatagcaaacatcccaccgtaagtgacgcctatactgtttctaactattatttattgtggttttctactccacatgtattgctgttggattgtttcttatcaaccatgctagtgatgttctgctgagtgctgaccacctgataaatcagcaacttggatcttgtagaccagcatgtgagaatgtagttaatttccatggtcattttgtactcgtagaaatggttcaacgattaatctgttggttaactatggcccaaaaaattgctggacttaatattcagtagcacttttcttctgtttccagtatatgatatgcatattcctctactcttaaattttctttcttttgctaatttgatttttgtgcactcccaggttgacaaaggagaatatacaggtgagattctaaacttgaacttcttttatatagctgaaatgctgattattttctgcatccacaatataggcactgtgtaaggttgtcactaaatctgccgaggatttcaaacaaagtattagacgagcgcgccaaaaggtaataaaacgataacttgtggtggatctggattactattatgctatgttcagaatttttagttgattaatgttttcaagcctttagttggcatttctaggtgtgaggcatacattttgttaatacaaccacagatatttatttccatttgaaattgacatctaatagacaagtgtggtgcaacataatttttggtgtattattgtataccctcttctctatagcattttgccatccattaaaatgggaagtattactttactttaacaagtttagattgagtagttaaggttcatctgatctatttatcttataaaatcggttcaactctcattgtagagttctgaagatagaatttcctatagcttctgattgttgacaccaaatatagtttcttcaacatcctacattatgtagaataaacacttattcttggactatcatatcataattggattaggtgcatcaatgctgatggagtagatgatgcattgtactatatctgaattctgtattattctttgtttctaggcacttgatacgataaagaaatctgcgtctggtatgccgaaggatgatgtaaaacgacttgagaaggaggtgagtaactgaattttggtgtcctggaaataaagaagtccacatggtaacaaacatgtacctgttatgtaccaggttgaagaattgaccaagaagttcataaagtcagcagatgatatgtgcaaggctaaggagaaggaaatctctggaaactgaggacgttaatctggcagaagttttttcttttacttacacaactttgatgccaacgagttcacgggttgcaattctgcagcagccgggaagatatatcttttttgtttgtgcccgttctaactatgatgttagaaattcgaaacagtgtgataccaagggcggcctgcccagcttgtgacaaaacattgattcggttgcaaggcactcatgaattcacgaatcgagaatgagtttaccctaatgtgtgcaactgcgcattgatgagtttgtttaccttaaatcattagaatttcttctatcctttcttggggtgatcaatcacattgacagtgcttatatgttctatatgtccaattctcagtagataaagtggtgagacgcaccgtgaaattttggaaatgatactgatatttcagagggaaagcaactacaagcagtcagctaaaacaactttagccaagcaaacaaccaccaaaggctatacaaactccaggcccctgaaccaaaaagacatcatggcaagccaacccaagtacccaacccagccttcgagctgaaggccagcagctgggcacacccactacactcttcgcggtctcccactccctctacgcccctactctttacaggcacgctcgctgcgaactaccaaagcctacggggagcaacaaaacacaggggcgtctcactccttccctctcttgccgtacaccgccctggtcaccgcccggatgcccctcacccacagctccgcctcctcctcgccgccctggcacacgaagtgcacctccctccccgtcgccgtcgccacgcggaacagcccgggctcgtacgcgtcgcagccccgcctctgccggtgcagctggaacgccgagctgccaccgagctcggcctcccggcacaccacgttgcgccgccccgacccgccccaccggagcacgcccgccgcggcgaccatccgcagggacttgccgtgcggcttgccgcgcccgcacttggtgtgcttcttgacgtgggcgcccccgaggacgagctggcggcccagctcgtccatgatcacgtcctcggccttgttgaacgccgcggtggccctcgccagggagagcgccgtctcgccgcgcggggtccgggtgtcgcaccgcgcgccgtaggagatgaggagctcgcacacggccgcgtgcccttccctcgccgccagcatgagcggggtgtagccgtcgccgtccgggatgttgacgtcgcagcccgcgctcgccaggtggcgcaccgccgcggtgtcgccgcgccgggacgcgcagtggagcgcgtagaagccccccgcatgcccttctccagcgg

SEQ ID NO: 63931 - DNA, 14154 bp, Oryza sativa
gggagcacccgtccacgtcctgctcgtcgacgtccacgtctggctgggccaggagaacttccatcgcggcggcgtcaccgcagctcgccgtgaacatcatcggcgagaacacgttccggtcgctcgaccgagggatcgtcccggaccgaatcacgccaagaacggcgcgctcgaagccggccttccagcccccggaacaagcgacggaagccgcggactcgccggccgagttcaacagcgcgacgtccgctccggcggacacgaggatcctcaggcaatcctcgcgcttgtggcgcgcggcgagtatggccgcaacgtcgccgccctccgccctcgcgttcacgtcgcatcccttgcctatcagcatctccaggatctccggctggccgaggcgcgcggccatgtgaacaggcctggacctggagctcctggacgtcttcacggccacctcgtggtccacgccggacgccagcagcgtctgcaccgcgccggcgctgccgcagaggacggcgtggtggaggagattccggccgagatgggtggcgcccgacgagtacccgttctggaggagcatgcggaggatggcgccggtggactcgtagtactccacggcgcaccagaccgcgtcgtaggggtccgcgaggccggcgccgacgcgcagctcctcgccggtggccgtgtcccatgaccacgctcccagcctcaccttggtgtccctctttactccggcctggacatgagatcaaaagatggtgttagtatagctccggctgctgaagagcaagtgcgtgtgctgccagcccgccaccagtggagtggtgcatacctgaagtagctgacgaacgacggcgatttgccggctgacgatcgcggcgaagagtgccgtgcagtcgacattggcatgcagagaaggcttcagagagcgcaggagcacccgagaagtagcatttgggtcagctccacactgcgaaaagatcagacgatattagctgcagcaatttagtcgtgtactaattcaagcaagaacgccggcacaattgtactctaaacgaattgcaaatgtgaaacatatgaagggagaagggcacaggtgtacaagttaaagaacccagatgcaaatgtaaaacatgtgaatgccacaggtgtaccgtgtacgaactacgaagtgcaaaagtagtatgtttgaaggacccaagtgcaaatggaaaaaaaattgaagggcacggatgcaaaaaaatttgggtaagatccgccgaagcgggtagccttaaccgcaatgtgctagaggaaagtccgaagactgttcccgtccctgtcaggggagatgccaaccgtctctcctttctacgaacacgctagatgggttaccgcttcgtcttataaaccagtgcaaacgagcaagaataagcgaggtgggactaaaccacaacacggctatctgcttctccctatgggccacggcccatgtgactaggcacactgggctcgacagcatctggactctgcaaaacagtacaacaccacccgcaacgctcgctatcggggatcaaatcgtcctgcacatctttaatcgcgcaatctcatggaacgagaacgatgtctctacagatgcatgaaggctatgaagccatggagcaaagtacacacttaccttgatgagcgagtccaccacgtccacgaagccgcgggcggcggccgacacgagcgcgtgcacagcgacgcgagggcggacgaggtcggagcccatgaagatgacggcgagggcggcctgcccctgcagcgccgcctccacgacggcctcctcgcacgccggctgcgacgccccggcgcgcaccagcaacgccgccacctccgcgcgcccctcccgcgccgcggccgtcgccgggtacccacggaacaccttgccgttcacgtccgcccccttcgcctgcaggagcgatgcacatttgcgccaaacattagactgtgctaaagaatgtacttctggttgctctagacacaagtttctgcttgtaatgatatgaacatagccaaaacgataatgttagcacaagttgatcaaacaattttctcagattttggacagtaactcagcaaacaagaactgatatgcctagtacagtttctccttttaccgcatgctctctctttcacctacattgctccacacaccgcgggataaggggtaccatcaggatggaccaacacagtagcacagaacagggcacaacaacagccatcgggacttggaaacatagctggccgagtaacaaatgtcgctgttactactatgtctggtcaggtcggtgatgtggagacttggtaaccaatggactggctagccagtctgtgcaagtcctgtggcaatggcactgtgccatgattcatatagcaagagacagaaggggcctcctactggaagaaggaatctggtcaaaattctgcagggtgatgctatccatcgatatatgaaatcttgatgtgtggtttcaccgcaatgtcagctcagcctcgctgaatacagtagttggccacagctaactgaaaattatctaaactggaaccatttatctctttcaacatcatatataagaatatttaactacccatccttgaacatttgctcttagagaaaatgaagttcacggaaagacaaatggagcaagaaatgaacaatgcaggctcagaaataaaagatgctagtcctttggtccttgctactcctacattctgattctgatgatcccaccatcaggacacatcatacaaattgtaaactcctgcttaaccaacccttggcattttatcaagatccatcggacaacaagacaagagacgcattcaattccacatccaggattctcatcacacaataaattcgtcgcaccaccacgagtacagtgctgtgcatgctgctatttaccactctgaaaactctgaaccgaggtgatgttctcaaacagcacttacgtggcacactggcatccccatgccaccatcaatattccaccgggggccatcaggccatgagcacacgcggggctgagcagcggccggcatacgcagatgcccgatcggcgaagcccccacgggccgtacgcgagaggcgctgtgcgttgcatgggcgccaggtgcgtgcagcagcaagggaggatacagctggccgcgcggccggccggtggcaggggaagcagatggctacagggcaaagaagaacacgacaccgtccacacatacggggtgcgcgaggagagcgagcgaaggagcagccatccatccgtacccgcgtcggcccagccgatcgatcaggcgccggtgtgggggcacacatcgatgcgtcgcacctgggcggcgacgtgcgcgttgctgtcagttaatagggaggcccttggcgctgcctgccgtggaggaggccgcggccagatcggggctatactccggtgaggagttgggtttttcatttctaaggcgtgatcaaatacagctggtgcggcttggacgtattggaagcggcggacatcggatccggttacttggctgtgtacccaggtgcagaacatgtgaactcactgatgatgttgcgcatggccagagcccgggagacatgacatgagctgagctgccgagcgacgctggcctttggatggccacctgacctcggactctcggagtcagttcagtctatggactgtgggtagacagggagatattccagtgtagaggatggaagaccccggcgcaaaatgcagaaaagaggatggaagaccccgcaaaatgcagaacaaagagtgcattgagaggtgattattgatgagcagttcatggctgattccacagtctgtggcctgtgggagtcagggtgacgttccaagaagaagaggaggccccgcaaaatgaagatcagagagtgcatggagcaatgattagtgatggacagctagcatgacatgcatgcatgcatttcatgctcaccaaacgggttcttcaatccttttttcctctgtgaaaaaaaaagatcctccacattttcacctcctatgcgttttgggataaaagccacggctatggtggctgccgtccttggcaatggcatttattgatcttttgcagaggccatggaacgcgccggtacagtcgtacagaggccctcatggccgtggcccgtgcgagctcatctgcctgcaaggcaaaaaaaaaaacaagaagaagaagtacacgcatggccgtgcccggctgctcccctacgccccgtcgcagcgcaaaccactcccctagtcccttgccactcccattcaattcaatgctgccccatgacatcggcggatcacccggtccgcgcaccacacctctccactcgtcagccatcatccaccaacactacttctccgatggtcagaaagtacccctagccgtccgatcgcggtgacgcgatcaggatcacaagagtgacgggcatgtgggaccccgagggggttgaatgagtcgtgagtgtgattagggtgacagggcccaatgcaaagtaccataggatccagcaccaaagcgtaactacactctcaagattaccgggagtaagtactcctgcatcaacaggagagatcaaacgaggggagaccggaagagcagagccaagcagatcacgtgatcccacccccgaccaagctcacgaggggaatatattggtttctaccaaagcgttgagctggtacttaagtacttaagcccggtacactatggaggagtacttaacaccagtgccctctgatgcttacacagattcattacattatcaattttgctaaaggaatgattcattatattatcagcagcagtaaacaaagaggctttggtcaggtaaagtcaaacccatctacccctgtcccccaagcaccagtcctctcgagctaaaaacactctcactcacgcagtgtatataattaggcttaccttctagtcgcagcatgcatgatgctggaagcagcagggagaagttactggaaatcagaatctttagcagggtacttgcgcacagtatcgtatccttgcttataggaaatgcgtttgatggtatatttgcttataggaaatgcttggaaaccacattcgccaataggaaatgcgcgcacagcatcgtatccttgcttataggaaatgcattttgatggtacatttgcttataggaaatgcttggaaaccacatttgctaataggagatgcttttgatggtactggtactaaaatacaggcatactataccgtatgtatgcgtgtacaccttgatcaatgcgtacacgtatttctagacaataaagagtgcccaggaagcttccctgcctatttgcttgtcccaattccagatttttatcatcggtatatagaacaaatatgtccgtacgcattaaaaacgaactgcaaatctgcaatgcaaagcatggtcccattgcagatttgcagccatgcggggctggtacttggtaacttaccttctagaaactaatagtagtataactgtaaaaatacaagttcataaaaatattttgctaatgcctataaaaaaaaactttgctaaagaagcacataattcggtctaaaactttggaaaatatctcatgatgagtaactttttccgttatggtttcccaccaaaaaaatgaaaagaagttccaatatcatagagagcgacaataaaagttagcgaagtttggaagtatacttattttttctttccaacaagtcctacttctactcataatttgggcttattaaaaatggcgataaaactttttaaaaaaggatgatatttgtctagcgcgtgcatttatacagtacattaaaatcatcatgggcacatagaaaaacaatactactacctgagcaaccatgaaaaaaaaaagagatcattagactgaacagtgggcaacttttatctagcacctattgggtgtggagatggcacttggcagtgcccgctaggcccatttgaaatgtcgtccaaggtttccaccaactcgaatgcttcaggagaaatgaaactagtgttaagtgaatttcgagaagcatgagtgttcagtgcttccttccgagaactaaattgatggtaaatgtgctcgagctctgcaaattttatgccatttcgccaccgacaccagacgctaattttatggggggaatgcgacgtattcagttcgaatgcacaaaaacgagaatggctaagcattcaaaccgcaccaaacgagagcattcaacatgcgacgaacagagcatagtaatgcggcgaagttgtagaacagagcaggaaacaggggagggcactcacaagcagcgcacggacgagcgcggcgtccccgttgccggcggcgaggaagagcggcgacacgtcggcgcggatctcctcgtgcgccgcccgcagctcagcggcggcgccgtcccgcagcgcggcctccgccacccgccgcgccttgagccacaccaccccggcgtagttcacgtccgcgcggccggacgcgagcagctccccggcctccctcgcgtccccgcgcgccaccgcctccaccagccgctgcgacgcggcctccgcctccgcctcgtcccgcagctgccggtggtggtcctccgccaccggccacacctgccgcccgccggcgatcgccgccgccggccgcagcagcactgccatccctaggagagcttctcgaagggcaacaacctctcctcctcctccactctctctcccccctattcgctccgcgatctccctgtgcggctgcgactctgagctttttccttgggaaacttgaagcggcaaggcgcgacgggacggagcaatatataggtggggactcggtcgctctcggcgagcaacaacaacaggaagccggcacggtagagttaccgcgtgggtgaaactgaaaggtgcaaatacggggggcccacctgtaagcggggatgtgctgctgctccggtggggtaagagcaagttcaatagtacagccaactactatcttcaattcaactatagccagtctaatagctcatttatacaatagttacatactacactattaatacatagtcccatctatcatacacacactgtgtcttggagtccgtgctacagctggctatatatttgtagcttgttgcccttctctctattcatttatctctttaaaatatgtttgcagctggcttatagcctgctattgtacctgctctaaaagggggtgcgtgcatacgtggaggggtgcgtgggcccctcccctagtatggtgggccgggcgtgatggcgttggcgtgatatccatcactctctcctcacctcacggctcggcgcctccccggctcagcggctctcggttgaatccaccatgcgcgccgggcgccgcgaccacaccactcgcacacggcctagcaaatcacggcgcgacgcagcgcaaccacgcgaaaacgtgaggcggcgggcgggccgcccgcccgctccgcaccgcgcgcggcgcacgagcgattcgcgtcgcggggacgaggagatgcagtacattactatacgtggcttggcagtcgcggtcgacgtggcgcccgataaaaaaagccggtgccggcgctgccgccggcgcaaggctaggggaaggggcctcacaatattgtctgtcgatcgctctttccccgcactccgcgctgctttgctcccgctggcatggcgcgagtgccgccgccttcgctgggatttcagaaaagaaaacaaacacacttgtcgccacaaaagctgccgcgtgtctgtcctcctcccgtcacgccggttttacagttttacaatgtatactccctccgccccataatactccctccttctctaaatgtttgaggccgttgacttttctaaatatgtttgactattcgttttattcaaaaaattttgtgaaatatgtaaaactatatgtatatctaaaagtatatttaataatgaatcaaatgatagaaaagaattaataattacttaaattttttgaataagacgaatggtcaaacatgtttaaaaaagtcaacggcgtcaaacatttagggatggagggagtataagggattttgactttttttcttgcactttttgaccattcgtcttattcaaaaaattttggaattattatttattttatttatgacttactttattatccaaagtactttaaacataacttttcgttttttatatttgcacacatttttttaataagacgagtagtcaaacagtgcaagtaaaaagtcaaaatctcttatattataggacggagagagtataatagtaggctataaataggctaaatgttgagatggaggagagagaagaagaagcaggctataaatttacagtcggcttaaacacaagaaccaataaactttgagagtgacaagtggaccttgtattagttataaagagctactattatttggataagctaagagaaaactataaaaaaccttatagccagcaggtcggctgtattattagacttgctctactatgctcaggtaaaaattacccgtttttttgacaaattgacccttttggaaaacttatttcgaaactaacccctgccaaaaacttcaaccaaaaataggccgtcgcctcagcgccaaacacattggcgctgacgttggctgtgtcagcgccaacgggactggcgctgacattgtgccaccgtggcggccgggccgatccccagctgatgtggcagctacctcagcgccaaccggactggcgctgaggtgggacttggccgcaacccccaaggcccagaccagcaagccttctggatggcttgcgggctgggacctcagcgccagccataatggcgctgaccgtgggacactcagcgccagcccacctggcgctgaggtgggacttggccgcaacccccaaggcccagaccagcaagcttgctggatggcttgcgggctgggacctcagcgccagccataatggcgctgaccgtgggacactcagcgccagcccacttaacggcacattctcctctgcatgtacttcctcccttactgggtcattctcttccctgacctccacatccgccatatcatttactccctcgcccccctccacgtcttcctcaatcaattcttcctttctactacacctctccgacagttcgtgacagctaatgggtgattctatgagtggactttcattaaggtctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccgcccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggctgccacggtggcacaatgtcagcgccagtcccgttggcgctgacacggccaacctcagcgccaatgcgcttggcgctgagccgacggcctagttttggttgaagtgtttggcaggggttagtttcgaattaagtttttaaaaagggtcaatttatcaaaaaaagggaaaaattactccctagtagatatacatacggacagttacacagtcgtactactagtagcacccactcattcactcgtctcgctcaccttttaccccacctatactaccagtagtaccagcacgtatttctcgctcgtttactccggccactacaggctctctggagcccggctgatttaccacccagatcgatctctggagagcctggagcgtagtatgggtttcgcctgccgatgcgtcagattgatcgctaccagagccgatcccgtatgagtgaatgcaggctgctgctgctgctctacgtgctttcccgtggctgtaacgcgggccgggggagtactacgtgccggagccgaacggtcgccctctgttttttgcaatccttaccaccgggctgcctgccctgccctgctgcgctatctgcatccggcctggccgtgcaggtggtccatccagagtccaggagatcgatcgagggagcgagaaggagtcaagccggtgccgaggaagctaggaacgggtcgcctctgcagcggatggagttggcaggagaaaggatatggtgatgttgtcgtagcggcggtacgtgtaagtatgtacgtactcccacatctcgtgatcatgcctgcgttcgctgctcccctctctggttgctcctttggctgttttctccatggagacagtttgctttagttggtgttctggtctaacgaagataaacttcatgttaggacatgaaaaaaaaataagaaagtcatttacacacgattaactaagttttaaaataacttttatatttgaaagctttcacaaaacacaccgtttactagtttaaaaaaatatactaacagaaacagagataaaatacatttcttaattaaaaaaaccactttactctctctcgtcgtgtactcctgctgacatttttctttcttcttcggtctctttgttcttgacagttgacaccaacttcgtttgctactctgaatttagagcgttttgctcatcagcaaagttgaaataatgcacaccaacacggtgcctgcatttctcaggtggaagtgtaacccgggccggttaattacaggtcgagtagtaaaatggcacccagttgccatgtgtgctgatctagctatacattactcctacgtgtctggctctacgtacgtacagctaggccattttgcctttgtcgtttccgatgggaaactacacgacctacttgcagttgtcaacttgtcaagtactccatacacgcacttgccggtgttcgacggcatggcgacggcaagggtgtatcgaggcgccccaaaaaaacaagcctcggagagctcgccctttgcccgatcgaaccaaatacttgtatagctgcattttatactgtactgatctctattatactcgtgcattgatgcgtagtaagctggagtgttaatgtagcatcaagtgccggccacttgtttagtaggagtaactaaattagtactccgtagtactctacgtggttagagatcacaatctgaggaggaacgtgcatgcaaatagtgtgagagctaggagacaagcgctggctgcgccgtaccggtaacccatctggtcgatccgtgcatggcgcaacttctttctttcttttttttttttttaccctttcgctttctctctgcttcttttccggtgaagattttctcggcctctcttcctgaccaagatcaacacatacaagtgtgctataccaacgagaggaaaaagaaaagaggaaacgaaaagaaaaggggaaaaaaataaagggagaaaggctgtcgagtgtctaggcaattcatcacgtatttcgatctggttggttgctctgtttccttggttttgtgtgaaatggaagagatgataggtcgccactcagcaatgcacacacactatggtagtagtactagtaactgccgagtacggagagtcagtagaaagtgaaaaaaggagtgcagattatgtgatggaacagaagggtgattttgtgcaggtttttttgcagcgtggcagaaactggcacgagtcaactcttgctaggggaaggatcataatcgtctgcttgcttgtgtccggagtcacgcagcattcaacgatcgattactgggtctccaattggaaggccgtgatttacgagaattgttcaagtgcttgcacggataaataaaaatagtattaacaatgtagtgatgaatggttagagcaaaaaagaaatgcataataggtgtggccaatgcatggattgcgtgctttagctactcaaatttttctgttaagtcaagtggtattcatgtgtattaggccaaaatccttagctagctagctcatgggtggatcgaatcatcatgagcatgactgcatccatgcattttgacatgttgcagcggctatcaggtagcatttacagtttgttaatctgccacgaccgcatagttgcattaggtgcacgatcgatagatacggtccgaatcttcgaggaagcaacgttgaaagggcaggcttaaggctgactgagaaatcggtccaattgttgggaaaatccagtgttttaagctgcaggtacttggcgtatcgttattatttatttattggatcctttccagccaagcataccaaatgctagcatgactatacttttctttcttctccatttttttaataaaaaaacatcataccctaacaatctcacattttctttcaagataccttgtactactgttgtatgaaatacatggagtatggtttttcaactggatgaaaatattggcagcgcatatatattggattgcaagcaggcaggattgataggactacacgtgcgaccaagagatgcatatgcacatttcagcgcactgtctagacaggagcaagaggggataacagtgagaaacctgtacaaggagtcgaggatgcttcagtccaaaaacaaccaaaccatgcatataccaacaaattgctcgcagatacatataacaagaactgctagtcctcgagcacatacccaattattatgtgtgcaacaaacagttcaaaggccttatctccttgtcattggcaagatggctaggtagctactactctctaggcaatagagcatcgatcctagctgccgttttctagggttttagctggggtgttgtgcattttttgggaggctacattacttgtagccatgtgccacaaggagcttggggctgaggatattcatgcacataatcacacatagtacatttttgggatatataggacggtgatgatgtgttcactaaccaattcaagtcatgtgtagcttgatattataactgataggcattgcttgtcctctccaactagccatgttcgaaatggttagccaccaagctcaactcctgtcgagacccgtttgttgctaggcaggcgctagcctctgagacctaagctgttcttggtcattgccattgagctaatcaaaatttgcctggattaaataaaaacataggcttcgtacgcaagattacttttaagtacttctatgatgcttcgtgcttttgcttacaatatgtatcacaacagagaaggaaccatttggcacttgaccaaaacccaggccgaggacggcattgggtgagaatgagtatgaataagcttataaaagcagcatgtttatctttgtaa

SEQ ID NO: 63932 - DNA, 3183 bp, Oryza sativa
aagttgaaagtttgaagaattattttggaattaaacacggcgttaaatagggaccaaaatgcataatttggaaatgctaccactggcaaggagtcctaaaagggatcgctttggagatttatcaacccatcatcaggttggcggcggagggatttggcaggcggtggaggccgagcccggcgcttccggctggcggcggttggatccgctgtcctcgcggctggacctcgtcggacccttggcgacggcgacgggttctctccgcggtgcggcaccctcgccgttgcagctccatgtgaccacggagggcctcggctcagcatcctcatcgtcgcgcccccctccccctggtgccggcggtgtgggctgggcccggtgcccccagctggcggcgcctagcgatggcgggctccttcccccgttgtccccgtccccccccccacaggttgtccatgcgtgcagcgttgggtctgggacggcacacgtggagctacgagggccggcgacgtagctctaccctccagccgccgccggccggggttgtgcgtggaggggctggcttcggaagcccggacgtccttctacgcgcgttttggctgccgacacgtccccttggttgcaacaaacctcttccccttctccctagtgccctcgatattgtgccttcttccctccccgctccaaacctgggcctattccattgttctttggtttgctggtgttattccccgttcaaaatcttctcattttcagcttgctcttgacaattggtccagatgtttgttctgggatttgtgctcctctagcaccttggctggcctctgctctgtgccctccgctgaggttgcggttgatgatctttcatcagtgaattcccccccttagccattttccttttgtctaactcctgctcatcttcacccccttccttgagaccgtccaagacctttcagcgtttctccctccttttaggcttccttcccttgaaggacgttggagtgtgttgatctaacaagcaactcgataaagtttgattgaagaaaactcattgtgggtggccttcggccacatctttcagtgccctccctcttctggggcttccttcccccagagggcgtcggcgggctttgatccaaacaacaataagatcaagttagcttcttgatgacttcatgcgggtggcctaggacttctacaacctttctttggcctttcttctattccggcatgcttgtggctgcgtgaggaaatggatgttgataagctagggtgttagctttaggttttggttttggccgggtaattttgtagatgtcgtttgtcaattgttatattttaggaggttttcctttctctgttctctcctctttgtattccccgtgtattctgttctcctatcctccagggcttctgcgtttctataggtgaagcctgccctgtgtaagctcatttggcttaatatattcaggtggggactcccccccctgccggtgatttagtcaaaaaaaaaatcatcaggttgggctgcgtgcttcccggtggcaacgcggcattgcggccgatatcgatccaagcccagatccactggccgttcaaggcctcatgctgaattgctgatgctaaacatgctggcaacgtgtaaactgaaataaattgaatactaacctactgtgaactgcttgaacaaaactagttgaattggaagatataaacagtatcgcttatgctgacgcaaaccaaatgagaatatgttttagaaaagggctgtagctgcatactctgtagaattctgttttgctgctattatggtggcctggctttcttttgcgtagcatggtgtaatcaacactaatgtttggacatatgtaatataaaatctcgcacaaaaaattcaaatactacatgaaggccaccggtgtcaaagaaggcagacgcagagagtcggaaggaaaagaaattaggcagagcaacatcagctagctaaaatgtcaacgtagaaaacaaatttgcaccgttcgcctaaaaagactctaactcaagaacagagattaaccataatgttactactgaataagctgaggaataatcatatatggcgggagatcgttcgtccgtactcgtacccgagggagacaaggcgacgaaggagcgagccttgaattcctccatggctcggtccgtagctcgtcctttcgcccccttgctcggtcgggaggaaggaaattgatttgttttgggagaggcacgaggggggcgggaggaggtggagataacacggggagaagaggaaaaacggtggcttaatttgtccagagccgccgaataatagcgtatggccatgccaaagcataggcttggcggttggcgtggcgctactattctcgtcgtcctcgtcgtcgtcgaacgcgggtcgggcaaatttagggcggcgagtgaatccgcgcgcgcgcgtggctcaaatgttggttcgttctttgccagatcgagctctggctggggtgatcgggccagcaatggagcagagcacggatggtgttttcctgtgagacatatggctgcgcttcggctgagtacagaaacggggtgcaggttttgctggcgattacggtgtctgttagtttgtggcctgattataaataccgtaatgctgcgaaaattaacgtatcagctggtttgcccgagtggttaagggggaagacttaagatcttctgcactgaagtgcgcgtgggttcgaaccccacagccagcaatatttaatttttttaaaaaaaatctcaaaatctgcatttttttaacaataatacaagtttgaaaagtagggttttgaactatttcaatttatttttctgattttctctcaaaaactgcaatattcgaacaatttcattactccaatagaaattttgttttctaaaatattttttgaagtccaatacaagtttgaaaagtagggttttgagctatttcaatttatttttctgattttatcaaaaactggattttatttttgaaatatttcgtagccccaatagaagtttagtttcttttaataatttctgcagtccaatacaagtctggaaaaaaactggatttttgaacaatattgggacccaacacaagtttatatttcaataatgaattttttggactccaatacaagtttattcattttttttcaaaaa

SEQ ID NO: 63933 - DNA, 3422 bp, Oryza sativa
cgaagaggatgtggttcgccgtgtcaagatcctgaacgcaaaaggggcagcccaagtgactatcgatgccacgcttctggatgagatcagccgtccagcagcgccgctggaatgcaaaccaaagaaagaacctgcatttggcaggaccctttgcatgccaaaaaagatcagcacaggcaaaggaatgctggccatagaagaatgcctggtatgccgaacgcgcagagtagcgctggtcagctgtccagcgccaaatgagacaatcctcgacacctggcgagagttgtacgtgaagcaccgcatcccaaataaggagaaaatgggagatgactgggatagtgagggcacctcgaatatcagagacccaggagttgttcgctagggcagaagcaactgtgcgtgaacctcaaaaacgttggggaacgacgaagaggagatctggagccaaggacgccaccgagcggccgtcgatccattggtcagatgagaagagcatagactcaccatttcccggcacaaagaaagtggatgccgcgaacatgtcggagacggtctgctagactggggcctttaggccatcctagtaggggtgccctgagcgctgaagccaaagccagcgaacacgtagggcaaaccctgccaacctgaggtcagtgatccccaactcaccaccggttttggagcgacaaacattcgtccaaaacacctgacactgcccaccatgggctgagtccgtacctgtccacaggaaggcgcgacgcttattgtcaatggccttaataacccagactgggaggccgatcgccatagattcatggactggaatggagaagagaaccgactggaccagcacagaacggccagccagagtggtaaatcgtcctttccaaggacccatgcatgttgctaccccggaccaacactgtaaattttctggataatgtctaatgatctgtatgaatcataacacatcactgaatcttgtctaatgttggccggagaataccctgaaaccagcaaccagattatttgctaaccgctgggtgaaccaatcactatttaccacagcaacaggacagctagaagcctaacatccagagcagcagagctccttgttaaaggaaggaacaattctagtctagtttcaattaattttacagctcaacaaaaggggttggtcacactgacaaaagaaaaaagactggactgatcgattcactggtaaaggtttgatcagacgacttcgacctttcgtttggaagagactgatgacctccattactttgctcttgtcacgctatatgctgcctgctatacctttaatttcctgtcgccaggcaaacatgttttgaggaccaaggagaaatgtcatcaaactagccagcactgcaatttgcttcacatcccattttagtcggctggtctgttccttgatgcttgcttgcagctgcaggtgcatttctccttgtcttccttcagagtctgcacacagggaaaaactcagtgttgtttccgggttgcgttgtgcttttatatatatatatatatatatatatatatatatatatatatatatatatatatatatatgttactccctcatatccgtcccaaaataaatcaacttttagctatgtctatgtttgtaatagaagttgatttattttgaaatggagggatacttgattactcatactgagctgctgttttacagtgcaatatattggtattccatctagctatatatattctgatgctaacgggggtctttgtaactggactggtacatcgacctatcaggcttctttaggcagcagtggcttcaattcagttttgccattctgaacatgcaaattagtaacacgcatacgtcattatacctgcagctggctctgcagtcccttgatgtgatcaactgctaagtccagcatgtctgaagtactcgtttgctgccacattaatttgtaagaagaacaaattagaaagatcatcaattgaactccaactcaataacctgaagattgttgtctgacgaaaaagttcagacaaggactggtatatacatgaaaagaacacacgtatggcacacaccttgtccatgttgggcaccagggcctgcaacttcctgagcttctcgctgatcctcgttcttctctcctgtcatcatcgatcgatcatatgcctgaagattaatctggcatgcacgatccaaggaggaacaacaagaatgctactggctagatgcatgcatatgaagaacatcttgaaaggttatcaatattcttatttggtaacatatcatgtgcacacaagtttcgcatgcaaattctatacacaccaacaaacaaatatcacaaaaaattctttaaaaaatacatattataatttcaaaaatgctacacctttgtgtaaaatcttaacctcaaatttgttatatcataggtgtaacaatttttttatagttttaagacaataagtatatcagaattttatcatttttgttgctctatctatgtaatgaatttgaagacatgactttatgtgtaaatataatactaaaaatacatgtatattgattttttttctaatttttttatgatatttgttaatttgatgtacggtgcatactatacacgttaaaggtctatgtatctaggatacgcttccatgctagttgacattacagtatatagttcgacccgctacgtacgtacataaaaagttggtactatgatggggcgtagaattagcaagggaaaatgtcgtctatacataccctctctgcgatgctccgtgggtgcgtcgcgcatccacgcttggcccgtactctgaatggcacctggtcgtgctgcatctgcaggtatttctctacgccagccatctccctgggcgcaacaagctgcatcgcagatgcatgtatatacaaattagacatgaaatcatccctcacattgtacacacacacactaataaatcaaactataaatacgaaaaatgaaaaataaagataaaacgcatatatatatacacctgagattcgtagttgctaagggtggcgatgatgtcgtcgttgccgtgcgctcctgatttgcccgtcgacgtggagaacacgatggagttggagtcctcccatgacccgatcgagaacccaccggaggagaaggagcggacgacgtggtcgtgggtggagacgttctcctcggagcgcccatgatgatgagcggcgccatggatgctgtcagtgaggtccgggatgccgtcctcggatatctgggagaggccgccggagccctgcctgctgctagcgaagctcagtggggccttcatcttcttgttgttgttgctgctgctgctcatggcgccatggcgaacctcaccgagtgatgatcctgctggtctagcactcgatgagaaacctattg

SEQ ID NO: 63934 - DNA, 2723 bp, Oryza sativa
ttacagagcgctcgagtttccggctaaacaccacaaatactgtcatttgccactgcacgtgctaccaccaaaacatttagagaagctttgaaaatacaattgttacggttcttccaaatctcctatgctactagaataatcaatgagtttagtcctttgcgcatctcttttgaaacttcattgatggctttacacaccaccaacctgaaaaatgaactgtcgttggctgagatgcaaccccagcgcaaccccatctccaagagaagggaagtacacacagcttgcaaaagacacgagagacaattgtatgtgttgtatagtttcatcactttgatctcaaagatggcatgcactcggctgtggaagagactagccgatccgaagccaaccatctgttattaattaccaatcaaatgaagaacttgcatcgtaaaggagcccaacttgatagttcctaggaagtaagcattgtgtgatcatttaaaccagttgtcgcctggccctctgagctttgcaatattatctacataaccctttaagatggctatgcccgagagcaagaataatagtagagcccactttctactattagcttatcttaaaactaatatatatagtagattaactataagtttggctataattttcttcttctctctatctctcacttatatatttaatgtatttatcttggagcttgtgataagttagctcttgcatgagagccaacacccttgattttttacttcctctttcctccacctaagtatatagtaagcttatagctcactattatacttgctctgagtgacatagtacaagatattttccattatctctctccattgtaccctttttctcctgagacaactaagaaccaacacaatgcctacatgtgtgtcatgtatagtcgattcaacgatcgaagattggcaaatcactccaaagattatgcaaatggagtattgcaaagtaaaagaggctacatgcctagttttgaaattcaaggtgctagctgggcttgtgttcagttcttttatttttttatggatttttctttccacggaatcatatatatataatcacaatttgatgttaatagtattagaaatatgattgggtctttgttaaaacattgcgttttccactgcaaattgttgttttcagttatgtgtggcaaaaattaggacgaaaattgaaagttctttctaagtgtaatatgtattgtgccatattaatataatattatagtgtatgcaattaatcaacttgcacatgcgtgatgttcatcaaagacattctaatgtgtcatgctagacattctagctaaatcgtactgccgtcgaacatcgcatgcacggtggagggtgatcacacacaagtagtttaatctacgatcgatatatatatatccccccattgtcacacaaagtactcccaattcgcaagtgtgcaagaaacatttttttttatcaaaatgcagtttcttaaatagaacatgccaagttgcaggggtggagctaggtaactaggagagggatgcctagctaggaacccggttaaaaaaaaatatctataatttatcaattttcaccgtatgtgcaccccctcaatttaaactcaagcatacatatcagtctaaacttgatataaagtagagtaaaccaagcgagtgatacccttctctattttgttctacctccatccctaccaagttgccaccggatcccatcgtatagtatagtagtagaccaggtttaccgtttacgatcgatctcacggcgatggacagatatgtcaaactgttgatggctttggcgccgcgtgcaacactcttccactcaccccagccaggcaaccagcgagtgagaatgaacccagaatgaattattcctcgatcgtcgtcgtctggtgctcgcatgtatatataggaggtgacatcacctctactttggttcgctgatgtctgcacgcgagagagatcgatcaactgaacctagacgggatatgacagaacttaatttcatgtgtaaggttagcgggcctaacctagctaagctagcttaattacgcgcgttcgataatacaccatcaagcgaagaaccgtcgtccagccccttggttaatcagtctatacatcacacggcagccgtatagcagcgtgtggggcaccaattcgattaaccttcttcgggttatagcttaccgtcgtcttggccagacataacttgagacatgggaaaatctaagaaaaagcgactttgttctttttcaaggataaggaaattaaggtaacttgaattgcatataattcaacacactgttgtatatgttcacacatgaggctgtacgttgttatcctattagttcaagtgccgctgtttattacgaaagaagctataaaaatgataggtgagtagaagaaatagtctcttaaaatgtagaccaaatgtgttacaagtggacaagaagttcaataggacaataataaaaaataatatttagaaaaggtcttcgcacttttccccataggatagatgtacacaattcaaacaaggtgtacgcatagttttactagttttatatatgaagggtgcataatggacattataaacaagttgtacgtataatttattagttttatatctagtgaagggtagatgctacacgtacaccaaatagagtctaataagataaggacaacttatcctgttagttctgaa

SEQ ID NO: 63935 - DNA, 1374 bp, Oryza sativa
tgattatatatcaatatatcttcatgtgtgtttgtagaccggacacacaaaaatagtatttgcatattttttgctgaagtaatttgcttacgatattgtgattttgttgcaaaagtaacccatcacaaacaaaagatttatcgatcatatttcactttgcataggtaggtaatttattttgatccgaaaaggaacttggggtttcaaataagtattttattcatggtaaacttgagtttattttgaaaacgaacacaaagatgaacgacagagcgacagtaacgaaattaagcctgcggcaaatttcccctcgaaaaaaaatcctgcggcaaataaaaagggtatggcgccggtctaccttcagatatatagagtgaactttattttaatttatcaaacctggtagcatcgaacatccgttttgtagtctaaacccttactaaaacgatcatacagccttttttttcaacataaaatggagtaaaatattgctgcccccgaaagaatattgcactaatcggtgggcggctgctaatgaacatgcatgcggcgtaaatataacagaaaaatgaaggcgctgttgcaaatgtattggatgactacattgcacagctgctgatgtacgtgtaacctgtgcagtagacccagaaacattcatcaaaagcactcaaatatcaagaaaatgagagaaaaaataaccaagatcacacttgactaaacatcgcaccataagaaaaaaaatcgcaggaaaagaagaaaaaaaagaaataaagacagagaaataaattggaatactccaatgagtcaagagaaagaagaacggtggttaattggaacattccaaactcgatagtaatggaagagacgaatcaagacggcaaatcgaaggtacacgtaattaagtgagcagagagtgcagtaaccgttgtccatgacggggctcgagaagacccgggaggcgagctgttgtgccgcgtcagaaaccccgactggtcgccgccgccgccaccgtccttcgcctcgacgccgaactgatggaaatggtgcttgccgccgtggccgtggccgtgccccagcgagatctcggccgcaccactcccgccgccgccgtagtgctgctgcctcatcgcgcgctccggcggctgctgctcccctcccccgcccggcaccgggaagaacgtccgcgcggtcgcggcgcccccctccacccccgccggcggggcgtcagcgaagaactgcagcccgccgccgtagcgcgccgacatctcccctccgcgctgctgccgctgcggcgccctcgacggcgccgggttcatgtgctaggcttctagctatagctagctagctaaccagacaggagtacctagctagctt

SEQ ID NO: 63936 - DNA, 1639 bp, Oryza sativa
ggaattaaagaaagtcaaaaacaaaaatacaaatcaacaatcatacgatgacctggtccagacaaagttcactgagaagttttggccttttgggcaatacgtcagatgcgcacacgcgaacacacacacacagatgactctgctgttccgtagttcagacaagcttaatgggatagtcatagatgttctttatgttgtcgtatataatgcctatactacagtaacccacttttatagcggtgcagaaggatgttggtcaatagggaaatcagaaaaaggtaatgtcaggctgcagaaagaatatgattaataacaacatgctatgctaaagataaaaggtgaagattcagccagcattaccatcattccaagaactgtagcaacagaaccccctaaagaatgcccaacaactcgaattttatatccatggcattcactgccttcccccaccagtgcaggaagaaatccaactgttagggatgacgaattatctgggttggcattgtgacaagagaagagcagattagccactatagtcatttattgtacttaaattaacaatattaacacacacattgcatctaatcttctaatatgaggtactagtttcctaaaaacaaagagtacatattctgctgcaaacagtcaaatattgcaatatcagacaacaaacagtaactagactagcacctcctgtgcagtcgttgagttgcatgaaaagctccctggcggactctagaattccaccatgtccataatgcggaaaggtagaaataactctctcccttgtagttgcaggtaactgttcacatctgaagaattagcagtgtcaacaaaacagattgtggacagtagatagcacaataaaatggccagcatataggtttgctccctgaaaacgttgcacagtttctaaagtggtccctcaacctcatgaactaattaattctcatccttctatcagttttacttcaagatattatacactcatacactgtactaaagtaggtcaaatagggatgcaagagtatctggtttggctgacccatttacccatcctaggccatttacttcacaaacaattcgaggatgtaaacaaagtggactgccaaattaaatggaatgtgaacagacaattaagtaaggtagatcaactggacaacttacgtccatcactaagatcaaattatctgatttgattaccagtaacataaagcttgggtgtacatgttgtggactttgacaaatggtgatatttcagatgtattttcctatgagccttcaatagaacctcgccattataatcatatttaccacataaactccaattgattaacacaataaaccctataatatgcaattgaacggtacaaaacaacttgcattgcatcgtgttccattgagaaaactgatcatatgatggcaaaaataatcaaaactggcaagtagaagtaaataagaaaattagtataataagttcagaagagcaggagtttaaggatcagaataattaattttgaaatttcaggttaaatcattttgtgattgttcatgttcttctaatcatgtgaatgctaatcagagcaccacagggttgaccattggtatttaactatcagcaaatggcttgcagcaagta

SEQ ID NO: 63937 - DNA, 3997 bp, Oryza sativa
aggagccatagatagtgaactggtaataacatggctagggaggagaatgagcaggagggctgcaaaggtggtaaagcatgatagagccttcaatacatgatttgcctctattgactaaaacatagggatgcttatctcttaacctctatttatgcaggcccatttgcctgggtcaccaagcatggcatgtatacatgtgccgcacatgacacagctacttaaggtatgtgaagtacattactgcaacctaaaggatggcttactttaaccaattcaccaaataacgtcgaaatgtacataattaggtacaggcgggatccataaagtagatatcaactatgagctaaagtaacattaacatgtggcaggttacaaatgtcacttggaacgattgcataattggctgaaatatatttttcatcattgcaattttagtttataaattccaattttatccaaactcgtgttacctggcaaacacggccccgtagaagtgctgcagctggtatgtgaacaaatcgaaggaaagcggcagcatgccctcgccaccagttgtcaccatcaagtgcagggcgcctgcatgaagaccaatatgtggatgtcatataaggcaagaacagcataagatgttcaaacttatctcaatgtaacagttggtccagttcaaggaggattaagcaaaataaaaatcaaatttagcttgcttcacattttaccgaacaaaatctccagctgaactggccaaaaagaggatcatcaaccataggggtatttggcaataaacacacaactgagaagtataagagagttcaggagatataccttctgcgcgaccatggagttaaaacaccttgtctgtaaacccatgcacatggaaacaaaatagggtttctcccaacatcaaggagaggtccctgaaataataccacgtcaaatgcaattatacaaggaagggaggtattaaacttgttccagttagatagtgtttccaaccgtgtaacatgcttcagcaaagggatgaaggatagcagcttcttgcataaggttcagtggcgcttccgtaaggtcagtttgcaaatgaggcaaattttcatttttctgtaatagtgcaagccctaaaacatgcaccgtaaaaatggatccttagtatgctctcaatatagtgacaataacaaggaattccataaaaaaatcatatgtgatgcttgtacactcataacagtctacattatactgataaaatagtttgtcataaagtgacacggcaatacaacccatgcggagaatctggtcctgtttagtcaactatccatggtaacctaaccgctagcaggcaactactcaaagtagaaaagatgaaagcatggtgctatgtaatttaactccaaacagagcagcactttaagctctgtactctttttgcaatattgaaatttccgtggtctatcaagtaaattgcaccaaacccatctatatcctatgaagaatgtaacttatacatattcatttaaacatctgaattcacaatatatgtattatagatttttgcaatgagaggggtttcatcgggaacactgtattactgtcttacaatttactcacctccaattttctgtgctaaatagattcctctctagattttgtacataagtcatgtttttaggaggtggacagattgcacacatatgactacaagtaggtggtaacaaaaacggaagtttatgttggagttctgaatggtacaattgagcctagtagaatttactcactgcttattgaaaacctaaacacctacatagctgtgcacgtctttagaaggtaagtgacaaaatttagaatattcatgtcatcatgtgtgttggcatcaaatttaattttgaaagtccaaataggacacagaacatattcaatgtgaaagcaatgaaacagaaaactgacctgctaaaagttccaaatgtcctgtcccagaagcacgatatgcaaccaaatcacccagaagtcttgccacagagtaaacctcatcctcttccaatacggttctgcatcagtatgtaagacaactagctcatataggtaaataaatagtgatatttctcagcataaaaagaataggtagtgacctacagatactttgcacgccctaggcagcataaagcttctcgaattccatgatcgaacacttccctgtaatgagctttccatgccatgtcatgtgttgcatagaacgacctccaccttaatatatcagaacccgtgaagcattggacaacgaccacaacccaggaaagaataagaaacaaagcaattaatgctcgtttcgagacatgatcagcttcatcctgtcctagattgcgagcaaggcaggccaattattgaacagaattgatggagcaggacaaaaaatcataagcaagtaggcagtggataaaatactagtgccatcaaaacctatcataatttagtactatattaagtaaaggcaaaagttattgacactttttacccatatttttttttcatttggaaactctaaggggagaaggctccagtaatgtttatgtataaagtttacttggcagaaagatttcatctaacaaaggttcaccattcacagctgaaatgcactacagatatatgacaggatctgatcatctgactcaaacataccaaagaaacaggaagtggctcttctttcatttgaaatatctctgacaatgacaagcatgagataaattgccccaaccaattgcattgcacccactgccatgccgaatctagtccaccacaaccagcgtttatacctcacctgttgagcaaaacaaaacagaaatagcagtatgataaataagtgctcagtagaaattctactcttcttacacctactctagcttctatggcagaattcaaatatcccatcagtacccataaagaatattctgagccctcctcactgatacatcttaaaggatggtatccagattacagatttataatgctatgctagagagttaagaactatgaatccatgatcctcactgatatatcgtcaacaatattctccagatttataatgatattaatgcgtgttgtttattgtaaaaagtttatgattacctatatcaatagattaaatatgattacaaagttaatgaactcaatttgaacaatgcagaatgccaacaagtggcaggaaaacaattcaaatccacaaatatgatattagattccaattcgaaatcttaaccctaaaccctcatgtcaggtctctgtgatctaataaaaaggtgctcaagctcacggtcacagtgtaacactgagtcgcttcatagtgtttggctataagcacattgtcctccagccatatgcatcagataaaagctcttaataagatgtattcgcagttcatctaagcttaatacgctgtatcttagcaccattgacaactcccgtcagttacacgcatttgcattaactcgcctcaaaattctgataaatggcgaaatcaagtccacttgttcagattgatcgtgtctcaaataatcccgtattgtaaccatacctagacaaacaaacaaaaaaatgcgttggtttatccttgaacggttgaaccaactgaaatcaaagcacaatttatcatcgaactttgacgaatacgtcaggaagcttaagccgagcaaatcacccaactaaagtggccttagctagccggcaaggagctcgagttctcaccctgatctcgtggcgcgcaacggcgtcagcggcgaccgacgctgcggcctcgtcgaggtggcgcctcgcgatggcatccgccgtggcgtgctgcgcgcgcgcggtgccgatcatggcgagcacgcggatccccgccagcgcgggcgccgcggcgagcgcgagccccccgccgcaccccggggggagcacgccgtcgatgagtagagcccgagcagcagcacggccacgtttgaggcccccgacgaggaacgagaccacccgcaccatc

SEQ ID NO: 63938 - DNA, 3012 bp, Oryza sativa
agggggaagaggaggcgacgaaggtgggggaggaggagcgggggacgaggcccgcgggtggcgaggatggggaggaggggctttctaggcatctctctcacccggccgcggcggccatggaaagcggagagggtcgcggcctcgcgggtggttggaggcggccgcggaaatagaaacggggaaggctttcgggtcgcggtcgcgggaggtggattcgggggcggacgagacgactagaggagtcgcgcggcgtccgccgcccgctgtttgttctggtgcgcgagctgatgtgatgactggcatgtgacaactggtttaaatctcctcctttttttttctccttctgaagctgtccttcggaattcgcttttttagatctaggcttaaatattcgtggaccacgtgagtacttgacgttcattctaagcaatagtctctctttgtatactcctgcaatactttgtttgttgttactagcaaaatacccatattttactatggttatttaaatatataatatttgcttgttcgaaaaataaatatttgactatttcataatattaacaaatattattggccaatttgtaaaaattgcaaaaggaattatgggatactgggttggcagtggcagatccattgtcaccgctactaatacttcatccttcccagattctttctaaattgatcatcatataagtttatgcactaagactaaggataatttaaatcacatcaatcaacacacccattcttccacagagcatgcgtcgattaaaaacccatgccaattacaccctatcatgcacacagtctctcatattgcatcaattgtatttcgatgaaatccgtgttcatgcagttatatgatgagcaatttaagaaattttggattctattatatgatgatcaatttgggaaagagggagtatctttttaaaaggagtacataattgagattttgaaatgagtcggctgctaagggtccattcgatttaaaggatttttggaggaaaagtgaatgattcaaattaatataagtaggaattaacactattcactcatttggaatggagggttagggtataagagaagtggaggatttttccctttgccatagattttataggcataatataggaatctaaacatccactgtaacctctttttttttcttttcctttgttaggtccaaggaaaatcaatactcaagtgactataatttaacaacaacataagaaagtttgtttaatttaagaaaaaagttcaaatgtcctccaaaactttgtctaacaccctgaacattaaaaccaaacatccaatcccctaaattctacaatacccttcatattatcctccgaggtggttttagatggtggtcttccgtatttctaagcttaaactagtggtttttaaataactaatataacaaaattaggtatcatcaatataggttgtcagtttataccatacagtgatgccatactgctgttatgttggtacttgtgtttttaagtgagagcgaacaagtggtaaaatgaaatatcaaagtggagatctcatatatgtccaatatgtatatcatgtgatcaaactgattcaacttatatacaaattagataaaaataaacgctatccaaaatcacccttggggttatataaacaatattgtaaagtttagagggttgtatatctggtttcaaagttcgggtgctagatgggctttcaatcgaagtttttaagaaaaggttagtgcaacgtggaatgtatagacacgggagaaagatgggttaattcgctctgccaccatatcgaaatttttatgacactaattttttttggtgtagtagaagaccaaataattcaatctaaaactttgacctattgcgaagtgagcgtagttaaactggttaggttcccttgtgatggaaccaacccacctgagttcaaatcctagaattgacacggctaattactttttcggtggtagacaacgaggcgagataaggtgtgcgtgtgtcttcatagagttgactgtctaattatattttcggtggtatacaacgtatctcgaggtagggtgtgcgtgtatctttatatatgtgagtctcatagagttgactgtctaattatattttcggtggtatacaacgtatcctgaggtaaggtgtacgtgtgtcttcatagatgtgtggtatacgacgtattccgaggtagggtgtgcgtgtatcttcatatatgtgagtgtcaacgaggcgaggtaggatgggcgcctgcctctgtactgaattttggtatgctgaagcttagatggggatttggtaaagcgtcaaactaattaaaatcagcctaatacatcaatgccacttacaccaacaaaacattttgttatgaagtaaaatgattaaaaaaaacagtgatcctaccaataccagccaccctgtttcccagctttttctgtgagagcaaggaccacgtttttccaccttatatatcacatactatctagtcacaaaataatgtcattttagactctaatttgataagacgtaactttaaccaattattttgtttacagaaattaagaaaaattacctaacataaaagtatgtcaagtgtttttttaccaaaaaaaagaaaaagactttgatcgttgcttaattataatcttccctattgaccaccaatatcaccttccctatctatttgagttggctagcttctactccctcgattttaaaatataagattatatcttctggaacaaaaggagtaactagacaagtcaaactggtttaatttggactttaccttcaggtaaaaataccatctgatagtaatctttcctccattggctgaaatttaaaacattttaaccattttgactatatgatctgcatatataattcgtttttcagcttgccaaaagaacttgtcaaccgtttctaaaaaaaaaaagaacttgtcaaccctatgaacgaattaaacttctagacaatactattcgtgcttgac

SEQ ID NO: 63939 - DNA, 5987 bp, Oryza sativa
tcacacacgaagctaaaacacaagtgcacaagttacacaacaagccaaaacacaagtgcaccagttaaggccggagagcctgagagcgcgagcgacctacccttgtctcgcgcttggcgaactccaccgtcggcccctcgccgccgccgccgctgccccccgcggagacgacggcgagcgcggtcacctcctgagcgcgcgccgtgccgaccatggccacgatcctcaccgccgccagcgcgaccgccgcgccgaccgcggcctcctccctccgcccgcagcgctcagtcacacccacccactcggccgccgccccggccgccgcgaccgccacgttcacggccgccagcgccgcggacatgcggcgcaccccgcggatccggaacggcggccgcatggtttggcgcacgcgccgcgagatcgaggagaggcaggccgggcgcgcgcggcgccgttctctgagtgcacgcgtgcatgtgcgggcgcggccgggcgacgtttttgtagcggcgcgcgcgccgcgcgggggtgcgaggcgtgcgagcggcatcagccaggccagccaggccagtaggacgacggttctttgcttgggcgacgccgaggcagaatagaatattagtatcacgtactgtacattgttttggccctgccaattggacgaggcgtttgcttgatcaggggtgcattgcatgcatgactgcatgccatgatgcattggccaacgtaaatgccaagccggagggtgtggcagtgtgtgcagtgcactcttggcaccggtacgtccaggcaggcaggagatgctgggagggcgtggctggcagcctggcactggcagctgcccgggcttcgcgtcggtggttggaggctgcttggagctcgcggagtcgcgggaagtgaggcatctattctaccgcgcagtgtcgccacaaaagctggaaagaaaaggaggaagcgtctttctttatctccgttggggcctcggggccgaggagacgctgacatgttagccccagtttagttagatccatgccggtttagcggtttaggaccataccggtttaatacaatagatggatgggccagcccgcctgcctattccattgaaatagtcctagtactaccaaaaacacagcccgttatccacagatggacgacttgagcagcccatttggcccaaaaacctattgagattactcctagtactaccaaaatcataacgaactgttggaatcgaatcacttcgccattgaaaaggtttctaaaaaaacaaacgtcaccattgaaaagggctggtgctgaccacttgatctacgtcggaacttggaagaacactgatacattgatcaaaaatagataaattaagacactgataccaaaaagatctaactctgcaaattctccaatactggcaagttaaaattagggtgtcgatgccattagctgatggcagctacacaaattattttctttttgtgtgacacgtcggtagcttgcgaatctctgcttatggatctattaatccagttgcgtcgctttcaaggtctcgtcaacctaattaagagcaaaacagtttgaagttcggctgtgccatcatgatataataataatctttgcgcattccgtcatagaaaaggggatatagtattatactagccggtgtcgttctttgttgatctgccttttcagatggcacgcaagggtaactttcgtaagggattctttcagctgaattcgcataatctatatatttcctttctttgcatgcgtttgctaggttacgtgcatgctgatgcttgtctccgtcagctccgatcaatctcgtacccttttcccttactcccccccccctcccctcttctctacaaagtgcaaacaaataatattcgatctctggcccaagctttctttcatttgcttggcttagaatttaaggtttgcatctttcagtgagccatgattccggcgtaccaatcacatatcctaggacgttcgaggacgacgcctccatatgctgcttggcccagttctccgaactttaacttttccatcactggtggagaaatgctttttagtcccggttcgtaaccccggacaaccgggactacgaatccgggactaaagatcgctatctttagtcccgggtgaaataaccgggacaaaagatcgatctttagtcccggttggtaactccaaccggaactaaagataaggtctaccaaccgagactaaagagggaataacagcagtacagatggtcatctttcttttttttcttttttattttctcccgaattaagtggcatgcatatccccaaatcccaaatcaaattaacatcccaaatccacatcacaaatctttaagttacttatacacataaatcaaatacatcgcaaatcctaaaaaaaatacacaaatcaaattacatcacaagttctacaaaattcatcgcaaatacatcacaagttcacatcgcacacaaatcaaatagatcacagaatcatgcaataaatcacaaattttaaaaaaaaaagaaaaaaagccacagaggcgccgctcggccggtcgctgtcgcctcctctccgcaccgccgcccgccgccgcgcaggccgccgtgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggaattatttatacagagcaagggtgagtacgggagtactcagcaagccatgggaaataagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgtaatgtatcagtctttagaatttaaacaaggttggcacccggccaacagctttttcaacggccacccgggccaacaacttttcaaacggccacccgggcctagctcatcccatcagctgcagatttttcaaacaccgaaccccttttcacacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgctaggaagcccaggggtcctccccgacaccaccccggcgaatccacatgtctctcggcatcaaggctcccctgataagctagttactcagccaggggtgtcccattccacccatgtggtcatacttgtcttatgtttggatgaaattccaaggaatcggtccttaagtgcgagagcgggaaaccgtacacccggtacgtttcccggtccgcggttttggaaattcatttagttcgcaagcgccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctcggaaactatacgcaaaacgggacaactcaacaaatggcgaaaataaagccctattaatgacctctaagcgtgccattagatagatctcgagatttgagaaattttggaatttgaacggagtcaaacggatttacggttgggaagatattgaatttctaagattattggatttttggtctaaaggaaaaggatttaattaaatccttttttttggaaaagaaaaagaaaagaaaaggggagagggagggaatatagacttccctcgggcggctagggcgcggcccgagagaaagggcggctcggccgagcttaacgggccggctggcccaagaaggcggcccagagcggcccaagacgcgcgcgcgcgggagggaggagagagagagccggtggaccgggctcaccatgcgcggtcccgggtgggacccgcttgtcagcggctcggctcaccgtgcggagggagtacgcggctcatgcgcgcgggtgggggagggacgcggtgcacgcgcgcggttcgcggtggacgcggatgcggcgggcccacgcgcagcctcacggctcgcggtggaacgcgcgcatggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggagcgaaccacggcgatacggacaaaagcgagcacatcgggcggttgctcgtgatgaggggagacgagccaacggctcggatttgccagaggaagcttgacggcggtgaatcgcggcggcgacaaccggcggggagggaagagggaaacggcggcgaggccacgaggggtcgattcccggcggtgagagcatctacgcggtttcgggaactcgatgctagcgtcggattggacggagctacgccgagcgaggctggcgacgtgtgggtgctacggagctcgagcggcgagcacgcggcgagcgacgacaacggtcggggcggcgccggctaactacggggagtctactcgagctactaccgaaagctagggggggagatggagcgaggaggaagaacggagggaggcatcaccgagatgaggaggggcgctgtgacgagaggccgacggcgcgggagtaatctctccggcctcgggccggggaagaggaaggagagggcgcggccgaagtccccttccgcgtccttgctcgtgccgactccttcgacacgcgcaacaacgaacggcgacggcgaacagagcacgggggcggcagctatggcgaggaggcgaaaacgagggagattggaggggaagagctggggtttaaagggggcggcaatgtcggtttgggaaccgacttagggcggtcaaggcgcgagctgcgctcggcggtcgcggccaaagcggcgacagggaggatgacgccggcgggggaaaaggggaaaaaggagggggagaaaggggcttgcccttttgccgattcgggaaaaaggaggaggggagcgggggcgacgcgacagagggagggggcgctgcctccgtcccttggcggcttgcgcgcggagtggcgggggccgagcggtgacgacggcgatgacggcggcggcgaccgggcggtcggccactcggcacgcgcgcgcggcttgcaacgggcggtgtccgcgcgggcgtgcgcacgcgaacacggcgcgcgggaagtggcagcgagggagcggagagggaggacttggct

SEQ ID NO: 63940 - DNA, 1005 bp, Oryza sativa
cccccaggggtcgatgggccgggaggaaatcggcccatcgacccccgggggaggcaaaatagacttttgcggaggaatttgatttggaaggattggattcgggattggactcgacgatagatcggggattgagatcttaagatggcacggacactagacaacaagcaaagaaacaaatttcgcaattagggtttttaagagataattttcccgctaggcgccacgacggaacgggcgctacacgccgccatgccggccgccgccccaccgcgccgccacgccggccgtcgcacaggccgccgccccgccccacggcccgccgtgccggtccaaatcttgtgcatgtccaaatcttgatgagatgcgggcgtgccagtcggtttgattctgcaactgacaggatatgcaaatagtagatcaaaacagccgatcagctgacaagccgatgtagtgattctagccgatgccgataatagccgatgccgatagggtgtaagaactcggctatatgtccaatgtagataatggtataatggcaatcggttgttgatgatgtaataaaataacaatataatccagtataaaccaatcggctagcattgatatgatagaataagcactgatccgaaggttaaagcacacatcggctggaggtccaatgtcatgaaatccacaagattagattaaacagtgaaacctttgttgtcatcggctaaatccaacttgtatatatatgtaatccttataagccgatgcaacgtcccgataacttatcggctagcaccccgataaaatattagcatgaacctattagcttagcaagacttatattatcaacacaatctagtaggtcgaacctaaccgatgcagcacgagattgtatatgataatctaatactcgatgagccgatagatctgtctaatgtgatggatataacaaatctatttagaacagcattgtaattgtagagatatatcggctaagacagaagatcggacctaacc

SEQ ID NO: 63941 - DNA, 1505 bp, Oryza sativa
aaatataggctaaaaaataattaattgcacaaattgtgactaatttgcaagacgaatcttttaagcctaattgcttcatgatttgacaatgtgatgctgcagtaaacatttgctaataacggattaattaggcttaataaattcgtctcgcggtttactgacgaattctgtaattagttttttattagtgtccgaacaccctcatacgacactctatataatacccgatgcgacatgccaaaactttacacccctgatctaaacaccccctcacatgcatggaatttctatgatgcacgcagagtgcatgctactaggaatcattcttaccggctacttatatcgttttctaatccatctccgacctacgacgatgaacgctaaccctgtgacctagttggacagggccaacctatgcgactgcaattatgcaagccgatgccactgtgtcataatccctccatccaaaaatctaagacttatttttctatcaccaaaatcaagaaaagaaatagctcacttagcttgcatataacgaagaccaaagacacgcaacagtaaatattaagataaggtacttgaatttcgatcaataatttaatttagcattggaggctataaatatgcctaattcatttgaaaaaaatagaaaataaaataagtcttaaacttttggttggagagagtatatagatagtgttatagctagctaggtgatgtcagagagggattttaatcacccgggtggacgtttgtgtatttattgcatgtcaactaaatatttatgaaaaaaaattcaaaaaaaagacaagatatattaatatgaaatatatcactttataaatatataaattaagatttgatatgtaaaaattttattataactaatgaaattaattgtgaatatacgtaaactaattagattttaatttgttgttttcgttacaacttgtataaatcaaatttgaacttgaatacttgtggagtcatatattacatactattttatcttcaattttcattaaccatggaaaattgaaaccgtgttattataattttacaaaatttgatatatgccatcctgacccacatgtcatcgactcatatgggtcctacttgtcattgagataccgatgacatatcttaaactttgcaaaattataatggtatggttccaaattacccttttattttatatgcgataaatggctagatgtccaccccgttcatgagacgagcacataccatccgttcattattcaagctagcgcgcggcgccggtgatcgcacggaggagagaaacatgcgtctccccgaaccaaagcatcagcagctagccactgcacccacacccacctccgctccgcgtcgcgcgcgctatgtatacacgggagagataatagtaggatatagggagaattccctatatgccatgccaaattagccttatccccttctagcccctgaaaattgtctctttccctctatgccactagtttgaaatt

SEQ ID NO: 63942 - DNA, 15672 bp, Oryza sativa
attgctttcggagttttggtgaattcctgaacttattgttggatgctgcatcatgatttctgaaattgcaatgagaaatgaatattcctgcaatattaactgcatccgttctgttgttttagacttttggtgatgattgatctgctcttgtcaatgccaataaggctcattgcactggcataattctgcttgtaatattcagtttgatgtggtgttgaatacttcattgactaattgacgagctttgagatactgatgtttattggatcttgtgactgtcccaatgtattcatgatttagtaatggttcaagtaaaaaaaaatggtgcatagtgctgaactactagtagtatcattgtgttgaccatgccagtgttgtgcattttttgtgtgcaactgtgatggagtgagatgagtccaggcaatttgaatcgaaacatgtcatcttgctcctgcatcataaaacaggttattttgcttctgaaagagtgaaactgataaatctgataacctggtcacatgagattttgcactttcggagttttgcccatatggaaattgccattcagtcagagctgtaattcaggatttgttttatgaaacatctgacagaatttgaaatatcaatattctagcgctctgaatcatcggtacatggctcctttcctttgctcatatgggagtagctaagagctcaattgccactgaatcgagtttttttttttcagtcataggacaatgtctactgatgcgggcttagaacattttgattcactctttgctgcagagtccctggtctactggcgcgtttatgataaagcatttacaatgtctgaaaactgaactagtctatcaatgaagtgaaccttaggataacacttgttacatgcaaagcttgtaaactactccgttcagtaaagcatctgttagtccattcagttcgactatcaagtagcaattctgaatttcacagtagtctttgacagtatgtactttgttcgatactcgcttactcagattcacagttaaatcttcacactgctgctctctgaatacgtgatgcatcttgctgtatggttagagcttgcagttgaagattaactgtcaatagagctttattattacctggaaaatgcttttctttttttttttgaacgaaaacaatttggaatactaagaagtaacttaggctgtgtttgcaaccccatgttcccaacctctctccctcgttttccgcacgcacgtttttcaaactactaaacagtgtgttttttgcaaaaaaaattatatacgaaagttgcttaaaaaatcaggagacgatgccaaggcacttcaggagatgatgccggaaaagatggatgctgacaagtgggatgagatgaaggcgcaggcagctgcaacaatacgcttgagtctcttggattctgtcatgtaccaggtcatggatgaaaaaacgccgaaggaaatttgggacaagttggcaagcctgtatatgtccaagtcgctgacgagtaagttgtatctcaaacaacagtcgtatggtttgcaaatgcaagaggagtcagatcttaggaagcacgtggacatcttcaatcagttggttgtggatctaagaaagttagatgtgaaactggatgatgaagacaaggccataattcttctgtgctcgcttccaccgtcttatgaacgtgactaccctgacgcacggcaaggataatgtcaaaactgaggagataatttcgtcgttgcttgcacgagacttgagaagatcaaagaaaaatgaggcaacggaggcttctcaggctgagagtttgctggtcaaggcaaagcatgattatgaagcgggggtgtcgaagagcaaggagaagggggcacggtgctataagtgtcatgagtttggacatataaggaggatttgcccgttactaaagaagaggaaaggtggcattgcaagtttagcagctcgtggtgatgattcagatagcagcagtcatgagattctcacagtgtctaacgagaagtctggagaagcgtggatgttagactcagctagttcctatcatgtgacatcgaagcgggagtggttctcttcatacaaatctggtgattttggtgttgtttacttgggcgatgacacgagttatcgtgttgttggagtgggcgatgtcaagttcaagatgtatgatggaaacgaggtgctactttcggatgtgagacacatgccgggactaaggaagagtttgatttcgcttgggagcctacatgagacgggttggttgtatcaggtggattctgataggaagaccatgaatatcatgaaggacggcaagactgttatgacttgtgagatgacgagctcatgtttgtacaagttacaagggagtgttgttgcaggtggagtcatggaagatgggtatgttggtgttgcggtacacgatcctgaaggcggcgagcctggcgtaggctcgtcgggcggctcggcatgagctgcggcagaaccaactcaagtcctggtacacggagattcgagcaagtaacaaatttaggttggcgtggcatattcgccaaggtggagtttgttagagtttgtgtcgaatatgtgtacgtagtcggttacagtttaggacttggagttgtaataggtattaggactagagtaagagtgtagcgcccgttccgtcgtggcgcctagcgggaaaactatttcttaaaaatcctaattgcgaaatctgtttctttgcttgttgtctagtgtccgtgccatctcagatctcgaatccccgatctatcgtcaagttcaatcccgaatccaaatccttcccaaatcaaatccctccgcaaaagtctatttagcctccctcgagttcgatgggccgaactcctctcggcccatctccccctccctcctcggctctctctctctctctctctccccgctctgcccgtgagccgcgtcgagctctccctctccactctcgtggccgttcccgccgatgccgcccaaatcgccgcgccgcccgcgcacgcgcgcgccgtggtggccgaccggccagtcgccgccgccgtcagcgcctgccgcgcctgccccgcgtctgccgcccgtgtcgccgctccactccaaaccgccccgccgtcatcgccgtcgtcatcgactcggccccgcctctccccgcgcgtgcctccaagggacggaggcagagctccccccctctgccgcgtcgccctctctccctcctccttttccccaaagcggcaaggaggcaagccccctttcttcctccctttttcctttttcccttcctccgccggcgtcattcccctcctccctgtcgccgatttggccgctagccggagcgccagctcgctggcttgaccgtcaaaagtcggttcccctctcccaaaccgacattgtcgcccatataaacccaaccttcccccctttcctttcctctcccattcgcctccactccattgtcgccgcctcccgtgctttgttcgctgtcgccgttcgccgtcgcgcgtgtcggaggagccggcacgagcgattcaaaggcggcgtattttgtggcatatggctgaacaaagcctagggcgaatagaccggcatccagtagcggttcaaccttggagaggctttggttcaacctgtttttccctctagcagacaggaagaaaacgccataggagatacaaaacaatgacgacactgagacacgatatttggtaacggagttcagccgtagcctacatctccggggcactgattacgtgtgctcctccccgatccatcatatacagcgtatcagagttacaacgactcacggccacttaattaatcatgtgttaaaaggtcgcaccgttttacgtgcaggagggatgggttcccatcctgcacttgcgaacacacccttagcattcaatattgatagagaagaaattggcgagagaacctgcgttcgaagggattcgaacccaggccagcatgttgctcctggcagctccctgccagccaagctaggtgccgttcttgaaaatgcttttctcaatgcagtctttttctgttgagggtgtgtttagttcacgccaaaattagaagtttggttgaaattggaatgatgtgatggaaaagttgaaagtttatgtgtgtagaaaagttttgatgtgatggaaaagttgaaagtttgaaaaaaaagtttggaactaaactcggccagagtgggatatgttttttcagtttcacagtcaaatcatcacaatgctcctgtctgattctgttacatgtcttgcttggccagagcttcatcagttggggattagctgcgattagagcttcagtagtacctggtaaatgctgtacctggcaaggtagagagacggctagcttagactttagagtacctgtaatctgtgagattcttgccttcgataggcccaggggtgtcctaagttaaaatggcccagcccaactctgccgcctcacacagccgcaagcatgtgattaccagagttgctggcacgatgggcccacccgtcatccacacgagggccacgccttgctaggagcgcgcggatttcccggctcgacaagaagggaaaggcagaagccgactcgaaacaacgcgaagcggcgcctctgactcgcttccgttcccatctcttcctctccctacctcgctccgccgccgccgctcccctcccgacccgcctcgcttcctccctccgccgccgccgccgccgccacggcccggccggatcccacccggccgctcgattcgaggtcagatccaaaccccagccctcccaggtccgaatcgcgccgaatttttttctaggttttggtacggatctagggtttggcttgccgtgggaaattttcgtggggggaattctgtcgaatttctctcggcttccacggtctggttggattcctgctcatggccgctgggcgccacggaggatacagggactacgaggcaagggagcgggagctcgacgcggaggcttccaggaggagcaaggagcagcagcaccaccaccacccgagcggccgacaccaacgcggcgactccgacccccgctgcgaagctgaccggcgccgtgacggcggtcgcagcaggggcggcagggagttgtcgaacgggtacggccaccgccgctctccgcctcccaggagtcgcctctcagcgaggctcggggatcgcgagcctggcgaagttctgagcggtagtgcgtcagatgactctggtgggaggccgcatagagcgagggagaatggtgtatcaagttctagtagggatggtgaatcggtggtggctgcatcggcctcatcacctagcaagaaaaggaaattctcaccgataatatgggatagggatagcccaaagccaatgcattctgatgtggcgaagggcaagaaggcggtggactctgtgcctaccgagcttcctctccctccccctccccctctgcctccgcaggatcacatccctgagaggttggctgtggagaagtcgccgatggatgtggagcctgctgttgcttccgagagtcctgagcagttacaggagcatgcggagagtagagtgatggaggaggaagaagagtactcaacaatgaggaacatatcaacttcaaggtgggctggtgctaatgatgacgaggaagagggggcaccacacaggaagaagaaaagtgcatcgcctgcagactctgctgagttggggcagaggaagaaggctcttagcccagaacttggtgaggttgtggccagtgatatctctggagggaggaccatgtcaaggtcgtctgattcagggaggttgggtgctgatgagaatgaggatttggaagttgataaagatgattatatggacgttgacagagatgatgatggtaacagtgatattgcaaatcatcagtcaggtatggactcagagtatgaagtgcgccggtctgaaacaccagaaccagtgaagccaccgcacagatgtataaatatgcttcaaggttgcagaagtgttgatgaatttgagaggctcaacaagattaatgaaggcacctatggtgttgtatacagggcaagggataagaagactggtgagattgttgcgttgaagaaggtcaagatggagaaggagagagaaggtttcccattaacatctcttagggagataaacatccttttgtcttttcaccatccctcaattgttgatgttaaggaagtagtggttggtagtagcctagatagtatttttatggtgatggagtacatggaacatgatcttaaaggtgtcatggaggcaatgaagcagccatatagccaaagtgaggtcaaatgcctgatgctccagctgttggagggtgtgaagtatcttcatgataattgggtacttcataggtaactgttgatttgacgctctatttttgtttgccaagtatcctcaaacctatcctgatgcctgtatactgatatgcattttccatataccagggatctgaagacctcaaatcttttgctgaataaccgtggtgagttgaaaatatgtgattttggactatctcgtcaatatggaagcccgctaaaaccttacactcaattggttgtgactttgtggtacaggtaggtctttggtcaacatcagattcatccccagtgttttggcttgccattaatttttccattgtgagctctgtttatcaatctgacctgcctttttgctccttctcagggcgccagaactattattaggaacgaaggaatattctaccgccattgatatgtggtctgtgggctgcataatggcagagcttttggccaaagaaccattatttaatgggaaaactgagtttgaacagctagataaggtatttcgtttgacttgtgattttgcatccttgcaattactatatttttttcagaggtctcatgttggatttcctttcctgttgcagatacctataaaccttgatatatattatatttgatcatatctcatggtgaagctacttttattgcagatatttagaacacttggcacacctaacgagaagatatggcctggctatgccaaattgccgggtgtaaaagtcaattttgtcaaacaaccgtaagtgtctcctggataatgcatacctaatcgtgttggtctgatgagtgtctatatgccattgtgatgaaatttctgttcttttatcttgtcaggtacaaccgattaagagataagttcccagctgcatctttttctggtcgtccaattctgtctgaagcaggttttgatctgttaaataatcttctaacatacgatcctgagaaggtaatgtgctactgctattttttttttcatgatttatatcatgcattcatatttaaatacttcaatctgagcacacctgttttggctttacagcggttatcagcagatgctgctttgcagcatgagtggttccgtgaagttcctctacctaaatcaaaggatttcatgccaacattccctgctctaaatgaattagacaggtacttcttcgcaaccatttaatctacttgtagtgttgcttaaatatctttgtttcatgtagtgaaatttattttcctaaaattccacaggcgtaccaaacggtatttgaagagtcctgatcctctagaagagcaacgattgaaagaactacaagggaacattggcaaccgtggtctttttggctgagctattagcaacttgtttgggctctattgatcctgactgtcatgcatcattctgaatctatgaggtcagatacactctgaggtgagatgtgccatggacatgaagtatcacgcatcttggtgtctaccagcaactgatagtgttctttagcaggcatggtgctggtttaagttgataggtacctggcccatcatagaaattttgttgcaggattaactccaaccagattgatcataaaagcagtctaatctgcctgcatcgtaaggtgtggcatgttggcttttattggttaacagcagtttcacctttggaacttctgtatgtaaaatattccagattggtacgttgtaaacaatgttcagtgcgttggatttaaaataagaatattccatcattttttttctatattctcctagtgccttttcttttgatctttccattttgtttgcaagagacaagagaagcgaaggggaaggatgccttttgcttttcaccaggaaatcaatggacagtaatacaacttgaaaggtaaatatattcaaaaaccatttacctcaagtgatgtattgctgactaaaactgatgagtgcacgtgcaaaagatcatttgtgatgaaaggtcgtggttgaaggttatctgtgttttcataggtctttttaaatgttgtctggaatctggacagacacatgttcccatatatctaaaaaagaaatgaaaaaaaggggttactgattaaaggaaaatggaacagaaaaatgaaaaacggaggatactgttctgtaggtattctccttggcatcttaacaatttgtgcaaaacaatgcttgtaagtaacagtaactgatgtttctgtatccaccactcaacagtgctgttcagcactatattttcactcccatcccatctggctatgcaccaatcaactgtaggatgcaatgagggaagaatgaaatgtttctttgtagttactgttcataagctatctaattgtgaatttggaagtgaatgtttggtcttttttttttctttcctgttcggcagccaactttcattttcacttatataaataaatctttaaaagagagaaacttcagtatcttgttactcattatacgtggtggactcttccatgtatttgatcgcttgctcccttgatgttctatttcatggactatttatctattcagggataatgttcaccaaccgtttacaaataatatttggttcttctgttgtatccttctaatctgaatggttttcaactcactgggaaacaagtttgtcttgcatcgattgatgctttcgttctctgtataccacatttttaggatattattagtaactgtctaatgtattgtgactcttgcaacctggaaaaaggtctttttcctttatctaaatgataatgaggttgaattaatcagctaagcatatctgtaaatattaaccattagctaagttatagtcatgcgaggtagaagtggtgagatcaaaagtcaagatgtctttatttttatgcaacatgttgactacttcgaagatatgctagttaactccttttatgcgacaagtgttttgcgtaaactgcctttatgctttgtgaactggtggaagaccatatgctcagtcattttgtgctttgcattttggtggtaacttaaatgctgcttaagtgcttggagagttatttgaactcactacagctgttgtctgtgacacgtctgcagcttaagctgtggctgcttcaagataggaagcttgatggccctcagcttgttgtacctaagtgactaaattttgtggaaggtcttcaagagagttcacctgttactttagtgaaccatagtggtcactggtcagtctacttatcctatcctgtctattaatatacatcatacttctgactgattgtggggaccgctcgtccatttctttgggatggttgaggtgtaacgccttctcttaaatgacattatcttcatgaacaacattttagttttctccctacaactttttccctcttgacattacctgtaaactttgaaaactagtacatggacacctgaaatggtactgcgaactttaaactactagtggagcgggttactcacaaaactactttaatctgattagttttagatgggatcacacaacttgaaaggcaagacttctactgttttagcttgctctgcatagttttagcagcttgtgctgcaatagggtgagggttgctcaactgcgcaaatcctcccctgatgcaagaccacattaacttggacaagaatatgctttaaaattttaatcatatatgatgcttgcatgacccgcttgagtgatatttgggtctctttttgtaatcgtgcttctctctaacttgtcttcccatgccttgccgatatgagttttgggatatatcgatatctgttcattggtttgattattcgttgtcgttattttgttctaacgtggcctcgaagagcctctataattcagccggcattgcctgttcgaatggccatccgaggcctgtctgcattgctatgggggtggcagctgattctatgtacgaaagaggaagcacacgcatgtatcattttgtcaagtactgttgtgtagtgcattgttcgctatgtgtactttgtgtttttctctcccccttttgtactttcctatatcaatgcttgtaaacatggaggactattgctttacagtagtaggtactgagctagtattacatgtaagtctgtctcatttacaagagaggagaagttgccgtgtgtgcaaatgctcaaattcggctccaggaaaccaagagcgttcgcgaatccgcagaccgggcaccgttgctgaggtgagtgagctggtcatgtccgtagcctacgtgtaaaccaagtgatggtccttgctggaaggtgacgggcggtaataaataaactataccccctggtcactttgatcggtcggtacgaggaatggttatccttcgggaaagcacgactgcattcagtagcggcctcgggtgagcatcggtgtccgagttctcttcctcgtcgatttcatcctcatccgcgaggtgaaattaccttccagggttcggttgcaaaatgtacatacgcaaacggctgggatttaatttattattaagaaaatagattcactagatgattagaggttataatacccgctgttcaaactatgtgtgtatgttcaacaacaatcggaaagggcatgtgaactagtggtggaataagtggattgggaacttgatttgtaatacaaattatttgtttagttgctataaataaagagaggggagggaattcatgctatttgtttcgtatgtggattttgaggtagggtgtgtttagttcacgctaaaattggaagtttgattgaaatttgaacgatgtgatgaaaaagtttataagtttgtgtgtgtagggaagttttgatgtgatagaaaagttgaaagtttgaagaaaaagtttagaactaaacttggccgtactagaaaattattatctcaatagttagtcactagggctaagctcgagcattcccttcttccgtaggaactgatcggactcatgtttccttctcaccaattaccctcaatcttgtgttactaaaatattacgtggatttctaatctctctgtctatctacagtagttaatacctccgttctagaatataagcatttttagagttggacacggttattaagaagttagaagtaaatgatggatggttgtgattgaatgaatagtggaggtaggtgggaaaagtgaatagtatagggttatgattggttgggaagagaatgttggtgtagaaattgttatattttaggataaatcttgagggctacaagttgttatattttaggatagagggagtagtcaacatgtctagctcgaccgctccttttatttgcgatattgattcgcatcttaatatgctaaatccatattatgttgttttaatccaccaacatttatgttgataaaaccaactacacctaccatataagtagaaaaccaagtaaaagaataataaatgcagctttactacctgataagaaataccgtggaagttgataataaatgcagtaagcaaataaattatattatttatacatttgcaagaggttgtaggaggcagggggttagccactttgtaggtggattttaccttatttttctctgtacaaataacacattgtgatatctctggtaactactatcttctgatcctataatccactatgcttataaaaaagtgtgaagtttgtaatggcagagacgtattaacttgattttttttgaagtggtgtattaagatgacaacaatcttatctctcaacagtagagatttaatcaactttttgcttattatgccgttgtcacgggatattttccatcatataattctctcattgtcattcaaaaaggagaaaggagtaacagaaataaatccaaaacaaatcagaaaaaggcaaatttccaacttaggctatacaaattaaacggcaacctccatttttgcaagatattgttcacaatcacttacctcccttttatagtatatagtctcccacaacggtataaatttatcccttctagaaaaaccaacagcacaaatccaaaacaaatcaccaaaaaagaagcaaattcccatccttacacacgcctgcaacctccacacaaaaacggaaacttttttcaaacacgcgaaaccaccggaggaggagttgtgaaaatactctcaaaacggagcaaattaccaacgttcaattctcaaaacgcgagggcatctccgccatttcgcccatcgccccaaccgtttctccttctcctccttccccttgaagcctctcctcttcttcctcctcctcctctgctctcccttcgcctcgcctcgcctctcctccaagagcgcaaccgtaaaaaaagaaaaagaaaaaaaaaacccgaggcggcgagctctcgggctgcttccggctccgtccgtaccggcgaggagggggcggagggccattggcgcggcggcccgcgcgaggcgcgcttgcattgttggtggcggcggcggggggtcgacggggtggagggcgtgtttttttgttggcttggggtggaggcgggggatgtcttgctcgaaggtgcttctgtcgaagaagggggtgctggggacggtgtgggtggcggcggtcagcggcgtggcggcgctcagccgggaccaggtggttcgcaccaacgtcgtcgcctgcgtcggtaagcgatgcgatgcccactcctcggcctcagcgcgcgcgcgcgagagagagaaaaaagtgcgtatttttcgtgggtttttatgtcgaatttgcggtctaggtgggaggcagtggaacagtgtgggaggcggtgtgcggaagaggggtttatccggggctttaggttatagaaatgaagcgaatcatgtgatgagaatctggtaaaaaaagaagaagaaagggaatggaatttgagaggagttgtttgctgtcatggcctcggtacccttctatactgtattgtggtaatcgttgtggcaatttgattttccatgtgaaatctcgaggtgaaaggaaaaggtagcaccttgggtgtaataacatggacctgtgggtatgggtttttggatggtgaagagttttgtactttgtagatggcatcggtttggggtttggggtttagggtcattgtacgacgacggttctacgtatggttctattaataaggcccaagcatatacccaagattcgggcgccaactaggaataccttgtaatccctaaatttaatagcattgaacaaatctagtagtcctgtaaatattgtttggtctgactcgtaacggaaatacaggtgtcaaaagtgtggaactaataagaagggaaatgctatatccaaagcatatgaaacaaattagaacagtaaatgcgggttgtgacattttataacgctttccttttctagatcgatttatttttagcattctttccctaatatgctcgtaacgcttgcacatttcctctttcccctggcagataagattttgcctgatgacaacgacaaaaccacatacagagtattgggactgcttctgcttggcattgttaggatttattccaagaaagtggaatacctctgccatgaatgcaatgagcttcttggatcatatggatcagcacattgcaatgaactaagtatcccaactggaggagcaacaaatagagtttcaaagcaagcgaagaaacctgttcgcgcaagaagattagttgtaagacaagaaggtgcttacaaggtaaaaatacctatgcaagctgtgcgaacaactagagcagaaacaagagctacttcacagataactgaagttcgagacacacatgctacacctgatcttccaactttcacaatacccaaaagatttgagcttgactcttttgatttggggattcctgaagataggtaacaggttttggtcctatactagttttattagcttgttgcttaaaattgtggtttctgatctatttttaaaactttctttgtagggatgatgatgacgtggatcatcaccaattgccacatcaaggtagaactgctgtgattgatgtttttaccactgctaagaaaccattttatttacgttctgcattcttttgtataggtaccatgttggaagatgagaatcaccatacatcctgtttgtttgaggtacactgctctctcctgtattgtccacaccacttaccgacacatgcatgcacaaaaaaaaaaacttgatcaaggggtaggacgtcgtcgttgacttagctttaaagaaggtgcccactgaaaccttgtgcagcgatgtggacagaactgtggcacccaggatttgagccctgggtgggcgtcaccttactgggtgctctaccactgagctacacactccatccaacacatgcatgcatacacgagctgtatttagtaacatctgaaatgaagaaatggaaaaactaactaatggtatgcatactagataagaaacacctggtattgctaagcattgatatagggtggccaggtgaatgtgttatccagtgatcccaaagtgaggtaggctcccaggtagccgaaagtactactccctccatcccaatggtaggtatttctagcgttcaaatttgtcccaaaatgtagctaattctccacctacctcgtcatttgaaccaagcacagccatatcccgttaaatttctgcacctactttctcttctcaaccgatcacaaccttccaccattcaaccgcacctattttcttaattcccgtgaaaacctctagaactgcttacattttgggacaaagtactgattaggcaagcactgtagtttttgaaaaaaaaaaggactcgagtccgctaatgctttgactggcatataccaagtctgtgaataccagtgtgatgctggctgcagtcctgtaccttgtgctaattattctgttcaacaatttagagaactgctacaggtgccacttgtcagttgctgaggggtttagggggttagttctgtaattgtcttattttttttagaaaatgaaggagagctgcgcttcatttcattaagaaaaaacaaaccacccatacaaccaagggctcacgagcccttcacacatctacaaacagcaccacacaaggtgatacacgaccaaaaaatcaccctacaacagcctagtgcccttgggttagcgaattacacccaggttttcattttttcccgtgttatttataaataataccacataattgctactcctttattaattattatccaataaccatgtcttccttttgtttcgtatattatctgtttgggaaactaaagccttattttggtccaatgaacagtcttataagatgatgacatgctcatacgctgatctagactctgcctgcattatgccagta

SEQ ID NO: 63943 - DNA, 2043 bp, Oryza sativa
attggtacagaagtaaggaaggtgcaaatacctgaaaatattgtggagaatgtgacttttccaagtcgtgatgcaaattgtcccacaattgaagaatcagaaaatgggtcactgcatggaactaacacaaatccatcatgtgatggttttgaggaacccgggtctcttgaacaaccaactttgcgctgtaagacaaagctaatcaatgagctgtcaccttccactccggagcccatgacagagggtggcacaggtttaatttttgtgataaaaattcctcttctatttgtggtcattattatgcttaatttgtgatgtgtgggtttcactgatttattcagggctaccctgctctcctaaatttatggttactacaccagctaaaaaggagaagcaccgggtgactagaaaacgaagaaggggattatacaataaagattatataccaacagatagaggagacaaacggaaggttagaagaagaggaacatgggtattgtatgatgaaaatattgttctaccaaatgagtaagtagagcttctagcttagaagctcttccatctgttgcactacctattcctgtttgatcttttaggtatcctaggagctggtttggcaaacttaggctcatcttatcagcttaagcagggatttgggattctttgatgaatctaagttctcagcttcttcttcttccttttttttttttgctaagatatttaaggctcaaggcaaggtactgtaagttatgaagcctatagcctcataaagaattataagctgagaaccaagatgcttggttggctggccctgaggatgtttgtgttgtccactgggattcaaatccttaaaacatgtgctctcattggttctacctgtttgcagtgggaaccagcgatcatggctggggtgctagcctcttgttcccgcactttatttttgtttgggggcttgggttaggtggtaggctgcagtgccatactattttttatgtgatcaatgatcatgtagtataagttggaacattaatttttcaatatgtggtacttctctatttttaattgctaatgctttggatttttttcctccttaatgtagaacattgagaaacacaatagaggatgcaagtgatctagtgcagcagagaaggaaggcacctcatacttgtctttatacctggaaggagggcaaaattcgttctctgccagttactttcatggatccattgattttgtgtaagtcttcatctatactaggtgcaattagtgatggaaacctccataattaactaaagaggggccattttattttcacagatccaacttcggtgtacgttagacacactattacagcagatacaccagaaaattcgtgcagggagtcagtaaaatcaagaaggcgactttcgttggagctttctgaatccaacaatatctgcgatgatgctaaaaatgtagaaggtgaaagcattccagatgaaccaagaaagagaaaattggatgaattgacagatagtgtacaggcaactgttgggtgttacactgaaagtgcacagtatcacaatgatgaagactatagatttaatgacgatacagtcaaagaaaaggatttctcaattggaggacatgaatctcattcaacagaactgcaagaaagattgaatgcattgaaaagtaaaaatccacagctcgacgaggcattggatgctgatatagatagtatggaagaggtaacactgtctacattaaactcttttataaaattcttttgaaaatatctggttttgtgtgcaaaatgccatgcaaacaatgcatttgttaatgtatattttatgcaaatgaatcatatgaaaattgcatctggcaggatactcatatggatgaacaacatgctacagatgaacgcactctctcacaccctatactagtttttatttttcctgtacattagatctttgtttttgccaagttctactgacattgttattttgcacaggtttactgcgttcaacaagaacaaggtggctaatgaacttgtcctgt

SEQ ID NO: 63944 - DNA, 2430 bp, Oryza sativa
agttgggcgcatgtagcgctagatggttaggaacatgtagagatgttagttgtttcccccttttttttcccctttagatggatagcttagttatttataataactttaacagttgtaaattgcagtttcctatcagtgttagatcccgtgttcttttcagagtttttgatcgtgcgtgtttggttcagttgtatatgtgagtttgccaggatgttgtctaatctggaaatgatgcagctgggaacagtttggaagctatgatgggaacagcgagccatggtgatttgaaggtactgtagttgggctcagttggaatgtatcattttggtgtatttaactaagtcttaataaagctttcattatcttaaaaaaaagatactgtagtcaaagcagtagcaaagcctcttgaaggagctgatgagtcccacacagtcgccgtcgttcttcgagcttctcgctgttccattgtgaacttgagaagcttatgcttttcttgattttttttaattcttctttctttttatttgttaagtagatgcaattctatttgtcgaagagcggttgaatctacatactgctgaatgtccagttttagctgaatcaacaaattcaggattagctgaattcacagttgaggtatagatgaatctaggtgatccaagagcggagcagctgagccgtgctcggtgctccacagttctttgtacagcaaaggcatgcacggaaaatgcatatagcaggtgcagatcttgtcaatctacactcattttcctgcatcgctgagccaggaaattcgacggtgaaaattggtaagatcctggcacgattggttgctcagcgtcagccggagcgcctagcgttaaatgggccgaaatacccacacgacccacgaggggcgagcgacaggccgcctagtggcccaagtaaatttcgttttatgccaccttttattattgaagttttactttatgccatcattatttaatcattgttttcaagcatatcatcagctgataacagctctatccataccctttttcccagttttttttttaaaaaaattctgttagctcctctatagttgtgacgagtagttttgtataacctatgtaaaaaaaacctagctatatatatggagatatgtatgtctagatatataatcatggtttgtcttttttttatatgggaaagctcttattagactagcggcactggctgggagcggtttgctagttagaccttgtttgattaatccctatgaggctatgcttggttaattcccaagagggagggagttgagcggatttatcccatacctattgtggcgtgaaattattcctcctcaatttcctccaattctcttcaatcactctaaaccaaataagaccttacttggctggaatcgatttcccagttatttttctgtgcactcttgctcttatgtttttttagtgtgcctttttatgtttttcttgtattcatgtatggactaccataacaatcctatttgtgtcgcagcaggcgtgcttactgcctcaacgggtaaaaggaagggatcaccctctcaataagatggcgatggtgattctcaagctgccaaaataatgagaaattcaatcccagaccttcctgaggtaccgaggcattgagttctgatgatgcaggtttagattgcaagcttattatcaccatgactccacttatccaaaaaaaaggacagacaagattaatttagtgctacgatttcttactgaattagtgactgtcctctctgcaaaggctgctaacatctccaacacatcttccagaatttgattcataagtgggatgctttcgtacaacttatagctaatttagtgcttcctccgtttcaggggttaagatgttttaactttagtcaaaatcaaactgcttcaactttgatcaaatttataaaaaaacagtaatatttttgacccaagataaatttataataatgataatttaattattaatttaataaaactattttggttatgtaaatattattatatttgcctataaacttagttaaatttaaagtagtttaattttgacaaaaatcaaaacatcttataagctaaaacatagggagtacaaaggatgctttggtactacaccaaaagatcacaaaatgaactttgaaactataagactaaaaaaattaaatatttgcttataaatataggagtaaattttacaaaactatatgttttatggttcaagttacagaaaaccacacatattttaacacttggtacttaagtatatatattttggtagtttagtttcacaaaaccacactatcgatgaatggattcacccatgatatgacgtggttgttttatctaggatgtggacgtggcatcctattaattctgtgcgatggctggtcataggatgccatgtcct

SEQ ID NO: 63945 - DNA, 5118 bp, Oryza sativa
tttgtgaaacaacactaccaaaatatatgtacttaagtgtcaagtatcaaagtgtgtgcgattttctacaacttggaccataaaacgtgtagttttgtgaaatttattcaaaacataagtatgagcgaacgacggggcagttcgttttcaatcgagctcttgagaggaacggaggaagcaatttgaggccgttggatccatgatcaatgcttcagatggcacgagaatcactcgcctctctctcacctcttcttcctcagctccgttccctacttccctccctctccggcgtccgccgccgccgccgccgccgccgcgccggcacaccatggcggcttcgccgtgagctcatcatgagcttcaagcacggctccgactccgatatctccctcccgcaccaatgccagcctcctccctccgcctccgcgccctcctcgcgtcgccggcaccgctccccgcgcgcgcgctcctcgccgcccacgccctcctgctcacgtccggcctcgccgcggactccgccctcctcgcgcacttcgccaggcacctcgcctccgcggccgcgcgctcctcctcctccgccgccgccgcctccgccttccgcgcgctgctcctcctccgcccgcgctgcgcacacccgttcaacgctctcatctccagcctcacccatgcgggcgacccctccgcggcgttccgcgccttcgcgctcctcctcgtcgcgtccggcgcgggcgcgggcgcgcggccggacgggtacacgctccccgcggcgctcaaggcgtgcgcgcggctgggcggcggcctccgggagggctgccaggcgcacgcggtcgcggagaaggccgggttcctggggcgcgtccctgtgcagaacgcgctggtcacgttctacggtgcctgcggccagtgtggcgacgcgaggaaggtgttcgacgaaatggcagagcgggacgttgtgtcatggaccgcgctgttgtctgcgttcaccaggggaggtatgttcatggaggctctcggggtccttgctgagatggacgttacaccgaacgaggtaacactggcaagcgtgcttgtcgcttgtggaaatctggggacggcacgggctgggaaggccgtgcatggatggtacttcaggcgggagaaggagctgaacctaattgttggcaatgctctgttagatatgtatgtcaagtgcgagaaactggatcttgcaaggagggtatttgacatgcttttggcgagggacattgtttcatggacggttatgataagtggcttggtgcagtgcaagcgtcctagtgaagcattggaggtgttcaatgcgatgcagatatcgggagtgaagccagacaaggttgttctttccactgtcctctcagcttgtgcaagcttgggcgcactggagtctggtaggtgggttcatgagtacatagaacggaagggcatcgagtgggatgtgcatgtggggacttcagttgttgatatgtacgtcaagtgtggatgcttggacaccgctgtttccatcttccaagagatgcccctcaagaatgtatcttcctggaatgcgttgatcaatgggtttgcattgcatggtcgtggcagggaggctcttgactgctttgacaggatggttgcatcaggtttgcaccccaatgaggtcacttttataactgtccttggtgcatgttgccactctggtttagtgcaagaaggccgtcagttgtttgagttgatgacaaagtcctacaagctctcaccttgggaagatcattatggttgcatggttgatcttcttggaagagctgggctcatccaggaagcatatgatgtaattaaagccatgcctatgagacccggtgtgttcacatgggtaaccctactaagtgcatgccaagctcatggacgaatggatttctcgcagcagattcttatgcatatccatgagttggagtcctctgggaatgggatttatgtccttctctccaacatgtatgcagtgagtgatagatgggcagatgtagggaaggcgagagggttcatgaatgagaaaggcatgcagaaggaaccaggatccagtgtgattgaggtgaatgggaagacctgtgaattcttagttgggcaacagaaccatctgtatatggatgatgtacgtgcaatgctttccatacttatgaagcaaatacatctggatggtctctagttctttaggatttaaatggttattgtgttctgccgagatcatcttgctgcttgtgttccatttggacaaatgatgatcaacgattcttggattggttactatgtttgcatttacactatttattattcctaagctaatgtgaggattttctggtactaaagcttagcagtcaagtggtctgcctaacagtgaaatccgcaagtcagcatcgtgatcagactggcaaatggaggaatagacctgacagttataagccattggcataatattgagactgctagagtttccactatgcacattattgcaccaatagttatgcaaagttctcagtaagcctaggatgctttcttttttaaagaacatgacgtgttatcagttgcattcttcaatgatgcactcaatttgttgctttgatagtcgcttttgaacatgacatggacaacagttgttgggtgcagaatcagtaggatttcgttcctgaagaaccagataaagtgttctccaagatgagatctgaagctaaattcattcgtaaagcaccttgtttagtgcctggatacgtatcaaaggtagtagttcttaaatgaagatacattaaaaggtccaccattgaccagcacgttgcgatgtgcctgaccccattcatcttctcacatgaatatcacctcttcttgtagagggctatgaatgatcctgacttttatctaatgtaccgtctgcctccacatccgttctccctctggcaattgaagaacactgctgccacaggaggtccaagattatacagtgcggaaaaatctcttgtattgaaatttggtctccatcctggtgcataaatagtctgttgtacatattggcgaaataatataaagacaaaacgatgtatccctgcagttggttttgggctttcataactgacaacttcatttcctgtaataaaaattgttaaaacatgttaaagtcagttcatatgagtattgctctcagcctctcaaacttaaaagttctatgcatgaagtatggacatccattggtcaagtttaggttaataaaaaaatagcatagggatgctcatgttgagctcagtgcagtcagatcagacaagtttatgacaatcatagttaaaagaaattatttccatgggttgatgtcgaaggcaggacgatctgctgtttatcatctgaaatccaggtatgacattggtgtatcgttatccttcagatttactatatgctcttatagtttagttttagtgtttattaaatgtaactacaaatgatacactttgctagttttttatttttaattatgttgtcatctggaccagcacgatatgtatttgctttaaaatcttggatgacttgatgccatcaaaacattaaattcagaaaagaaaagaataggaataacccaccataactagcatttgccgattctggaatgtctgtcaccaacctgtcacatgcaaataaccataagaatagcttttgattttgtatttgtcacgtcacacacaagtggagaagtagaattgtataaaccaattaattctgaaatgtttcagattttaccaatgaaggtattctctttttgttgggttgcttggacttggcgagtcaggatccaccatcacctaaaagcaagttagcgtgttacttctagggaaaaatataactttttagttaaataaaacattatcattccaagcaaaggataaaaactttgaatttgagggtataaggtccatgaactgtgcatctcagttacttgtgttccactaagattatatggccattgctttcttaattgacacaacccagatacaaggctctccataactttgatgctttagaaaattaactttctataacactattattttgttagcttcaatggttgtgtcactactaatgcatcttcatgattctagcaaagtacagttaattttttaatgcatctaatcataatgattcagattcctatacttcatggctgacgtgcataattttgatccacaggcagcattcaaatatgcaggtatatgtgctgacctatcaaaagcaaacagaatatctttgtttacacgaaataaagaaatagaggtgcaaaggtctttttcaatccacccagtcacacagatgaagttgtacaacttacagaaagctgagaatatttgcttccagtgttctatacgtactgaacactaatagcacatgctacaggtatagcactctacacagttggatggggctcgtgtaattaggcacatgcttttttccccctgggctagatgccaaatagtattccttatgaactcaatattgttcaatgcagtaatgaggatttggacttaccagagtgtaaaggttccttatgtcgcggccagcaatttcaatccttggttcatttgctacctgtgacggtttgagctcagacccatttgttaattccttgttgttgtataggaccttgagtgatgctgatttgttgaatgggtctaagatatccccaacaacatgtcctacgacaagtgggtcccttgacatggctagtgaagattgatgatcttcaggagttgagcaagaagaggctgtgctaagaagctaacttgagcagaaatgttgaacttgggtgaactgatgagtgcaggtatgtgccctatatatactcacaatctaagtgctgaaggcattcgtggtatcaggagttgttagctcctgaagacttggaatcttaactttaaggcgtaggcaggtgtactgtattatattggttgccatcactggaaatattgtggtatgtccactctcatagcctacataaaaataaggagtgttcattgctattccacatcgatgaataaaatctgctgaccactctcacttattccctatatctgcaaccctagacatgatacgctc

SEQ ID NO: 63946 - DNA, 4181 bp, Oryza sativa
  unsure (1)..(4181): unsure at all n locations
ttatagcagttcttttatcaagtagatgcttgataagcaaattagtggtacagctgtgtggtttatttcagtgcatgccgacatctagaattcagaatcaagttttcgtcattcaaagattataggttagggtgggttcttagataatgatgacgatggtaaattggctttatttgatctacaacattctgttattcactgctctccaagtatgtctatctaaagttctaaacatattagtcctgttctttatctatcaagcgagattttgctcaaagactaaaacagccttctttcggaacaaacattttggcatgttttgaactgtcacaatatctgctctattgtaacaaaatttgaaaatccaattttcttttattttaatatgcataataggtggtgcagtcaattataatataaaatcagtctgctattttttttgtccaaaatatttacccttttctgtgtctctgtagttctatgatctcacccccccgagttcaagctactacctaaaacaccagtccaagtcacattccaagggcagtaggccttctagaatcattttataagttgcttgacacacaatcactcatattgcggaactgaacatctaaactcacttgtcagctgttctcaagattcaaactttcacacgaaactcagaatttcacttaagggctgttgacagtacgcatattctgctaataaactttctatagaagtttattgtactctgtacatctctattttactagttttcctgatggaatatgatctctgacaaataggtcagaatgcagcttcttacgaatactcctaggggggtgcatttgccttttgaaatgtctgccgctctgtcttccttgctttctgacagaatatgatttgtgtaatacaacgtcctaatcttcttatcatgacaggaatatgcctgcggagctgatggactctacataaagcggacgcagaaagcagagatagataaggcaaaggcctactacatttattcttgaccaacaggggcccgcggaatcccattttattcctgtaattcgcaccaaagattttatgtcaatcacgcctcccccttctgatgttatgttcccacttgcagaacgcaggccttgagctgtgcatcgaggaatcaagccactggttttctcagtcctccactcctgctggcacctaaatgtctcatcctattaagcattttgcaagataaactccaggaaggtaatttcagttaacatttatttttctcgaacgcgcaaaagaagaactgcacatcattatattaagaggaaagaaaagagttcaaaaggacccaaacaagcccagtagggcatggtttagtacaaaacggcttgccaacaaaaaaaaaatgctaatggtagttacccaggttgctcaccaaatatttcatttgtggtcatggcttcttttaggaggcggctggagggtagcaggaaaggcaaagagctcagttacgtggacgaagcgaacgtcaggttgagagttggaatccatgccccgaactgtcgctggcttgataatcttgactggagaacaattgaacaaggcagagaacaatgcaccatccccccttcacgtgggcgcatcccattcgtcgcgtgatcgataggacttgcagagggggggccgtggtcctcgccgagtcgccggcgccggattctctgtgaaaagaggctgcaaaggagattccacaaggcagaaaaatctgccggaaacggcaacatgatcgtgctgctgctctcgaccaccgtcgccatcagcccagttgatgagggcaagtgtagtacaaaacctcagcgcctgcccgctgccattggcttgctttgggtcagaaagcaacaccaaggtttttgggtctttcagatcagaaagcaacgcaaaagactggctcttcggatcagaaagcgacctctagtgtgtgctttcggaattcagatcagatatatgcgtcgacgacacttgcttcatcgagtgtatgcccttcttcttcttcagcactgttgcagttgacctgtccacataacacattccatggatatcaggccaggcctaccgtgtgtatatctgatgatggactagcagcatatcggttggcccaggtaaaactaggcatatatcgcttgtttacatagcttcatctgaagcctccatgatatcatccaatctaattttttgtatcaagttctatctatcctaacactcgtcaactccaatagcgcgggtggcttgatagttgatacatatcctgatatcaagcagattgcggaacaaacaagccgaaatttacgatgatctgtttgcctttttgttattctgctacgcgttcgtattgcggctgacatatttttaaggtgatgtatctggatcagtgatcacatcaagaaaaacagttgcgaggtcaaaagagaggagcagcttggctgtggaagaacttatgcctcgtcgtcgaataagacaggagttttgtaggatgcagaatctatgccccggaagaactagattggtaacaataatgtgtataaatgaaacgatttcatatttttcacaatgttagacatatgcgtgcaatatttatttgaaacttcaatcttctgaatatcctgataacacgattcaactacataaaagtatcagtttttactgattttcttcaccgggtttttctgctattatgcaggcccattttatttattacgagttctttttattgacagctcaacatttttatacaaggatgcattcaggttcagaatgctngacattcttttctgtatgtatcaatacgttgtcagctaagcgttcattttctccctgtcgacattatgggccagcatatcatatatattctcagcataattcccagcaacgtgctcaagactcatgtagcaagactcaaattggcgcctccgaaagcataacctttctgaagcaatgtttgattaaaaaaaatttgctgaactaatatagaaacgattagtccgcacagcactggcctgctcagtacgtctgcatcatgatctgcccaaagatcttatgcgaccatgataatggtcatgaaccatacatagtgctttgtgaacttcacaagttgatcaataaatacatttttatgaatctatgactatgatgcaacagccacttgatgtataatccacccatttcctcaaaattatcaactactacaacagtgcatcagaatgcatctatgcaggcaccaagaaagcatatccataacgcaaaatttacatttagcagtaaacccatgaagaaattgaactctactagaatgcatctatgcaggcaccaagaaagcatatccataatgcaaaatttacatttagcagtaaacccatgaagaaattgaactctactgattttcatagtttcccaaaaggatgtatattccatgcaatggtgagccagtcagctacatatgcttactatcccccgtctcaactgcaaattgaaatcagaaagattagaattctgcacagacgcatggttttctttttttcttcaagaaagcatcttcacattctcctattttgccctcgacaccataataaatgcacaactggatgaaaggaaatatgaaccacaatacttgtttgatccaatatatattcaataacagccatacagaacttttaaattaaaaggcaaccaatatagcaacatgtcatatactactagtgttgaaggcattgcagctgcaggtagattctaggtatggtaaaaatatggtactagtatgctaaaactaattatatagtagcaaattggggaaaaaaattctgggcattaattaacttccaaaaatcagttggatggcacagattaatgtttagcaaggcatgaaaaaccttctggatcaaatatgaagctaccagagtgaagtaagatggcaggcatagctggtgaaggatcttaacacaactcaccttataggcattttctttgtgatataaatatagaggttctataaacaggactgaagtccgtgacatgctgagatcaaggactcagacggtacaaactggtcaacaaaatgttgtcaaacatttaactgtgagataattacagttgataatatcagttcaaatatcattcaaataatcattaaaaatttgagaacgaacaaaaag

SEQ ID NO: 63947 - DNA, 7550 bp, Oryza sativa
tattaagtagtggtacaatgcaaatcacccaaaggaaaaaagaaactgaagaaacctattgtaataaagctcaaaatgtgaaatggtcatattaacaacaaattgtggaagccgttagcagaaaatactgtactgatgctcttatgtcaggatctacgattcataaaggtgtatcaaaatcaggagtgtaattgtgcacaaatatgctgcatcaacaaaatgctgcccttacccaaaatacaatacaaagaaggatatttaagcagatcagtataccactattactgaatcaagtgcaattctctatttgtaaaaaataataatgcaaagtaatatttcagtctagagctgctcaacaaatggttgaatagcttacaggcatatttcataaaataacactgtcaaatttaataggtgagtgtctacatattacagcagtcttgagattacttgctgatgctgatactgtgaaagaactaaatgaatcccctaagtcaacctgtggttctatattcttgccataaccaacaacaataacaacaaaggtaaatagaaatatttgagtggtatatgaaagaagtagaccaacctcatgacatatgccatagcacaactggagggcttcgtcccacttttttacttcaactaatccctttatgaggcaaacaaagacacttaactcaggtacaaagcctctccttgtcatttcactatacaatcgaaatgcttcctcaacttgagatgctaaacaaagtgcctggatcaatgaagcgtacatgtcattgtcagtttttacagatgacggaacttccatcatctctttgtgcaactccatagctatctccagcctgccagctttggagaaacaatcgatcagcattccataaacaggtgcaattggtactgtgccatatgattccatctcctccagaatacccagagaagcgataaagctcttgctgaaaccttgaattgcacaacggtatccttgtaagtactttggccagtaagtctgcttcatttcaccaagcagtaaacgagccttatccaaaaggccagcagcacacaagtggtttatcagaactctgtacgtaacataattgggagaacatccttttctgctcatttgtgtaaaaaggtcaagactcagatcaatcttgccagctttgcctaatccatctattagagcagtgtaagttacaacattcggactgcatcctttctcttccatcaatgacagaagctttagtgccttctcactttcacctatcctacaaagaccattaatcatagctgtgtacgtaacaacattaggagtacaagaatcctttaacatctgagagagaactttcattgcaagatcaagtcttccatccttgaacatcctgtcaatcaacgaggtgtacgtatgtacactgggaaggtacccacactttgtcatctgcagaaatacctcctgagcactgtcaatttttccagctttgcaaaagccatcaataagagcatcgtacacaatgtgattgggctcgcaaccagaagataacatagcatctagtaattcatgagcatggtccactttgtgagctttgcataaaccatctactagtgcaccatatgtcacaacatttggagcaagtgtgtgtctgtcctcacatggaaagtaaaaatcagaatcggcgctatcagaagttccaattaatttggcatagacttcaaaagccttactgatgttgcctgctttacagagaccatctaccaatgcaccataagtaacatcatttggacgacagccagcatcaaccattcggtgaaaaatatcattagcctgaggtacctgcttagctttgaggtaagcatgaataagtgcagtatatgtcaccacagttggggagcaacccacactcctcatctcctcaaacaaccactgggcttgttcaatgagtccagctttacaaaagctgtcaatcaaaattgtgtatgtatacacatcaggagttacaccgaccatcttcatctcttggaacagaaggaaagctttctctaccttagtagcatggcagagaaaagtgatcaccttagagtatgtacttgtatcagggacaaaacctttcctcatcatctcctttatgagctgaaatgccttgtcaaacttcccgacaccacaaaggcatcgagcaaaattggcaacgttaaccttattaagaacacaattagcagccagcatctctccataaattttctcagctaaatccagcaaatcagggcttggtaatttctcctgaccacatatacttccaataaaaatattgtacacaacataaccaggagggcaaccacaagtagtcatcctatttaaaagtttataggcatacgcataatccttttcattgcaataactatgcacaagggaattaaacaaggatggatttggattgcagccctcagtcatcatcatattaatgatcctcttgcaccagccaagctgtttctttttcaaaaatcctgagagcaacgtcctatatgtgaccacatttggaatacatgagttgcatcgcatcctatggaggaatgacatggcctcgtcaaaatacgatgcctccatcagcccgctgatcatatgtgtgcataatactgtatcaagcttgaaatcctccctctctatcatgtctagtgcatcagcccaccgcccctctttgcacagagcgtgcgcaaagcacccaacggtgaaccggtccatgcagaaccccgactcggacatctccttctgaacccggaaccccaagtccacctgccccgcgctcgagagcacctggaccagtgcattgtaggtcaccttagacggcctgtacccaaagtccttcagcctcccgagctcctccagcgcctcgttccacatccctccgcggcagcaccgccgcactagcacattgagcaatctgccgagcacctcgcggtcctcctccccaatctccctaagcagcctctcggcatccctggcgcggccgtcgaaacccaacgcatccgcaagggcgtcgtagcatgcgcccgtgtggctgtacccaacctgccgctcggcccagaggaagaacctcgcgcagagctccggggcgtcgcgcaccgccccgagcaccgccaccacgacggagtcggtcaggaacccgcggcaccgccgcaggacgcgctccgccttgccgtcgaagtcggcgccgaatgcccggatcgccttggagatcagcacggcctccggtggcgggagggcaccggccgcggcggcggcggcgggctcccgaagaaactcgaagtctctggggccgaggcgagaccggggtggcggttgcggcggcgcgggtggctcgacgaggccgagcagggggtcctcggagtcgccggcggcgtgggagcaggtgcggcgcagggaggcgcgtagtgtcgctaccgccgccgcgcggcggcggatcatggagcggcggcgtgggcggtggcggtggcggtggggcctggagctccgtccatggaggttttgaggggagaggggattaaaccctagggaggggcactcccgtaaatatctcggtaagctggtagtggggcccactctccagtgggagaagggagtgtttctctcgctgagccagtgagccccaccacccgaagctacagcgccacacttccctcatctctctctctccctctccctctcctcctcggcgcggctcggcggcgctcccctcgcctgcgcggccgcgcagcggtagggcggaggcgccggcggtggctcagccgacggacaccgtgggttggccctctacgacgccatcagcccggctcaccagcctccgctgacctctaccgctccacagaccacagcaaggcagcaagaggtaaggatttctgaaacgaatccctttccagttctcacagtccgcttgccaattattgttgatctgaagctgaattggtcactgaatcaatggtagagtttgagatttcagaaatgtgagtttgagaatttgaagtatttgtgggggaaaaaacttgttatggttgtgcgtttcatgtatgaaacgtttttttaactgaacaactggctgcaaaatcgtacattcgccactactcgtagcatctcatgctacctgtttgacgtatttgcgcagcggagtcgacactgccaataggagttgctctggtgagattcagctttttgaatttatcggagactattgctctgatggtagttctgtgtggtacaaccgtacaaatagcctgaagtagttaagtgttttcatattctctgtgtttccctgtgcaatggtaggtgccgtgctaggaaagttgttagtgcctcgtaattgcctttgcccttttaccatacctgtgaatgacgatggtgtgttcaggtttgaaccaaccatactgcattaatgctttaggcttgaggatttaaattacattgaacagcttggagtcaatcacgttttgagtacattggaatgccataaaccactgtatagtgtatagtatactgccgtagcaaacaataagctattcccatgtcaggatgtttgatggctgtctgatggcaaagtattttcccatcaaacggaatttggaatgcctagcaggctaatgcatcccttcaatttggttttgaggcatattgtagaattatcaattttttgcattgtcactattttcatcgtctgttccttcagataatccattgatatttctgttagtcgttgtgttcattctttctattgttttctttctttcttgacttatctacttttatctgcaaacttgtgcctctcacacaacagcagaatccctaattgcatatctgtgttttattgaaatttttatgttcatgcagtgattggcacttttcaatggcatgtgcttcaaagacaatctctattggttttgccaacagtggtctatatggagaggcaaggctactgtcgccaagctacaaaaactacccaaggagatcctcttacaaatttatcaaagttcgtgcagtacagggaaatgatggtcgtcgaaggctagttgatataatccgaaccatccctgaactctctagaaactatttcagaagccggtcaaggagagctctttttggtggtatctcacttctgggaggcttttatgtggcgcagacaatatctctgtctttcggagcgttgggtgtgaacgatgtcatagcagcagttgtgtgtgtcctgcttactgaatacgtaactaagttctactacagccggcctaaggttaccttcccatttgctctcctcaacaacttcaagatgggtttcacatatggcctgtttattgatgccttcaagcttgctagctgacctgcaattcttcctattggtgctttgacatgttatgttcttgaatcttgaaaaacagcaaagatggtgaaaaaatagcatgcccccacgatgttattactgagacgagggatctatagttctgtggctttcctcagctttgttctcctatgtgaaggcaggcttgttgctggtatagtttttgagttggtggatagattttcaaagattggtccacatgtgggtatactgtagtgtgatgataacaactatttattttgagattcagattacatatgattgaagcccggtgtgtacatatgcaaatttcaagctatctgatcttgatcatctcaaaaaggctgtctaatttttaatggaacttggttcagatttaagtccattttgctggaaagactgtagccttgtgtgattttttatgctaatttcctcgacccagtaactcgaccgagttacacctaaatgcactaagcttcatctgtactctttgatttcatgtatcgaagatgcaaataatacagtagcacttgatctgtcctgttaagacctgctgtgccaagagttcatttcattgttagcaactacaggtgcaacagctttttattattattatttttgaaatggtgcaacatgtaatttgtatagtattagtaccaaccttgggcaaagtgtaagcaaacatttttattcttctcttgcgcaacgcatattatcctgacctgatccaaactttgttaaactcacgataagtttatcctgtctcaggttgatatgggctcatgtggctcatcgacctatgtctgctttgctcaacgaatatcatctataatcagtaacttgtaccatcactgagtagtatactgtatggcaactgatattttcatgccataattggctaaacattttcttatcactttagatcaactgatcaatcatgccaaggtaaccttcagattacattacacatcaggttgttgccaacattgagcaaatggtagacatggaactgtctccctcttttctctttaacaacagtagacagggatagatggctagtggccactagcaacacatgctgttgcctagctgagctcagctcatctttacctccccactgtgtgtccagccaccagcttaccgaaatgtcagagctatcctctccacttcctagtggccaagaaacttctcctcttatagagagatcaagggagtaaagagacagagagaaccaagtgttttgtgttgtagaccacactcccttttgcaaagaacacacacaagattcctaatcgtctcctctccttgctttgttgttgctatggtttgccaccatcacaagcaaccttgtgcattagttagatccagaattccagatctctcacttctttctcagtaggcaagcacataatcttgtatagggtagtatatttatttgttttcattgctgtttctgttgctctcagtccatatctgtcagtgggtcagtattgcatctgcctttttttttctctctctcttcatcgatctttatagatttgtttgggtgatgcctgggcgcagtggtttatcgatctcttccctgccttgtgctgctccgatcgatgcccgtgctgattcttgataatatacaacgcaggaatcgatcgataagcctctgcatccagatctcactttttgtttatgcgtatgagccggtacaggttgcctctttgttcttgttttatagggatataatcactgattgatatatttcttgggagtttagtttttgttctatgtgctagaagtatctcttgatattggatagcaagatttgccccttttcttaaaaaaaaaaagtggatagcaagatgctgtcttccaattaacccgccttgtgatagtttctcttgttattttatcatatccttaactgctgcgtatgaatatatacagctcgattaatggatcgttttttgtacaggcaatagcttgctttagcttaacaaatatcctcatattgctgctgccacttttgcaagcttgttttgtaaattacatttggatagttggttatgcatttgtgagttgtgacaaattacataaagttatggatgatgtattgatgttagaatagttgcctccaattgttgcttactccttttttttctttttgaaaccgaattattgctttattattggcatgctcagaac

SEQ ID NO: 63948 - DNA, 14487 bp, Oryza sativa
  unsure (1)..(14487): unsure at all n locations
aatcctaacggtgaatgacgacagagtactcttgtcaaattgcgagaaatttgtgcaggcattcagcgtagtaatggtccaaaaacgtactccaaatagagactatgctaattatctttacaacgtactacgagtagctaggacaaagaaaccaaggtactcgtaacttcgttgaaatataatgcaacaaaagttcaaaagaaagcaaagaaagctcgtgcattttagcgcaggctttagacacgtactaagtgcaaatgccgaacgtgacaccacaactctacatacaaacgctcccgtatgcgtcctttgttgacttattagacacggctttttcgatatatatcgatggagagacgtgcggtgtgggcaggccgacagggcggtgtatgtgacacacgcgatgacgtcgatcccgtcgtccccagccaggcagccatgatcgatccagcgtttttgcacacgtacgcgccaaaagagagagaaagaaagcattttcaggaggcaaaactataatattcggccggtcatagaggcacagcgggggtgtttatctattggtataaagttttagcgtgtcacattagatatacggatatatatttaaagtattaaacgtggactaataacaaaacaaattacagatttcgcctgtaaactacgagacgaatttattaagcctaattaatccatcattagcaaatatttattgtaacatcatattatcaaattatggagcaattagacttaaaagattcgtctcacaatttacacgtaatctatgtaattagttattttttcgtttatatttaatacttcatgcatgtgtttaaacattcaatgtgacagagtgaaaatttttgccagtggatctaaacagggccatagtaagaggcaaaagatttcgcattatacgtatgtcaaaagttttgtcttcatttttttttattatggaaactttattaaaactcagtcaaatacaccaagataatacatttcaattaagcccgctcccggcctctgcataagatgcatatagccacacacaaagaaagacctacgaagacccctatgacaaaacagaaatattagtggctatcaatccgtagactagatcgccaaccatactcttgagtaaaaaaaaaactcttgtgccacctggtccaacatcgcgataccactacaatagtatcccgaagacccggtttatggaggatagcccagatgcgaagccaccggatgattaaagtaataatctgcaattcaatattcattatggagtatttttttagccataaaaacataaaaatatgtcattcaattcgtaagggcataatttcatcggatttttcgttttgctatttctgtagttgaatttgaacatgggacttcacacataggtgtttaatactattagaagtacgtacacaagttttccttttaattttcggtgatatttgctagttcgttgtgcataaaaatgcatttaaaggttgtgtgggtaggatactattggagaagtgggagcccgggttcccacctccaactgctcagggctctaaagatctccaaaacaggccacgtggggctgcatcccgctagtcacaagcgggactaagagttcagtctcttaattttgtaggctgcgccctaagatcgggtgtaagcccaaaaaaggccccaagctcggtcttctgttgactgctcagggcctctggcataccataattgcaattagacttgaaccgtcattccctcacgtcgcacggttgatctcgtatttaatgcaaaggatacgaatccggcagctatacgtggggtggatgacaagactacgcataatgcccgtgaaacaagccatcaacactcctgaattaccggggcatgggctgtcaagaaatgggattgattgtcacgtcgcttggccgggcccgagaagacacggtgcgtccagcacactgtagcaggcaagtgaatccaccaagcgtcaccagcgtcctagtcacctaccctagctaggccacgcatcgacatgaggaggaggtgcccgggacgaccctgtcacactcaatgctagctccaccaagggagctcaggtgggagctagagagattcattgcgggcactatttgtaagcatgtgataagacttcacaggtctaatttcttcgggtgtcccatttgtaagtgacgaacactacggtattcccagcgaagtcaactataagggcatgaccaaggcgacagatgaggggatcgaacttcaatagctctagcgagaaaaagtttcataccctgtaagagagtcataaaaggagatcgagagaaaaacataacatgaataggatattacgttttgagtggactcggacatgtataaactgcttgcctctctttgtctcacgcgaccataacttgcgtctgtacatctattccctggccgaatcaactaaaaggatttatctgctactcgctattggagcttgggctatcatagacagattcccatacactcttttattttacttttttttttcaaaacatgtgcagttatcgtacagctacagttatatacttaggcacaatcaatttctaccgttgtatatatacgaaatgctatatactctagatacggttaatttatacggagagtaccttcatatacggttaatttggtcagttgctatcgtcagtacgtacgacatgctgtactggatcagtagttatattgcctacccttctagaagttgcggcgctattcaattcgcgtaaccgtagtttgacctgcgttaataaaattttctatcccgaatattccatgaaggaacacttccgcatacatcatggacttgtaggtttgatctccctctatcgccttggccaccaagcaattaacaagcttgcgcgcagtgcaaggaaattacttctcctaggcgaacaagaaaaaacaaactcatgctgctggtagagatgattgattagttattcttcggttcttcaggtgttgaatggttcaaagaatgacgagaaaataggatttcgagttcacgtgacgattgtgctagttacagtatcagggaaactgcacgcactcgttttctggtttgccgtttccctccccacctatagctagcggttgaactttcagcaacaaatcatattggtcagtctttaccagtaggagtacgtacgtgactactacgtgtgggatgattagcatcctgtctgaatcattgatttcgtgatacgctgttttaaatttggctgtgtttagatctaaagtttggatccaagcttaagtctttttattatatcaacctgccatacacacatgacttttcagtcacatcatctctaattttaatccaaatttaaactttacgctgaactaaacacaacctttatacccacccggacattaaaaaaaaaaaaaggtactactacttcccgaggaggaaagaaccgccgcccgccgctcgggtcgggtcggccggtcccccacgcccgcgcgcaaaaacaacgggacgaaattaagctcacacacgaccttgtacgttctttttttcttgggaggctcacaaagtcacgatcggtgcttggagcgtgcgccgctagagatggcgcgcgcggcaggtgacaacacatcggccggccggccggccgtcggcccgtcgcgcgatggctttcacgcggatgtcacggagtggagtaggggaatttttctgtcacggggacggagtcgagtagccgacgaaaacgagcccattagattcaccggccgccgtgcgcgatgcgaaccgacgaaacgtctgttgcgaacgttggtagggaccagggagtagtaccggagtagagagatcgatccgtccggtgtttggtggataccgttcgtggtactacgtcgcgtggagttgtaggcccgtctccgttgcaggcttgcagcattgcgactctgcaacagtgtgatgggcttacatgcatgtcctgctgcttaaaggattgaagaaacaaccgtgcagtgtactatgcttgctggtactccctccgtatagtccatgagccatagtagcctagtaagagtatcattctattcgctcaaaaaataagttctgatttttatatatcatatcagataggatcaggggcggacctacggggtgtgccaggttggcactggcatatgcaattttttttgaaaaaacactagacgtagtatgcaatcaaaggatataaaaatagaatcttatcagaaaattatcatggtttgtctggagatcttgtaatcgtaaagaaatcaaatcagggaagaggaaaggactaaatgaagagaaacaatggggccaaaattcttccatcagaattagatgttttcttttaaaaaatatatatagtggagcgatcgttagaatggatacacccactgtaatttttctgggtccgccgctggataggatgtattttttcccttggaagatggaatggaaatttggatgtgatcctctacttatagagtacttagaaccggaaccggtgtagagtaataaaaggaagtgatagttggaaaactattctaatccctcgaggggatgttccctcgtttgctcaaaaactatctaaacggttatgaaaaattctggaaaaatttgacaacattcatacaacacatatatacaacttcacaaaatcttaagtccaaactcaactcacacgtcgagatataaaaaagacaaattcagcgtatgaatattagcgtactgtttatatctaaatttgtctttttttgtttctcgatgtgtagatcgaatttgaacatgaattttggtggactagtaggtatcattatactctatattgtcaatttttttttagattttttcacaactatttgcatcgaatttgaaagaaaaaggtatattaggggatatcccctcgagggattagaatccactcccgtgatagttgtactattggaaccgaacaccagatatgctaaaccataatattgtcagtcaaatagtctcgttatggtattataaatttgtatcaatatatgtaactatcagagatgattcaaagtaaaaaagtataataatttaagtacttcatgacaatgttctagcatcaacactgacaatatacaaggattaaacttaatgttcatttcattattatgcgtattgatatagcctttttttcgaatatttgggtgaaaacagtatatcacggaaatagaataaactctccactatttccgtttccatttacagacattactatatcagaataaataatggtagaaataaaaaaataaacagcaggtgatctggctaggaaattccagattattttcatttctgaaccacatatgcgtaaattgaggtccaattattatttgacatcatggtccatgtaacatttacccaaaagaaacaatgtgtcattgtcctagagcagtaatacaagcaatgtggtaagcttctgtggcaaaatcatcaactttcgcacaagatcacatgcttgtaagttgtaacacaacaaaaaaataataatccacagcaattaccaggtgaagaccgggcctacacgcaaggatttgcccggaggcttggccgtcgcccctcccacaagaggatatatagccggatgttgccgtgcactcttttcagtattgcccgcggatcacagcataagcatcaccgtaatccgtaataagagcaggtacaatagcaggctatataagccagctataaacatattttaaaaagataaaggaagagagagaagagcagtgggctacagaactgtagccagctgcagcacgggctccaaaatataatgtgtgtatgacaagtgggactaaatattaatagtatagtaagcaactattgtatgaattaactattatattaactatagatgatttggagctaaagcacgcacgcacgtacgttccccgcatccccgggctcaaaacagcgaataaatcggccccggcaattcaggtagcacacacgacacgagaacgacaaaagcaaacatggcacggtaatctcgtccacacgcaggcggatgcatccaatccaatccaaaaacgccattggaatcggtgctgcgggcaaagaaagaatagttggtggcgtcggaaccgagtacgtattcgattccacatcgatctccaccaccctaccaggccaccaccacaccaaaggcaccaacaacttccacagatgctaacgctgctaacccccccccccccccccacacacacacacacacacaagcgaacaactaaccccgtcaatctcggacaagctgcattgtgtagcaggtcgatccccatttcagccgctcacgccgccccggtggccgggcgatgtttcacgcgcggaagctgcagcgcaggcggtgatcgagcgaacggtggtggaggagccaaaatttacgacgccaccaaccgcgcgggcatccgcgcatgtgcggccgcgcagtcaccactttactactgccccaaaacacttgggatccccagtacgatgtcagtttatggaagcctgatgagaaattgagaatgcattcaagcttggtaccatcacgcatttggtactggagcagcgaccagtggagtgggtgctgatgagtgaatccgagggctcctctctcggcgtgccaatggagagagggacggtggttggccaagtgggcaccctccctgagtcccggaaaactttcactgcgtgggcagctcaaacgcatttgtcagccacatggagcacagctatggtgtcccagagggattttactacggtgcattttgcaggagtaaaaaagagtttatataaacctttttttttgccagaaccacgtcgatatagaacggtataaaccttgaccttttaaagatagtgagtataagccttaacttgccaaaccaaactttagacatggtacactttcttaatcagttgtttgagttaacgtatggctaaccatatttttcatgtgacccacgtgttaaatacaccttttctttttctcttaagcttgtgtaagggtggctatccatacttcttgtgacaagtcagtaagtcacaccttatctgggtttaacaaagttaaccatcaatcaagcgaccccagtacctcatttccagccatggattatgttttctgtttgcataggtacctcattgatggcgcaagggcacttcaaagcatttactactttgagagaatgttgcagaaaaatgtacaaaaccgtgaccatttctattactcccactgaaaggaagtaacaggtattaacatcaatggctacccaaagcgaaatggaacacatggatggacacaacattaggccaattttgctgttcatcattccttatgtacactcttcagtaatcccctagcttgcatcgttgcacggggaaatgtatccaacaaagaagaaaataaaagggaaaggggaaaaatactatacagactgtactccattaaacacaagagcaaagtcgatttatgtactccaccgcgccgtactttgtcttaattatgtctattactaatagagacccccataataattctagtccatagaaaaaaccaaaatagctatgtaattttccatttttaagagagagaacgctaaaaaagaactcaataaatacgctcagaaaaatacggagaaatcgccttctttggacggatctctcctctgctcgccatcgccgacggccagagttccacctgcctccggcgaaggcttctccaccacacccgctgcggccccgccgtcattggccgcgaacacctcgttgacgaccttctcgacgtcgagcacctcgccggcctcgtcctcgtcctccggcgggggcgggatgaacggcgggcgcgccacgcggaggatgcggtcccagtcgacgccgttgaagaacgggtgcgccttgatcccgcgcgcgccgatgcgcttctcggggtccttctccaggaggcgggcgatgaggtcgcgcagcggcgtcttctcgccgacgagctccggctgcttggagaggacgcggtagaacgtctccttcctgttcagcccccggaacggcgtgcggccgtagagcatctcgtagagcaccacgcccaggccccaccagtccacggagaagtcgtgcccgctgccggcgatgatctccggcgccacgtagtcctccgtgcccacgaacgagttcgacttcgctggcgaccgcacgccagcggcggtggaggacgacgcggtggtggccgtcgaggatgaggacgaggacgacgccgaggccgtgcgcgaggtggacgttggcgacggcgagtccgccgacgcggccggcttcgtggcgccgaccgaacagaacgggaagcacgaggccgcccccggttgcctcttgcccttcgcgcggttcggggacggtgaactgggcggaggctccggcatggaatcagcaatcgttgcgtcctgctcctccggtggcggcggcggcgtcgggagcctcgtggagaggtcgaagtcgacgagcatgatgtggccgctgtcctgtatcaggacgttctccggcttgaggtcgcggtacacgatgccgaggctgtgcagatagtcgagcgccagcaccaactccgcggcgtagaagctgcaatcagaagcaacaatcaacaacggcgaggtggttagttaacccattcgtgcgcgggtgggtggcggagaagcggcgatggccaaacgggggggatgcgagaagcgtaccggatgacggagtcggagaacatcttctcggtctggcggcgccggagcgagttgaggtctccgccgccgcagcggtcgatggcgaacccgacgacggcgtcggtggcgaggacgccgcggagggaggggagcagcgggtgtcgcagcgacatgagcacgtcccgctcgaaccagatccgccggtgcccgtcctcgccgccgctcccgttcttcttgtgccgcgccgcctcccgcgagaccgccttgagcgccatggaggcctcctcctcccccgccgccgcgggcacgacgtggaacacgacgcccttggcgccccggccgagcatggacaccgccctgaggtcccccaggctgagctcccgcggcaacgccggctccggaggcgagggcgccatcgccgccgccgccatggctggcgaaggaccgcgccgatcgatcgatcgatcgaccaaccgctcgtggacgggagagaggcagtgaggaggggaggagaggatccgagtggggtcggtgcgcgagggaaagcaggggaggggggagcgtgagatattgggggggattatttgcggtttgattcgaggggattttatgcggccgccggcttccttggaggcgaaggcgaaaggcgagaagcgcacggtcacggtgtggttgagaaaatttttgaatggccgcgttttacttggattttttagtggtggtgttacggttttgaggccattgagggcgctgtgtcgcgtggaccggaatcatcgtctggtgcgatgcgaagtagtacaggggtttgtgatgtttgcaatagaaaaggggaggaaattgggggaaatcgggtggatttcgtcaggtctacctgggactgcggttgggggcctcgtcttgcgcggattttgttggtctttgtacggcttctagaagggccgtttggtcagaggcacgactacagtgcccagaaacttttactgctccgtacattcttttcactctagaagggcggtcgtcgaacccgtttaaattagcttactgcacccaaaatttattcagcttgtaaatcgcacataaaatttaatttttaaagcttaaattggattcaaattttataaatcgcacttaagttgtttactttatttttcgatatttattttttaaattgctaagaacacatatataaaaattttgtttacgaattacatttagttgtttgttgaatagtcgttacggcttattatgagtataagcgaaacaatcattgtgttaaaagttgaagggtatcagtgatatccgattataacgattttgtaatggaggttagaattaactaagttactcctaagtgttcattcaaaagatggaagaatgtgttttctttttttttacaggtatagctataattgttttgtgtgggttgcacctgacgggtaattatagagctatccatgtttcaatgcaataaatcacatgaatgtatttgctctctttttttttggaaaactgaatgtgtttgcttcatatgtgctaggttttggcgcacagtttttactagtgacgttatagcatttcagcaatcagagccaaaaccgtttggttagcctctaattcgctagaactagagcacggagctaataataagaataccactaaacttttataacatgtaaaagaatggatcaacaataatgtaaaaaagaatctacaaagaagaaaaaataatgttatgaaaaaggaaaatctagaaaggagaaaggcgtcattcacaccgatttgttttgcgtgtgagcttgctcctctagactctagctaatcgtgagcacacgtgaagctacgtcaacatctttagtagcaataaactcgtactggtttgaagtgtgaacactcatttttctaactaaaatttccttatcattggttgaaaatccaaacaaggtttatttaaacttttcatgtgtttcttgcacaacaaactttgtacccaaactgaccaggcagcagacctgctgttcagtagaaaaataaaatgtgcttaagaatctttacgtcaacattattcgcgtcttccagttctccatagcctgcagcttcggtgccttccgggaaattctaacatccatggatagcaaagaatgagatcgattttcgttccttaagagacacattcttttgttttaggtatgctatataaaaagtttaaaaaaatagagaaaatataacatattacgtgtgcccaagcttttcatgtacgcccatgtgcataacaaataacaaatatcaaaaaaaaattataaaaaggtatactcgtgatattaatgataaggaatttctggtggggtgacgtggaaaataaacgaagggttcattggatttcttgggagaatctaattttaccaaaatacatgggaggcttaggtttcagggaccttcgcctttttaatcaagcgttgttgagcaggcaagcatggcgtcttattcagtatcatgacagtctgtgtgcaagaatcctgaaggctaaatattaccccaactgtgagcttattgatgcagtgtttccggcagatgtttccccaacttggaaagctgttgagcatggtttggagctgcttaagaaggggttaatatggaggattggagatgggaggaaagttctgatttggaaggatcagtggatacctcgccagtcgtccctcaaattgtcgccacagaatggaagatgcaggcttaggtgggttcatcagctgatcaatcaggatacaaactcttgggatgctgacctaattaaaaatgtttgctctccccttgatgtaaatgaaatcttaaagattaaattgccacatcgtggaatggaggacttcctggcttggcattttgagaagactggagtattcacagttcgcagtgcctaccatctagctttgcacaaccaatgaaggctaatgaactgggttcgtccagtttcgtcgacaaagtggagaacgcnnaaaantatgggcacacgcctttggacagctcctgttccacagaaggtaaaaatttctgctcggagattagctagagaatgccttgccactatggagaaccgaaaaaagcgaaaactggaattgactcaacttgccgtatttgtggccttggcggtgaggatggttttcatgctgtcatatcctgtactaaagccgcggcactgcgatcgctgatccgggaggtttgggagctccctgacgagcgttttctgattcggtcaggaccggactggctgctcattatcctggactcaataaacgctgaaagcagggcaaaatttcttttactcttatggagagcctggtttctcaggaatgatagtgtgcattgttctgggaaagcttcagtactagggagtttgttattcctccagagcctttgggagtccctgtttatgagtacaagccaagggaaggtagacgataaaggcaaaaaacctgtgatgcagtctcggctcagttctccggacagccatgaaaggaatcacactacgactatgggatggacccccccccccccccccggccgatgggctgggttaaagtaaatgtggatggctccttcattcagagttcggaacctgctagtgctggatttgtcattcgtgaccacactggctcagtactgctcacttcctggagaattatcagccattgtggatcagcggaagaggcggaagcgactgcatgttgggaaggggtgaatctcgcagctgagtgggtgaaaaaaccgttaattcttgagacagactgtgccaacttggtatctatgcttacgagctctggatttgatcgagcgcagctctgccatgtcctccggagtattaagttattactccaagctttgcctgattttcgtgtgcagaggattagaagggaatgcaatagagtagcccatgatttagctaaatttgccatgcgtacgaaccattcagctgtttggcgtatgcaggctccttcttgtgtttttggggctctggcaaatgattctaatcacattgatgagtaatcaataaagcgttcccttcccccgcaaaaacacacacacacacacacacacacacacatatatatagtcttaactttcaactcactatattttaacggtaagaaaataattttttttgacaattttaagagtatatacctattgaaatttttttttgttctatatatatgataaatttgaagataaaaccttacatatagatgtaatactactaaaagtactataacttttcatataatttttatagaatttttagtgatatttgttagttagcatgtacggtgtgtgcacgtgaaggtttatgtgcatataataaattctaaaaaatattaagatagattaatatatgatatatcaccaacaacatataagtttgaattcgacctatacaattagagaaagcaacaaatttaaccataaattatgtgttatatttatagtcaaattcattatttttatttctgtttgtacaagttaaatttgaaattgtattttgtaaagtgatatatcacatattaatatatcatactaatcttttaaatattttttagatgatacgtaaaaacgggcgttccctttgagggactaataaagttttccagcaaagaactccattaagttctgaacagtgctcccagaaaaatgggggagaaaaatgcacatgtcccataagttcagtttcttgttggctagctgcaaaaatttgttgatatatttatgatctgataggaacagcttgaccgaaccaatgatgcggattaagcctcactaacccacaatttagactactccctccgtttcacaatgtaagtcattttagtatttcccacattaatattgatgttaatgaatctaaacatatatatctatatagattcattaacattaatatgaatatgggtaatgctagaaagtcttacattatgaaacggaagaagtagaagaaacaggtgccaaattggccacgcttgttgcattgggtgactggttatactgtggaatgtggatacagttcgaagttggatgtcatacgtcccagcattactacggcctttgtgtactactcatttttcttataaggttaattggttagctcaattcgtcactgttggtaactaaagcacgatgccaatataatcaacaatgcgttttattctattgagaacactcataatttctaatttcttttgacgggtcccgtacgtaactttgtgtaattcttttattctttttctattaatatatgaggcaaagcttttaccgtcctttcaaaaaaataatttttatttctacctagttaggatacacatcgttaaatccactcacatccactgatccacaagttttgcaatagtaaaagaagtgtaaaaggactatcaattcgtaaattagattaccacccatgacggaaagaaaaatgtaatttgtaccccttcatattttaattttaatgtatgacaccgttgactttttccaacatttgaccactcgtcttattcaaaaattttatgtaaatataaaaatacttatgtcatgcttaaagaacatttgatgataaatcaagtcacaataaaataaattataattacataaattttttgaataagacgaaaggtcaaacgtttgtcaaaaagtcaacggcgtaatacattaaaatacgaaatacggagggagtactgtttataataggtgaatgaattgaaacaaggggtt

SEQ ID NO: 63949 - DNA, 9214 bp, Oryza sativa
cacttgaaaaaattagtaaaaaaaaagcatataaacaagaaagagcgaattatactatggccttgtttggatcctccgggctattaaatagcccccaagaatcttgctatttaggattattaaacgtatattaccgataaaaccgattccataacccctagactattttgcgagacgaatctaataatctatattaatccataattagtggctgattactgtagcatcacggtagcaaatcatagattaatatacctcgttagattcatctcacaaaatagcttaggggttatggaatgagttttcttagtaatctacgtttaatactcttaaatagcaagattctaaagagctatttaatagtccggaggatctaaacaggaccatatatactgggtgaaggtgaattcggacgcggggtttgacaagctcacgtcaacagggagcagtggggtggtgatacgagaccattctggtgttgtacaggcagctgccgctcgatggatggaacgtgtcccggatgccctgactgctgaagctttggcggcgaaggaagctctagagctagcgatggaagtcggctgtgatcgtgtgatacttgaagtcaactgtgctgagttgaaggttattctggaggacagtgaaggttttaaatcatgcattgccgggatctgtttcgacatcacagagcttgctaggagttttgttgatttcaaagtagaatgggtgcctagggaggctaactcagtggctcactgttgttcgagccttgtgtcttctgctgagcgctccatgttctggtttgatgatatcccggattggctagagggattagtttctattgattgtactcctatgaacaattaatgaaagctctgtgtttggtctcaaaaaaaagaattatactatatacctttataaatttctttttcgatttcacaaagacacgtactactacacaagtgcattaaccccactgaaactcacacaaatgctcccctaacccatctttaaagaaacgagaccaatgataattttttttgtctcactgaaatctacaaactctttctcagaataaattcatttttcatccattctacataaatcaataaaaaaattagtagagtaccctcaattttaccaaattctaatataattatttcctactttatctagtttttgtgtgtttatctcctaattttaaaaacttcaataaaacgattgtttaaaattcaaattattttagaacaaataagagagtgtaaatataatattattttagaacgaatgaagtaatcctttgagagagaaaaaataataagagagaaagacttttgcgtcggaagcactacgtggtgctcgttttacgtcagagatgagggcaagattacgcatatatatactgtatttcgttgtgggttggtgactctgttcgatggagactaaaaaagttcttttttttttcttgttatgcatgttgtcatgttgaggagtagaaataactaatcttttatagatagcgcgatgagatataattcaagctaaaaaaaatactactccctccatcccaatatattaaaacctaggatcggatgagacatttcctagtactacaaatctggacagacatgttttatccggtcctaggttttaatatattgggacggagggagtatcagtttgatggtccaaataggtcagcggccactggcattatccctctttattttaaattcactgaaagacatgcgtgccctgtacaatagcagtgcgtgatcatcagatggtccaaaagcagttcagtgcttctcgtctgccagaatatccgatctgagtgtgtgattgcatttttaattgtcctcgtaagcaaattttaaaaaggggcatattctgacgagaaaatttaaaaagtgcacaaagttggtttgcttcttatttaactcatgtacttgggttcgtccctcggcaacaagagggaaatcatggattcctcatgatcaaaaaaatattcacgttcttcatttctatcatgtggctggataacaagatcaagatggcctttacaatattgagcatctcacttgcttttctgctcggtcaaattattccatggagcactgatggatcgtgtgcctaacaaaaataaattgtaaaatagaaaaggtaattacaagtggaaaagtgccaacttttgttactagatcgatcggcaagatattgtacacagtacactcctccggaagtggcgatctaaagtttcgctttgccctatcagtgtacgctcctttccttgcatttctttttcgtattgcgcttgtgttgtgcccgcaaattgaacagtggccattctatgggtgtgtttagttccacgctaaaattggaagtttaaagaaaaaagttgaaagtttatgtgtgcagaaaaattttgatgtgatggaaaagttgaaagtttaaagaaaaagttgggaactaaaccagacctatgactcaacagttgacgcactgatcgcacattggcaatagctttatctcccccacaaaccaatgagattctttacaaaggaggtacaaatcacttgaaagccttggagatatttttctctcttttttttagtgatagaagatgtataaggtcatgtccaatgcatcaccatgaagagtgatatcaagcctcccgattggagcgtggtctcacggtaccgaacgtgacctatagaggttatagttttctccacgcgccttagctcgaagacatggttggggtcacacattgggggagtccaaatccctgcgatgcgattggtcacgagaagaaagagaaatggtgaaggagaggagaggagggcctaccaggcagggactaagtcaattgccaacgagctcgttcgcattgacaagatcagatctaacgctagcgagctcttccatgccgacgagttcctccgctctgcgcgcttgtccatacttgagccactgtggccaccggactcgtcgctgtcctcaagctacggtagccgcggggctcatgatcagatctagcgaactcgtgaccatatccgccaaactcgactagagaaaggagaggcggcgctggattcggcaaactcggccaaatctgtcgccaacacctagagagaaggagaaaggagatgggggatatgttggaggtggaaaaggagagcagtgtggcggtggaagaggtgagcgttggacagagagctgaggaggagaggggtggaggtgggcaatggagtggcaaggtgatggatgcgttgagcaaaataaccagtgggcagagaaatggtgaaaaaaaggggaaaataaagtgggaggggctgacagtgggaccgtatggaggctaggggtacatatatgtagtactttttttcgttgttgtaggttctaaattataaaagttctagttagttcaatagtaaaaaatcacaaggaccgatacacaaatacttatgggctgaaacataaaatacaattgattgtggtctccattgtggctagagtggtttttgtgtgatcttatcctatgtgacacgttgacaccatatatcagtggttttcattgtacatgtcttaattgtactacgacaatacttatatccatctttttcttgacttaaaataatcttttggctggggaggagaagatgatcagctcgtgacaaatgctagacatttacaaaagtagagagggtggaaaaggaggagacaagagacgtctgcattcttgactggctatcctatacttacatcggaaaccaattgtggagatggaaagcgacccttgatgctcaagttggatgcagggccaactcagcctctctatgaatgacaaggacttgtcaatggccatcaggcgcatgatgatcccgtttttgtacatgcaggattgtactcaagtaaagccgtggtttgttctgaacttttttttttcaaacttctatcatttttatcacatcaaaactttcctacacatataaatttttaacttttccattacatcgttccaatttcattcaaacttctaattttagcgtaaactaaacacacccaaagttaaacatggtcatgtcaaccttgaaatgaacgaaaactgaaatggcattttgcatcttgcagtgtggaatttctgagtagaaatatgaggcatgggtggtcttgaaggcaccatatgggtgagcaggtcaacttggccaaagtagccaggccatggcaggtttcctccctagcatatcaccgcatcccgtcagcagggcagcgatctgcactgcccaaacgtagcggtggccggtgagttcacgttgtcatctccaaagtcacccataaactgcaacctgccctgcccccatctcgcaggaggaaaaaaggcgacggcgaaagagactccaccgaaatccgcacactggtcaccaccaaaccaccactgctacaactaactgtgtggcccgcgccccgggtgacaaaggccaaaccgccaaaccgccaaaccgcaccgcaggatcgatctcacgctgagacgctgagttgcaaccccacgcgacgcgcgcgggcgattcggctaaccgctaaccacaccgaccgagcggtgtgcccgtgtgcgcgcgcctcaaccgattcccgagccagagagcgaacgcacgggagggagagtgaggtgaggcgaggcgaggcgggcgggtgtggctcacggttccattgattagccgctcgcgcggcttcgactttggaggcgttgattacacgattgatcggtggagagcaacagggagctacgtgtactaactccttttccagccgccgaggtcgacgatgattgagcgggttcggggagccatgtttggctcgttggttggttggcggcgtcggcgatcgcagcgggtggtcctctcctcgtggattttggcttgacgacgtcacgacgatcgataatcggattgactcttggaaagcgcaagcgcgcacaggggcgcgtacgttccgtcgtgccgtccccctctcgcgtggcagcgtccgtcgctgcggatcgctacgcgtcactgtggattctggcacgcgagcagcgtgactgcgtgagcggagtgatatatcgatcgacgcccttcggagtacaccattgagatttttgatggaaatggcccgcttggtcggaggaatcaggggtgtatggaccaccgacccctattccactttgagttgaaacaacttgtttggtttcatgagagaggacatgctatatcccgttctctaatatagtaacttgtcatctctgtgctaataagaaattagggatacttcctgcctcgctaaatataagaatgtctactatttaagccaaagataaattatttcgatttagttatcaatactagttattttggtggaggtgtctgtagtgacttcgttaatcttaatttatattgatccattatttcgaatgcgctcatagatatatgtttataagagtgagcgtgcacgtgttgtgagcgtctatgtttatactatatctgtacaaagaaataggttaagagggaagatttcttttcaatcacctcattggttgaatttttaaattgattagattctcctaaatacctgattggttgaaaaatacttagatttttttgtcttgtaatccgggataaatttggatcttataaatgattatatttagaaatggaagaagcacatatgaaatcaagtcaataaatcttaggatggtcatatcatgaaccatctacgcgatttcaatatgatactaaaaaactaactatagacaagcaggggtgagacttgatggcaattggggcttgccggcttggggctcgaggactaaagttaggtccttaaactcattgaactcctaccagcatgtgataaatatttttgagatataaagcatctctagacgctggcccgtttccggctccacacatgtatacatgctataagaggtaacagcaggcaaatgggggagacatgctgtgtgtactccctcggttttattttaattgacgttttggacaataacacggtctacaagatacatcttttaccttatttttctattataatatatataataaataaatgcatgtttacttttattatagtactttaaaagacaaatatatatatgttgttctagttcctttaaactaaatatttttaaagttattgatggtttaagttataaaagtttgatctcaatcttatccaaaatgttaattaatatggagccggagggagtacttagttgcacactgtagctggagcgtacgtccagctacagatcatcaatgcccaagtgtcgttccaaactgttcctgattccgatccgctaagtcctggtgcaccgctgtcgttggaacgatgcatttagtgcctaacaacacgtccatgttccaggtaagtagcagcatcaagcaacgggagacgaaagctaatctgtgtctggccacgatgtcgtcctagctctatgactgaccaccacttctatcaagtttgaaccaattgtgtgcgtgcgtgtttgggtgaagaggattaatgcgtgtgtccggattagcttttatggttagcaccagatggtattcatttagcaacctaaccgacagtattgtggccaagctggtagctacatggaaagcaagcagtaccatgaatcagcactgtgtatatgtggcactaaggggatgtttaattgatgcctaaccttgccataactaagtttaggctagttgtggtatggtggcacaagtgtgacttagaaatagttgaccacaagtgtggtatacttagttctaaatttgagagcataacatatgggtctcaaagttaagaaagtgtggcataacacaattacggcagcaaaccaaacacatgcgtaagaaactgtggaatcactaaagtgtggcgtggcaaagtgtggcaaccaaccaaacaaccatttactctcgcaactgtctcagtgtgcacgaatcattcaaataggataagcgagaaacgctaaaggtgagtgtttttttttttcgcgatagatgatgaatgaaactgagtttatatgacaattatttgatcgtgcaaacaaatgaattaaatattataaagttgataatttgatctataaaaatgttttacaaaaatcgtgccgttggtatcttacataattcgtgttggtgcgcgtgataagatccaaacagatcgccacaccataaaccagttggactctgtgattaccacaacaatcatgaactattaacagaacgaatatccgaactttttcgtaaggatcggaaagatgagcttagaagggcaagggagagaatggatattgttctggaaggacaaaaaaaaaaagtactactcacaaggcattgccaaggtaggcgattgtcgattggcaattagcaggaaaattggaggatttaaagggttaggcaatggcatcatgtggaggtaacaaataaatgcacataagcttgaataaacaggggcacacggttggaaaatcctaataagtttgcgcacaagccatatattaatcaacaaacatcatcagactgtatacctttacatctctgaatgaatgcagtattggataagaaaatgctggacagtggaaaaaaaatgtcgtaaccatcttagttgatctcggtgttaaatattcacatttaaattttcacctgtcaatcagtcaatctagctaacacgtgtgaatatgtacatcatgttaacttgcacaaattaaaaaatggatatgaacaagcaggaatggctgcagaataaagaatgagaacaaaccgctactatcagggtgtaggcctgcactagatgatcaatgtacacgcacaaggcattgccaaggtaggtaggtagatagaaataagatgttgctttgctgtatatgaagtcgtcagatttcttttgatccatgcgtccggtgcctgcctagccagtctaggactgtcagtaagctcagcggaatgtagagctgtcgtcacagagatctcatgtaaacagacataactgctttccatagaaatatgctggcagcatgtgaaaattttgctccttcagtcttcagtgaagctgcattgctcctaaagtggcattcatatacattctctctatttgctttcagctgtactgagaacaactctatcctggactcctggtcagaccaaacgttctaccggtgaatcaggacaacttgctgccgtttgcgcttccagaactctctgcattgcatagtgacacctaaaatttaaaaagaacagtacattagaatagctctaggtttttaggataaatcaatgcaaatgtaacggcaactgagtgagcatgcaactttcttgtgcgcagataaaaggcgagtttgccaaaagccaactagcaaaggcataccattgaattgtcaacagctgttgaaaataaatggttactaccgcactccaaaggaatcatttttcaaaaaaggttactaactcaaatcaacgtgacattacaagaaaaccccagtctagaaatggagttcctattcagagtatgaatacttcacacgagaaatcaacaaaattatatttgacatgacagacaaacacgcatacttgactgagatgcacattaaacataagaacacaatagggactaaccatcagttcttcattcattctttgtgtgttgttttgttgtcatatggtccaacaaattcttagcaacatagccatggaaaaggtactagcaacagtacattggctactatacaaggtactccctccgtcccaaaatataacaacttttagcactcggaatttgtcccaaaatataacaacttctctatcaacattctctacccaaacaatcacaacccttccaccattcacttttcccatctacttctacttctcaatcaatcataacatctccccatttaattctacctatttttttaataactgtgtccaactctaaaactttttatattatgggatggaggtagtacctataaaatatgctgtattatgtgtgcatttcttataattaaatactgttcgaatcttacctccatggtaggtgatccgtaaacatcgaaggagtaacggcaagatcagtgaagttctccctttttgcaaaaaaagctttatatggtggttcacttccctgcaagctccagcatttccaaagagggaagaggcttcttctt

SEQ ID NO: 63950 - DNA, 724 bp, Oryza sativa
aaatctacaatagtcccagtttcattaaaaaccgggactaaaaacgatttttagtcccggtttataagaacaacaggactagatgatttttagtcccggttggttccatgtcagaccgtgtcaggcgcctaggatctttagtcctggtttgtaacaccaaccgggactaaagatctaactttagtcccgattggtgttactaaccgggaataaaaatcaacacgtactatataatccctattacttatcctcttctctcgttcacgcaacaaactctgtctctttctttctttcttcctctctaactcctgccttatctctttcttccttcctctcttttttttttgatcgaacgagtgttaacagtgaaatttggtaagcccggagtagtcatcggcttagagtcagcatcggcttggaagtcctgagattagccgatgagagttgtcaagtcgtcagttgtcggattcttgctatattcggttaaggaaattgatctactaaaggaagcttatccagaagagaccgagttcaaagagaatgcggcatggtaagttatctattaattaggaatagtttgttagtttccttttatctctaggaaagtgtgtttagtgtcttataaggactttatctttttcttttatctttagaaaagtttctttcttgtccgacaaggacttgtatcaacccatgggtataaatatgtacacccggggtctat

SEQ ID NO: 63951 - DNA, 732 bp, Oryza sativa
attccctgtcgaacgaaacaggcgcgtgtgggccgcggcccatacatatcatcgcgtcgcgcctcgagtttgaactcgcgcgcgtcgtacgtacgtgtacgtggcatcgtttgtctcggctctctcaaagcatctcacagcctctccaaatctaactctccaaacacctatatagccaactctccatttgatttggctagtcaaactagttgttcactccaacagcctctctatctaccctctctactttgactctatgacaccgggacccatatgtcagcatctcccttcttctttctccccttccttcccctttttctctttttctcgcgttggctggaagcaggcggcgccgacaagctgggagcgagcggacggcggccgcggccgcggcgcgcgggggccaacggccgcggcgagcgggggacggtgggccacgccgcgcgggggacggcggccgcgccgagcagagggcgggtggccacagcgagcggaggccggtggccgcaccgtgggcggggaacggcagcggtggcgcgtgggggccagcgaccgcgccgagcgggggacggcggccgcggctagcggaggcggcggccgcgccgcacgggggccggcggcggcggcgagcacctcctcctcgtgctccttccgtgcggttgtcgtgtggggaactggggatggtggagatgggttgtgtggggcccaccattggctagctaaatagagtgg

SEQ ID NO: 63952 - DNA, 1868 bp, Oryza sativa
atacttgcccaccaaaatctttccttgagatcctggtacatcttagtactaccagggtgaatggagtataaagtatcatgagcttctttcataactgcatcttttagatctttgttgtcggggacacagattctctcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctaaaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcgcaatacacttgaaaacccttctttggatcaggcaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccgataatatcctgcgaggcctaggaaactgcgaatctctgaaactgtctttggttgcttccaattggttacggattccacgttactaggatcgacggcaactcctccggctgagatgacgtgaccaaggaatttcacttcagacaaccaaaattcacacttgctaaacttagcatacagttgatgttctcgtagcttctctaatgcaagacgaagatgttcctcatgctcttctttggttcgaaggtagataagaatatcatcaataaagaccaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatgaatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctggtgagagttacttttttgttggcacagtctatcacacctttatgtctggctaaccagtccat

SEQ ID NO: 63953 - DNA, 2805 bp, Oryza sativa
tgtgctggagctgcaacaggacgtggagcttgattacggatgttgttgccagcattgttgttgaagaactgacgctgcggacgaacaacagacgaagaacctccctgtggcatgggctggggtcctaaagtaagacgcggcttctgaatatttccctgttgtgtcttgaattgagcaatccgacgttttttttgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacttcttccggagcataacgagcaagacgattgaactcgtgcagatactccgtaacagagcgagatccctgggtaagcgacctgaactccttcttcttgagagacactactcctgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttctgtggaggtgcatggttatttccttggttttgctgattctgaaattgctgcatcatcatgttcataagctgtgtctgttgagcaagaacttgagcaagagtgggattctctccattgttgttgttattggggttgttgggaccattcccattgctgcgagtgttcaccatctggcatggacagggcacaagaagagaaaccggggaaactacttaggacagagaattactttaacttttattgatcttaactgagtttcattattacaaactaaagattctcacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcgattgaaggctcgtctttatcatcttgagttgctacccactcaatcttggaattgttgcgcttggattcttcttctccatcactacttatgatgatgaccggaggatccgcttgagctggggcaactttttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagcggctaacacagtctccgcatgactttcatccatagcccacaacatctcaaccaaatgcttcgtggtagcatcattctcaattccttcagtctcaaggtaactgccacggtcacttccctggggttggcgaggatggtagcgatactcagtgtcggccaattgatcactgtagcgatcacggagctctcctatggcgatccttgccacttcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaaggtaagtaaataaagtaaaccaagctttgcgagataagttaaaacagttggaaacgaggtcacaaattttgtaattttgaataactggtttcaaaagaaatgaaagaaaattataaaatcaacatgctaaatttattttattgcagcaagattaaataaaacagtattgtaaaacttttgctggtaaatgagccattagtacagtaatagatgtacagtactaataacactggaataaatttttaatgagaaccattaaaagagattatgaagtgcatgtgccattagtttggtttaattaaaagagaaagggaggagaacagttctacttttccaatatttttagagggcttctatggataaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcaca

SEQ ID NO: 63954 - DNA, 5155 bp, Oryza sativa
ttcagggtacccaatcggatcatcactgataacggcacccaattcacaggcggagtattcaaagatttttgcgaggacttcggcatcaaaatttgttatgcctctgtagcgcaccccatgagcaatggacaggttgaacgtgccaatggcatggtacttcaaggaataaaagcgcgagttttcgaccgattgtgtccttatgccggcaagtgggtagaacagctgccatctgtactttggtccctacgcaccactcgcagtcgagctaccggctagtcgccttttttcctagtttatggagcggaagcaatgttgccgagtgaggtggaatttgaatctctacgatttcgcaacttcagcgaggagcgctatggagaagaccgagttgatgatatcaaccgactggaagaagcccgcgaagcagccttaattcaatcggctcggtacttgcaagggttgcgtcgttatcacaatcgcaatgttcgctcacgagcttttttagtcggcgacctggttctgagaaaaattcaaactacacgggatcggcacaaattatctcccttgtgggaaggaccgttagttatatctgaagtcactcggccaggttcttatcgactcaaacgtgaggacagtactcatatcgacaactcttggaatattgaacatcttcgtcgtttttatgcttaggcattacttttgtattttcctctttgacttctaacatcaagcctttccttgagttatcagttgggggctactataataataacggagtgtgatttttatcaattcaatttgcttactcgatttatcattgccttgtttgatttttttggcttagtcaatgaggactgaaagttttttaataacttttgcgggttttaggctcaacaaggtttgataaaaacttttaagaaatcaggagctaagtttggaatatcaagcacagcataaattcatcagtattatacaaattgtgcctccatcatcatcagaatcactgctacaatataacatcaatcggtgtcagttttttcatcatcggagttattagaaccagtcggaatttctatccaaaattctaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcatgaaatattagtgagtcattagttatcccgaatgtgtgctaatgtttctaagcagggctaagcaattatatctaatatctagttgaaccaatataaataaagctcaactagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaaagtgtaaatctcaattttagaaaaatttagagacttgaaccaactaaatcggagctaagatgaattagttatgaatttttaaagattaaatcggattaaaacacttatatcggttaaaattgaattatgacgcaataatgaattatttttgaaaaggaaaagaaggattattgcgtcagcgggctagggtttggtggaccgggcgcacgggcggcggttcacacgaacggacggccgagatcgaaccaatccaaaacggacggccgagatcgaatggtccacgaccggctcacggcggacgaccccgatgacgtcagcggtgacgtcaccgacagcggcggcggctcggcggaacggacggctcgggcggcgcacgcttgccggcgaacggcggcaccaggacgcaaacggagggcaccagcacgtagaggacgacgcggcgaacacaccggtgaccaaaacggcggcggaagaacaacggacgacgacgacgacgaggaggaaacggcggaaaccttcgggttgtcgacggcgacgaagctccggtgatctccggcaacggcgaaggggcggacgagaacggcgacgcgacggcgaccacgacgacggtcttcccgagcgacggtgacggctgaagcgacggcggcgcacggctggagcggcggcggcgacggcaaagctagggcacacggcgctagagctcttccggcgacgagaggcgaaggcgagggtggcggcgggtagaggagacaccgagggtccttttaaaggggctcggaggcggcggcaaaggcccacgacggcggcaacggcgaaggaaactcgcggcttgaaggaaagaggtcgatccgaatcgaactcgattccacgaacttccaaaccgatttagccgaagattccaaaggagaaaaaggtagaggagatcccggagattgtttcccctcttttgattcgaccagagaaggaaaggaatggccggatttggaaggaaacggcggcggcgcgaaactagggtttcggcggcggcggccgaaggaggacgaaggtcctgacaggcgggaccctcctgtcagcgacagcgagagggcgcgcgcgcggcggactgggccgaactgggccgaggagagagagaggggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctgggcccattttatattggaatttattaattaaaactagatcttctcttcaagacttttaaaattatttctaaaaattccatttaaacaacaatttataaattttaaattttcagggtgtgacaaacctaccccccttaaacagaatctcgtccttgagattcggaagaactggcgaacaggtgcgaatgagctgacttcaattcatcttctcgttcccaagttgattcttcttccgagtgattactccattgaactttgcagaaacggataactcgattcctggttcttctctcatttgtttccaggatacggattggtttctcaacataagtcaaatcctcttggacttctatcttctcaatattagcttcttcggtaggtacccttaaacattttttcaattgtgacacatggaacacattatggactcctgccaaagattgaggtaattctaactgataagcaacctctcctcttctactgacaatcttataaggtcccacaaaacgcggtgccaattttcctttggtgtgaaaacgatgaactcctcgaagaggcgtgacacgaagatacacatagtctccttcttcaaaactcaaatctctacggcgattgtcggcataactcttatgtcgagactgagccactcgcaatctttcttgaatgacctttaccttttcttctgctttccttaggatatccgtcccgaaaacctgacgttctcccgtttgatcccacaaaagcggagtgcggcacttccgaccatacagtgcttcgtaaggagccatctgtaaactagcttgataactggtgttgtatgaaaattctgcataaggtagattcttatcccaacttccaccgaaatctaaagcacaagctctcaacatgtcttccaaaatctgattcaccctttcggtttgtccgtctgtctgtggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccggaataggttgtctttaccggaataaaatgagccactttggtaagtctgtcgactatcacccaaatagagtcatggcctgatgacgttctgggtaaaccagtaataaaatccatacatatttcttcccatttccat
